United States Patent 9,834,782 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 3

SEQ ID NO: 4058 - DNA, 1133 bp, Oryza sativa
ctccgcaatcatcagctgtggcctcgaactcgtgggcaggtaggcccggtccacgaaccaccgcccgcgtcacggatctcgaggcgccgacgaacggagaagattcactcgggtccatacaccgggtgcacgcgccccccgccgcacgcacggctcacttgaagagaggagaacccggcgggtgggtagcagcggctgcttcttcttcctcattccaatctccccccaatttcggttggattcgtggaggcggattggggatttggatttggattggagagaggggggagatggaccaggtgctgaacaaggtggggagctactggttcagcaagagggcgagcaaggagatcgactccatcggcgacgacatcagctcaatctctacaagcattggaacaggagctaaatggatggtgaacaagatcaaagggaagatgcagaaagcattgccagaccttctcaaggaatatgacatgccggcgggcctcttcccaagggatgctactaactatgagttcaatgaggagacaaagaagctaaccgtgtacattccttcagcttgtgatgtcgggtacaaggattcgtctgttctgcgattctttacctgtgtgactggctacctggagaagggaaagctctctgatatcgaaggcttgaagacgaaagtgcttgtttggaccaaggtgactgccatcaagactgagggatcgaaggttcatttcactgctggtgtgaagaagacccgcagccgtgacgcatatgaggtagtcagagatggtatccccatagacaagttctgagcttgtacctgccatgaaaatgtgatgtaattaattagttgacgccttctacaacaaatatcaattgtcatatctcgtgttatgacctatttaactgaactgtattgccataatattgattgtccggcccaagagtgtttctcagcaccttaaaaatttggtgcttatttggttgtgattgtgaatcttgtagacggttttatgtttacttagtttaaggccatgtttggcaccacttcaagtctcagattcatgctggatttgaagtttatatgtaaaattatagtggtttaaagctttttttaatctaaaatgggaacaaaatgattc

SEQ ID NO: 4059 - DNA, 853 bp, Cynodon dactylon
aagcgtgcggcgtgacccggccgcaaaggcttccgagtccactctccagtctccacccgaccctgacgaggcgatgattgctgagcgccgcggcattttccgcagttaattcctccgtctcgctctcgccccgtcccaaatccgattcggccgccgcgaatccaggtgagggttccgggttcgagagggcaagggggagatggatcaggtgctgaacaaggtggggagctactggttcagcaagcgggccaacaaggagatcgattccatcggcgacgatatcagctcgatctcaagcagcatcggagagagtgccaaatggatggtgaacaaactcaaagggaagatgcagaaggcgctgccagaactccttaaggaatacgatctgccagcaggtctcttccctcgggatgcaaccaactatgagttcaacgaagagacaaagaagctgacagtgtacatcccatcctcctgtgatgttgggtacaaggactcatcagttcttcggttcttcacctgtgtgactggctaccttgagaagggaaagttttctgatatcgagggcttgaagaccaaagtactggtttggaccaaagtgactgctatcaagactgagggctcgaaggtccatttcactgccggcatgaagaaaacccggagccgtgatgcctatgaagttgtcagagacggtatcaccatagataagttctagagtatacctggccagtgcataagagacataatgtaattattcagatgatgctttgccccctccatcggtataccaaaaattaaaatgtagtgtgatacttctactgattatcaatgtagtttcctatgagttggatgttaa

SEQ ID NO: 4060 - DNA, 961 bp, Eragrostis curvula
  misc_feature (159)..(159): n is a, c, g, or t
  misc_feature (396)..(396): n is a, c, g, or t
  misc_feature (635)..(635): n is a, c, g, or t
  misc_feature (686)..(686): n is a, c, g, or t
  misc_feature (694)..(694): n is a, c, g, or t
  misc_feature (723)..(723): n is a, c, g, or t
  misc_feature (746)..(746): n is a, c, g, or t
  misc_feature (751)..(751): n is a, c, g, or t
taagcggaatgatgtgagcgcagcggcattcgcagtaattcctccgtctcactccctctctccctccatccccaatccggttcgagcgccgcgcgaatcgaatcgaggtgagggtttcggattcggtgggagaagaagagggagaagggacagatggancaggtgctgaacaaggtggggagctactggttcagcaagcgggccaacaaggagatcgactccatcggcaacgacatcagctcgatctcaacgagcatcggagatggagccaaatggatggtgaacaagctcaaagggaagatgcagaaagcactgccagaactcctcaaggaatatgacatgccagcaggtctcttcccacgggatgcaactaactacgagttcaacgaagagacnaagaagctaacagtgtacatcccatcagcctgtgatgtcgggtacaaggactcgtcagttctgcggttcttcacctgtgtgactggctaccttgagaagggaaagttttctgatatcgagggcatgaagaccaaagtactggtttggaccaaagtgaccgccatcaagactgagggctccaaggtccatttcactgccggcgtgaagaagactcggagccgagacgcctatgaagttgntagagatggtatcaccatagataagttctagagtatactttgcatgagagncgtaatgnaattattcagatgctgctttggcccctcngtacaccaacagtctgaaatctngtgtnatacttctgccaattcaatcaatgtagtataacgtttctcatcaaaacgtggttggtttgacatgattaaaaaaaaaaaaaaaaaaaaaaaaaaaaagtactctgggttaataccactgtttaatcaatttcccgcggcccccatgggggccggaagcatgcaacgtcgggcccattcgcccaaaagggagtcaattaatctgcggggcc

SEQ ID NO: 4061 - DNA, 897 bp, Secale cereale
tcagcttagataaagtccggtaggttgcgggcgagcgctctcaactccatcgcttcctccgattccggcgatccaaaccgaatccggccgattcgaggcggactgggggttcggattcggggcgggggagaggagaggagggggagatggaccaggtgctgaacaaggtggggagctactggttcagcaagagggccagcaaggagatcgactccatcggcgacgacctcaactcggtctcttcgagtattggcggaggagctaaatggatggtgaacaagatcaaagggaagctgcagaaagcattaccagatcttctcaaggaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgactggctaccttgagaagggcaagctttccgacatagagggcatgaagaccaaggtgcttgtatggaccaaggtgacctccatcaagaccgagggttcaaaggtccatttcactgctggcatgaagaagacgcgcagccgcgatgcgtatgaggttgtcagagatggcatcatcatagacaagttctagagcatacctgtacctggcctgacaggtgcgatgtaattacttagatatgctttctctgctagcttacattgaaatctgttgtgctatcggatcggcctattaaccaactgtgttgctgaaaactccaatccatgactttttctatatcttgacaatttgtgcttgttttgctgtcatcctgattcttccaccagacctgaaagggcgaccagaccagggcgccatgttgtatccagtt

SEQ ID NO: 4062 - DNA, 779 bp, Lolium multiflorum
gtccgggacgggagatggaccaggtgctgaacaaggtggggagctactggttcagcaagagggccagcaaggagatcgactccatcggcgacgacctcaactcggtctcttccagcattggtgggggagctaaatggatggtgaacaaaatcaaagggaagctgcagaaagcattaccagatcttctcaaagaatatgacatgccagcaggcctcttcccaagggatacaactaattatgagttcaatgaagagacaaagaagctgacagtgtacatcccatcagcttgcgacgtcgggtacaaggactcatcagtggtgcggttcttcacttgtgtgactggctaccttgagaagggaaagctttctgatatcgagggcatgaagaccaaggtgcttgtatggaccaaggtgacctccatcaagaccgagggctcaaaggtccatttcactgctggcatgaagaagacccgcagccgcgatgcatatgaggtcgtcagagatggtatcatcatagacaagttctagagcacacctggcctgacggatgagcatacctggcctgacagatgcaatgtaattacttagatgatgctttccctcctagcttatgtcaaaatctagtgtgctatcggcctataatcaatggtggtgggatacactttgatctcgtgactgttcctgtatcttaaaatattggcgattattctctgtgattctgattcttctatcaaaccaaaggggtcgtcaggccacaatatatgagaccggttttaaaac

SEQ ID NO: 4063 - DNA, 697 bp, Avena sativa
cggaggtcgggaggggagatggaccaggtgctgaacaaggtggggagctactggttcggcaagagggccagcaaggagatcgactccatcggcgacgacctcagctcggtctcttccagcatcggcgggggagctaaatggatggtgaacaaaatcaaagggaagctgcagaaagcattaccagatcttcttaaagaatatgacatgccggcaggcctcttcccaagggatacaactaattatgagttcaatgaggagacaaagaagctgacagtatacatcccttcagcttgtgacgtcgggtacaaggactcatcagtggtgcggttcttcacttgtgtgactggctatcttgagaagggaaagctttctgatattgagggcatgaagacaaaggtgcttgtatggaccaaggtgacctccatcaagaccgagggctcaaaggtccacttcactgccggcatgaagaagacccgcagccgcgatgcatatgaggtcgtcagagatggtatcatcatagacaagttctagagcatacttggccagacagacgagcatacctggcctgacagatgcgatgtaattacttagatgatgctctctctgctagcttatatcggaatctattgtgctatcagcctgtaatcaatggtggttgcaaaacctttgatgtcatgactgtttctgtatcttaaaa

SEQ ID NO: 4064 - DNA, 801 bp, Pseudoroegneria spicata
aaagtccggtaggtcgcggcagcgctctcaactccatcgcttcctccgattccggcgatccaaactgaatccggccgaggactgggggctcggattcggggcggggaagaggagaggagggggagatggaccaggtgctgaacaaggtggggagctactggttcagcaagagggccagcaaggagatcgactccatcggcgacgacctcaactcggtctcttccagtattggcgggggagctaaatggatggtgaacaagatcaaagggaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttctgacatcgagggcatgaagaccaaggtgcttgtatggaccaaggtgacctccatcaagaccgagggttcaaaggtccatttcactgccggcatgaagaagacccgcagccgcgatgcatatgaggttgtcagagatggcatcatcatagacaagttctagagcatgcccgtacctggcctgacaggtgcagtgtaattacttagatatgctttctctgctagcttacattgaaatctgttgtgctatcggatcggcctattaaccaactgtgtagctgaaaactcccatccatgactttttcgatatcttgacaatttgtgcc

SEQ ID NO: 4065 - DNA, 846 bp, Triticum aestivum
aagtccggtaggtcgcggcagcgctctcaactccatcgcttcctccgattccggcgatccaaaccgaatccggccgattcgaggcggactgggggttcggattcggggccgggaagaggagaggagggggagatggaccaggttctgaacaaggtggggagctactggttcagcaagagggccagcaaggagatcgactccatcggcgacgacctcaactcggtctcttccagtattggcgggggagctaaatggatggtgaacaagatcaaagggaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttccgacatcgagggcatgaagaccaaggtgcttgtatggaccaaggtgacctccatcaagaccgagggctcaaaggtccatttcactgccggcatgaagaagacccgcagccgcgatgcgtatgaggttgtcagagatggcatcatcatagacaagttctagagcatacctgtacctgggctgacaggtgcaatgtaattacttagatatgctacattgaaatctgttgtgctatcggatcggcctattaaccaattgtgttgctcaaatctcccatccatgactttctctatatcttgacaatgtgtgcttgttttgctgtcatcctgattcttacaccagaccagaaagggcgaccggacc

SEQ ID NO: 4066 - DNA, 1010 bp, Triticum aestivum
atcgcttcctccgattccggcgatccaaactgaatccggccgattcggggcaggttgaggcggactgggggttcggattcggggcggtgaagaggagagcagggggagatggaccaggtgctgaacaaggtggggagctactggttcagcaagagggccagcaaggagatcgactccatcggcgacgacctcaactcggtctcttccagtattggcgggggagctaaatggatggtgaacaagatcaaagggaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttccgacatcgagggcatgaagaccaaggtgcttgtatggaccaaggtgacctccatcaagaccgagggctcaaaggtccatttcactgccggcatgaagaagacccgcagccgcgatgcgtatgaggttgtcagagatggcatcatcatagacaagttctagagcatacctgtacctgggctgacaggtgcaatgtaattacttagatatgctacattgaaatctgttgtgctatcggatcggcctattaaccaactgtgttgctgaaaactcccatccatgactttttctatatcttgacaatctgtgcttgttttgctgtcatcctgattcttacaccagaccagaaagggcgaccggaccggggcgccatgttgtatccagtttttagttttgaattcctcttgatctttgggtgtgatgtggcctgtaaacgccatcaagtttggatgcaggtggcaatgcaggaaatggggagaaaaatagattatgggtgtgatttttgcttgttttctggcggagggcttcatcgacctcaaacagtgcttgtg

SEQ ID NO: 4067 - DNA, 906 bp, Hordeum vulgare
gcgtgcacagtggcgatatctccgcgacaccgccgcacgactaacctcgtcgtcactgtaaagcttagattaaagtccggtaggtcgcggccgatctccgctctccacttcatcgcttcctccgattccggcgatccaaaccgaatccggccgattcgaggcggaccggggaagaggagaggaggctaggggagatggaccaggtgttgaacaaggtggggagctactggttcagcaagagggccaccaaggagatcgactccatcggcgacgacctgaactcggtttcttccagcattggcggaggagctaaatggatggtgaacaagatcaaagggaagctgcagaaagcattacccgatcttctcaaagaatatgacatgccagcaggcctcttcccgcgggacacaactaattacgagttcaatgaagagacaaagaagctgacggtttacatcccgtcagcttgtgatgtcgggtacaaggactcgtcggtggtccggttcttcacctgtgtgactggctaccttgagaagggaaagctttccgatatcgagggcatgaagaccaaggtgcttgtatggaccaaggtgacctccatcaagacggagggctcaaaggtccatttcactgcaggcatgaagaagacccgcagccgcgatgcctatgaggttgtcagagatggtatcatcatagacaagttctagagcatacctggtctgagaggtgcaatgtaattacttagatatactttctcggctagcttacattgaaatctgttgtgctatccatcggcctattaaccaactgtgttgctgacatactcccatctatgactttctctatatcttcacaatttggtgcttgttctgctgttctatccagtttttagttttcaattcctct

SEQ ID NO: 4068 - DNA, 952 bp, Hordeum vulgare
cttagattaaagtccggtaggtcgcggccgatctccgctctccacttcatcgcttcctccgattccggcgatccaaaccgaatccggccgattcgaggcggaccggggaagaggagaggaggctaggggagatggaccaggtgttgaacaaggtggggagctactggttcagcaagagggccaccaaggagatcgactccatcggcgacgacctgaactcggtttcttccagcattggcggaggagctaaatggatggtgaacaagatcaaagggaagctgcagaaagcattacccgatcttctcaaagaatatgacatgccagcaggcctcttcccgcgggacacaactaattacgagttcaatgaagagacaaagaagctgacggtttacatcccgtcagcttgtgatgtcgggtacaaggactcgtcggtggtccggttcttcacctgtgtgactggctaccttgagaagggaaagctttccgatatcgagggcatgaagaccaaggtgcttgtatggaccaaggtgacctccatcaagacggagggctcaaaggtccatttcactgcaggcatgaagaagacccgcagccgcgatgcctatgaggttgtcagagatggtatcatcatagacaagttctagagcatacctggtctgagaggtgcaatgtaattacttagatatactttctcggctagcttacattgaaatctgttgtgctatccatcggcctattaaccaactgtgttgctgacatactcccatctatgactttctctatatcttcaccaatttggggctaaaaaaaaaaaaaaaaaaaaaaaattcggggggggggccggtgacccaatattggcctttagggaggccggattaccatttaactcgggcggcgtttttcaaaacacccggactggggaaaacccctgccggtccccaactaatttggc

SEQ ID NO: 4069 - DNA, 871 bp, Festuca arundinacea
  misc_feature (41)..(41): n is a, c, g, or t
  misc_feature (74)..(75): n is a, c, g, or t
  misc_feature (103)..(103): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (131)..(131): n is a, c, g, or t
  misc_feature (244)..(244): n is a, c, g, or t
  misc_feature (301)..(301): n is a, c, g, or t
  misc_feature (526)..(526): n is a, c, g, or t
  misc_feature (556)..(556): n is a, c, g, or t
  misc_feature (816)..(816): n is a, c, g, or t
ggcacgagggtcgcgggcaggctctcccacctcacctccanctccccgattccggcgatccaagtcgaatccgnncgattcgaggcagctcgaggcggatttnggggacggggangngnagaggaggtcangaggggagatggaccaggtgctgaacaaggtggggagctactggttcagcaagagggccagcaaggagatcgactccatcggcgacgacctcaactcggtctcttccagcatnggtgggggagctaaatggatggtgaacaaaatcaaagggaagctgcagaaagcattnccagatcttctcaaagaatatgacatgccggcaggcctcttcccaagggatacaactaattatgagttcaatgaagagacaaagaagctgacagtgtacatcccttcagcttgcgacgtcgggtacaaggactcatcggtggtgcggttcttcacttgtgtgactggctaccttgagaagggaaagctttctgatatcgagggcatgaagaccaaggtccttgtntggaccaaggtgacctccatcaagaccganggttcaaaggtccatttcactgctggcatgaagaagacccgcagccgcgatgcatatgaggtcgtcagagatggtatcatcatagacaagttctagagcatacctggcctgacggatgagcatacctggcctgacagatgcaatgtaattacttagatgatgcttcctctcctagcttatatcgaaatctattgtgctatcggcatataaccaatgatggtgggataaactttgatctcgtgactgttcctgtatcttanaaattggtgattattgtctatgattctgattcttccatcaaaccggaagcggtca

SEQ ID NO: 4070 - DNA, 696 bp, Avena sativa
cggaggtcgggaggggagatggaccaggtgctgaacaaggtggggagctactggttcggtaagagggcaagcaaggagatcgactccatcggcgacgacctcagctcggtctcttccagcattggcgggggagctaaatggatggtgaacaaaatcaaagggaagctgcagaaagcattaccagatcttctcaaagaatacgacatgccggcaggcctcttcccaagggatacaactaattatgagttcaatgaagagataaagaagctgacagtgtacatcccttcagcctgtgacgtcgggtacaaggactcatcagtggtgcggttcttcacttgtgtgactggctatcttgagaagggaaagctttctgatattgagggcatgaagaccaaggtgcttgtatggaccaaggtgacctccatcaagaccgagggctcaaaggtccatttcactgctggcatgaagaagacccgcagccgcgatgcatatgaggtcgtcagagatggtatcatcatagacaagttttagagcatacttggcctgacagacgagcatacctggcctgtcagatgtaatgtaattacttagatgatactttctctcccagcctatatcgaatctattgtgctatcggcctgtaatcaatggtggtggcaaaacctttgatgtcttgactgtttatgtatcttaaaa

SEQ ID NO: 4071 - DNA, 849 bp, Triticum aestivum
aagtccggtaggtcgcggcagccctctcaactccatcgcttcctccgattccggcgatccaaactgaatccggccgattcggggcaggttgaggcggactgggggttcggattcggggcggtgaagaggagagcagggggagatggaccaggtgctgaacaaggtggggagctactggttcagcaagagggccagcaaggagatcgactccatcggcgacgacctcaactcagtctcttccagtattggcgggggagctaaatggatggtgaacaagatcaaagggaagctgcagaaagcattaccagatcttctcaaagaatatgacatgccagcaggcctcttcccacgggacacaactaattacgagttcaatgaagagacaaagaagctgacagtgtacatcccgtcagcttgtgacgtcgggtacaaggactcatcggtggtgcggttcttcacctgtgtgaccggctacctcgagaagggaaagctttccgaaattgagggcatgaagaccaaggtgcttgtatggaccaaggtgacctccatcaagaccgagggctcaaaggtccatttcactgcgggcatgaagaagacccgcagccgcgatgcgtatgaggttgtcagagatggcatcatcatagacaagttctagagcatacctgtacctgggctgacaggtgcaatgtaattacttagatatgctacattgaaatctgttgtgctatcggatcggcctaaccaactgtgttgctgaaaacttccatccatgactttttctatatcttgacaatctgtgcttgttttgctgtcatcctgattcttccaccagaccagaaagggtgaccg

SEQ ID NO: 4072 - DNA, 986 bp, Brachypodium distachyon
gggataccccgccgcaggactaggccctctgagtcggtgacctgaaaagcgtagataagaagtccggtaggtcgcagtagctctcaagtctcaacccccatctcctccgattcggcgatccaaaatcgaatcccgttcgattcgtcctatcgaaggggaagatggaccaggtgctgaacaaggtggggagctattggtttagcaagaaggccagcaaggagatcgactccatcggcgacgacctcaattcagtctcttccagcattggtgggggagctaaatggatggtgaacaaaatcaaagggaagctgcagaaagcattgccagatcttctcaaagaatatgacatgccaacaggcctctttccacgggatacaaccaattacgagttcaatcaagagacaaagaagctgacagtatacatcccttcagcttgtgacgtagggtacaaggactcatcagttgtgcggttcttcacctgtgtcaccggctacctcgagaagggaaagctttctgacattgaaggcatgaagaccaaggtgcttgtatggaccaaggtgacctccatcaagacagagggctcaaagctccatttcactgctggcatgaagaagacccgtagtcgtgatgcatacgaggtcatcagggatggtatcgtcatagacaagttctagaggatactttgcctgagacatgcgatgtaattatttagatgatgctcccactgctagattataccaaaatcgattgtgctatcaagggtgttcccaaagaattccgtacatgactttttctgtatcttcaaaatatgttgcttctgtttttgtgattgtgactattctatcgatccggaaggtgtcaggatgcgggcagatttttaattctgagagagtaaacatgagttaaggtctgattgttggtcaatatgtttttttcagagaagttggtaaatacagctgatttggtggaatcatcaatttctagaa

SEQ ID NO: 4073 - DNA, 730 bp, Brachypodium distachyon
aggccctctgagtcggtgacctgaaaagcgtagataagaagtccggtaggtcgcagtagctctcaagtctcaacccccatctcctccgattcggcgatccaaaatcgaatcccgttcgattcgtcctatcgaaggggaagatggaccaggtgctgaacaaggtggggagctattggtttagcaagaaggccagcaaggagatcgactccatcggcgacgacctcaattcagtctcttccagcattggtgggggagctaaatggatggtgaacaaaatcaaagggaagctgcagaaagcattgccagatcttctcaaagaatatgacatgccaacaggcctctttccacgggatacaaccaattacgagttcaatcaagagacaaagaagctgacagtatacatcccttcagcttgtgacgtagggtacaaggactcatcagttgtgcggttcttcacctgtgtcaccggctacctcgagaagggaaagctttctgacattgaaggcatgaagaccaaggtgcttgtatggaccaaggtgacctccatcaagacagagggctcaaagctccatttcactgctggcatgaagaagacccgtagtcgtgatgcatacgaggtcatcagggatggtatcgtcatagacaagttctagaggatactttgcctgagacatgcgatgtaattatttagatgatgctcccactgctagattataccaaaatcgattgt

SEQ ID NO: 4074 - DNA, 1025 bp, Elaeis guineensis
tgcacacgtgggtggtatggggtaggcgatagcgcaattacccactgtccaaccgctagattttgattaggtttcgggattgatccacagtccttttctgcgctctcccttgtgaaactttctttgcatcgaagcaaagaaagggacggggggtgcttggaactcgagatctccgctccagaatagagggagagagagagagagagagagatggatcagatactgaacaaggtggggagctactggttcagcaagagggccaacaaggagatctcttccgtcggcgacgacatcaattcactttctagcagcattgaaggaggggcaaaatggttggtcaataaaatcaaaggaaagatgcagaaacccttgcctgatctgctgcgagagtatgatttgccagcgggcctcttccctcgggatgccaccaactatgagttcaacgaagagacagggaagcttactgtgttcataccttccgtatgtgaggttggttacaaggactcctctgtcttgcgttttttcaccagtgtgactggatatctagagaaggggaagctggcggacatcgaggggatgaagaccaaaattttggtttgggcaaaagtgactggcgtcacaactgaaggatcaaaggtcaattttacctccagcgtgaagaaaaccaggagccgagatgcttatgaggtcctcagagatggtatcagtgtagacaagttttaagttgctattgaaatggctctttgtggtgaactacccatgtgagctaggatttgtggctgggttatctatgaaaagtgaagctttttaactcacaaatgtatgaaacttatgatattcacccttgcaaccacctccatgtttcataaactttgttggtttctgatgctgcctatcgtcagcagtggggatgagatttgttgttgcctgactccattttcctgctattattcttttaccaaggttcggttctgcacttctgctcctgtattaaagcagggaagctatgcagacctattgctcgc

SEQ ID NO: 4075 - DNA, 516 bp, Brachypodium distachyon
agatggactaggtgctgaacaaggtggggagctattggtttagcaagaaggccagcaagcagatccactccatcagcgacgacctcaattcggtctattccagcattggtggtggagctaaatggatggtgaacaaaatcaaagggaagctgcagaaagcattgccagatcttctcaaagaatatgacatgccagcaggcctcttcccacgggatacaaccaattacgagttcaatcaagagacaaagaatctgacagtaggtacaaggactcatcagttgtgcggttcttcacctgtgtgaccggctacctagagaagggaaagatttctgacatcgaaggcatgaagaccaaggtgcttgtatggaccaaggtgacctccatcaagacagagggctcaaaactccatttcactgccggcatgaagaagacccgtagtcgtgatgcacacaatgtcatcagggatggtatcatcatagacaagttctagagcatactttgcctgacaaatgcgat

SEQ ID NO: 4076 - DNA, 496 bp, Brachypodium distachyon
gtgctgaacaaggtggggagctattggtttagcaagaaggccagcaagcagatccactccatcagcgacgacctcaattcggtctattccagcattggtggtggagctaaatggatggtgaacaaaatcaaagggaagctgcagaaagcattgccagatcttctcaaagaatatgacatgccagcaggcctcttcccacgggatacaaccaattacgagttcaatcaagagacaaagaatctgacagtaggtacaaggactcatcagttgtgcggttcttcacctgtgtgaccggctacctagagaagggaaagatttctgacatcgaaggcatgaagaccaaggtgcttgtatggaccaaggtgacctccatcaagacagagggctcaaaactccatttcactgccggcatgaagaagacccgtagtcgtgatgcacacaatgtcatcagggatggtatcatcatagacaagttctagagcatactttgcctgac

SEQ ID NO: 4077 - DNA, 1928 bp, Sorghum bicolor
aagccgccgtcgcgcaggctgcgcgcacccagaaaaaaggcggcgccccactccgtctcgccgcacccccttcctttcgtccccacctcttgctcgcgttccagctcccaagtcccaacaccacccgccggctgcgaggggatgcccgcgatcccaacggccccagctcccagcccctcgagcttcctcctcgcccgccgccacagcctccacgtctcctacccatcgcctagctctaaccaccagcggctcccgccccgcctcctgcgcctgcccgctcgtccccaggccgctcccatgtctgccgtggcgcgggcacccgcgtcgccggtggcgccgccggcgcaccccacctacgatctcaaggccgtcatcgcgctcgccctcgcagaggacgccggcgaccgaggggatgtatcttgtttagccaccataccttctgatgtggaagccgaagccacatttattgctaaagcagatggtgtcattgctggaataagcctagcagatatgatatttaaccaggttgatccatctttgaaggttgaatggtttgaaagtgatggaaattatgtccataaaggattgcagtttggaaaagtatatgggtgtgcccggagcatcatcgttgcagaaagggttgtgctaaatttcatgcagcgaatgagtggcattgcgaccctaacaaaggctatgtctgatgctgcccgtccagcatgcatattggaaacaaggaaaaccgccccaggtttacgtctggttgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggttgagacaaggacaattgaagaagtgaaagatttgttgaagtatgctgctgagaacaaaacttcattaacccgtataatgttggacaatatggctgtacctcttgcaaatggggatgtagatgtttcaatgcttaaagacgcagttcagttgataaatggtagatttgagactgaggcgtctggaaatgtgacaattgatacagtaaagaaaatcggagaaacgggagtcacttatatttcaagtggagcattaacgcattctgtgaaggcacttgacatctctctcaagatagacactgagctcgctcttcaggttggaagacgtacaaatcgtgcttgactccaccgcattacgattgtgcacgcattgccacatgtgcaagatgataggagaacagcgtggcaaatcagcttaaataacttagcgtgtcgctgagacctctgactgcaactacatgggattcatccttcagtttcatccaaaatgcagtaaataccttaaatttggaacagaataattggcaggacagacaggttgcttccagcatttgttctagcaccaagtttggaagctggaaaagcttgcgttgtgcggcaggtatgcaggcaggcagataggagtacatcttcctgcgcccagccacagctcgacagcaggtaggtttactgtaaacgggatgtcgcactgaacttgcaataccacaaacaaaaaatcgagaataagatgcttatcttactgccttcggtgacaagaagcgagggccataataattaatttatatggaagaataaaagcaagaggttgcaaggtcaactctggactttcacatctattattgaagtatatcgttccatggtcacttccaccctagtactgctggtaacatgcgttttttttttatccaatgtaacatgcgttctcatgccacatgcactctattgtctacgagtaaagtatatacgatcaatttactcacgctttgaaagagaaaatacaga

SEQ ID NO: 4078 - DNA, 2043 bp, Sorghum bicolor
aagcgctacccagcaagctatcgatccgcagaccgcagcgccttgtcaaaataaataaataaataaatatcaccgattcagcgcgccccgcctccaagccgccgtcgcgcaggctgcgcgcacccagaaaaaaggcggcgccccactccgtctcgccgcacccccttcctttcgtccccacctcttgctcgcgttccagctcccaagtcccaacaccacccgccggctgcgaggggatgcccgcgatcccaacggccccagctcccagcccctcgagcttcctcctcgcccgccgccacagcctccacgtctcctacccatcgcctagctctaaccaccagcggctcccgccccgcctcctgcgcctgcccgctcgtccccaggccgctcccatgtctgccgtggcgcgggcacccgcgtcgccggtggcgccgccggcgcaccccacctacgatctcaaggccgtcatcgcgctcgccctcgcagaggacgccggcgaccgaggggatgtatcttgtttagccaccataccttctgatgtggaagccgaagccacatttattgctaaagcagatggtgtcattgctggaataagcctagcagatatgatatttaaccaggttgatccatctttgaaggttgaatggtttgaaagtgatggaaattatgtccataaaggattgcagtttggaaaagtatatgggtgtgcccggagcatcatcgttgcagaaagggttgtgctaaatttcatgcagcgaatgagtggcattgcgaccctaacaaaggctatgtctgatgctgcccgtccagcatgcatattggaaacaaggaaaaccgccccaggtttacgtctggttgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggttgagacaaggacaattgaagaagtgaaagatttgttgaagtatgctgctgagaacaaaacttcattaacccgtataatgttggacaatatggctgtacctcttgcaaatggggatgtagatgtttcaatgcttaaagacgcagttcagttgataaatggtagatttgagactgaggcgtctggaaatgtgacaattgatacagtaaagaaaatcggagaaacgggagtcacttatatttcaagtggagcattaacgcattctgtgaaggcacttgacatctctctcaagatagacactgagctcgctcttcaggttggaagacgtacaaatcgtgcttgactccaccgcattacgattgtgcacgcattgccacatgtgcaagatgataggagaacagcgtggcaaatcagcttaaataacttagcgtgtcgctgagacctctgactgcaactacatgggattcatccttcagtttcatccaaaatgcagtaaataccttaaatttggaacagaataattggcaggacagacaggttgcttccagcatttgttctagcaccaagtttggaagctggaaaagcttgcgttgtgcggcaggtatgcaggcaggcagataggagtacatcttcctgcgcccagccacagctcgacagcaggtaggtttactgtaaacgggatgtcgcactgaacttgcaataccacaaacaaaaaatcgagaataagatgcttatcttactgccttcggtgacaagaagcgagggccataataattaatttatatggaagaataaaagcaagaggttgcaaggtcaactctggactttcacatctattattgaagtatatcgttccatggtcacttccaccctagtactgctggtaacatgcgttttttttttatccaatgtaacatgcgttctcatgccacatgcactctattgtctacgagtaaagtatatacgatcaatttactcacgctttgaaagagaaaatacagatcatgtagccttgtttagtt

SEQ ID NO: 4079 - DNA, 1637 bp, Setaria italica
atgcccgcgatccccgccgcccctgactgcttcctcctcgcgcgccgccaccgcctcgcgttcacctccccgtcgccgtcctcgaaccaccagcggcttcaccccacccgcctcctgcgcctgcccgctcgcccccgggccgctcccatggccgccgaggcgcgggcgcccgcgcctccggtattgggggatgtgtcttgtttggccacaataccttctgacgtggaagctgaagccacatttattgcgaaagcagatggtgttattgctggaataagcctagcagacatgatatttaaccaggttgatccatcattgaaggttgaatggtttgaaagtgatggaaattatgtccataaaggattgcaatttggcaaagtatatgggtgcgctcggagcatcattgttgctgaaagggttgtgctcaatttcatgcagagaatgagtggtatcgcgaccctaacaaaggctatgtctgatgctgcccgtccagcatccatattggaaacaaggaaaactgccccaggtttacgtctggttgacaagtgggctgtactgattggtggtggaaagaaccacaggcttggtttatttgatatggttatgataaaggataatcatatttctgttgctggagggattgcaaatgcaatgaggtctgttgaccaattcttggagaaggaaaaacttacaattcctgtcgaggttgagacaaggacaattgaagaagtgaaagatgttttgaagtacgctgctgagaacaaaacttcattaacccgtataatgttggacaatatggttgttcctcttacaaatggggatgtagatgtatccatgcttaaagatgcagttcagttgataaatggtagatttgagactgaggcatctggaaatgtgacgattgatacagtaaagaaaatcggtgaaacaggagtaacctatatttcaagtggagcattaacgcattctgtgaaggcacttgacatctctctcaagatagacaccgagctcgcccttcaagttggaagacgtacaaatcgtgcttgactccactgcattatattgtatactcaccttgccacatctacaagatggtagattaacccagcgtggcatatcaacttaaataacctatcaaatcgagagctctgactgcaactgtatgtatgggatccattcttcagtttcaccccgaaatacacaaacaccacaatatggagcagaataattagcagggcaggttgcttcaatgcttctcgcatatgttctggcaccagatttggaagctggaaaaggagcggctgctgcgttccgcggcaggtagccccggccagtagatctccccctgcgccctgcgcccagccagtgagccagaaaggttactgtaaacgggatgccgcactgaacctgcactatcaataccacagaacaaaataacgaaagatccaactgtgccctcggtgacacgacaaaaggcgagggggcatcgtttagatgatcgaaagtaagaggatgttgcaaggtcaactctgtacttcacatcttttattgcgtcgttgcatcaccgcttccattccaccctcgtactggcaatttgcattcctgttcccgtgtactctgtacacgaccaattcccg

SEQ ID NO: 4080 - DNA, 1933 bp, Brachypodium distachyon
accgcgccggcacacacggagaaaggcaccgcacccgtcccacacacacgcgcgcgcgcggggacagaagccggcttctcgtggcagtggcacgcatcccaactctccgaacccaaacccagccgccgcctgcagcgctgcgaaccgatgcccgcgattcccgccgccgctgcccccagccccgacgccgtggtcgcccgccaccaccttctccaccccgcccccatctctttctccagcagcacccgcctacgcctgcccgctcgaccccgcgccgctccctccatgtctgctgaggcgcggcctgccccgtccgccgtggcgccgccggcgcaccccacatacgacctcagcgccgtcatcgccctcgccctctccgaggacgccggcgaccgaggggatgtgtcatgtttggccaccataccaactgatgtgaaagctgaggccacctttattgcgaaggaggatggtgtcatcgcaggcataaacctggctgagatgatatttaaccaagttgatccattactgaaggttgaatggcttgaaggtgatggaaattatgtttgtaaaggattgcagtttggcaaagtatatgggtgtgctaggagtattattgttgctgagagggttgtgcttaatttcatgcaaaggatgagtggaatcgctacaatgacgaaggccatggctgatgctgctcgtccagcatgtatattggaaacaaggaaaactgctccaggtttacgtctggttgacaagtgggcagtactaattggtggcgggaagaatcacaggcttggtttatttgatatggttatgataaaggataatcatatttctgttgctgggggcattacgaatgcaatggtgtctgttgatcagttcttggagagcgaaaagcttgcagttcctgttgaggttgagacaaggacacttgaggaggttaaagatttattgaagtacaccgatgagaacaagacttcattaactcgtataatgttggataatatggttgtccctcttcctaatggggatatagatgtatcaatgctgaaagatgcagttcagttgataaacggtagatttgagaccgaggcatctggaaatgtgaccattgacacggtgaagaaaattggagaaacgggagttacttatatttcaagtggagctttaacacattctgtgaaggcacttgacatatctcttaagatagatactgaactcgctcttcaggtaggaaggcgcacaaatcgtgcctgactttacaacaccaggatgttttttctggcatggctcaccgatttatcaacctgagaaacatatgctggtggttatgtgtgttctaactgctgtaccgaaggatacatcgcatttatccattttggaccaactccacaataatacaatatacaagggaacaataatagcctggacgagcagcttgcgccatcttagtggacatgaaagctggatgatccaaggaagcaaagctgtagcttacaaaagttaagaatcatgaaaaggactgacagccagccttggcaggtggaaaccttttttttaacggagtctggtggaaactgtaaatggttccccttattaacaccctctgacaaaaatatagcagcaataaaatgagggtcaactttgtactttctcacctattgtggtgtggtggtcactcgcaaaaaaaaaaagtggtgttcatgatctttttagtagttccggttctacaatttgtgctgattctttgtatcgatgcctactttgattccacagtcctgaagtttttctaaattggctgtgtaagacgagattgtgttgcgtaaacctacaacattacaaagtttgttctcttttatgttgcattatgccattgtactggttgttattagcattcgcaaagaggaaaaggaacgtatttttatccgaaaag

SEQ ID NO: 4081 - DNA, 1650 bp, Brachypodium distachyon
gggacagaagccggcttctcgtggcagtggcacgcatcccaactctccgaacccaaacccagccgccgcctgcagcgctgcgaaccgatgcccgcgattcccgccgccgctgcccccagccccgacgccgtggtcgcccgccaccaccttctccaccccgcccccatctctttctccagcagcacccgcctacgcctgcccgctcgaccccgcgccgctccctccatgtctgctgaggcgcggcctgccccgtccgccgtggcgccgccggcgcaccccacatacgacctcagcgccgtcatcgccctcgccctctccgaggacgccggcgaccgaggggatgtgtcatgtttggccaccataccaactgatgtgaaagctgaggccacctttattgcgaaggaggatggtgtcatcgcaggcataaacctggctgagatgatatttaaccaagttgatccattactgaaggttgaatggcttgaaggtgatggaaattatgtttgtaaaggattgcagtttggcaaagtatatgggtgtgctaggagtattattgttgctgagagggttgtgcttaatttcatgcaaaggatgagtggaatcgctacaatgacgaaggccatggctgatgctgctcgtccagcatgtatattggaaacaaggaaaactgctccaggtttacgtctggttgacaagtgggcagtactaattggtggcgggaagaatcacaggcttggtttatttgatatggttatgataaaggataatcatatttctgttgctgggggcattacgaatgcaatggtgtctgttgatcagttcttggagagcgaaaagcttgcagttcctgttgaggttgagacaaggacacttgaggaggttaaagatttattgaagtacaccgatgagaacaagacttcattaactcgtataatgttggataatatggttgtccctcttcctaatggggatatagatgtatcaatgctgaaagatgcagttcagttgataaacggtagatttgagaccgaggcatctggaaatgtgaccattgacacggtgaagaaaattggagaaacgggagttacttatatttcaagtggagctttaacacattctgtgaaggcacttgacatatctcttaagatagatactgaactcgctcttcaggtaggaaggcgcacaaatcgtgcctgactttacaagatgttttttctggcatggctcaccgatttatcaacctgagaaacatatgctggtggttatgtgtgttctaactgctgtaccgaaggatacatcgcatttatccattttggaccaactccacaataatacaatatacaagggaacaataatagcctggacgagcagcttgcgccatcttagtggacatgaaagctggatgatccaaggaagcaaagctgtagcttacaaaagttaagaatcatgaaaaggactgacagccagccttggcaggtggaaaccttttttttaacggagtctggtggaaactgtaaatggttccccttattaacaccctctgacaaaaatatagcagcaataaaatgagggtcaactttgtactttctcacctattgtggtgtggtggtcactcgcaaaaaaaaaaagtggtgttcatgatctttttag

SEQ ID NO: 4082 - DNA, 1893 bp, Oryza sativa
gaagctagccatcggccccaccaaaaaaaaaaatccacaatacgcgcggcggcttctttcctctttcgctccccacacccttcttttgtcgcgctgatccccagacgccggcggctactgcgtttgcgatgcccgccgccgccgccgccgccgcgccgcccaatcccaacgttctgcagctagccccacgcctccgaggcctcgtctccttcccctcctcatactcctcctcatcgccgttctccaaccgcctccgcctccgcctcccccgcgccgcctccatgtccgccgaggcgcgggtgcccgtggcgccgccggcccaccccacctacgacctcaaggccgtcatcaacctcgccctatccgaggacgccggcgaccgaggggatgtatcttgcttggcaaccataccttctgacgtgaaagctgaagccacctttattgcaaaggaggatggtgttgtcgctggaataagcctagcagatatgatatttaagcaagttgatccatcattgaaggttgaatggtttgaaagtgatggaaattatgtccataagggattgcaatttgggagagtatatggttgtgctcgcaacattattgttgctgaaagagttgtgctcaatttcatgcaaagaatgagtggaattgctacaatgacaaaggccatggccgacgctgctcatccagcatgcatactggaaacaaggaaaacagctccaggtttacgcctcgttgacaagtgggcagtactaattggtggtggaaagaatcacagaattggcttatttgatatggttatgataaaggataatcatatttctgttgctgggggcataacaaatgcaatgaaatttgttgatcgattcttggcgaaggaaaagcttgcacttcctgttgaggttgagacaagaacacttcaggaagtaaaagatttattggagtatgctgctgagaacaatacctctttaactcgtataatgttggataatatggttgtccctcttggtaacggtgatattgatgtatcaatgctcaaggatgccgtggagttgataaatggtagatttgagactgaggcatctggaaatgtgactattgacacagtgaagaaaattggagaaacgggggttacctatatttcaagtggagcattaacacattctgtaaaggcacttgatatatctcttaagatagacactgaactcgctctccaagttggaaggcgcacaaatcgcgcctgactctacagaactaatgtaaccttgcaagatctgcagggtgtttctgtggcgtggcttgccagtctatcaatccatgcccttctcatcaacttgtaagcgttgagtgtacaacaaagaatgtgttttcccatatttatgggatataaaccaacaccacataatacagcaaaataataacattaccttgtaggcttgcctaccgtcctagcatttgtatttggtagaaaaaaaactgcagattgcggcaagttatcgaattttactcaggtattaataagactttttgcaccatgaaaaattagcaagctggacactgtaaatgggatgtgcgcggcattgaacttgcagttctgcacttgtgtttgaccaaacaaacactataaaatggtgatgtttgtgatctacaaaagaaaaggaagtctaacacagcagtgcattctttttcagattccatgtactcgtattgaattcatgttctcaattatagtatactagtatcattcaaccgtcttgtctgcgtactcgctcaagggggaaaaatatataaggtcaacttttttttccattaacaacagcattctgtggtccttctggacacatgttaacctatcgctacttttaccgcatccataactcttcatgatttaac

SEQ ID NO: 4083 - DNA, 1434 bp, Secale cereale
agcacctcccctcctcctcctcctcctcctcggcgcgctccggcaacccgcgcccatccgcccgcctgcgcctgccggctcgcccccgcgccgccccctcggcatccatgtccgccgaggcgcggccggcgccgtcgcccgtgccgccgccggcgcaccccacctacgacctcagcgccgtcatcgccctcgccctctccgaggacgccggcgaccgaggggatgtgtcatgtttggctacgataccaaccgatgtgaaagctgaagccacttttattgctaaggaggatggtgtcattgcaggcataagcctggctgagatgatatttaaccaagttgatccatcgttaaaagttgaatggtttgaggctgatggaaattatgtccataagggattgcagtttggcaaagtatatgggtgtgcacagagtatcattgttgctgagagggttgtgctaaatttcatgcaaagaatgagtggaatcgctacaatgacgaaggccatggctgatgctgctcgtccagcatgcatattggaaacaagaaaaactgctccaggtttacgtctggttgacaagtgggcagtactaattggtggtgggaagaatcacaggcttggattatttgatatggttatgataaaagataatcatatttctgttgccgggggcattacaaatgcaatgacatcagttgatcagttcttggagaaggaaaatcttgcagttcctgttgaggttgagacgaggacactcgaggaagttagagatttattgaagtataccgatgagaacaagacttcattaactcgtataatgttggataatatggttgtacctcttcctaatggggatctagatgtatcaatgctcagagatgcggttcagttgataaatggaagatttgagaccgaggcctctggaaatgtgacgatcgatacggtgaagaaaatcggagagactggagttacatatatttcaagtggagcattgacgcattccgtgaaggcgcttgacatatctctcaagatagacaccgagctggctcttcaagttggaaggcgtacaaatcgcgcatgacaccataagatgtggcaggtcggttcatcattcgacaacacgctcgccatggtgtgatttctaacaaatatagtgaaggatgcatcccccctcacaattatccagttcgaaccaacaccacagttactacagtatacaacggaacagcaataataatagggaaaatatcagactatactgctgtaaactgtttcccataatgatatcctgaatgcccagcttgaaagctggatctagcaacaggtgctttcagtcgttgccaaatatttaaaccgttgactaggcaggtggaaattgttgctaaatggcgtggaagaagttgtatgtgacaccacaaacacttgtttggcagaaa

SEQ ID NO: 4084 - DNA, 1479 bp, Pennisetum glaucum
gcccgcgcctccggtggcgccgccggcgcaccccacctacgacctcagggccgtcatcgcgctcgccctctccgaggacgccggcgaccgaggtgatgtgtcttgtttggctacaataccttctgacgtggaagctgaagccacatttattgcgaaagcagatggtgttattgctggaataagcctagcagacatgatatttaaccaggttgatccatcattgaaggttgaatggtttgtaagtgatggaaattatgtccataaaggattgcaatttggcaaagtatatggatgcgctcggagcatcattgttgctgaaagggttgtgctcaatttcatgcagagaatgagtgggattgcgaccctaacaaaggctatgtctgatgctgcacatccagcatgcatattagaaacaaggaaaactgccccaggtttacgtctggttgacaagtgggcggtactgatcgggggtggaaagaatcacaggcttggtttatttgatatggttatgataaaggataatcatatttctgttgccggagggattgcaaatgcaattaggtctgttgaccaattcttggagaaggaaaaacttacaattcctgtcgaggttgagacaaggacaattgaagaagtgaaagacattttgaagtatgctgctgagaacaaaacttcattaacccgtataatgttggacaatatggtagttcctcttccaaatggggatgtagatgtatcgatgcttaaagatgcagttcagttgataaatggtagatttgagactgaggcatctggaaatgtgacaattgacacagtaaagaaaattggagaaacgggagtaacctatatttcaagtggagcattaacacattctgtcaaggcacttgacatctctctcaagatagacaccgagctggcccttcaagttggaagacgtacaaatcgtgcctaacttcaccacattatgttgtatactctcgcctagccacatctacaagatggtagattaacgcagcgtggcgtatcaacttaaataactcatcaaatggagagctctgaccacaagtccacaactgtatgtatgggatccattcttcattttcgccccgaaatacacaaacaccacaatatggaacagaataattggcatggcaggctgcttcaatgcttctcgcatatgttctagaactagagatttgtggaagctggaaaaggacacctcccccctgcgtcctacgacggtacgccctgcgcccagccagtgagctagaaaggcaggtaggttactgtaaacgggatgccgcactgaaacctgcaatagcaataccgcagaacaaaataacgaaagacgcgactgtgccatcggcgacatgacaaaagttttttttttgaaataaaaaaggtgaggggggcataaactggatgatcaaaagcaagaggatgttgcaaggtcaactctgtacttcacatgctattatt

SEQ ID NO: 4085 - DNA, 1483 bp, Secale cereale
gcacctcccctcctcctcctcctcctcggcgcgctccggcaacccgcgcccatccgcccgcctgcgcctgcccgcgcgcccccgcgccgccccctcggcatccatgtccgccgaggcgcggccggcccgtcgcccgtgccgccgccggcgcaccccacctacgacctcagcgccgtcatcgccctcgccctctccgaggacgccggcgaccgaggggatgtgtcgtgtttggctaccataccaaccgatgtaaaggctgaagccacttttatcgctaaggaggatggtgtcattgcaggcataagcctggctgagatgatatttaaacaagttgatccgtcgttgaaggttgaatggtttgaggctgatggaaattatgtccataagggattgcagtttggcaaagtatatgggtgtgctcagagtatcattgttgctgagagggttgtgctaaatttcatgcaaagaatgagtggaatcgctacaatgacgaaggccatggctgatgctgctcgtccagcatgcatattggaaacaagaaaaactgctccaggtttacgtctggttgacaagtgggcagtactaattggtggtgggaagaatcaccggcttggattatttgatatggttatgataaaagataatcatatttctgttgccgggggcattacaaatgcaatgacatcagttgatcagttcttggagaaggaaaatcttgcagttcctgttgaggttgagacgaggacactcgaggaagttagagatttattgaagtataccgatgagaacaagacttcattaactcgtataatgttggataatatggttgtacctcttccgaatggggatctagatgtatcaatgctcgaagatgcagttcagttgataaatggaagatttgagaccgaggcctctggaaatgtgacgatcgatacggtgaagaaaatcggagagactggagttacatatatttcaagtggagcattgacgcattctgtgaaggcgcttgacatatctctcaagatagacaccgagctggctcttcaagttggaaggcgcacaaatcgcgcctgacaccgcaaggtgtttctctgcttggcgtggctggtcggttcatcattcgacaacatgctcgccatggtgtgatttttctaactaatatagtgaaggatgcatcccccctcgcagttatctactgtagtttggaccagcaccacagttactacagtatacaacggaacagcaataataatagggaaaatatcagactatactgctgtaaactgtttcccataataatatcctgaatgcccagcttgggagctggatctaacaacaggagctttcagtcgtcgccaaatatttaaaccattgactggcaggtggaaattgttgctaaatggcgtggaagaagttgtatgtgacaccacaaacacttgtttggcaggaaccgggaacagaactagtaaaggttttcccttgt

SEQ ID NO: 4086 - DNA, 526 bp, Zea mays
ggatatgaactattgcatcaaatggaaccatatattaatcagtagttgggagaggtgatctttgcatgagtccagtagaatttgaaccttctgtaagtgatgatttagtactggagaagaaatctggaaatgggcaacatgatgtcagaggcacacatcatcacagaaccagcatgaaacctgaaaaaccaattgacttgcttaggaaagttgatggcaataatatgtgtgctaactgtggtgcttcagaacctgattgggcatcattaaaccctggcgcacttctatgcatagagtgttctggggtgcacagaaatcttggagtgcatatatcaaaggttagatctctgacacttgatgtcagagtttgggagccatctgtaatcaatctctttcagtcattaagcaacatgtttgtcaacagtatttgggaagagacgctgccagatgataattcaagtgctgatggatcagacacatcacagtacctctctgttagcaagcctaatctctttatgagaatttt

SEQ ID NO: 4087 - DNA, 3182 bp, Sorghum bicolor
ccgccccctcacgcgcccagatcgccgccattcccttccccgccctgccgcgacgaggaggccgcgggcaccgcaccaccttctccaccgatccccaagctgcctaccttcgcgcggcggtgggtgggggcgcgggtcccggcggccggcggcgaacaggcgcgaggcggagcgcccgcagcgtgccggcggatgggctggtaggaggaggtggcgagactgcggggacggtgactgtgccagcgggcggcagccatgtatttctccaagctcgatgactcgcccatgttccggacgcagatacaatcacttgaggagagtgctgaattgctgagagagagatgtttgaagttccataaaggttgccgtaagtatactgaagggctaggggaagcatacgatggagatattgcatttgccagctcacttgaaacatttggaggaggccacaatgatccaattagtgttgcttttggtgggcctgtaatgaccaaatttacaattgccttaagagaaattggaacatacaaggaagtccttcgctcccaggtcgagcacatgttaaatgacagattactaaattttgttgacattgatttgcatgatgtgaaggatgctcataagcgctttgacaaggctagcctcttatatgaccagattcgtgagaagtacctatcattgaagaaaggtacccgaccagacataacaacggcaattgaagatgagcttcacagtgctagatcttcatttgagcaagctcgtttcaacctggtcacttcactttctcatgttgaggcaaagaagagatttgaatttttggaggctgttagtgcgacaatggactcacatcttcgatattttaaacaaggatatgaactattgcatcaaatggagccatatattaatcaggttcttgcttatgcacagcaatcaagagaaagagcaaacaaggaacaagcttctcttgtagagaggatgcatgagtacaaaaggcagatagaccgggaaagtcggtcttctataaatggtttgaatgattcttataatggtgatggaatacagacaattggcagaagttcacataaacagatcgaggcagttatgcagtcaacttcaaaaggcaaggttcagaccattcgtcaaggttatctttcgaaaagatcttcaaacttgagagccgactggaaaagaaggttcttcgtacttgatagtcgaggaatgttgtactactatcgaaaacaaattactaggccacctgctggttgctccatgcagagaagcgttaacccccctgaacatggttctgggttgttgagcagattgttctcttctcattaccatggtattatacatgatgaaaagtctgttgcacggcatactgtaaatttgttgacatcaaccattaaagttgatgctgagcaatcagatctgaggttctgtttcagaattatttcacccacaaagatctacacattgcaggcagagagtgcagtagatcagatggattggattgaaaagataactggtgttattgcctctttactgagctcacaatccccagaacagtgttttctgtcaagccctaagggcagtggacatgataggagtaccagtgatggaagctcctttacaagttcagtggaatttgaaccttccacaatcgatgatttagtactggagaagtactctggaaatgggcagcatgatgtcagaggcacacatcatcacagaaccagcgtgaaacctgaaaaaccaattgacttgcttaggaaagttgatggcaataatatgtgtgctgactgtggtgcttcagaacctgattgggcatcattaaaccttggtgcacttctatgcatagagtgttctggggtgcacagaaatctcggagttcatatatcaaaggtaagatctctgacacttgatgtcagagtttgggagccatctgtaatcaatctctttcagtcattaggcaacatgtttgtcaacaatatttgggaagagatgttgccagatgataattcaagtgctgatggatcagacacatcacaatacctctctgttagcaagcctaaacacaaagatgtattctctgccaaggagaagtttattcatgccaagtatgtaaacaaagaattcatacggaaccatagcatggatgagaatcagctagctcagcagatgtggaatagtgtagctgcaaatgacaagaaagcagcatacagtctcattgtgagatcgcgtcccaatgtaaatttagtttatggagagatgccttctagcccatttttgactcttggaaaagcacttcagcaagagcaaccggcttcaccacatgatggaagtcccagatttttcgattgcaattcacatgacaagatttctcctcgagagcccctttcccctgcaagcacgagttcacgcacagatgacatggaggacacttgtgaaggtctctccttgttccatcttgcatgccgtgttgcagatgttgggatggttgaattacttttgcagtatggtgctagtgtaaatatgaatgattctaggggtcggacaccccttcatcactgcattttgaaaggaagacatcagcatgcaaagcttctcctctccagaggggctgattcacaagccatggatcgagatggtaggacagcattacagtatgcaatcgacagtggaacaagcgatgaagacattcttgcgttgttagaggaccatagtagataatcttgcaaccacacctgcggtaaattgaggtcctcttggtgtggtcgactcaactaacagggctccagccccgccctgccccgcccggtcccagcttgtcgtgcagacaatccaaatttatggcaggaaagcaacctatgtacatgtcgttgtagggcttcagtatcatgatgcgcctgttgtttctttccccaccttttgcttgtttagcatcagtggtccttatttagtcatctggcaaacggtttggttttgtttgctgcaggtgatgcatagtaagcttgtaaatggagttgcttctctttattttctagtcatctttcatcattgaagtagatgtgccattctgatgaaagatgattgtacatatcgagatgtgctgttgtggtatatgaaatatgagcatggtgtggatggtttatacgaaagttgtgccttgcttactcaaaata

SEQ ID NO: 4088 - DNA, 3347 bp, Sorghum bicolor
agaaagagagcgcaccgttattccctcctggggctcccctcccctcttgcgcattccaccaccccgccctgcccccctttccctccctccctgcctcctcgcctcgcttctcgccgagccacccgaccaattcccccgccccctcacgcgcccagatcgccgccattcccttccccgccctgccgcgacgaggaggccgcgggcaccgcaccaccttctccaccgatccccaagctgcctaccttcgcgcggcggtgggtgggggcgcgggtcccggcggccggcggcgaacaggcgcgaggcggagcgcccgcagcgtgccggcggatgggctggtaggaggaggtggcgagactgcggggacggtgactgtgccagcgggcggcagccatgtatttctccaagctcgatgactcgcccatgttccggacgcagatacaatcacttgaggagagtgctgaattgctgagagagagatgtttgaagttccataaaggttgccgtaagtatactgaagggctaggggaagcatacgatggagatattgcatttgccagctcacttgaaacatttggaggaggccacaatgatccaattagtgttgcttttggtgggcctgtaatgaccaaatttacaattgccttaagagaaattggaacatacaaggaagtccttcgctcccaggtcgagcacatgttaaatgacagattactaaattttgttgacattgatttgcatgatgtgaaggatgctcataagcgctttgacaaggctagcctcttatatgaccagattcgtgagaagtacctatcattgaagaaaggtacccgaccagacataacaacggcaattgaagatgagcttcacagtgctagatcttcatttgagcaagctcgtttcaacctggtcacttcactttctcatgttgaggcaaagaagagatttgaatttttggaggctgttagtgcgacaatggactcacatcttcgatattttaaacaaggatatgaactattgcatcaaatggagccatatattaatcaggttcttgcttatgcacagcaatcaagagaaagagcaaacaaggaacaagcttctcttgtagagaggatgcatgagtacaaaaggcagatagaccgggaaagtcggtcttctataaatggtttgaatgattcttataatggtgatggaatacagacaattggcagaagttcacataaacagatcgaggcagttatgcagtcaacttcaaaaggcaaggttcagaccattcgtcaaggttatctttcgaaaagatcttcaaacttgagagccgactggaaaagaaggttcttcgtacttgatagtcgaggaatgttgtactactatcgaaaacaaattactaggccacctgctggttgctccatgcagagaagcgttaacccccctgaacatggttctgggttgttgagcagattgttctcttctcattaccatggtattatacatgatgaaaagtctgttgcacggcatactgtaaatttgttgacatcaaccattaaagttgatgctgagcaatcagatctgaggttctgtttcagaattatttcacccacaaagatctacacattgcaggcagagagtgcagtagatcagatggattggattgaaaagataactggtgttattgcctctttactgagctcacaatccccagaacagtgttttctgtcaagccctaagggcagtggacatgataggagtaccagtgatggaagctcctttacaagttcagtggaatttgaaccttccacaatcgatgatttagtactggagaagtactctggaaatgggcagcatgatgtcagaggcacacatcatcacagaaccagcgtgaaacctgaaaaaccaattgacttgcttaggaaagttgatggcaataatatgtgtgctgactgtggtgcttcagaacctgattgggcatcattaaaccttggtgcacttctatgcatagagtgttctggggtgcacagaaatctcggagttcatatatcaaaggtaagatctctgacacttgatgtcagagtttgggagccatctgtaatcaatctctttcagtcattaggcaacatgtttgtcaacaatatttgggaagagatgttgccagatgataattcaagtgctgatggatcagacacatcacaatacctctctgttagcaagcctaaacacaaagatgtattctctgccaaggagaagtttattcatgccaagtatgtaaacaaagaattcatacggaaccatagcatggatgagaatcagctagctcagcagatgtggaatagtgtagctgcaaatgacaagaaagcagcatacagtctcattgtgagatcgcgtcccaatgtaaatttagtttatggagagatgccttctagcccatttttgactcttggaaaagcacttcagcaagagcaaccggcttcaccacatgatggaagtcccagatttttcgattgcaattcacatgacaagatttctcctcgagagcccctttcccctgcaagcacgagttcacgcacagatgacatggaggacacttgtgaaggtctctccttgttccatcttgcatgccgtgttgcagatgttgggatggttgaattacttttgcagtatggtgctagtgtaaatatgaatgattctaggggtcggacaccccttcatcactgcattttgaaaggaagacatcagcatgcaaagcttctcctctccagaggggctgattcacaagccatggatcgagatggtaggacagcattacagtatgcaatcgacagtggaacaagcgatgaagacattcttgcgttgttagaggaccatagtagataatcttgcaaccacacctgcggtaaattgaggtcctcttggtgtggtcgactcaactaacagggctccagccccgccctgccccgcccggtcccagcttgtcgtgcagacaatccaaatttatggcaggaaagcaacctatgtacatgtcgttgtagggcttcagtatcatgatgcgcctgttgtttctttccccaccttttgcttgtttagcatcagtggtccttatttagtcatctggcaaacggtttggttttgtttgctgcaggtgatgcatagtaagcttgtaaatggagttgcttctctttattttctagtcatctttcatcattgaagtagatgtgccattctgatgaaagatgattgtacatatcgagatgtgctgttgtggtatatgaaatatgagcatggtgtggatggtttatacgaaagttgtgccttgcttactcaaaatagattgcattattgcaggggtcttttcataa

SEQ ID NO: 4089 - DNA, 1847 bp, Saccharum officinarum
aaatttgttgacatcaaccattaaagttgatgctgagcaatcagatctgaggttctgtttcagaattatttcacccacaaagatctacacattgcaggcggagagtgcagtagatcagatggattggattgaaaagataactggtgttattgcctctttactgagctcacaatccccagagcagtgttttatgtcaagccctaagggcagtggtcatgataggagtaccagtgatgcaagctcctttacaagttcagtggaatttgaaccttctgtaatcgatgatttagtactggagaagaactcaggaaatgggcagcatgatgtcagaggcacgcatcatcacagaaccagcatgaaacctgaaaaaccaattgacttgcttaggaaagttgatggcaataatatgtgtgctgactgtggtgcttcggaacctgattgggcatcattaaaccttggcgcacttctatgcatagagtgttctggggtgcacagaaatcttggagtgcatatatcaaaggtaagatctctgacacttgatgtcagagtttgggagccatctgtaatcaatctctttcagtcattaggcaacatgtttgtcaacaatatttgggaagagatgttgtcagatgataattcaagtgctgatggatcagacacatcacagtatctctctgttagcaagcctaaacacaaagatgtattctctgccaaggagaagtttattcatgccaagtatgtagacaaagaattcatacggaaccatggcatggatgagaatcagctagctcagcagatgtggaatagtgtagctgcaaatgacaagaaagcagcatacagtctcattgtgagatcacgtgccaatgttaatttagtttatggagagatgccttctagcccatttttgactcttggaaaagcacttcagcaagagcaaccggcttcaccacatgatggaagtccgagatttttcgattgcaattcacatgacaagatttctcctcgagagcccctttcccctgctagcacgaagtcacgcacagatgagaaggaggacaagtgtgaaggtctccccttgctccatcttgcataccgtgttgcaaatgtggggatggttgaattacttttgcatatggtgctaatgtaaatatgaatgattctaggggtcggacaccccttcatcactgctctttgaaaggaatacatctgctttcaaagcttttcctctctataggggctgattctctatccattgatcgaaatgttatgacatcttttccatttcattcaactgtgtatcaatctatagagactttcttgctgtgttaaggaccataatttattatctagctacctctcctttcttaattcaagttcttttatctcgatcttcatcaacttttttgcacttctcgtctcagtttattctagtctatctcacctatcttgtcttggttatatagtaacttcttcacgttaatctaagttcttcatatatacatgtgtctatgattcttatcccacgtctattctgtgtataattcgtggcattacttaaatattatgcatactgttgagttatctgtcccttactttcaaacctttctgtaactgagttacattcttttttgtattctctctttattcatgcgtagatttcgtattctttccattcttattatcataatttaatttcttccttcttacttatattttaatgtggtgtatagtatctttaatgttatatatcagtgggctttcattttactctctttaaactcttctttacagttgtacattctctctattctatccacttcttttggatgtgtttctctcatttcgtt

SEQ ID NO: 4090 - DNA, 1037 bp, Zea mays
aattcgtaatgtactatttccaggttcagaccattcgtcaaggttatctttcgaaaagatcttcaaacttgagagccgactggaaaagaaggttctttgtacttgatagtcgaggaatgttgtactactatcggaaacaaattactaggccacctgctggttgctccatgcaaagaagtgttaacccccctgaacatggttctgggttgttgagcagattgttctcatctcattaccatggcattgtacatgatgaaaagtctgttgcacggcatactgtaaatttattgacatcaaccattaaagttgatgctgaccaatcagatctgaggttctgcttcagaatcatttcacccacaaaaatctacacattgcaggcagagagtgcagtagatcagatggattggattgaaaagataactggtgttattgcctctttgctgaactcacaatccccagaacagtgttttttgtcaagccctaagggcagtggtcatgataggagtaccagcgatggaagctcttttacaagttcagtagaatttgaaccttctgtaagtgatgatttagtactggagaagaaatctggaaatgggcagcatgatgtcagaggcacacatcatcacagaaccagcacgaaacctgaaaaaccaattgacttgcttaggaaagttgatggcaataatatgtgtgctgactgtggtgcttcagaacctgattgggcatcattaaaccttggcgcacttctatgcatagagtgttctggggtgcacagaaatcttggagtgcatatatcaaaggttagatctctgacacttgatgtcagagtttggggagccatctgtaatcaatctctttcagtcattaggcaacatgtttgtcaacagtatttgggaagagacgctgccagatgataattcaagtgctgatggatcagacacatcacagtacctctctgttagcaagcctaaacacaaagatgtattctctgccaaggagaagtttattcatgccaaggtattcactacattcacaac

SEQ ID NO: 4091 - DNA, 520 bp, Zea mays
gtgatctttgcatgagtccagtagaatttcaaccttctgtaagtgaagatttagtactggagaagaaatctggaaatgggcagcatgatgtcagaggcacacatcatcacagaaccaacatgaaacctgaaaaaccaattgacttgcttaggaaagttgatggcaataatatgtgtgctgactgtggtgcttcagaacctgattgggcatcattaaaccttggcgcacttctatgcatagagtgttctggggtacacagaaatcttggagtgcatatatcaaaggttagatctcttacacttgatgtcagagtttgggagccatctgtaatcaatctctttcagtcattaggcaacatgtttgtcaacagtatttgggaagagacgctgccagatgataattcaagtgctgatggatcagacacatcacagtacctctctgttagcaagcctaaacacaaagatgtattctctgccaaggagaagtttattcatgccaaggtattcactacattcacaac

SEQ ID NO: 4092 - DNA, 869 bp, Saccharum officinarum
actgcagtagaacatcctggactcctggtgtggtgaagactgccgaagagaaacaaacgattccacacttctccggtcgaagcgcagatcgccgcggagagcagagcagaggacgggagaagagacggcgagttcctgagtcttcctcctccgtagctgagcctgctcgtcaacccggcggcaggcatggatggaaagaacctcagcaataaacagcaagctgaacaaaagaacccagatgcagtgacagacagtattccaagccaagatcaagaggccttgaatccgtttccagattcagatgatggaaacaccagtccgttgaatggccatgaagctgatgtgaacatggaagctgccatctcgaccgaggacgtcatacgagctggtgggttcggagcgaaggacgacattggtagcctcctcccgacagcaattgattctaccgatttcgaggcctcgctgcgggacgcccgcgatttcgaaggcgagaaagaggcaccagcacatcctggactaggatggaagggggagaaggttgatgatggaagcaaactgtcagatgtggcttaacagtgatcgtgctttcatcttctgtagcccagctccagccttcagaaaacattcttttctgccatatgtgtctggagagctgccttgcgtatgaactttttgtcacaatgttttgtgtgtaacattacattctgtttgcttcagtgctgtatgaacatgaggatgacggttctatgttgtctgttgtatagcatcaacactgttggatgtccgaggaatgtataatccagcatggcttcctgtctgtttcaatcgcctgctgatgagtggcaacagagttgcaatatgcggttccc

SEQ ID NO: 4093 - DNA, 870 bp, Sorghum bicolor
actgcagtagaacatcctggtggactgactgctgaccgaagagaaacaaacaaacgattccacacttctccggtcgaagcgtagatcgcagcggagcagagggacgggagaagaggcagcgagttcctgaatcttcctcctccgcagctgagcctgctcgtcgacccgccggcaggcatggatgggaagaacttcagcaataaacagcaagctgaacaaaagaacccggatgcagtgacagacagtgttccaagccaatctcaagaggccttgaatccgtcagatgatggaaacaccagtccaatcaatggccatgaagctgatgtgaacatggaagcttccatctccaccgaggacgtcattcgggccggcgggtttggagcgaaggatgacattggtagcctcctcccaacagcaattgattccaccgatttcgaggcctcgctgcgggacgcccgcgacttcgaaggcgagaaagaggcaccgtcacatcctggactaggatggaagggggacaaggctgatgatggaagcaaactgtcagatgtgccgcagcagtgatcgtgctttcttcttctgtcatatatgtgtctgaagagctgccctgcgtatgaactttttgtcccaatgttttgtgtttaacgtgatcttctgtttggtccagtgtttgtatgaacgtgaggatgacggttctatgttgcctgttgtatagatctcaactctgttagatgtctgaggaatgtataatccagcatggtttcctgtctatttgttcggctgatgctgatgctgatttgttctgatagaaaaacactattccatggctgagaattagtgcctgataagcttaagcgactcgtcgcccttgat

SEQ ID NO: 4094 - DNA, 1020 bp, Sorghum bicolor
actgcagtagaacatcctggtggactgactgctgaccgaagagaaacaaacaaacgattccacacttctccggtcgaagcgtagatcgcagcggagcagagggacgggagaagaggcagcgagttcctgaatcttcctcctccgcagctgagcctgctcgtcgacccgccggcaggcatggatgggaagaacttcagcaataaacagcaagctgaacaaaagaacccggatgcagtgacagacagtgttccaagccaatctcaagaggccttgaatccgtcagatgatggaaacaccagtccaatcaatggccatgaagctgatgtgaacatggaagcttccatctccaccgaggacgtcattcgggccggcgggtttggagcgaaggatgacattggtagcctcctcccaacagcaattgattccaccgatttcgaggcctcgctgcgggacgcccgcgacttcgaaggcgagaaagaggcaccgtcacatcctggactaggatggaagggggacaaggctgatgatggaagcaaactgtcagatgtgccgcagcagtgatcgtgctttcttcttctgtcatatatgtgtctgaagagctgccctgcgtatgaactttttgtcccaatgttttgtgtttaacgtgatcttctgtttggtccagtgtttgtatgaacgtgaggatgacggttctatgttgcctgttgtatagatctcaactctgttagatgtctgaggaatgtataatccagcatggtttcctgtctatttgttcggctgatgctgatgctgatttgttctgatagaaaaacactattccatggctgagaattagtgcctgataagcttaagcgactcgtcgcccttgatccgttttgttatccatcctagagtttcttgcacttctggatggggggacttgatggaacaaggtgccaccatggtggaggagaagatcacgtgatggggagaaaaagagggaggtcggctatgggaggggagggagagagttaagaacat

SEQ ID NO: 4095 - DNA, 1034 bp, Sorghum bicolor
tacagcgccagggccagggagccaccagcccagcatcactctggcctcatcctccattcctcctcgcggctcacagaaacctcaaaacccaaccaggccggcgtccacagaaagaggagagcagagagagtgggagatcatggagctctgcgtctctaccaccaccgcctccgtccgcgccaccaccgccgcgcccatatccttcgccccgccccgccgtggcggcgcgtctgcttccaccgcccttccggtccaccaccgccgcatcccaactcgaggctggcgttgcgccgccagtgcggccgtgcctgacccggtgccctccgaagagcccgcctccgcctcctacaccgtcgtcgtcacggacaagcccgacactcctgccgacgacaaggtcgaggaagttagcgccgcgcctagtggctccgcggaggcgcctgtagcagagctggtgtcgtcggaggcgtccccgtccccggatggcggcggtctggatgagatactaagcaagttgaacattgaagtgactccgactttaatcctcactggatctgctgcctttgttgctttatggatcctatcttctgttgttgctgcaattgattcagtccccctgctcccaaaattgctggaattagtaggaactggttactcaatttggttcatcgcacgatatctccttttcaaggaaagcagagatgacctgtttgcaaagttcgaagatctcatacagaggattgtttgatctgtcgtcgatcttttgccacgtgtttaggctttacagccagcttattattaggttttctccctttatattttcaaatattactgaaggggtaaagaaggtcgtgtaaattttctcctcatggggtctgttatcagacttctcaagtttggctagtgtgcttcttcaggtcactatggatgtttttttactcaatcctatgtgtatactgtcaagtaaagctttaaaaaaagatgaatacgatcagtatgttctcactcctatggaagttttgaagttctatttgcta

SEQ ID NO: 4096 - DNA, 1461 bp, Sorghum bicolor
gataagaataaagaagcggtgattcgttcctctttccctctttccctttggaggaaaccacaaaaatgcaaaaccacaaccggacatgccgggccccggaacaggagagaagcgaaagcgaaagcaccacctgtcgtccaaccacccaaaagcatgcgaagaagaatcggctcggccccagaaagcacaggcccaagcggccgggagccgtcggatgtcacgcaaactgccgagcggtcgtcggtcgagcaggacacaggactgcaggagagttggtgccttggtggtgcacacgtcatgcagtacagcgccagggccagggagccaccagcccagcatcactctggcctcatcctccattcctcctcgcggctcacagaaacctcaaaacccaaccaggccggcgtccacagaaagaggagagcagagagagtgggagatcatggagctctgcgtctctaccaccaccgcctccgtccgcgccaccaccgccgcgcccatatccttcgccccgccccgccgtggcggcgcgtctgcttccaccgcccttccggtccaccaccgccgcatcccaactcgaggctggcgttgcgccgccagtgcggccgtgcctgacccggtgccctccgaagagcccgcctccgcctcctacaccgtcgtcgtcacggacaagcccgacactcctgccgacgacaaggtcgaggaagttagcgccgcgcctagtggctccgcggaggcgcctgtagcagagctggtgtcgtcggaggcgtccccgtccccggatggcggcggtctggatgagatactaagcaagttgaacattgaagtgactccgactttaatcctcactggatctgctgcctttgttgctttatggatcctatcttctgttgttgctgcaattgattcagtccccctgctcccaaaattgctggaattagtaggaactggttactcaatttggttcatcgcacgatatctccttttcaaggtacatctttttttgatggaacttttcaaggaaagcagagatgacctgtttgcaaagttcgaagatctcatacagaggattgtttgatctgtcgtcgatcttttgccacgtgtttaggctttacagccagcttattattaggttttctccctttatattttcaaatattactgaaggggtaaagaaggtcgtgtaaattttctcctcatggggtctgttatcagacttctcaagtttggctagtgtgcttcttcaggtcactatggatgtttttttactcaatcctatgtgtatactgtcaagtaaagctttaaaaaaagatgaatacgatcagtatgttctcactcctatggaagttttgaagttctatttgctactgtcgagccttctgtgagactgacggaactgcagctcaacttagctgactttcaacgatgctattcctttcatttttgaaatcctcttttata

SEQ ID NO: 4097 - DNA, 944 bp, Zea mays
ccgtttcgcggctcacagagatacctcaaaacccaaccaggccggcgtccaggtgtccacagaaagaggagagcagagagagcgggagatcatggagctctgcgtctctaccactgcctccgtccgcgccaccgccgcgcccatatccttcgccccgccccggcgaggcgcgtctgcttccaccgccctcccgctccaccgccgaatcccaactcgaggctggtgttgcgccagcgcggccgtgcctgacccggcgccctccgaagagctcgcatccgcctcctacaccgtcgtcgtcgcggacaagcccgattcgcctgccgatgacaaggtcgacgaggttagcgccgcgcctagtggctccgcggaggcgcccgtagcagaaccggtgtcatcagaggcgtccccgtccccgtccacggatgacggcggtctggatgagatactaagcaagttgaacattgaagtgactccgattttaatcctcactggatctggtgcctttgttgctttatggatcctatcttctgttgtttctgcagttgattcagtccccctgctcccaaaattgctggaattagtaggaactggttactcaatttggttcaccgcacggcatctccttttcaaggaaagcagagatggcatgtttgcaaagttcaaggatatcaaagagaggatcatttgatctaccatcgatatctggtcacgtgtttaggctttacagcctgcttattattaggttttctcccctttcaaatattactgaaggggtaaagaaggtcgtatatctaatttttcttctcacggggtctgtcattaggcttctcaagtttggctagtgtgcttcttcaggtcactctcgatgttttttactcaatcctatgtgtatgctgccgaataaagctttaaaaagatgaatgcaattagtatgttctcgctcc

SEQ ID NO: 4098 - DNA, 997 bp, Saccharum officinarum
aacccaactaggccggcgtccacagaaagaggagagagagagagagtgggggttcatggagctgtgcgtctcgaccaccgcctcctccgtccgcgccaccgccgcgcccatatccttcgccccgccccgccgtggcgcgtctgcttccaccgccgttccgctacaccgccgcatcccaactcgaggctggcgttgcgccagtgcggccgtgcctgacccggtgtcctccgaagagcccgcatcggcctccgcttcctacaccgtcgtcgtcacggacaagcccgacacgcctgccaatgacaaggtcgagggggttagcgccgcgcctagtggctccgcggaggcgcctgtagcagaactggtgtcgtcggaggcgtccccgtccccgtccccggatgacggcggtctggatgagatactaagcaagttgaacattgaagtgactccgactttaatcctcactggatctgctgcatttgttgctttatgggtcctatcttctgttgttgctgcaattgattcagtccccctgctcccaaaattgctggaattagtaggaactggttactcaatttggttcatcacacgatatctccttttcaaggtacatctttttttgatggaacttttcaaggaaagcagagatgacctgtttgcaaagtttgaagatctcatacagaggattatttgatctatcgtcgatcttttgccacgtgtttaggcattacagccagcttattattaggttttctccctttcttttcaaagattactgaaggggtaaagaaggtcgtgtatctaaatgttctcttcatggggtctgttatcagacttctcaagtttggctagtgtgcttcaggtcactgtgtgcttcttcaggtcactatggatgttttttactcagtcctatgtgtatactgtcgagtgaagctttaaaaagatgaacacgatcagtatggtctcactcctatgcaagttttgaagtcctaaaaaaaaa

SEQ ID NO: 4099 - DNA, 1321 bp, Zea mays
agtcagcagtcagcactgccggcgacgcgtagaccgagtccctcatcaaagagtccgcaacctaccaagtaccaaccaaccgcctgggctgggcaggcgagcaagacaaagcacgccaagcggcaagcgcaagtccaacagcccgcatcgctcactccgtcactcactcggcgcggcgcccatccccgcggttctcacgagcgcgcgcgcctgcgtccggcgccgtccgccatggcgtcgtccaagcctttattccccttccccgtccccgcccccgacccgtccgacgaggtcgtgcgcgagttcggcccgctgctccgggtctacaagagcggccgcatcgagcggcccctggtggctccgcccgtggagcctggccacgacgccgccacgggggtccaatccaaggacgtccacctcggctcctactcggcccgcctctacctgccccccgtggccgacgccggtgccaagctgcccgtcgtcgtgttcgtgcacggcggcggcttcgtggccgagtccgccgcctcgcccaactaccacctcttcctcaacaggctcgccgccgcctgccccgcgctcgcggtctccgtcgactaccgcctggcgcccgagcacccgctcccggcggggtacgacgactgcctcgccgcgctcaagtgggtgctttccgccgccgacccctgggtcgccgcccacggggatctcgcgcgcgtcttcgtcgccggggacagcgccggcggcaacgtctgccactacctcgccatccacccggacgtcgtccaggcgcagcagcagggctgcccgccgccgctcaagggcgccgtgctcatccacccctggttctggggctccgaggccgtgggcgaggagcccagggaccccgccgtgcgcaccatgggcgccggactctggttcttcgcgtgccccgatgctaatagcatggaagacccgcggatgaaccccatggcgcccgccgcaccgggactccacacgctggcgtgtgagcgcgtcatggtgtgtaccgcggagggcgacttcctcaggtggcgcggccgcgcgtacgccgaggcggtggccgcggcgaggggaggccgcctggggcaggccgccggcgtcgagctgctggagaccatgggagagggccatgtcttcttcctcttcaaacccgactgcgacaaggccaaggagatgctggacaagatggcggctttcatcaatgcgccgtgaacgtgaacgtgatccgtgacgcgtgcgcccttgttcctttgtgtttgcgtgacaatgtggaaaataaaataatatatttcagctgttttgg

SEQ ID NO: 4100 - DNA, 1480 bp, Sorghum bicolor
cgcaaacggacctcacctcagcgcgtccgctaccaaccaaccacccatcctcgccggccacgcgacgcgacgcgagcaaggcaaagcacgccaaagaagaagcggacgcaactccaacagccctcggttctcacttctcactccacacctccaccgtccacccacccagcctctcacgagcgtgtccgccatggcgtcgtccaagccttcgttatcgctccccttccccatccccgcccccgacccgtccgacgaggtcgtgcgcgagttcggcccgctgctccggatctacaagagcggccgcatcgagcggcccctggttgccccgcccgtggatcccggccacgacgccgccacgggggtccagtccaaggacgtccacctcggctcctactccgcccgcctctacctgccccccgtggccgcttccagcgccaagctgcccgtcgtcgtgtacgtccacggcggcggcttcgtggccgagtcggccgcgtcgccaggctaccacctcttcctcaacaggctggccgccgcgtgcccggcgctcgtcgtgtccgtcgactaccgcctggcgcccgagcacccgctcccggccgggtacgacgactgcctcgccgcgctcaagtgggtgctctccgccgccgacccctgggtcgccgcgcacggggacctcgcacgcgtcttcgtcgccggggacagcgccggcggcaacgtctgccactacctcgccatccacccggacgtcgtcgtcgtcgccggcccgcagccgcggccgctcaagggcgccgtgctcatccacccctggttctggggctccgaggccgtgggcgaggagaccacggaccccgccgcgcgcgccatgggcgcgggactctggttcttcgcgtgcccggacaccagcggcatggacgacccgcggatgaaccccatggcgcccgccgcgccggggctccacacgctggcgtgcgaccgcgtgctggtgtgcgccgcggagggcgacttcctcaggtggcgcggccgcgcgtacgccgaggcggtggccgcggccaggggcggcggcggcggcggcctcggggacgccaacgccaacgccggcggcggcgtcgagctgctggagaccatgggagagggacacgtcttctacctcttcaaacccgactgcgataaggccaaggagatgatggacaagatggtcgctttcatcaatgcgccgtgatccgcgacaattgcgcttaatagtgttgcttttgtgtttatcgtggtctcagaatcaccgtgataggcatttatcgtgacattgtggaaaataaaataatggatttcagctgtttttgaaaatgttgcccacgcatcgacttgtcaacttctcgccaatttcattcacgtaaacaattggagtacgcgtacttcttcggtttatgcaggattgttatctatgctatttttatatttttaaagtaaaaattaaagtctaataaat

SEQ ID NO: 4101 - DNA, 1568 bp, Sorghum bicolor
gttccatccacgcaaacggacctcacctcagcgcgtccgctaccaaccaaccacccatcctcgccggccacgcgacgcgacgcgagcaaggcaaagcacgccaaagaagaagcggacgcaactccaacagccctcggttctcacttctcactccacacctccaccgtccacccacccagcctctcacgagcgtgtccgccatggcgtcgtccaagccttcgttatcgctccccttccccatccccgcccccgacccgtccgacgaggtcgtgcgcgagttcggcccgctgctccggatctacaagagcggccgcatcgagcggcccctggttgccccgcccgtggatcccggccacgacgccgccacgggggtccagtccaaggacgtccacctcggctcctactccgcccgcctctacctgccccccgtggccgcttccagcgccaagctgcccgtcgtcgtgtacgtccacggcggcggcttcgtggccgagtcggccgcgtcgccaggctaccacctcttcctcaacaggctggccgccgcgtgcccggcgctcgtcgtgtccgtcgactaccgcctggcgcccgagcacccgctcccggccgggtacgacgactgcctcgccgcgctcaagtgggtgctctccgccgccgacccctgggtcgccgcgcacggggacctcgcacgcgtcttcgtcgccggggacagcgccggcggcaacgtctgccactacctcgccatccacccggacgtcgtcgtcgtcgccggcccgcagccgcggccgctcaagggcgccgtgctcatccacccctggttctggggctccgaggccgtgggcgaggagaccacggaccccgccgcgcgcgccatgggcgcgggactctggttcttcgcgtgcccggacaccagcggcatggacgacccgcggatgaaccccatggcgcccgccgcgccggggctccacacgctggcgtgcgaccgcgtgctggtgtgcgccgcggagggcgacttcctcaggtggcgcggccgcgcgtacgccgaggcggtggccgcggccaggggcggcggcggcggcggcctcggggacgccaacgccaacgccggcggcggcgtcgagctgctggagaccatgggagagggacacgtcttctacctcttcaaacccgactgcgataaggccaaggagatgatggacaagatggtcgctttcatcaatgcgccgtgatccgcgacaattgcgcttaatagtgttgcttttgtgtttatcgtggtctcagaatcaccgtgataggcatttatcgtgacattgtggaaaataaaataatggatttcagctgtttttgaaaatgttgcccacgcatcgacttgtcaacttctcgccaatttcattcacgtaaacaattggagtacgcgtacttcttcggtttatgcaggattgttatctatgctatttttatatttttaaagtaaaaattaaagtctaataaatgtattatctagtttgctaaaatagtaagtttaccatattgtcctcgctacctatcctatacaaagtctattgtggcac

SEQ ID NO: 4102 - DNA, 2616 bp, Sorghum bicolor
ccgttgacgggcagacccttgttttctctgggccctcccctcccgtaccctcctttctccttcccttcccttccccctcccctcttctcccccgtcgccggcgagagctcgggcggaggcgctgtggcgcccgcaggagagcttttctccccgggaaacaagggaacctgcggagggctcttcttgacttcccccaagggcgggctgccgttggattgtgttgaaagatctcagttttatccccaaggaaggatttcttgtcgccaatccggatctatctgttggtggtggaaagttccctcttttatgaggcgaggaggctgtgtgaggaacccgtgtgcctcccatggatgcgctgctgaaccctgattggcgcaccaggcgagaaggggcagcaagcatcgggtggtgacagagcaggaagacgagggagaggagaggcagttagtatacaagagaagcaggcaaaaataggaaggacgaaggagaaggagaggagggagctctccatgggggagcccctcctcacctccctctccatggagaacagcaacagccacccctgcacgctgctctccatggaccctgctggctcgcacccggcctccgccgagtcctcaggtggtggcggtgttgccaccaatggggttggggttggggttggtagcggtggtgacagggaactcttcatcattccgcggcgtgagtcggcgcacccaggcccgccggacatcaacctcccgctctctgcagatcccttaccgccgcctccgtcatggagcctcgatacatttgacatacttgatgttactcttggaacacacaactatgagtctgaggttgcacttgcacttccaaagtcgacgggtaacagcaacggcaatggcagtgccactattggtgtcggcgcgaggaagtgtgctaagagaggagacagcatctggggtgcatggttcttctttaatcactacttcaagcctgcgcttgtggagaagcctaaggggaagatgacacgggatgcttccgggagcatctcgggcttcgacaagtctgatctccgccttgatgtcttcctggtgcagcatgacatggagaacatgtacatgtgggttttcaaggagcggcccgacaatgcccttgggaagatgcagctccggagcttcatgaatgggcattccaagcatggggagccatctttcccgttcagtgccgataagggctttgccaggtcacaccgtatgcagcggaagcactaccgtgggctatcgaacccgcagtgccttcatgggattgagatcgtgggctcaccaaatttgtcagcagttcctgaggcagacttgaagaggtgggctgaactgacaggcagggaacttaatttctcaataccatctgaagccagtgacttcgagtcatggaggaatcttcccagcactgattttgaacttgacaggccacatccaccggcagcaaagagtgccacacatggatctcatagccataagaagggattgaacggttcaggtctcaacctttcaactccgccatcatcagatgatgggatggacctttcaccaaaatgtgccaaacgccgcaaggatttctttggccatagtgtagaggaggactgtgtgatggcaaacaattcttgttctgacagagagcaagaggtagaagctcacactggtgagccatcatggatgcacgagttcactggtgtggccaagcatgcaagtgggcctgtcactgctgccaagacgatatacgaggatgaggaagggtacttaatcgtggtgagcatgcttttctctgatccacatagcgtcaaggtgtcctggaggaacacgctgacgcatggcatcgtgaagataacatgcgtgagcactgcccggatgccctacatcaagagacatgacaggatgttcaagctgacggaccctttccccgagcactgccctcctggtgagtttgtgagagagatacctctggccacacggattccagaagatgcaaagattgaggcgtattatgatgagacaggaactgggctggaaatcatggtcccaaagcaccgggttggaccagaggagcatgaagttcaggtgtgcatgaggcccccacatcttggtgacaacgatcttgtgctatcctagaacaggaaaacagttagcttttagatctcccagtgtcatgctcatgccattagatgctggaatgtaacaggtggtgccatggatcagtaagagccatcatatttgctgctaaacatgtagcttataagttgagaattcctttttccccataaaagttggtgatttaggcaaaagttacctccccctacctctgtcaattcccctctgtacctctgttacacaagtaaatcactattggtgatcttccttgactatctgaaagctggctagttgagattctgtgtatattcagatgaccaggttcgtaataatgttgatggctacctatgattttgaggtttggaatcatgttgtcgatttcgaaaattatttgtaatgattgccttaactgttttaatgttcctatctcgctttcatcagagattgaatcagaacatgatgtggttgctgtattcagattgataca

SEQ ID NO: 4103 - DNA, 3653 bp, Sorghum bicolor
cgcccagctgcatctacgatagtgatcgatttagccaaggttccccgttcatctttttattgtgatgacaagaaaaaaatagcgaagatccagccaagaacacctgcgcctttcctttccttggaggagaagcgagggaacgaaacgagacgaacgcggttgcaggttgcgacccgcaatggactagcggacccgaatccgttgacgggcagacccttgttttctctgggccctcccctcccgtaccctcctttctccttcccttcccttccccctcccctcttctcccccgtcgccggcgagagctcgggcggaggcgctgtggcgcccgcaggagagcttttctccccgggaaacaagggaacctgcggagggctcttcttgacttcccccaagggcgggctgccgttggattgtgttgaaagatctcagttttatccccaaggaaggatttcttgtcgccaatccggatctatctgttggtggtggaaagttccctcttttatgaggcgaggaggctgtgtgaggaacccgtgtgcctcccatggatgcgctgctgaaccctgattggcgcaccaggcgagaaggggcagcaagcatcgggtggtgacagagcaggaagacgagggagaggagaggcagttagtatacaagagaagcaggcaaaaataggaaggacgaaggagaaggagaggagggagctctccatgggggagcccctcctcacctccctctccatggagaacagcaacagccacccctgcacgctgctctccatggaccctgctggctcgcacccggcctccgccgagtcctcaggtggtggcggtgttgccaccaatggggttggggttggggttggtagcggtggtgacagggaactcttcatcattccgcggcgtgagtcggcgcacccaggcccgccggacatcaacctcccgctctctgcagatcccttaccgccgcctccgtcatggagcctcgatacatttgacatacttgatgttactcttggaacacacaactatgagtctgaggttgcacttgcacttccaaagtcgacgggtaacagcaacggcaatggcagtgccactattggtgtcggcgcgaggaagtgtgctaagagaggagacagcatctggggtgcatggttcttctttaatcactacttcaagcctgcgcttgtggagaagcctaaggggaagatgacacgggatgcttccgggagcatctcgggcttcgacaagtctgatctccgccttgatgtcttcctggtgcagcatgacatggagaacatgtacatgtgggttttcaaggagcggcccgacaatgcccttgggaagatgcagctccggagcttcatgaatgggcattccaagcatggggagccatctttcccgttcagtgccgataagggctttgccaggtcacaccgtatgcagcggaagcactaccgtgggctatcgaacccgcagtgccttcatgggattgagatcgtgggctcaccaaatttgtcagcagttcctgaggcagacttgaagaggtgggctgaactgacaggcagggaacttaatttctcaataccatctgaagccagtgacttcgagtcatggaggaatcttcccagcactgattttgaacttgacaggccacatccaccggcagcaaagagtgccacacatggatctcatagccataagaagggattgaacggttcaggtctcaacctttcaactccgccatcatcagatgatgggatggacctttcaccaaaatgtgccaaacgccgcaaggatttctttggccatagtgtagaggaggactgtgtgatggcaaacaattcttgttctgacagagagcaagaggtagaagctcacactggtgagccatcatggatgcacgagttcactggtgtggccaagcatgcaagtgggcctgtcactgctgccaagacgatatacgaggatgaggaagggtacttaatcgtggtgagcatgcttttctctgatccacatagcgtcaaggtgtcctggaggaacacgctgacgcatggcatcgtgaagataacatgcgtgagcactgcccggatgccctacatcaagagacatgacaggatgttcaagctgacggaccctttccccgagcactgccctcctggtgagtttgtgagagagatacctctggccacacggattccagaagatgcaaagattgaggcgtattatgatgagacaggaactgggctggaaatcatggtcccaaagcaccgggttggaccagaggagcatgaagttcaggtgtgcatgaggcccccacatcttggtgacaacgatcttgtgctatcctagaacaggaaaacagttagcttttagatctcccagtgtcatgctcatgccattagatgctggaatgtaacaggtggtgccatggatcagtaagagccatcatatttgctgctaaacatgtagcttataagttgagaattcctttttccccataaaagttggtgatttaggcaaaagttacctccccctacctctgtcaattcccctctgtacctctgttacacaagtaaatcactattggtgatcttccttgactatctgaaagctggctagttgagattctgtgtatattcagatgaccaggttcgtaataatgttgatggctacctatgattttgaggtttggaatcatgttgtcgatttcgaaaattatttgtaatgattgccttaactgttttaatgttcctatctcgctttcatcagagattgaatcagaacatgatgtggttgctgtattcagattgatacactcatatgcacgtcatttcgactgattcctgtttgcatcctggtactgaactactgatgagaaactggtgtttttgcaagcagtaaacaatcttatgtttccttcagcctagcctgcagttttgctcaactcggatgctgcggattgtgatgtctaactgacctgtgcccaacaaagatctctctctacttggttgtgagaagcaggatattttctggcttttcagtggccggcactgcaccatgcggccacgcagtgtatgtgtagtttaccacgagaggtctgtgtaccgaaagcaacgtcgaatatgctttcagcgatgcagctgatggttgtgtgtggacgggagcaggcgaatggatcagtggatgcccgggtggcgggatgacagccggaaatgggtttggtttgtgctttgcagccggtgacgtctctgcagcgttgcccatgcatcagaactcggaagagatcatggcaccaggaccaggtgatttctgaacatcgatgatggtgtctgaaccgagttggcaatcccatatactgattttatgaagagtaaagtccactaccggtccctaaacttgtgctgtcgtgtcatcccagtccctaaactcacaaatcgattgtttaggtcctcaaacttgtttatctgtgtcatctcggtctctaaacttgttcaattgtgtcaccctggtctcgaaacttagaaatcatccgtttagagttgttcagttgtgtcatctcggtccctaagcttggttttgaatctcatttgggtcaaaacaaagcgatctaacaactctatatcaaaaaataattcataactttttcatatgaac

SEQ ID NO: 4104 - DNA, 2429 bp, Zea mays
cgcgtcttttctcctcccttcccgtattttctgctccccccttctcccccgtcgccggcgagagctcgggcggaggcgccacagcacccgcaggagagcgtttctccccgggaaaaagggggccctccggagcggagggctctttcttcctctattccccaagggctgctgccgctggattgggctgaaagatctcggttctatttccgaaagaaggatttctcgtcgcgaatccggatctgtcggtggtgggaagttgcctcttttatgtggcgaggctgtgagaaacccgtgtgcctcccatggacgtgctgagccctgattggcgcaccaggcgagaaaggggcagcaggcagtaggtggtgacagagcaggaagacgagggagaggagacagactgtcggtatagaagacatcaagacaagcaggcgacaataggaaggacaaaggagaaggagaggagggagctctccatgggggagcccctcctcacctccctctccatggaaaacagcaacagccacccctgcacgctcctctccatggaccctgccggttcacgcccggcctctgctgagtcttcgggtggtggcggcgctgccaccaatggggttggcagtggtggtgatagggaactcttcatcgttccacggcgtgagtcggcgcacccaggcccgccagacatcaacctcccgctctctgcagatcccttaccgccacctccgtcgtggagcctcgacacgtttgacatacttgatgtcactcttggaacacacaattatgagtccgaggtcgcgcttacgcttccaaagtcgaccggcaacggcaatggcagtgctactgctactgtcagtgtcggcacgaggaagtgtgctaagagaggagacagcatctggggtgcatggttcttcttcaatcactacttcaagcctgctcttgtggagaagccaaaggggaaggtgacgcgagacgcgtctgggagcatctcgggcttcgacaagtccgatctacgccttgatgtcttcctggtgcagcatgacatggagaacatgtacatgtgggttttcaaggagcggcccgacaatgcccttgggaagatgcagctcaggagcttcatgaatgggcattccaagcacggggagccgtctttcccattcagtgccgataagggcttttccaggtcacaccgcatgcagcgaaagcaataccgggggctttcgaacccgcagtgccttcatgggattgagatcgtgggctcaccgaatttgtcagcagttcctgatgcagacttgaagaggtgggctgaactgacaggcagggaacttaatttctcaataccatctgaagccagcgacttcgaggcatggagaaatcttcccagcactgattttgaacttgacaggccacatccaccggcagcaaagagtgccactcatggatctcatagccataagaagggattgaatggttcaggtcttaacctttcaactccaccatcatcagacgatgggatggacctttcaccaaaatgtgccaaacgccgcaagggtttctttggccatggcgtagaggaggactgtgtgatggcaaacaattcttgttctgacagagagcaagaggtagaagctcacgcgggcgagccatcatggatgcacgagttcaccggtgttgccaagcacgcaagcgggcctgtcactgctgccaagacaatatacgaggacgaggaagggtacctaatcgtggtgagcatgcttttctccgacccgcatagcgtcaaggtgtcctggaggaacacgctcacgcatggcatcgtgaagataacgtgcgtgagcactgcccggatgccctacatcaagagacacgacaggacgttcaagctgacggacccttcccccgagcactgccctcccggcgagtttgtgagggagatacctctggccacaaggattccagaagacgcgaagatcgaggcgtattacgacgagacgggaactggactggaaatcatggtcccaaagcaccgggttggaccggaggagcatgaagttcgggtgtgcatgaggcccccgcatcttggcgacagcgatcttgtgctatcctagaacgaggaaaacaggtagctttcggattttccagtgccatgtttattgccatgagatactcgaacgtaacaggtggtgccatggatcagtgagagccatcatatttgctgctaaacatgtagcttataagttgagaaattcttttcctccataaggccccgttcggttaggctggaataagactaggaactattccaggtgaccaattgttatactgcaaattatacagttattcctgctgggatcctttctggaggagattcctgaataaccgagcgggccctccaagttctgtggtttaggcgaaagttacctcctacctctgtt

SEQ ID NO: 4105 - DNA, 2547 bp, Setaria italica
ccgttgacaccccggacccctgttgcctcttcttctctgggccctccctacctgtcctcccctttctcctcctcctccccttccggcctacccctctccctccccgtcgccggcgagagctcgggcggagacgccgcagcccccgcaggagagcttctccccggggaaacaaggggcttccggaaggttcttcctcccccaagggttgttcctatcagattggcctgagagatctcaattttattccgaagaaggggtttctcaccacaaatcccgatctactggtgatagagagctccatctttgatgagacgaggctgcggaaaacccgtgggcctcccatggtcgtggtgaaccttgattggcgcatcaggcgagaaggggcagcagccagcaggaggtgacagagcaagaagaagaggtagctgagaagtaggcaacaataggaaggacgaaggagaaggagaggagggagctctccatgggggagcccctcctcacctccctctccatggagaacagcaacagccacccctgcacgcgcctctccatggaccctgcaggctcgcacccggcctccactgggtcctccggtggcggcggtgccaccaatggggttggtagtggtggtgacagggaacccttcgtcattcctctgcgtgagtcggcgcgccctggtgcgccagacatcaacctcccgctttctgcagatccctcccagccacctccatcgtggagccttgacgcgttcgagatacttgatgtcactcttggaacacataactatgaatctgaggttgtgcttacacttccaaagtcgactggcaatggcagtgccactgtcggtgtcggcgcgaggaagtgtgctaagcgaggagacagcatttggggtgcatggttcttcttcaatcactacttcaggcctgcgcttgtggagaagccaaagggcaaggtgacacgagacgcgtccgggtgcatctcgggcttcgacaagtctgacctccgcctcgatgtcttcctggtgcagcacgacatggagaacatgtacatgtgggttttcaaggagcggcctgacaatgcccttggcaagatgcagctccggagtttcatgaatgggcattccaagcatggggagccctctttcccattcagtgctgacaagggctttgcaaggtcacaccgcatgcagagaaagcattaccgagggctgtcaaacccgcagtgccttcatgggattgaaattgtggtctcaccaaatttatcagcagttcctgaagccgaattgaagaggtgggctgaacttacaggcagggaacttaatttctcaataccatctgaagccagtgactttgagtcatggaggaatcttccgagcactgattttgaacttgacaggccacatccaccggcatcaaagagtgccgcacatggatctcatagtcacaagaagggactgaatggttcaggtctcaacctatcaactccaccatcatcagatgatgggatggacctttcacccaaatgtgccaaacggcgcaaggatttctttggccatggtgtggaggaggactgtgtgatggcaaacaattcgtgttctgacagagagcaagaggtagaagctcatactggcgagccatcatggatgcatgagttcactggtgttgcaaaacatgcaagcgggcctgtcactgctgccaagacgatatatgaggatgatgaaggttacttaatcgtggtgagcatgctcttctccgacccacacagtgtcagggtgacttggaggaacacgctgactcatggcattgtgaagataacatgcgtgagcaccgcccgtatgcccgttatcaagaggcatgacaggacattcaagctgacagaccctttccccgagcactgccctcccggcgagtttgtgagggagatacctctggccacccggattccagaagatgcaaagattgaggcgtattatgatgagacaggaactggactagaaatcatggttccaaagcaccgggttggaccagaggagcatgaagttcaggtgtgcatgaggcccccgcaccttggcgacaacgatcttgttttatcatagaagagaggaacagttagcctatagatcttctggtatcttgccatgagataccagaatgtaacaggtcgtgccatggatcagtcaaatccatcatcttttgctgctaaacatgtagttataagttgatgaacttctgtttccccccataaaagttggtgatttaggcaaaagtttacctccgttaattcccctctgtacctctgttacccatcactatattggtgatctccttgactatctgaaaggcggctagttaagattctgtgtatattgagatgatctggccataataatgttgatgtctactacctatgattgtgaggtttggaatcgcgcagtcgatttcgacaaattgtctgtaatcattgccttaaccgttttaatgtggctgtctcgctttcatccgaaaccaaatcagtatctgatgtgttgatgtattcatgattgatgca

SEQ ID NO: 4106 - DNA, 2014 bp, Secale cereale
cggtggtaggaggagatacagcagaggcaggagaagaagagcaagcaaggataggcaggaccaggaaaaggagaggagggagctctccatgggaggagagcccctcctcacttccctctccatggagaacagcaacagccatccctgcaccctcctctccatggaccccgcggggtcgcacccggcctcggccgactcctccggcggtggtggcgccgtcaacggggttggtgccggtgctgacagggaactcttcatcattccgcggcacgagtctgtgcgtcaaggcccgccggacatcaacgtcccgctgtcagcagacccctccccgccgcctgcattgtggagccttgacacgttcgacattttcgatgtcggccttggcacgcacacccatgagtctgaggttgcgctgacgcttccaaagtcgagtggcaatggcagtgccgcagtcggcgtcggtgcgaggaagtgcgctaagaggggggacagcatttggggggcttggttcttcttcaatcactacttcaggcctgcacttgtggagaaggcaaaggagaaggtgacgcgggacgcatctgggagcatcaccggctttgacaagtccgatctccgccttgatgtcttcctggtgcagcatgacatggagaacttgtacatgtgggtttttaaggaacggcctgacaatgcccttgggaagatgcagctccggagtttcatgaatgggcattccaagcacggggagccatcttttccgttcagtgcggacaagggcttttcgaggtcgcaccgcatgcagcgaaagcactaccgtggtctgtccaacccacagtgccttcatgggattgagattgtgaactcgccaaacttgtcggcagttcctgaggctgacatgaagaggtgggctgagcttacaggaagggagcttaatttctcgataccgtctgaagcgagtgactttgagtcatggaggaatcttccaagcactgattttgaacttgataggccacagccagcagtgtcaaagagtgtcgcacatacctctcataataataatcacaagaaggcactgaatggttcaggtctgaacctgtctacaccaccgtcatcagacgatgggatggacctttcaccaaagtgccacaaacgccgcaaggacttctttggtcatggcgtagaagaggattgtgcgatggccaataattcctgttccgagagagagcaagaggtagaagtacacaccggtgagccgtcatggatgcacgacttcactggcgtggcaaagcacgcaagtgggcctgttactgctgccaagacgatatacgaggatgatgaaggctacctgatcatggtgagcatgctcttatccgatccacacagcgtgaaggtcacctggaggaacacgctgacgcacggcgtcgtgaagataacatgtgtgagcaccgcccgcatgcccttcgtcaagaggcacgacaggaccttcaagctgacagacccttcccctgagcactgccctcccggcgagtttgtgagggagatacctctggccacaaggatcccagagaacgccaagatcgaagcgtattatgacgagaccggtactggactggagatcatggtaccgaagcaccgggttgggccggaggagcatgaagtccaggtttgcatgaggcccccgcatcttggcgacaatgatctcgttttatcataatagaacaggaaaagaaacattttagcctcttactaggtcctccggtgtcatgccatgagacaccggagcatagcagcaacgctatcatcatgtccaacttatttgtctcccttaggcggaaaattaccttctcccctgttaatcccctctgtactttctttctacacaggtgctacatcactacattggtggtgatccccttgactattccttcctgtgaaacatggcaaagctaatagtactcgtatatattctgtccctgtatattccgaggatcgggttcataataatgtggacagaact

SEQ ID NO: 4107 - DNA, 1895 bp, Triticum aestivum
ctctccatgggaggagagcccctcctcacctccctctccatggagaacagcaatagccatccctgcaccctcctctccatggaccccgccgggtcgcacccggcctcggccgagtcctccggcggtggcggcgccgtcaacggggttggcgccagtgctgacagggagctcttcatcattccgcggcatgagtctgtgcgtcaaggcccgccagacatcaacgtcccgctgtcagcagacccctccccgccgcctgcattgtggagccttgacacgttcgacattttcgatgtcggccttggcacgcacactcatgagtctgaggttgcgctgacgcttccaaagtcgagcggcaacggcagtgccgcagtcggcgtcggtgcgaggaagtgcgctaagaggggggacagcatttggggagcctggttcttcttcaatcactacttcaggcctgcacttgtggagaaggcaaaggagaaggtgacgcgcgacgcatctgggagcatcactggctttgacaagtccgatctccgccttgatgttttcctggtgcagcatgacatggagaacttgtacatgtgggtttttaaggaacggcctgacaatgcccttgggaagatgcagctccggagtttcatgaatgggcattccaagcacggggagccatcttttccattcagtgcggacaagggcttttcaaggtcgcaccgcatgcagcgaaagcactaccgtggtctgtccaacccacagtgccttcatgggattgagattgtgaactcaccaaacttgtcggcagttcctgaggctgacatgaagaggtgggctgagcttacaggaagggaccttaatttctcaataccggctgaagcgagtgactttgagtcatggagaaatcttccaagcactgattttgaacttgataggccacagccagcagcgtcaaagagcgtcgcacatacctctcataataataaccacaagaagacactgaatggttcaggtctgaacctatctacaccgccgtcatcagacgatgggatggacctttcaccaaagtgccacaaacgccgcaaggacttctttggtcatggcgtagaagaggattgtgcgatggccaataattcatgttccgagagagagcaagaggtagaagtccacaccggtgagccgtcatggatgcacgacttcactggcgtggcaaagcacgcaagtgggcctgttactgctgccaagacgatatacgaggatgatgaaggctacctgatcatggtgagcatgctcttatccgatccacacagcgtgaaggtcacctggaggaacacgctgacgcacggcgtcgtgaagataacatgtgtgagcaccgcccgcatgcccttcatcaagaggcacgacaggaccttcaagctgaccgacccttcccctgagcactgccctcctggcgagttcgtgagggagatacctctggccacaaggatcccagagaacgccaagatcgaagcgtattacgacgagaccggtactggactggagatcatggtaccaaagcaccgggtcggaccggaggagcatgaagtccaggtttgcatgaggcccccgcatcttggcgacaatgatctcgttttatcataatagaacaggaaaaaaaagattttagcctcttactaggtcctccggtgtcatgccatgagacaccggaacatagcagcaacgctatcgtcatgtccaacttatttgtctcccttaggcggaaaattaccttctcccctgttaatcccctctgtactttctttctacacaggtgctacatcactacattggtggtgatccccttgactattcctttctgtgaaacatggcaaagctaatagtagtatatattccctgtcccctgtata

SEQ ID NO: 4108 - DNA, 2700 bp, Triticum aestivum
cacagattcaaaaattccaatctcccctcctcccctctccgctccgcccccgcgtctccggcgagggctcaggccgcggccccgccgacccgcgcaccttccttgcgagagcgcctcctccacgggaacagcggcctcgcgggagctcccttctccccccccaaggtctgcggcgccggattggcctcatcagctcgaagatctcgaacttgtttccaaggaaggaaggaaccctcgtcgcaaatctcgatctgtggattggtgggcagaaagactcgccttttatggggcaaccccgtgagaaacccgtgccatgattggggcgtcaggggaggagaggcagtggtaggaggaggtgcagcaggaggcaggagaaaaagagcaggcaaggataggcaggaccaaggacaaggagaggagggagctctccatgggaggagagcccctcctcacctccctctccatggagaacagcaacagccatccctgcaccctcctctccatggacccggcggggtcgcacccggcctcagccgagtcatccggcggtggcggcgccgtcaacggggttggcgccagtgctgacagggaactcttcatcattccgcggcacgagtctgtgcgtcaaggcccgccggacatcaacgtcccgctgtcagcagacccctccccgccgcctgcattgtggagccttgacacgttcgacattttcgatgtcggccttggcacgcacacccatgagtctgaggttgcgctgacccttccaaagtcgagcggcaatggcagtgccgcagtcggcgtcggcgcgaggaagtgcgccaagaggggggacagcatttggggagcctggttcttcttcaatcactacttcaggcctgcactcgtggagaaggcaaaggagaaggtgacgcgggacgcatctgggagcatcaccggctttgacaagtccgatctccgccttgatgtcttcctggtgcagcatgacatggagaacttgtacatgtgggtttttaaggaacggcctgacaatgcccttgggaagatgcagctccggagtttcatgaatgggcattccaagcacggggagccatcttttccattcagtgcggacaagggcttttcgaggtcgcaccgcatgcagcgaaagcactaccgtggtctgtccaacccacagtgccttcatggcattgagattgtgaactcaccaaacttgtcggcagttcctgaggctgacatgaagaggtgggctgagcttacaggaagggaccttaatttctcaataccggctgaagcgagtgactttgagtcatggagaaatcttccaagcactgattttgaacttgataggccacagccagcagcgtcaaagagcgtcgcacatacctctcataataataatcacaagaaggcactgaatggttcaggtctgaacctatctacaccaccgtcatcagacgatgggatggacctttcaccaaagtgccacaaacgccgcaaggacttctttggtcatggcgtagaagaggattgtgcgatggccaataattcatgttccgagagagagcaagaggtagaagtccacaccggtgagccgtcatggatgcatgacttcactggcgtggcaaagcacgcaagtgggcctgttactgctgccaagacgatatacgaggatgatgaaggctacctgataatggtgagcatgctcttatccgatccacacagcgtgaaggtcacctggaggaacacgctgacgcacggcgtcgtgaagataacatgtgtgagcaccgcccgcatgcccttcatcaagaggcacgacaggaccttcaagctgaccgacccttcccctgagcactgccctcccggcgagttcgtgagggagatacctctggccacaaggatcccagagaacgccaagatcgaagcgtattacgacgagaccggtactggactggagatcatggtaccaaagcaccgggtcggaccggaggagcatgaagtccaggtttgcatgaggcccccgcatcttggcgacaatgatctcgttttatcataatagaacaggaaaaaaaacattttagcctcttactaggtcatccggtgtcatgccatgaggcaccggagcatagcagcaaagctatcatcatgccatggatcaaaaatcggaaattttctttcggcactgaacattagtcgcacttatctgtctgtctgtctcccttaggcggaaaattacctcttcctcctctgttaattcccctctgtactttctttctatacaggtgctacatcactacattggtggtgatccccttgactattcctttctgtgaaacatggcaaagctaatagtagtatatattctgtccctgtatattccgagaattgggttcataataatgtggacagctactactcatgagcagagtctgtcgatatcgctgttgtaatcattgtcctaggcatcttagcatacttgtatgtgtcgtactacataggtatggcctggatcgctctcggcataaatgggaacttaagattctgttgcctgaatctgtgcccgcaccttggttattcctgctgatgaccagggctcggttttcggcagcggtaatactgaatctcgctgctcctggctcgctccagcacgaaattctcagtttcatccgtacttgtgggtgatgctgtgtgagcaaataagaa

SEQ ID NO: 4109 - DNA, 2639 bp, Hordeum vulgare
aacgcggttgcaggttgcgagttgcgacccgcaacgagacgagccgagacccgaacccgctgacgccacccctcttcttctttggctggcccgcccccctccctctccccctctctcttcccctccacgctccgccccccgcgtctccggcgagagctcaggccgcggccccgtcgacccgcgcaccttctccgggagagcgcctcctccacgggaacagcggcctcgcggaagctcccttctccgctccttccaaggtctgcggcgtcggattggccttcagctcgaagatctcgattttgtttccaaacaaggaagggctcctggtcacaaatctcgatctgtggattggtgggcagaaaggctcaccttttatggggcaaccccgtgagaaacccgtgccatgactggggcgtcaggggaggagaggcagtaggaggaggaggtacagcaggaggcaggagaagaagagcaggcaaggataggaaggaccaaggaaaaggagaggagggagctctccatgggaggagagcccctcctcacctccctctccatggagaacagcaacagccatccctgcaccctcctctccatggaccccgcggggtcgcacccggcctcggccgactcctccggcggcgggggcggcgttaacggggttggcgccagtgctgacagggaactcttcatcattccgcggcacgagtctgtgcgtcaaggcccgccggacattaacgtcccgctgtcagcagacccctccccgccgcctgtgttgtggagccttgacacatttgacattttcgatgtcggccttggcacgcacactcatgagtctgaggttgcgctgacacttccaaaggcgactggcaacggcagtgccgcggtcggcgttggcgcgaggaagtgcgctaagaggggtgacagcatttggggagcttggttcttcttcaatcactacttcaggcctgcacttgtggagaaggcaaaggagaaggtgacgcgggacgcatctgggagcatctccggctttgacaagtccgatctccgccttgatgtcttcctggtgcagcatgacatggagaacttgtacatgtgggtttttaaggaacggcctgacaatgcccttgggaagatgcagctccggagtttcatgaatgggcattccaagcacggggagccatcttttcccttcagtgcggacaagggcttttcaaggtcgcaccgcatgcagcgaaagcactaccgtggtctgtccaacccacagtgccttcatggcattgagattgtgaattcaccaaacttgacagcagttcctgaggctgacatgaagaggtgggctgaacttacaggaagggagcttaatttctcaataccatctgaagccagtgactttgagtcatggaggaatcttccaagcactgattttgagcttgataggccacagccagcagcatcaaagagtgtcgcacatacctctcataataataataatcacaagaaggcactgaatggttcaggtctgaacctatctacaccgccgtcatcagatgatgggatggacctttcaccaaagtgccacaaacgtcgcaaggacttctttggtcatggcgtagaagaggattgtgtgatggccaataattcctgttccgacagagagcaagaggtagaagtacacaccggtgagccgtcgtggatgcacgacttcactggcgtggcaaagcacgcaagtgggcctgttactgctgccaagacgatatacgaggatgatgaaggctacctgatcatggtgagcatgctcttatccgatccacacagcgtgaaggtcacctggaggaacacattgacgcacggcgtcgtgaagataacatgtgtgagcaccgcccgcatgcccttcgtcaagaggcacgacaggaccttcaagctgaccgacccttcccctgagcactgccctcccggtgagttcgtgagggaaatacctctggccacaaggattccagagaacgcaaggatcgaggcgtattacgacgagaccggtactgggctggagatcatggtcccgaagcaccgtgtcgggccggaggagcatgaagttcaggtttgcatgaggcccccgcatcttggcgacaatgatctcattttatcataatagaacaggaaagaaagcaatttagcttcttactaggtcatccggtgtcatgccatgagacaccggaacatagcagcaaagctatcatcatgtccaacttatttgtctcccttaggcggaaaattacctcctcccctgttaattcccctctgtactttctttctacacaggtgttacatcactacattggtggtgatccccttgactattcctttctgtgaaacatggcaaagctaatagtagtatatattctgtccctgtatattccgaggatcgggttcataataatgtggacagctactactaatgagcagagtctgtcgacatcgctgttgtactcaatcaatggtcctaggcatcttagcatgtatcggactgtataggtatgacctggatcgctctcggcataaatgggaacttaagattctcggtttcattcttacttgggcgatgctgtgtgagcaaagaagaaggtgtttgcacatgtttgcag

SEQ ID NO: 4110 - DNA, 2847 bp, Secale cereale
gcgcaggccgcggccccgtcgacccgcgcaccttcctcgggagagcgcctcctccacgggagcaggggcctcgcggaggcttccttctccctcccccaaggtctgcggcgccggattggcctcggctcgaagatctcgattttgtttccaaggaaggacccctggtcgcaaatctcgatctgtggattggtgggcagaaagactcgccttttatggggcaacgccgtgagaaacccgtgccatgattggggcgtcaggggaggagaggcggtggtaggaggagatacagcaggaggcaggagaagaagagcaagcaaggataggcaggaccaaggaaaaggagaggagggagctctccatgggaggagagcccctcctcacctccctctccatggagaacagcaacagccatccctgcaccctcctctccatggaccccgcggggtcgcacccggcctcggctgactcctccggcggtggcggcgccgtcaacggggttggcgctggcgctgacagggaactcttcatcattccgcggcacgagtctgtgcgtcaaggcccgccggacatcaacgtcccgctgtcagcagacccctccccgccgcctgcattgtggagccttgacacgttcgacattttcgatgtcggccttggcacgcacacccatgagtctgaggttgcgctgacgcttccaaagtcgagcggcaacggcagtgcggccgcagtcggcgtcggtgcgaggaagtgcgctaagaggggggacagcatttggggggcttggttcttcttcaatcactacttcaggcctgcacttgtggagaaggcaaaggagaaggtgacgcgggacgcatctgggagcatcaccggctttgacaagtccgatctccggcttgatgtcttcctggtgcagcatgacatggagaacttgtacatgtgggtttttaaggaacggcctgacaatacccttgggaagatgcagctccggagtttcatgaatgggcattccaagcacggggagccatcgtttccgttcagtgcggacaagggcttttcgaggtcgcaccgcatgcagcgaaagcactaccgtggtctgtccaacccacagtgccttcatgggattgagattgtgaactcgccaaacttgtcggcagttcctgaggctgacatgaagaggtgggctgagcttacaggaagggagcttaatttctcgataccgtctgaagcgagtgactttgagtcatggaggaatcttccaagcactgattttgaacttgataggccacagccagcagtgtcaaagagcgtcgcacatacctctcataataataatcacaagaaggcactgaatggttcaggtctgaacctatctacaccaccgtcatctgatgatgggatggacctttcaccaaagtgccacaaacgccgcaaggacttctttggtcatggcgtagaagaggattgtgcgatggccaataattcctgttccgagagagagcaagaggtagaagtacacaccggcgagccgtcatggatgcacgacttcactggcgtggcaaagcacgcaagtgggcctgttactgctgccaagacgatatacgaggatgatgaaggctacctgatcatggtgagcatgctcttatcagatccgcacagcgtgaaggtcacctggaggaacacgctgacgcacggcgtcgtgaagataacatgtgtgagcaccgcccgcatgcccttcgtcaagaggcacgacaggaccttcaagctgacagacccttcccctgagcactgccctcccggcgagtttgtgagggagatacctctggccacaaggatcccagagaacgccaagatcgaagcgtattatgacgagaccggtactggactggagatcatggtaccgaagcaccgggtcgggccggaggagcatgaagtccaggtttgcatgaggcccccgcatcttggcgacaatgatctcgttttatcataatagaacaggaaaaaaaatattttagcctcttactaggtcctccggtgtcatgccatgagacaccggagcatagcagcaacgctatcatcatgtccaacttatttgtctcccttaggtggaaaattaccttctcccctgttaatcccctctgtactttctttctacacaggtgctacatcactacattggtggtgatccccttgactattccttcctgtgaaacatggcaaagctaatagtactcgtatatattctgtccctgtatattccgaggatcgggttcataataatgtggacagctactactcatgagcagagtctgtcgatatcgctgttgtaatcattgtcctaggcatcttagcatacttgcatgtatcgtactatataggtatggcctggatcgctctcggcataaatgggaacttaagattctgttgactgaatctgtgctcccaccttggttattcctggcgatgaccagggcttggttttcggcagcggtgatactgaatctcgccgctcctggctcgctctagcacaaaattctgggtgatgccgtgtgagcaaataagaagatatgtgagtacaaaggtatatctgctgagacttgatagaggatctttcttgactgacatgtggctgaattattagtgatgttcagagctcagttttttatctccttcttttttggggtgagaaagagcttcggtttttgcagcggtaacaaaatctcaccgtttgtcgctcaactcgggatgcatttctcggtttatcctgacttgtgggtgatctctggttcatcctgtgtaagcgaaggagaccactttcccacatctgcggtgcaaggatacatacgtcgcggg

SEQ ID NO: 4111 - DNA, 2815 bp, Brachypodium distachyon
acgcggtggtagcaggttacgagttgcgacccgcaacgagacccgaacccacgaccaaccccagtcttcttctcctgttcccctcctcctcttctccggcgagagctcaggccaagtctcaagcctgtccgcagagagagagagagagagagagagagagagcgagggagggagggagaggagagctcctcctcctccacgggaacaggggcatctccaagcttccttctttcttgcccccacaaggtcactgacgtcggattggcctcaaagatcccagttttattaggaaggattcgttgtcacaagtctgttctgtgtggattggtggttgagagattcattcattcaccttttgatggggcaatcccgtgaggatcccgtgcagctcccatggataatggttggggaggagaggaggcagtagggggggcaacagcaagaggtagaagaagagaggccagtaataataggaaggaccaaggaaaaggagaggagggagatctccatgggaggagaacccctcctcacctccctgtcgatggagaacaacagcaacaacagccacccttgtaccctactctccatggacactgccgggtcacacccggcctcagccgagtcctccggtggtggtggtgtcgtcaatgggagtgctgttggtgctggtggtggtgatagggagctcttcgttattcctcggcatgagtctgtgcgccgtcatgggccgccggacatcaacctcccgctctctgcagacccctctccgccacctacgtcgtggagccttgacccgtttgatatccttgatgttggccttggcacgcagacttatgagtctgaggttgcgctcacgcttccaccaaagtcgagtggcaacggtggcagtgctgctgttggtgtcggtgcgaggaagtgtgctaagaggggggacagcatttggggagcatggttcttcttcgatcactacttcaggcctgcgcttgtggagaagccaaaggggaaggtgacgcgcgacgcgtccggtagcatctctggctttgacaagtccgatctccgccttgatgtcttcctggtgcagcatgacatggagaacatgtacatgtgggtttttaaggaacggcctgacagtgctcttggcaagatgcagctccggagtttcatgaacgggcactccaagcatggggagccgtctttcccgttcagtgcggacaagggcttttcaaggtcgcaccgcatgcagcggaagcactaccgtggtctctccaacccacagtgccttcatggaattgagattgtgaactcaccaaacttatcagcggtccctgaagccgacatgaagaggtgggctgaacttacaggaagggagattaatttctcaataccgcctgaagccagtgactttgagtcatggaggaatcttccaagcactgatttcgaacttgataggccacagccaccatcatcaaagactatcgcacatagctctcataatcataagaaagcactgaatggttcaggtcttaacctgtctactccaccctcatcagatgatgggatggatctttcaccaaaatgcgccaaacgccgcaaggatttgtttggtcattgtgctgaagaggactgtgtgatggcaaacaattcttgttccgacagagagcaagaggtagaagtccataccgtcaccggtgaaccatcatggatgcacgatttcactggcgtggcaaagcatgcaagtgggcctgttacagctgccaagacaatatacgaggatgacgaaggatacctgattatggtgagcatgctcttctctgatccacacagcgtgaaggtttcctggaggaacacgctgacgcatggcatcgtgaagatatcatgtgtaagcacggctcgcatgcccttcgtgaagaggcatgacaggatgttcaagctgacggaccctgcacccgagcactgccctcctggcgagtttgtgagggagataccactggccacaaggatcccagagaatgcaaagctcgaagcgtattacgacgagaccggtactgggctggagatcatggtcccgaagcacagggtaggaccagaggagcatgaagtccaggtttgcatgaggcccccgcatcttggtgacagtgatcttgttttatcatagaacagaaaaagaacatttagtcttcttaggccttctggtgtcgtcatgcgcgagatgccggaacataacaagtcatcatgccatggatcagtggaatttttctcttttggcgctaaacattagtcgaacctatctctctgcctcccttaggcaaaagttacctcaccctctgttaattctcccctctgtactttttacacaggtacattgctcactatattggtgatcccccttgactactcctttctatgaaacatggcattagcaagttgataataatactagtagtactctgtctgtgtattattctgagtatcatgttcataataatgcagatagctactactcatgagcagatgctcagaactgtgctgtcgatttcgccatcgtttcttcttgtaataattgtctcaaccattcttttagcgtacttgtatattgcaatatgacccggatcgctttcaggaatctgaaaactcatattgcagccgctgtattcatttgatggacggtatgctgtatccacactagtaaacatatcatcatttttggggggcttagtgcaggttaaacatctatatcatcatggtgagcaagcaagcaaagaagaccttttctttgacctgagatgagactcagagatgatatttgttggcttag

SEQ ID NO: 4112 - DNA, 2684 bp, Oryza sativa
cccaatatctctaaaattactggacacggttgcattctgcgacccgcaaacgacttttggatccgtaacccgttgacacccgcgacccctgttttcgcttttctttgggccctcctctctcctctctctcttcctccattgttcccctcctccccttctctcccctctcctcctcgcttccggcgagaagctccggcgaggcgaagcctccagaaccttcaggagagctcctcaccgaagggacaaggggccttctagaaccttgctgcttcctcccccaaaggcttgcagcgctggattggctccgaagatcttaattttgctccaaaggaaggatcccccatcgcaaatcttgatctgtgggtggatttggtgggttgaaaactccatcttttatggggcaaggctatgcgaaatccttgatgctcccatggagttctcctcccatggggcaagaggtgaagaggcagtagatagaggaggagcaagaggtggaagcgaagagaagtaggtgagaataggaaggacgaaggataaggagaggagggagctctccatgggagagcccctcctcaccaccctgtccatggagaacaccaacagccatccctgcacccgcctctccatggatcccgccgggtcgcacgcggcctcgggtgactcctccggtggcggtggaggtggcggcagcaccggtgccggtggtggtggtggtggtggcggtggtgacagggaattgttcatcattccgcggcgtgaatctgcgcatccaggaccaccggacattaacctgcccctttctgcagacccctcaccaccaccgccgccgcatccgccgtcgtggggtatcgaccagttcgacatgcttgatgtcggtctcggcacgcagacttatgagtctgaggttgcgctcacgcttccaaagttgactggcaatggcaacactgcggttggcgtcggtgcgaggaagtgtgccaagaggggggacagcatttggggtgcatggttcttcttcaatcactacttcaaacctgcacttgtggaaaagccgaagggcaaggtgacacgggactcttctgggagcgtttcgggctttgagaagtctgatcttcgccttgatgtcttcctggtgcagcatgacatggagaacatgtacatgtgggtttttaaggaacggcctgacaatgccctcgggaagatgcagctccggagcttcatgaatgggcattccaagcatggtgagccatcctttccattcagtgcagataagggctttgcaaggtcacaccgcatgcaacgaaagcactatcgagggctgtccaacccacaatgccttcatgggatagagattgtgagttcaccaaatctgtcagctgttcctgaagctgaaatgaaaaggtgggcggaacttacaggaagagaacttaatttctcaattcctcctgaagcaagtgactttgaatcatggaggaatcttccaagcactgatttcgaacttgataggccactgccactgtcatcaaagattacacatggctctcacagtcacaaaaaggcactgaatggttcaggtcttaacctttctacgccaccatcatcagacgatgggatggacctttcaccaaaatgcgccaagcgacggaaggacttctttgctcatggtgcagatgaggattgcgtgatggcaaataattcttgttctgacagagagcaagagatagaagttcacacaggtgagccgtcatggatgcatgagttcactggtgtagcaaaacatgcaagtggacctgttacggctgccaagacaatatatgaggacgatgaaggctacttaatcatggtgagcatgctcttctctgatcctcacagtgtcaaggtctcttggaggaacacattgacacatggcattgtgaagatatcgtgtgtgagcactgctcgaatgccctttgttaagagacatgacaggacattcaagttgactgatcctttccctgagcactgccctcctggagaatttgtgagagagatacctttggctacaaggattccagaagatgcaaagctcgaagcgtattatgacgagactggcactggactggaaatcatggtccccaagcaccgagttggacccgaagagcatgaagtccaggtttgcatgaggcccccacaccttggtgaaaacgatcttcttttatcatagaacagaaaacagtttagtctttagatcttcctgtgtcatgccatgatatgcaggaaagtaacaagtgatgccatggatattttgctgctaaacatttagctgaaattcctttctcagtagtgttggtgatttaggcaaaaaagttaccactttgttgattctcccctgtactttttacactagcaccactatattggagatcttgatttctatggaacatggcaaagttaaaattctgtatatatatctgatgatcaagttcaacggttcattactccataataatgtcgacagctacttacgactagaagttcggaactgtgttgtcaatttcagcaattgtttgtaatcgctgtcttaatcatttcaatgtgctgtactacaatactactggctggatcgctttcaactgaaaccaaaaactcgatcccattgctgtactaacttcatgatcgatatgctcctatgcgaattccgtttggtg

SEQ ID NO: 4113 - DNA, 3345 bp, Brachypodium distachyon
atctccatgggaggagaacccctcctcacctccctgtcgatggagaacaacagcaacaacagccacccttgtaccctactctccatggacactgccgggtcacacccggcctcagccgagtcctccggtggtggtggtgtcgtcaatgggagtgctgttggtgctggtggtggtgatagggagctcttcgttattcctcggcatgagtctgtgcgccgtcatgggccgccggacatcaacctcccgctctctgcagacccctctccgccacctacgtcgtggagccttgacccgtttgatatccttgatgttggccttggcacgcagacttatgagtctgaggttgcgctcacgcttccaccaaagtcgagtggcaacggtggcagtgctgctgttggtgtcggtgcgaggaagtgtgctaagaggggggacagcatttggggagcatggttcttcttcgatcactacttcaggcctgcgcttgtggagaagccaaaggggaaggtgacgcgcgacgcgtccggtagcatctctggctttgacaagtccgatctccgccttgatgtcttcctggtgcagcatgacatggagaacatgtacatgtgggtttttaaggaacggcctgacagtgctcttggcaagatgcagctccggagtttcatgaacgggcactccaagcatggggagccgtctttcccgttcagtgcggacaagggcttttcaaggtcgcaccgcatgcagcggaagcactaccgtggtctctccaacccacagtgccttcatggaattgagattgtgaactcaccaaacttatcagcggtccctgaagccgacatgaagaggtgggctgaacttacaggaagggagattaatttctcaataccgcctgaagccagtgactttgagtcatggaggaatcttccaagcactgatttcgaacttgataggccacagccaccatcatcaaagactatcgcacatagctctcataatcataagaaagcactgaatggttcaggtcttaacctgtctactccaccctcatcagatgatgggatggatctttcaccaaaatgcgccaaacgccgcaaggatttgtttggtcattgtgctgaagaggactgtgtgatggcaaacaattcttgttccgacagagagcaagaggtagaagtccataccgtcaccggtgaaccatcatggatgcacgatttcactggcgtggcaaagcatgcaagtgggcctgttacagctgccaagacaatatacgaggatgacgaaggatacctgattatggtgagcatgctcttctctgatccacacagcgtgaaggtttcctggaggaacacgctgacgcatggcatcgtgaagatatcatgtgtaagcacggctcgcatgcccttcgtgaagaggcatgacaggatgttcaagctgacggaccctgcacccgagcactgccctcctggcgagtttgtgagggagataccactggccacaaggatcccagagaatgcaaagctcgaagcgtattacgacgagaccggtactgggctggagatcatggtcccgaagcacagggtaggaccagaggagcatgaagtccagcgggccgaggcggcgctctacacgctggcggacgcggccgtcgtcgcgggggcggcgggaggggacctggaccaggcggtgcagaagaaaggcgggtggttcgggttcatctccgacgccatggaggtcgtgctcaaggtgctgaaggatggtctctcggcggttcatgtgccgtactcttatgggtttgcaatcattttgctcaccattgttgtgaaggctgcaacattacctttaacaaaacagcaggtcgaatcaactctggcgatgcagaatctgcagccgcagctcaaggctattcagcagagatatgcaggcaatcaggaaaggatccagcttgagactgctcgtttatacaagcaagctggagtcaatcctctagcaggatgtttgccgactttggcaacaatacctgtctggattggactgtaccaagccctttcaaatgtagcaaatgagggattgttgacagaaggatttttctggattccatctttgggaggccctacaacaattgctgctcgtcaaagtggagctggcatttcatggctcttcccttttgtggatggtcatccgccaataggttggcatgacacaatagcttatcttgtgttgcctgtgctacttgttgcttctcaatttgtctccatggagatcatgaagccaccccagtctactgatccatcacagaagaatacacagcttattttaaaatttcttccattcatgatcgggtatttctcattgtcggtgccatcaggattgtccatttattggtttacaaacaatgtcctcagtacagcccagcaagtgtggttacggaaattgggaggagcaaagcctattgtgaacgagggaggcagtggaatcataactgcaggacgagccaagcgttcaagtgctcaatcaggccagggtggagaaaggtttaagcagctaaaagaagaggagagcaggagaaaagctaccaaagcgcttgctgcaggagatacaaaagcttcagtggagacatcagaggatgaagaaacggatgacgagattacagaggagggaggagctgtagaggaaacttacgcttccggtagtgacaagaaacttcctacttactccggaaagaagggcaaacggtcgaaaaggaaacgcatagtgcagtaacgcgacagagcctaattggacatcatttttgtcaggactggttaagttgaccagttaggtgatgtagttgttctcgggttacaattttggtggcgtctcacgggacgcctaatcttcagacgcggacatatacacaattcgaagtgatgctgatactcgcatgcagaagatgtgtaggatgaaatagccagttaagtttattacgaatttacgataggaaccgaaaggtcaagaggaccaggcagcaaactaaacctgttccagctgaggagaggagaggagaggatctttagaagaggtacataaaccgtttaaaaatctttgttctgtatgtaagggcgggtatggttcgaaaaccgggctggaaatgattcgcatacttggtatatactcttatgtaatttcctttgttccccactcctgtcgtgtaatctgacaactttgttcttgggagagagagcatatggtatgcaaccgtacaaacaattggatgcaagtgtaaagaaagagatgagcattttgagcagtgtggtggtggatgctgaactgttaagcttgctacactactctaatgtctgtttgggccca

SEQ ID NO: 4114 - DNA, 966 bp, Sorghum bicolor
gtcagatcggatgcctcctgcttgccgatccaatcacatcacgcacacgcttccggcgaatccagcacggaacaaattgcccctcacccaccttgactcgccgccgccgtcgcaaaccacccacccgatccccaaatcgccccccacccgccttgactcgccgccgcggtcgtaaatcccgcacccgatcctcaaattctccggtggtgatggcagccagcctgtggcgcgccgtgatggacagcgtcagcggctcctcctcctccccctcggcgctggacgcgcctccgggcggcggcgtcgagttctggcacggtgcggagcgcgcgggttggctaaacaagcaaggcgagtacatcaagacgtggaggcggcggtggttcgtgctcaagcaggggaggctcttctggttcaaggaccctgtggtgacgcgggcctcggtgccccgcggcgtcatccccgtcgcctcctgcctcacagtcaagggcgccgaggacgtgctcaaccgccagttcgccttcgagctctccacgcctgccgagaccatgtacttcatcgcggactccgagaaggagaaggaggagtggattaactccatcggtcgctccatcgtccagcactcccggtccgtcaccgacgcagaggtcgtcgactacgacagccgcccccagcccccgccgcagcctaaggctagcgaagagagtgaaccagcagcttaatggggaggtgattcctgccaactctctcgatatggctctgaattttagcatatgtacttccaattccaagtgattgtgggctgccaactctctcgatatggctctgaattctagcatatgtacttccaattccaagtgattgtgggcttgtgccgactttcctttgtttcttcactcctgaaacaaatgtagtatattaactatcaacgatatggtctggtatgttaataaactgtacttttgtgta

SEQ ID NO: 4115 - DNA, 1493 bp, Sorghum bicolor
ctttagatcatagatgtggccgtcagatcggatgcctcctgcttgccgatccaatcacatcacgcacacgcttccggcgaatccagcacggaacaaattgcccctcacccaccttgactcgccgccgccgtcgcaaaccacccacccgatccccaaatcgccccccacccgccttgactcgccgccgcggtcgtaaatcccgcacccgatcctcaaattctccggtggtgatggcagccagcctgtggcgcgccgtgatggacagcgtcagcggctcctcctcctccccctcggcgctggacgcgcctccgggcggcggcgtcgagttctggcacggtgcggagcgcgcgggttggctaaacaagcaaggcgagtacatcaagacgtggaggcggcggtggttcgtgctcaagcaggggaggctcttctggttcaaggaccctgtggtgacgcgggcctcggtgccccgcggcgtcatccccgtcgcctcctgcctcacagtcaagggcgccgaggacgtgctcaaccgccagttcgccttcgagctctccacgcctgccgagaccatgtacttcatcgcggactccgagaaggagaaggaggagtggattaactccatcggtcgctccatcgtccagcactcccggtccgtcaccgacgcagaggtcgtcgactacgacagccgcccccagcccccgccgcagcctaaggctagcgaagagagtgaaccagcagcttaatggggaggtgattcctgccaactctctcgatatggctctgaattttagcatatgtacttccaattccaagtgattgtgggctgccaactctctcgatatggctctgaattctagcatatgtacttccaattccaagtgattgtgggcttgtgccgactttcctttgtttcttcactcctgaaacaaatgtagtatattaactatcaacgatatggtctggtatgttaataaactgtacttttgtgtatattttttttatgtttatatatactatactacgaattgatctaggtggcggtggatgtccttctagtttttttttacagttttgaagttttggctccagttttagaaattgcaatagattatataaccatccaatattccattcctcttgttccttttgttgagtttgatttgttctattctcacggaattgtattgagtcgcagaggattgcttaactgactcctcatttttgcagaagattccccagtttagatcctagctctgactctagtgctcttgtgaagtttctgtcctagaagtagaaacacaaacacaaacactgatgaagtgatgaatgtgctgtagtacgcttattaatcatgaagtaaaactgtaaaagaaccatatatcaagatgtcttatgctgcaatctgaagtggaaggtttcttcgtttccaaaaaaagaaaaaagtggaagttttctggagtgaattggtgtatgcagtactttttgagggccgacat

SEQ ID NO: 4116 - DNA, 787 bp, Panicum virgatum
cggcccacccacctttgagtcgccgcccgccccccgtcgcgaacgcccccgcacccgatccccaaattcccccccggcggcgatggcggccagcctgtggcgcgccgtgatggacagcgtcagcgggtcctcctccccctcggcgcccgacgcggcgtccggcggcgtcgagttctggcacggggccgagcgcgcggggtggctcaacaagcagggcgagtacatcaagacgtggcggcgccggtggttcgtgctcaagcagggccgcctcttctggttcaaggaccccgccgtgacgcgggcctccgtgccccgcggcgtcatccccgtcgcctcctgcctcaccgtcaagggcgccgaggacgtgctcaaccgccagttcgccttcgagctctccacccccgccgagaccatgtacttcatcgccgactccgagaaggagaaggaggagtggatcaactccatcggccgctccatcgtccagcactcccgctccatcgccgacgccgaggtcgtcgactacgacagccgcccccaggccacgacgcagtccaaggacagccaagagaccgagccggcggcgtagcatcgcggtgatccctgtgaatctctccatatggctctcaattgtagtatatgtacttcctcgtgattgtgggctttgttccttcactcttaattatatatgtatattaactactatcaatgacttggctgtgccaataaatgataatttcgtgcattgatttttatatactaatacattatacgaagaactgatcttgat

SEQ ID NO: 4117 - DNA, 806 bp, Saccharum officinarum
ccaaattctccagtggtgatggcggccagactgtggcgcgccgtgatggacagcgtcagcggctcctcctcctccccctcggcgctggacgcggccctgggcggcggcgtcgagttctggcacggcgcggagcgcgcggggtggctaaataagcagggcgagtacatcaagacgtggaggcggcggtggttcgtgctcaagcaggggaggctcttctggttcaaggaccctgcggtgacgcgggcctcggtgccccgcggcgtcatccccgtcgcctcctgcctcacagtcaagggcgccgaggacgtgctaaaccgccagttcggcttaaagctctcaaggccggccgaaacatgtacttaattgcggactccgagaaggagaaggaggaatggattaactccatcggtcgctccatcgtccaacactcccggtccgtcaccgacgcagaggtcgtcgactacgacagccgccccaagcccccgccgcagcccaaggccagcgaagagagtgaaccagcagcttaatggcgcggagattcctgggaactctctcgatatggctctgaattgtagcatatgtactttcaatcccaatgattggggtctgtgccgacgttcctttgtttctcactcttgaaccaatatagagtctataactatcacgacatggcttgttaaaagaaaaaaaaaggcggccgccctttgtttttctgggccctcatttttaaactatgccgtggtatttttttggggtctgtgcccgacttggtaaatcggagcgcccttaaaggtactatcttcaaa

SEQ ID NO: 4118 - DNA, 741 bp, Panicum virgatum
gcacacccaccttgagtcgccgccccccgtcgcgaaccccgcacccgatccccaaatccccccggcggcgatggcggccagcttgtggcgggccgtgatggacagcgtcagcgggtcctcctcctccccgtcggcgcccgacgcggcgtccggcggggtcgagttctggcacggggccgagcgcgcggggtggctcaacaagcagggcgagtacatcaagacgtggcggcgccgttggttcgtgctcaagcaggggcgcctcttctggttcaaggaccccgccgtgacgcgggcctccgtgccccgcggcgtcatccccgtcgcctcctgcctcaccgtcaagggcgccgaggacgtgctcaaccgccagttcgccttcgagctctccacccccgccgagaccatgtacttcatcgccgactccgagaaggagaaggaggagtggatcaactccatcggccgctccatcgtccagcactcctgctccatcgcagacgccgaggtcgtcgactacgacagccgcccccaggcaacgacgcagcccaaggacagccaagagaccgagccggcagcgtagcatcgcggtgatccctgtgaatctctcgatatggctctcaattgtagtatatgtacttccaagtgattgtgggctttgttccttcacccttaattatatatgtatattaactatcaatgacttggtgtggtaataaatggtaatttcgtgctttgttttttata

SEQ ID NO: 4119 - DNA, 937 bp, Setaria italica
cgctcccttccacggcggtatcgagagcggaacaagaacaactgctccgttcccccacggccccacgtccccacccaccttgactcgccgcccccgtcgcaactcgcaaaccccccaccggcgcatccgatccccaaatccccggcggcgacgatggcggccagcctgtggcgggccgtgatggacagcgtcagcggatcctcctcctcctcctcccccacggcgcccgacgcggcgtccggcggcgtcgagttctggcacggggccgagcgcgtggggtggctgaacaagcagggggagtacatcaagacgtggcggcggcggtggttcgtgctcaagcaggggcggctcttctggttcaaggaccccgccgtgacgcgggcctccgtgccccgcggcgtcatccccgtcgcctcctgcctcacagtcaagggcgccgaggacgtgctcaaccgccagttcgccttcgagctctccacccccgccgaaaccatgtacttcatcgccgactcggagaaggagaaggaggagtggatcaactccatcggccgctccatcgtccagcactccagctccatcgccgacgccgaggtcgtcgactacgacagccgccccaaggccacgacgcagcccaaggacagcgaagagagcgagccggcagcgtaacatccacggtgacccctgtgactctctctccatatggctcttaattgtaatatatgtacttccaggtgattgggagcttgtggcgacgttcctttgtttcctcactcttgattatatgtaaattaactatcaatgactcgtgtctggtaataattggtattttcgtgtatagcttgttctttcaataccttactacgaattgatcttgatacaacgtaatttaccaagcagttgttgcttgtatagtttttttgcagtagtggcgtttgga

SEQ ID NO: 4120 - DNA, 2228 bp, Brachypodium distachyon
cacccaccccgatcccggatccccaaatcccccggcgtgatggcggccagcctgtggcgcgcggtgatgggctcctcctcggctggcgccgatgacccggcgacgggcggcgtggagttctggcacggggcggagcgcgcggggtggctgaccaagcaaggcgaatacatcaagacgtggcggcggcggtggttcgtgctcaagcaggggcggctcttctggttcaaggaccccgtggtgacgcgcgcgtcggtgccccgcggcgtcatccccgtgtcttcctgcctcaccgtcaagggcgcagaggacgtgctcaaccgccagttcgccttcgagctctccacccccaccgagaccatgtacttcatcgctgacgccgagaaggagaaggaggagtggatcaactctattggccgatccatcgtccagcactctcgctccgtcactgacgccgaggtcgttgactacgacagccgtccccaaccctcaccgcgggccaagaagagcgaggcgagtgagccgtcagagcgcacgcacctgtccgctcctccctcgccgccgtccccacgaggtcgtgccgtgccccaccgccggaatccgcccaagtaccaccacccgttgtctgttgattcacgaaccgcaggcgcagactcactgacacgcccacctcgtcgtcacctcgcctcgtgaagcacctgcgcgaagcagggtttaggcctcagggccagaggaaacccccatccatggagcccgctgcggtggcggcggcgccgatcccgcgaggcggggctttcgggcgagtccgggtcgcctgcggcgcgcgggggtcgcggcgggtcgtggtgggcgccggcctccctcggcccgcccgcgtgagggtgctcgtcgccgcgcttccggagcccctcgaccagctctcgcccgcacaggagggcgccgctgcgctagactcagaggttagtttagctgacgacgtccatatgaatgcggcttctgctgagatttcttctcgccctgctgttcatgggagtacggtgcgtgtcagatttgtgctaaaagagcagtgcaccttcggccatagcttcctcctggttggtgacgaccctgcgctcggcctctgagagccaacaaatgcgatagctctggattggtcggaaggccacgattgggctgtagagaaagatttgccggccaacaggctggttgagtttaagttcttgctgctagattccctggggaagttccattggcagaatggggctaatagaagcgtacagaccggtgaaaccgcaaagacgttggtggtctacgaagattgggttgatcacaagaagcagaaagtagcagaggagggagacgcttcagttggagtggtggagacagttgttgccgacaatggtaatgccagaaacggcgttgtttcagtaaatgagctacaagtggatgacaatccagagatcaaagaagacgaatcaagtagtgaggatgacgagaactcaacagttgctgttattgcttctcttcaaggggaatcggtgaaggcacatgaagatgatgctgaccagacagagttgatgatgaatgaacagaaaactcaagatgagcgtcatgatgaagtagacacagaaccgccgaatggcagtccaacgaagtgtgctgatgatgattatgctgaaggaactgatgatgctagcatcttgaccaaggatggcgttccagttaagaatgggtggaccggaggttttgaacgtgagttgctctggggttggaaggccatgcagcagcttctcatgagcctgggcttcaaaatggatgcaacatgaaacatttctggtactgcttgctatatatgcacggtcacatgacggtctggatggcgtgttgctaactctcaaggatgtagtagaaactagaaagcattagcaggtagcagcagctgggtattgttgcggcactctgttgtgtgtacagtcattgcaactagttctcaataagctatcatcagtttggtgtctcagtaattaaagcagccccagtttgagacgataaagatgccatccctctgctgcaatgcaaaggatgttagcaaatcttatattcgtcacggaaattaaattctgaactgaactgcaagtactgtgataattgtgctccgctgctgtgtccgaatgcaatgtaatctagctttgttggaagaaaaaaaatgatatagactcaggtttcagagg

SEQ ID NO: 4121 - DNA, 1135 bp, Brachypodium distachyon
ccggccgaatccagcagcgcactactcttcggcccctttgtctctagtcgcagcccggacctcacggcgcacacacccaccccgatcccggatccccaaatcccccggcgtgatggcggccagcctgtggcgcgcggtgatgggctcctcctcggctggcgccgatgacccggcgacgggcggcgtggagttctggcacggggcggagcgcgcggggtggctgaccaagcaaggcgaatacatcaagacgtggcggcggcggtggttcgtgctcaagcaggggcggctcttctggttcaaggaccccgtggtgacgcgcgcgtcggtgccccgcggcgtcatccccgtgtcttcctgcctcaccgtcaagggcgcagaggacgtgctcaaccgccagttcgccttcgagctctccacccccaccgagaccatgtacttcatcgctgacgccgagaaggagaaggaggagtggatcaactctattggccgatccatcgtccagcactctcgctccgtcactgacgccgaggtcgttgactacgacagccgtccccaaccctcaccgcgggccaagaagagcgaggcgagtgagccgtcagagtaagattgcggtgaaccacctctctgtcggtatgcctctcaattgtatcaactcaaagtgattgtgaatttgtgtttttgtttcttattcttattgtatgtatattattgactgtcgtctgggaataattggatttcagtgtatagttctttgacacttccaattggttgcttgccgtatcatgacttgcaaattgattagcatctagtactggtttggggttctgtgaattttctgcctctggtaactggtttctgaagtcgtgacaaattttcatcatgcaattctctgatgtatgtctatgacagaaatgcatttgcgttgaattccagaggattgcacctgaattgtcaccaatttgtttggtgcctactagggcataaacttcgtactaaagagagacctagaaaaatgatttttgtacagctcctttgagcaattaaaatgaattagacaattattttgtatttcaatgtcacagggaacagttccactggcattagtactgtggaactttgagtcactatgtatagg

SEQ ID NO: 4122 - DNA, 708 bp, Triticum aestivum
gcgcgatggcggccagcctgtggcgcgcggtgatgggctcctcctcgtcgggcggcggcgacgacccggcggcgggcggcgtggagttctggcacggggcggagcgcgcggggtggctgaccaagcagggcgagtacatcaagacgtggcggcggcgctggttcgtgctcaagcagggccggctcttctggttcaaggacgccgccgtcacgcgcggctccgtgccccgcgggatcatccccgtctcctcctgcctcaccgtcaagggcgccgaggacgtgctcaaccgccagttcgccttcgagctctccaccccggccgagaccatgtacttcatcgccgacgccgagaaggagaaggaggagtggatcaactccatcggccgatccatcgtccagcactcccgctccgttaccgacgccgaggtcgttgactacgacagccgcccccagcccccaccgcagcccaagaagagcgaggcgagtgagccgtcagagtaagatcacggtgaactccgtcacccttctctcgatatgactctgttgtatcaacttatgtgattgtgaattcttgtttttgtttcttatttattgactttgtgtatattattgactgatgtctaagaataattgagtttaagtgtatagctctttgaccctttggatcggttgacatgtcctaatttccgaaatttcatggttgtctcct

SEQ ID NO: 4123 - DNA, 829 bp, Secale cereale
gactcccggcgcaggcgcccgcccgatcccggatccccgatcccccccggcgcgatggcggccagcctgtggcgcgcggtgatgggctcctcctcctcgtcgggcggcggcgacgacccggcggcgggcggcgtggagttctggcacggcgcggagcgcgcggggtggctgaccaagcagggcgagtacatcaagacgtggcggcggcgctggttcgtgctcaagcagggccggctcttctggttcaaggacgccgccgtcacgcgcgggtcggtgccccggggcatcatccccgtctcctcctgcctcaccgtcaagggcgccgaggacgtgctcaaccgccagttcgccttcgagctctccaccccgaccgagaccatgtacttcatcgccgacgccgagaaggagaaggaggagtggatcaactccatcggccgatccatcgtccagcactcccgctccgtcaccgacgccgaggtcgttgactacgacagccgcccccagcccccaccgccgcagcccaagaagagcgaggcgagcgagccgtcagagtaagatcgcggtgaactccgtcgcccctctctcgatatgactctgttgtatcaacttatgtgattgtgaattcgtgtttttgtttcttatttattgactgtatgtgtatattattgactgctgtctgggaataattgggtttaagtgtatagctctttgaccctttggatcggttgacatgtcctaatttccgaaaattcatggttgtctcctaatcctgtgctatgtaaatttgttgcctcttgtttctggagttgtgacaaaaaatttatcagac

SEQ ID NO: 4124 - DNA, 1195 bp, Oryza sativa
tttagcccatgtagaacaggagtactagtacaccacaaagagtcctttatggtaacgatttcgtagaattttgtgatttaggcgaccagaaatcagttaatactcggtttgagatggcgatgaggcgatgagatcattgccttttcggtcgaatctagcagagcggcgagcaacccccacccactttgactccgatcctccccgcccccagcgcgatagcccatccgatcccaaattccggcgagatggcggtcagcctgtggcgcgcggtgatgggcgcggccggcggcggcggctcctcgtcgtcgtccgcggccggcggcgacgcggggggcggcgtggagttctggcacggcggggagcgcacggggtggctgaacaagcagggggagtacatcaagacgtggcggcggcggtggttcgtgctcaagcaggggcggctgttctggttcaaggacgccgccgtgacgcgcggctcggtgccccgcggcgtcatccccgtcgccacctgcctcaccgtcaagggcgccgaggacgtcatcaaccgccagttcgccttcgagctctccaccccgaccgacaccatgtacttcatcgccgactccgagaaagagaaggaagagtggatcaattccatcggccgatccattgttcagcactcccgctccgtcaccgacgccgaggtcgtcgactacgacagccgccccaactccaagcccccaccgcagccgaagacgagcgaagagagtgaaccgtcagcgtaagatagcggtgatctctggctctcaatatgcatatctattgtatgattttatctactcaagtagtagtaattgtgaatttttagtttttgttttcttctcttggttaattatatgtatattattgactgctacctgagaataagttcaaggttttgccgtgtggctagttcttttacattatggattagttgcaacagcataattcggttggtgtttacttgtttcatcctgtatgaagttactggcttggatcatcggtgctgcgaaaaattttaagcactcagttctttaattttcattatggggattttcgtttgtcaccaatgggagcctgaaatgtggttcagaacatcagatgcaatcctctgtattgtatagtagtactgaagtttgggctgtattcagctgcatgtttagctttgatcttaatc

SEQ ID NO: 4125 - DNA, 639 bp, Avena sativa
ggcaccccaccccgatctccgatccccaaatccctcggcgtgatggcggtcagcctgtggcgcgcggtgatgggctcctcctcgtcgggcggggacgacccggcgacgggtggcgtggagttctggcacggggcggagcgggccgggtggctgaccaagcagggcgagtacatcaagacgtggcggcggcgctggttcgtgctcaagcaggggcggctcttctggttcaaggaccccgccatcacgcgcgcctcggtgccccggggcgtcatccccgtctcgtcctgcctcaccgtcaagggcgccgaggacgtgctcaatcgccagttcgccttcgagctctccaccccgaccgagaccatgtacttcatcgctgacgccgagaaggagaaggaggagtggatcaactcgatcggccgatccatcgtccagcactctcgctccgtcaccgacggcgaggtcgttgactacgacagccgcccgcaacccgcgccaaagcccaagagtgagccggcagagtaagattgcggtgaactctccatatgcccctcaattgtatcaaacttaagtggttgtgaatttgtgagtctagtttttttgtttctgattgtgtgtatattattgactgctgtatgggaa

SEQ ID NO: 4126 - DNA, 769 bp, Hordeum vulgare
ccctcccccggcgcgatggcggccagcctgtggcgcgcggtgatgggctcctcctcctcctcgtcgggcggcggcgacgacccggcggcgggcggcgtcgagttctggcacggggcggagcgcgcggggtggctgaccaagcagggcgagtacatcaagacgtggcggcggcgctggttcgtgctcaagcagggccgcctcttctggttcaaggacgccgccgtcacgcgcgggtcggtgccccgcggcatcatccccgtctcctcctgcctcaccgtcaagggcgccgaggacgtgctcaaccgccagttcgccttcgagctctccaccccggccgagaccatgtacttcatcgccgacgccgagaaggagaaggaggagtggatcaactccatcggccggtccatcgtccagcactcccgctccgtcaccgacgccgaggtcattgactacgacagccgcccccagcccccaccacagcccaagcccaagcccaagacgagcgacgccagcgagccgtcagagtaagatcgcggtgaactcggtagccctctctcttcgatatgactatgttgtatcagcttatgtgattgtgaattcgtgtttttatttactgacttaagtgtgtatattattgactgctgtctgggaataattgggtttcggtgtatagctctttgaccctttggatcgttctccatatcataatctccgaactggttggcgcctactagttccatgctatgtcaattttaatgcatcttgtttc

SEQ ID NO: 4127 - DNA, 898 bp, Hordeum vulgare
cgccgcccggtcgaatccagcggcgcactactcctcacccaccttgtccctctccctccccagtcgtagcccccccggcgcccgcccccgatcccggatccccaatccccctcccccggcgcgatggcggccagcctgtggcgcgcggtgatgggctcctcctcctcctcgtcgggcggcggcgacgacccggcggcgggcggcgtcgagttctggcacggggcggagcgcgcggggtggctgaccaagcagggcgagtacatcaagacgtggcggcggcgctggttcgtgctcaagcagggccgcctcttctggttcaaggacgccgccgtcacgcgcgggtcggtgccccgcggcatcatccccgtctcctcctgcctcaccgtcaagggcgccgaggacgtgctcaaccgccagttcgccttcgagctctccaccccggccgagaccatgtacttcatcgccgacgccgagaaggagaaggaggagtggatcaactccatcggccggtccatcgtccagcactcccgctccgtcaccgacgccgaggtcattgactacgacagccgcccccagcccccaccacagcccaagcccaagcccaagacgagcgacgccagcgagccgtcagagtaagatcgcggtgaactcggtagccctctctcttcgatatgactatgttgtatcagcttatgtgattgtgaattcgtgtttttatttactgactgaagtgtgtatattattgactgctgtctcggaataattgggtttcggtgtatagctctttgaccctttggatcgttctccatatcataatctccgaactggttggcgcctactagttccgtgctatgtcatttttaatgcatcttgtttctgatgtcgtttctgatgcaat

SEQ ID NO: 4128 - DNA, 781 bp, Triticum aestivum
tgcgcgatggcggccagcctgtggcgcgcggtgatgggctcctcctcgtcgggcggcggcgacgacccggcggcgggcggcgtggagttctggcacggggcggagcgcgcggggtggctgaccaagcagggcgagtacatcaagacgtggcggcggcggtggttcgtgctcaagcaggggaagctcttctggttcaaggactcggccgtcacgcgcgcctccgtgccccgcggcgtcatccccgtctcctcctgcctcaccgtcaagggcgccgaggacgtgctcaaccgccagttcgccttcgagctctccaccccgggcgagaccatgtacttcgtcgccgactccgagaaggagaaggaggactggatcaactccatcggccgctccattgtccagcactcccgctccatgaccgacgacgagatcgtcgactacgacagcggcccccagcccccaccgcagcccaagaagagcgaggcgagcgagccgtcagagtaagatcgcggtgaactccgtcagccctctctcgatatgactctgttgtatcaacttatgtgattgtgaattcgtgtttttgtttcttatttattgactgtgtgtgtatattattgactgctgtctggaataattgggtttaagtgtataactcattgacactttggatcgattgacatgttataatttccaaaaattggtggtcgtctcctaatacagtgctctgtaaattttatgcctcttgtttctgaagtcgtgaagtttttatctggcaaaaaaaaaa

SEQ ID NO: 4129 - DNA, 723 bp, Lolium multiflorum
ggcactactcctcgcccactttgtctctagtcgcgcccacccgatcccggatccccaattcccccggcgggatggcggccagcctgaggcgcgcggtgatgggctcctcctcctccggcggcgacgacccggcgctgggcggcgtggagttctggcacggggcggagcgcgcggggtggctgaccaagcagggcgagtacatcaagacgtggcggcggcgctggttcgtgctcaagcagagccgcctcttctggttcaaggaccccgccgtcacgcgcgcgtccgtgccccgcggcgtcatccccgtctcctcctgcctcaccgtcaagggcgccgaggacgtgcccaaccgccagttcgccttcgagctctccacaccgacagagaccatgtacttcatcgccgacgccgagaaggagaaggaggagtggatcaactccatcggccgatccatcgtccagcactcgcgctccgtcaccgacggcgaggtcgttgactacgacagccgcccacaaccctcgccaaagtccaagagtgagccctcagagtaagatttattgcggtgaactcccgatatgcccctctctattgtatcaacttaagaagtggttgtgaatctgtgtgattctagttattatttgttgatcgtatgtatattattgactgctgctgtatgggaataactggtctaagtgtacagttcattgccacttttggaaaaaa

SEQ ID NO: 4130 - DNA, 1242 bp, Sorghum bicolor
ggaaaggtccccgtgtacgtgtggcttttcccccactctgtctttctcgtctcgtctcttcccatctgagctccatccccttgctcctcttaccactgtaccagcacggaaccggaaatgagcgtcggcgccggcttctcgtacaagaagttcgtccacttcgcgctggagcagacccgccaccgctccactctcgtcccccacccgtcccaggaaaagttcaagttcataaaaccaaatgaggataatactgttctcagtgctttgtcattcagcacttccaaagttagactgcttcggagcttgacaattgagcagaaaaactcagctcaggttcttgactttgctgccttctcagaacctgaatacgaccttcctatattttgtgcaaatgccttttcatcccctgcacgtagtatcgttgtcttggacctcaatcctttgtatgataccactgaacacaaggattacagggaaaaatattacaggaacttgatgcctcttatacacaagtacagtgagcttctgccatggggtggcaaaattacaagcgagtctctgagattcttctcgcccattgttatctggacgatatttgagccaactgaagccaacctccaagctctatactccgccttcatggattactataaggtctggcttgagttaatggatggagcagttcgagaaaccaacgaagaaaaaatcgatcgtaatagggaagcgcaacataagtatctcacatggagagcagagaaggatcctggttactctctgctaaagaagttgattggtgagagcggcgccaaggatctggtgagggagttcctcttcgaaggagtcagctcgctcggaaccaagtcgtttctggattatttccccgagtacgcgcaagaggacgggacggtgaacaggaagcggagcatggccggcaagtcctttggaactcggccttgggacgttcacggacggttcgtcggcggcgacgcaagctgttgattctcggaactcggccgttgtttctagtggatttgcttcagcaaagaactggacgttgtttgtgtttggctctggtttcagatcatccccaagcttttctttcccccgttgcattacatgccaggccaggccagctgctacttgtgtttgtatttttgtgtaatagcagtagtagggcacctgtacttcctagttgcttggacacactgcactttcattacacaacgcaaggcgtaggcgccc

SEQ ID NO: 4131 - DNA, 1780 bp, Sorghum bicolor
ccatgacgaaagcctgtgggtgcaaatggaaaggtccccgtgtacgtgtggcttttcccccactctgtctttctcgtctcgtctcttcccatctgagctccatccccttgctcctcttaccactgtaccagcacggaaccggaaatgagcgtcggcgccggcttctcgtacaagaagttcgtccacttcgcgctggagcagacccgccaccgctccactctcgtcccccacccgtcccaggaaaagttcaagttcataaaaccaaatgaggataatactgttctcagtgctttgtcattcagcacttccaaagttagactgcttcggagcttgacaattgagcagaaaaactcagctcaggttcttgactttgctgccttctcagaacctgaatacgaccttcctatattttgtgcaaatgccttttcatcccctgcacgtagtatcgttgtcttggacctcaatcctttgtatgataccactgaacacaaggattacagggaaaaatattacaggaacttgatgcctcttatacacaagtacagtgagcttctgccatggggtggcaaaattacaagcgagtctctgagattcttctcgcccattgttatctggacgatatttgagccaactgaagccaacctccaagctctatactccgccttcatggattactataaggtctggcttgagttaatggatggagcagttcgagaaaccaacgaagaaaaaatcgatcgtaatagggaagcgcaacataagtatctcacatggagagcagagaaggatcctggttactctctgctaaagaagttgattggtgagagcggcgccaaggatctggtgagggagttcctcttcgaaggagtcagctcgctcggaaccaagtcgtttctggattatttccccgagtacgcgcaagaggacgggacggtgaacaggaagcggagcatggccggcaagtcctttggaactcggccttgggacgttcacggacggttcgtcggcggcgacgcaagctgttgattctcggaactcggccgttgtttctagtggatttgcttcagcaaagaactggacgttgtttgtgtttggctctggtttcagatcatccccaagcttttctttcccccgttgcattacatgccaggccaggccagctgctacttgtgtttgtatttttgtgtaatagcagtagtagggcacctgtacttcctagttgcttggacacactgcactttcattacacaacgcaaggcgtaggcgcccatggccctggactgccacagctctgcctgaagcagcaagctcaactgcttcaaggaacaaggaaaggaaggaaccgggaaattgcctagctgactgaaagcgaggcaaacggacaatgaacaggacagtgtcctcggatcctctttttttcccagcacgggcggccacagcgcacacagcaacggccgacactgaccgactgacggagggaaagaagagcatgtgcacgcgcggagagagagaggggggattcacagcaaacgacaactcgtagtagtactccctgcgcctgcaaaagtgaagaagcgtgagaaaagaaaagggtgaagtgaacaagacaaacttggctagtagtaggtactttaggtgtgaaagctgcgcctaaccagcagccattactcacactcgctttccttgagatttggaggaggaggaagccctttcctaaacccacttgtgtgtagtgtaggtttgctcgtaggagtagttgtcgaccaatccaattatcaag

SEQ ID NO: 4132 - DNA, 1115 bp, Setaria italica
atgagcggcggcagcggcggcctgggcgccggcttctcgtaccagaagttcgtccacgtcgcgctggagcagacccgcctccgcaccgccctcgcccctcacccatcgcaggaaaagttcaagttcataaaaaccaatgaggataatactattttcaatgctctttcattcagcgcccccaagattagattgcttcgaagcctgacaattgagcagaaaaactcggttcaggttcttgactttgctgccttctcagaacctgaatacgaccttcctatattttgtgccaacgcttttacatctcctgcgcgtagtattgttgtcttggatctgaatcctttgtatgacaccactgagcacaaggattacaggggaaaatactataggaatttgatgcctcttatacacaaatacagtgagcttctgccctggggtggcaagattacaagcgagtctctgagattcttctctcctattgttatctggacaatacttgagccaactgaggccaaccaccaagttctgtactctgccttcatggattacttcaaggtctggctggaattaatggatgaagcagttcaaggaactagcgtagaaaaaattgaccgaaatagagaagcacagcataaatatctcacatggagagccgagaaggatcctggttatccactgttaaaaaagttgattggtgaatgtgctgccaaggagttggtgagggagtttctgtttgaaggggtagactcgcttggaacaaagtcattcttggagtatttccccgaatatgcacaagaagatgggacggtaaacaaaaagaggagcatggtggggaaatcttttgaaactaggccttgggatgcccatgggcagttcgtcggcgacgctggtgatggatagcagctctgttctagctacatctagtagttgtttgttcttgaaatacgcgcaacttgggcagtggcgcccggcaactcgtggtaaaaaaaaaaaagggctatgggccgacggcccaacgagagactgcgatgacgtggacgtggttgctgccatcccgttgatcaacgatgaacattatctttatcaaaaaaaaaatgatgaacattatcagttcttgc

SEQ ID NO: 4133 - DNA, 1125 bp, Panicum virgatum
tgtctctctctcatctcctcccttcccttcctgtcccagctccatctccctgctcgcgcatccccaaccgtaccacctcggagctgaaatgagcggcggcggcggaggaggcggattgggcgccggattctcgtaccagaagttcgtccacgtcgcgctggagcggacccgcctccacaccgcccttgcttcacacccatcacaggaaaagtttaagttcataaaacccaaagaggataacactgatatgaatgctctctcattcagcgcccccaagattagactgcttcggagcctgacaattgaacagaaaaactcggttcaggttcttgactttgctgccttctcagaacctgaatacgacctccctatattttgtgccaatgcttttacatctcctgcacgtagtattgttgtcttggatctcaatcctttgtacgacaccactgaacacgaggattacagggaaaaatactacaggaatttgatgcctcttatacacaagtacagtgagatgaaatgcagcttctgccctggggtggcaaaattacaagcgagtctctgagattcttctctcctattgttatctggacaatacttgagccaactgaggccaaccacaaagttctatactcagccttcatggattactacaaggtctggctcgagttaatggatgaagcagttcaagaaacaagtttagaaaaagttgatcgaaatagagaagcacaacataaatatctcacatggagagccgagaaggatcctggttattcactgttaaaaaagttgattggtgaatgtgctgccaaggatttggtgagagaatttctgtttgaaggattcgattcgctcgggacgaagtcattcttggagtatttccctgaatatgcacaggaagatgggacggtaaacaagaaacggagtatgatcgggaagtcatttgaatctcggccttgggatgctcatgggaagttcatcggcgatgctggtgatggatagcagctagctgttctgcttcatctagatacagccgcgcttgtttctccttgttgttcttgatagctgttttgcttctgcaaagctggacatttctttctcgaagctttctcgtcgcatggcaga

SEQ ID NO: 4134 - DNA, 1386 bp, Zea mays
aaaaatggaatgcccacagatctgtaaaatttgctggtttactcgcgaccaaccgaatcgctgttgatgactcgtgcacaaacaaaaaaaggaatcgaattcctgcccccttcttccccacacacgctaaactccaagcaatcaagcaagcaagcgcgaaataaccaccgtttccttgcagctcgcgaatctgcggcccccgttccccgacccgacacggcacaccactcgctccagtccgccttcatccaacggttcccctcctatttgccctcggaatcccgcccgcgaaccctagccggcctccgcgagatggacgaggactgggagctcctcctcgcgtcccccaaggcggcgccggccgagccgtacgccggcggcggaggagacggggaggtcgacgccggcgccatcaagcacgactacttcgacctcggctccgacgccaagtacccccggagggcgtcgccgtcgaagggaagcgaggaggagtgtgcggaggaggggcctttcgcggcgtcggacaacgcgggctgggtggagccggaccccgacgaccttctcttccccggccgcgaccgcgcggcgctctggtcgcactcgtcctccgacggggagaggcccgaggtcgaggtcgaggttgaggccgccgatcaggtggaacgggccggggtcacggcggcggctgacgcgggcgagggggccgtggcgaagggaggagggccggcccagtggtggaggctgccgctggacgtgctgcgggtgtgggcgctgcgcgcggccaggagcgtctggtcggtgccgctcgccgtcgcgctgctcgggttcgccgtgctcgggcgccggctgtaccggatgcgccgccagagcaaggccgtcgcgcgcgtccgcctcgtcctcgacgagaagaaggtctcccaattcaagggccaaggatcacgtctgaatgaatccatgacggtggcgcggcgaactcctatcataaaacctatgcttcctgccaacggagtgactccatggcctgtgctgggacacctgtgagatgacgtgatcgagctagtagtacaagtacaactgccccagcccacgttgccacaggcgggcatattatgcgatgcccagcagcagatgtactactggctgcttgtaatttggaactacacacttgtggaagaccttgtaagtttaggacctgatctagtttatgccccttctgtgtatacccatgcttatatttttatttcctgaatccttatgtcatcgatcttgtgtgctggagttgtaaatgattggatactcagtacccatggtactatggtagtgtgatgtatatgactattacccataaatcaatgcacgagtggaagcttgattatgttctgggca

SEQ ID NO: 4135 - DNA, 1151 bp, Zea mays
gatcgaaccgtttggctggtggggcgcgagcgcgaggtgacgacggcgacgcttcagttgagtgcgggtgtagtgctcctgcgacttcggcctgtccactttttagggggtgccgaggggcgtgggggtacggccgtccgcacaataatctgcgctgcgcggaagaagggaaggggaaaagcagttaagcttgagcgcgcgcgacagggtcaagtcgagggccggggaatcgccggagaatggaggtgggcagggctccgcgacgacgggtgtccccagcggcggcggcggcggctgtgccttcgctgcttctgttcgccgttctattcgcgggccgggcggcggcgttcggccacctgcaaggcgccggcgcgacggcgctgtacaagcacgcgtcgttcttcgaccgcgatggcgacggcgtcgtctccttctcggagacgtacggcgcgtttcgggcactcgggtttggattcggcctgtccagcgtcagcgctgccctcatcaatggcgcccttggtagcaagtgcagacctcaaaatgcaacgtcatcgaagttggatatctacatagaggacatccagaaagggaaacatggaagcgattcagggtcatacgacgccgaaggaaggtttgttcctgacaagttcgaagagatattcgccaagcacgccaagactgtcccagacgccctgacgtcggacgagatcgaccagctgctgcaggcgaacagagagcccggggactacagcggatgggctggcgctgaagcggagtggaagaccctctacagcctcggcaaggacaaggacggcctcctccgcaaggacgtcgcgagaagcgtctacgacgggacactgttccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagcggtgtgaacgggtggtgtgaacactcttttcatatcacatcataaaaaaaggtgtgaacagatatttcaatgtacattatcataaaataagataaattcataattcaaataaaaatattctgtgtctt

SEQ ID NO: 4136 - DNA, 857 bp, Panicum virgatum
  misc_feature (207)..(207): n is a, c, g, or t
  misc_feature (674)..(674): n is a, c, g, or t
gctagcaagaaaagcacaccagccatggcgatccggggcgtcgcctcctcccgcgaggacatgacgctggaggagttcaaggagtggctcaagcagttcgacgccgacggcgacggccggatcagccggaacgagctccgggaggcgctccgccgccgcggcggatggttcaccacctggaggagctgccgcgcccttcgccacgcngacaagaacaacagcggcttcctggacgactccgagatcgagaacctcgtcgccttcgcccagaaagatctcggcatgaaggtatccacctggtagaagagaacaacgaaccaagcagcgcagggggacagacagctgcaccatcctccagcatcgatctgtgacagaatctggctatgaactgatcgatgagccaccagtgtgtcgttgtattgtagcgcctagtgttaagtttagtgtttacgtgtgtaaccagctgcatgaggatgggcctcctccacggtactgcagagggactcaccctactaatgcatgggtcccccagatcagtgggagtagtgtgtttgcagtactgcagaggaaccccttccgctacatgcatgatgtagagttgtgtgcggctatggctatatccagaaatacaagaaattgagaaactggaccttctcacgcctcctaggtgagangatataagtttgaatcctttaaactttaaaggcgtgtacaatgaaggtgattaggtgaaaaaacagttttttcagcatgtcatatgcatcaagttcctacagggtgtgggatgagatgcttaagtttccatgcacccaatacttaatatgtgttaacatggtgggttttgtgccaatttaagc

SEQ ID NO: 4137 - DNA, 650 bp, Sorghum bicolor
attgccactgccagtgccagccatggcgatccgaggcgtcgcctccacccgcgaggacatgacggtggaggagttcaaggagtggctcaagcagttcgacgccgacggcgacggcaggatcagccggaacgagctccgggaggcgttgcgccgccgcggcggctggttcaccacctggaagagcagccgtgctcttcgccaggccgacaagaacaacagcggcttcctggacgactccgagatcgagaaccttgtcgctttcgcccagaaggatctcggcatgaagatatccacctggtagaagaagaaaagaagcgcgcgcagagtgacagacgcagagccggtgcatatgagaaattcatgaacatgaactagccatatacgaactgaagaccctgcagcgtcgttgtataaatactttgtattgtagcaacttgattttgtgtggttgattctgtatgtttgatacagtattacagtatctatgccaattgcacctcttcaataatgctatggtatgtgtatgtagtacgaatttataagaaaatgaaactgatgggtctttagctcaagcctccaattgctcggtcgactcaaaatacaggttcgttcggtcatcgtgtaactttttaattgcctaaatgttttgc

SEQ ID NO: 4138 - DNA, 739 bp, Sorghum bicolor
gcagatagcagcgaataaatccatgccactataaaaggaggcgttgatagatcagcctgcactcttcaggttgcagagcgcgagctgccattgccactgccagtgccagccatggcgatccgaggcgtcgcctccacccgcgaggacatgacggtggaggagttcaaggagtggctcaagcagttcgacgccgacggcgacggcaggatcagccggaacgagctccgggaggcgttgcgccgccgcggcggctggttcaccacctggaagagcagccgtgctcttcgccaggccgacaagaacaacagcggcttcctggacgactccgagatcgagaaccttgtcgctttcgcccagaaggatctcggcatgaagatatccacctggtagaagaagaaaagaagcgcgcgcagagtgacagacgcagagccggtgcatatgagaaattcatgaacatgaactagccatatacgaactgaagaccctgcagcgtcgttgtataaatactttgtattgtagcaacttgattttgtgtggttgattctgtatgtttgatacagtattacagtatctatgccaattgcacctcttcaataatgctatggtatgtgtatgtagtacgaatttataagaaaatgaaactgatgggtctttagctcaagcctccaattgctcggtcgactcaaaatacaggttcgttcggtcatcgtgtaactttttaattgcctaaatgttttgc

SEQ ID NO: 4139 - DNA, 643 bp, Setaria italica
ctgcgacaacagcaatcttcaggttgcaagaaagcaccagccatggcgatccggggcgtggcctcctcccgcgaggacatgacgctggaggagttcaaggagtggctgaagcagttcgacgccgacggcgacggcaagatcagccggaacgagctccgggaggccctccgccgccgcggcgggtggttcaccacctggaggagcggccgagcccttcgccaggccgacaagaacaacagcggcttcctggacgactccgaaatcgagaacctcgtcgccttcgcccagaaagatctcggcatgaaggtatccacgtggtagaaggacgcagagtcacagctgcatgatcctgcatgcgtgacacccatgaacctggctgcttctatgaactgatgagccagcacccacacccagcagtgtcctcctccttgtattgtgtagcacctaaattttgagctcctatctttgttttctccccttaatttgtgtggtgcttgatatgccgatcacttctcctgaatggtggtatgtgtaaacgccacacatgaggcttgtttgtatgttaagcatgacgcagttgtggctatgtccaggggtttgatgcttgtagtgcataagaaaatgaaactgggtcttttactca

SEQ ID NO: 4140 - DNA, 1891 bp, Sorghum bicolor
gctccatgactagtgtgccccacagctgagaatatttggagggcccactccacactcaggccaatgggctctgctgcgtgagcgtatagtagtcgcgctcttttctcgttatccgacacgccgggctgctacgtgtcccgcctggccctcccccactcctcgcccacacccttctggtctattcccgctgggtcccgcaagcactgggtcccacctgcctgcctccacaacgcctcggctctcccctagtcccctacaccgccgttcccctcccttgtccttgtcccttcccccaacttcccttttccttcccggaagagacgggcagacggcagagagccaccacggccatggaggacgccgcctcggagatcagcgactgggaggtgctctctgccacctccgcctgcgggggcggcgacgacgacgacgaggtattaatcgtctccggcggggccggcgacgtcgtcctcgaccacttcgccctcacccccgaccccgcagccgcctgccatggcgacggcgagggctcgtggtcggcacccggcggcgtctggcaagggttagaattattggatggattcgatccgattccggaatcaattgcatctggcgttaggagccagcagtcaccgccgccgataggcggcgtcgataacgcccccaaagaaggcttgattcttcaacccaccgtggcgcgcggtgcgacccgcatcgcatatggaaatcaagccgaggtggtagacgccgagattgagcaggagagtgattccgtgattagtcgcggggaattgtgcccggtgctgcagccggcgcatcatggcgcgggagaaactctggattctgatgctgctacacctacaggtgccctgctccaaagcgaggtatcggagagttcccttgtgcaattggatgatggaggaatcggtgcgggtgtagaaagctcgtgccttgaggatgcggtgtcaagtgatgggattcatggtgagcaagaagagcaggagcaggagcaagggagcaacgctaatgctgccactggttgcgatgaaccagatggagaggccaaggatggtgctttgcctctggctcacacgccaggtgctgaagaaggagagaaacaatttgttgtctggtggaggctgccgttcaagctgctgcacttctgtgcttggaaggtgaaaccagtgtggtccttctcaatcgccgcggcatttcttggcctggtcgtgctggggaggaggatgtacaggatgaagcgcaaggcaaggggcttgccccagattaagattgcgtttgatgataagagggcctcccagtttgctgatcgcgcggcacgtctcaacgaagccttcctggtagcgagacgtgtacctatgctaagaacatcatctggtgctacgcttccatggtcaatggttcaggacagatgagtgaagctgctcaaagttccctaggaaggttcctacaagcaaccattctggatgatgaacatcagtacgagcatcaggattggccttgcctaccttttgttttagatgacgcatcaaggaggatgccaatgttgatgtccgttgtctctctttctcttcttttttcttccttcaatttttgtttcttttttgaggaaccgcttggttttcattttttttagcctttactctgtttagtccatggtcagtggtggtgtcctaaaatttaccattcctacaacgttttttttttcttgttaatttggatgctagtgtgctcagttttcatgtgctcccttttgccattgtcgccctgttgtgtacttctcacactcctgtacagtgtgcactgatgatgatgatgttggcttaatggcttgtgcgtccaatcttcaacatcaatgccaaaacagttatcctct

SEQ ID NO: 4141 - DNA, 2277 bp, Sorghum bicolor
tccatgactagtgtgccccacagctgagaatatttggagggcccactccacactcaggccaatgggctctgctgcgtgagcgtatagtagtcgcgctcttttctcgttatccgacacgccgggctgctacgtgtcccgcctggccctcccccactcctcgcccacacccttctggtctattcccgctgggtcccgcaagcactgggtcccacctgcctgcctccacaacgcctcggctctcccctagtcccctacaccgccgttcccctcccttgtccttgtcccttcccccaacttcccttttccttcccggaagagacgggcagacggcagagagccaccacggccatggaggacgccgcctcggagatcagcgactgggaggtgctctctgccacctccgcctgcgggggcggcgacgacgacgacgaggtattaatcgtctccggcggggccggcgacgtcgtcctcgaccacttcgccctcacccccgaccccgcagccgcctgccatggcgacggcgagggctcgtggtcggcacccggcggcgtctggcaagggttagaattattggatggattcgatccgattccggaatcaattgcatctggcgttaggagccagcagtcaccgccgccgataggcggcgtcgataacgcccccaaagaaggcttgattcttcaacccaccgtggcgcgcggtgcgacccgcatcgcatatggaaatcaagccgaggtggtagacgccgagattgagcaggagagtgattccgtgattagtcgcggggaattgtgcccggtgctgcagccggcgcatcatggcgcgggagaaactctggattctgatgctgctacacctacaggtgccctgctccaaagcgaggtatcggagagttcccttgtgcaattggatgatggaggaatcggtgcgggtgtagaaagctcgtgccttgaggatgcggtgtcaagtgatgggattcatggtgagcaagaagagcaggagcaggagcaagggagcaacgctaatgctgccactggttgcgatgaaccagatggagaggccaaggatggtgctttgcctctggctcacacgccaggtgctgaagaaggagagaaacaatttgttgtctggtggaggctgccgttcaagctgctgcacttctgtgcttggaaggtgaaaccagtgtggtccttctcaatcgccgcggcatttcttggcctggtcgtgctggggaggaggatgtacaggatgaagcgcaaggcaaggggcttgccccagattaagattgcgtttgatgataagagggcctcccagtttgctgatcgcgcggcacgtctcaacgaagccttcctggtagcgagacgtgtacctatgctaagaacatcatctggtgctacgcttccatggtcaatggttcaggacagatgagtgaagctgctcaaagttccctaggaaggttcctacaagcaaccattctggatgatgaacatcagtacgagcatcaggattggccttgcctaccttttgttttagatgacgcatcaaggaggatgccaatgttgatgtccgttgtctctctttctcttcttttttcttccttcaatttttgtttcttttttgaggaaccgcttggttttcattttttttagcctttactctgtttagtccatggtcagtggtggtgtcctaaaatttaccattcctacaacgttttttttttcttgttaatttggatgctagtgtgctcagttttcatgtgctcccttttgccattgtcgccctgttgtgtacttctcacactcctgtacagtgtgcactgatgatgatgatgttggcttaatggcttgtgcgtccaatcttcaacatcaatgccaaaacagttatcctctacatctagttctagcgggtgggtgtctgcagccctccattcagtttcagtatgctgcagcttgaaagcttacctggagtgtgtctctctcagctggttcacggtcctactgggtggctgggcgcgcaaggttttcggtatgctgcagcttgaatgcctgttgtctcttactatgcacagatcctccggatgcgaaaggtttaggaaaaacagggttggtgcccgtaacagagttttgaactgaaaatgttggtttagatggcgcagaactgagcgcccttggtcgatcctgaccattccggtaattgaagaagagagttcttttccggtaattgtcctcttggctttaacagtgtcaactctgatgtaaatgatttcgatagcggcag

SEQ ID NO: 4142 - DNA, 1288 bp, Saccharum officinarum
tccctttccttcccggaagagacgggcagacggcagagcaaccacggccatggaggacgccgcctcggagatcagcgactgggaggtgctctctgccacctccgcctgcgggggcggcgacgacgacgaggtattagtcgtctccggcgggggcggcgacgtcgtcctcgaccacttcgccctcacccccgaccccgcagccgcctgccccggcgacggcgagggctcctggtcgggccccgggggcgcctggcaagggttagaattattggatggattcgatccgattccggaatcaagtttcaacctcgcaactggtgttaggagccagcagccgccgataggcggcgtcgataacgcccgcgaagaaggctcgattcttcaagccaccctggcgcgcggtgccgcccgtagcgcagacagaaatcaagcggaggaggtggtagacgccgagattgagcaggagagtaattccgtgattagccgcggggaattgtgcccggtgctgcagccggcgcatcatggcgtgggagaaactctggattctgatgcagctacacctgcaggtgcctcgctccaatgtgaggcatcggagagttcccttgtgcaattggatgatggagaaattgttgcgggtgtagaaagctcatgccttgaggatgctgtgtcaagtgatgggattcatggtgaacaagaagagcaggtgcaagggagcaacgctaatgctgccactggttgcgatgaaccagatggagaggccaaggatggtgctttgccgctggctcacacgccaggtactgaagaggagagaagcaatttgttgtctggtggaggctgccgttcaagctgctgcactactgtgcttggaaggtgaagccggtatggtccttctccatcgctgcggcatttctcggcctggtcgtgctggggaggaggatgtacaggatgaagcgcaaggcaaggggcttgccccagattaagattgcgtttgatgataagagggcctcccagtttgctgatcgcgcggcacgtctcaacgaacctttctggtacgagacgtgtaccaatgctaaaacatatttggtgctacgcttccatggcaatgattagacagatgatgaatctgttaaactccaagaggttccacaacaaccttctggttataacataatcacattgaatgtttcttccttttgttaaccataagaggcaagttaggcagggctctttctatttttcttaatttttttagacgttgcccggttatttttactctttacaggagggg

SEQ ID NO: 4143 - DNA, 2125 bp, Zea mays
gcctagaccgaaatcgccttcactgccactagcgggtccatgacaacctggccccgctgctgagtatatttggagggcccacttcacactcagtccaatggactccggccgctccggctccgctgcgtgaacggtagtcgcgcgcttttctcgttatccaacactcggggctgctacgtgtcccgcatgggcctcccccactcaccttttgtctcgcccacagccgcacagccttctggtctatgcccgctgggtccgccagcaccgggccccacttaattggcttctctcctgtctcctcctcggctctgccccacaccgccgttcccttcggtcagtcagttgtcccctcccccgcttccctttccttctcggaagagacgggcagacgaccatgtccatggaggacgacgcctcgaagatcagcgactgggaggtgctctctgccacctcttcccgcgggggcggcgacgacgatgaggtattaactgtctccggcgggggcggtgacgtcgtcctccttgaccacttcgtcctcacccccgaccccgcagcctcctgtcccggcgacggcgagggctcgtggtcggacgaccggggcgcctggcaagggttagaattattggatggattcgatccgattccggaagcaagtttcgatcttgcagttggtgttaggagccaacaactgctgataagcgacgtggatgacgcccgcgaagaaggctcgattgttcaagccaccgtggcgcgcggtgcgacccgtagcgcagaaggaaatcaagatgatgtggtagaggtcgagattgagcaggagagcagttccgtgattagccgcggtgcattgtgcccggtgctgcaggtggcggcggatcatggcgtggaagaaactctggattctgaggcagttacacctacaggtggctcgctccaaagccaggtatcagagagttcccttgtgcaactggatgatggaggaattggtgctggtgaaaaaagatcatgccttgaggatgctgtgtcaagtgatgagattcatggtgaacaagaagagcaggagcaagggagcaacgctaatgctgccattggttgcgatgaaccagatggagaggccaaggatgatgctttgccactggctcacacgccaggtactgaagagggagagaagtaatttgttgcctggtggaggctgccattcaagctgatgcactacaatgcttggaaggtgaagccagtatggtccttctccgtcgcagcggcacttctcggcctggtcgtgctggggaggaagatgtacaggatgaagcacaaggcaaggggcttgccccagattaagattgcgtttgatgataagagggcctcccagtttgctgatcgcgcggcgcgtctcaacgaagccttcctggtagcgagacgtgtacctatgctaagaacatcatctggtggtgcgacgcttccatggtcaatggttcaggacagatgagtgaagctgctcagagtcagggcaccgtaagaaggctcccgcaagcaatattctggatggtgaacgagcatctgaattggcttttgcctataccttctgtttttagatgacgcgtcaaggtggatgccaatgttgatggcagtggtctctctttctcttcttttttttttcacttagttttttcttttttaaggaaccacttattgtgctcctgatttccttttttttaatttttttgcccctactctgttttttctaacctctacatctagttctagcgggagtgggtgtctgcagccttgtattcagtatgctccagcttgaaagctcatctgaagtgttgtttcatctcagctggttcacaggccctactgggtgcgcaacattttctgtatgctgcagcttgaatgcctacagtattgtgtaatcagatctgtgttggtcccctgctgtctgttactatgcatagatcatctgggtgctctcaaggtgttaagaaagcaaggattggtgctcgtatgtaaggccgtaacagagttgtgaactgaactttttggtttacattgaacagaactgagcagcccttggtggatcctgagcattgcggaaactgaagaatagagttctttttttaaaaaaaaa

SEQ ID NO: 4144 - DNA, 3290 bp, Sorghum bicolor
cccaccgctctccctctccctctcgccgcgaccacgcgacgccgtgggaagcacacgcgcaagcgcaagcgcacggacctcgccccaccgctgtctgctgccaccgccgcggctcgccggagatggatggctccggcagctgggacgccatcgactggaaccaaatcgaggatccgaggccgcggaggtcgggccaggccgtcaaggagagcatggacgacttcctgctcgaggacgaggaggtgctcgcacagggccatggagttgttctactaaacaaccgtgaggctggtacactctcagttacaaatttccggcttctctttgtgagccaagcaaaaaaatgtgtcatagagctgggtaccattccactgacgacaattgagaagctaaatgacgatgtgaagctccaacccttgccccacctctctgataagaaccgcccccgtgaacttcttcaagtcattggcaaagacatgagaatcattgtgttcgcttttgttcccaaaacaaagcagaaaaatgaagtgtttgatgctttgaggagatacactaaacctgctaatttgtgggatctatacgcattttcttgtgacccatccgccattaagaatgattctgagccaaagtggcgtctcttgagggaatactttcgtctttttaggagaagtttaccactacagggagttgaggaagtttctttttgtaacgaatggtggaggctaactagagttaattctagttattcattgtgttcaacttacccctctgaactcattgtaccaagaagcataagtgatgaagatttatttcaagcctccacatttcgatcaggcaagcgcttgcctgttatttcatggtgtgaccctgggtctggagctgttctagcgaggtcatctcagccgatggtggggttgatgatgaactttagaaacaatgcggatgagaagcttgtctgtgctcttagcagcagaaccaccgatgagaaaggatctccaaggaaattgtacataattgatgcccggccaagagcaaatgctttagcaaatggggcaaagggtgggggctcagaatcatcttctaactaccccagatctgaggttctttttttaggaatacaaaacatccacacaatgagagatagtctttctcgccttagggactatgtggatgctcatggctcaatttcatcaaatggaagcccttcagctgtatctgttgttggagatcggaggaatcgtggatcaacctggggtggaggcaatctaaatagcatgacatcattttcttcaacactgggggaatggctaaaccatatccagaatattctggtcggtgcttcatggattgctgcacaaatttcagaagaagcagcgtcagttcttgtacattgcagtgatggatgggaccgtacaacccagttggttgcacttgcttgtttattgcttgatccctattatcgaactttcagtggattccaggctcttgttgaaaaggattggttagcatttggtcatccatttgcagagagaatgggagttccaacagtagctgagaatgtggggtcacagtatgagctactaaggcaaccttccctcggaaatttaagcagttctccaagtaggaacactttagggccatcaggaccatcctctaatccttcagttcaatctcagacatcaaacaactcttcaccgatattgttacagtggctcgattgtatctcgcagttgttacgtctgtacccatctgcatttcagttctcatcaaaattcctagttgattttatggattgtgtgctatcgtgtcgctttgggaacttcttgtgcaatagtgaacgggaaagggagcaatctggtgtcacaaactcctgtcgttgcatgtggtcatatttggctaatctaagagcttctggcggcagcttccatgagcactataatccattctatgatccagtaaagcacaatggtgcactattgccccctgctgcagcacttgccccaacactctggccccagttttatttgaggtggacatgccccattgagtcacaaggtggtgatcttgaatcccaatggcatgctatgaataaaaaatatgcagatgcaatgaaggcaaaggatattgctgagtggagggcaaaagatatcaaattgaaattggaatctatgaaacaagacttgcaaagggagaaacgtgctagtagtacagctttagccacagctcaaagtgctcaaagggagaatgctgccattaagaaggcgatagaatctataggatgcacaattaaattctcgacaagcgaagacgaggacaaaactgaagtgctgtcgtgttcattacgaagaggcgcagatggtagagctcagcaagatgaaaatggtgacttctctgtatcaatctctgcaattgaggacagcctggtctcggatgcaccaggggaccatttttgcgaatcactctgccccttccgcacaagagaagggtgcagatggccagatgctccgtgtgcacagcttggaagtcagtttgtcggtttgaaggcaaattttgatgcttttgaccggttgtctatacaggactgctattttggaccagagtagttgatcatgaaccagctgtgtcagtacatgcttggcagttgccaatggattttttcagtagttggcacctccaggtctgcatcaatagcaaaagaatgatgcatgtttgacgagtatttgcaaattccttcattcaacatttttttttcactatctgggtcctccgaatctgcatcaacagaatagcctggaaagcaaatcaaggatgcatacctgatatgcgtcacaggatttttcttgttccaatgatcttataagcttctgtgagggaattccagccttctatgatagtagttagcaatttgttaggaaccactgggattgaaatcagtccctgtatatagtttggcaagccattcataaaataagcaaaataaagtgaaacatgaaaaagaggaatagtttgttactctttttctgatagtgcagtgttcgactttgtaactcttagctttagaataagagccatgcacatcctgcttggaaaggaaatgttgtacatgaaagtatagacatgtggactggttcctgatccctccttacgattgtaatgatatagttttttcaagtgtcattgccttcctaatgttaactgtgggcaagactgtcaacgggtctgacaaacgttgttacttgtttagctgttcaggtgtgacatgcttcaacatcttgaaattgttactgaat

SEQ ID NO: 4145 - DNA, 3353 bp, Sorghum bicolor
ccagaacaaggcaagcgaacacatttctttccttgttttaattaattattaatcttcccccaccgctctccctctccctctcgccgcgaccacgcgacgccgtgggaagcacacgcgcaagcgcaagcgcacggacctcgccccaccgctgtctgctgccaccgccgcggctcgccggagatggatggctccggcagctgggacgccatcgactggaaccaaatcgaggatccgaggccgcggaggtcgggccaggccgtcaaggagagcatggacgacttcctgctcgaggacgaggaggtgctcgcacagggccatggagttgttctactaaacaaccgtgaggctggtacactctcagttacaaatttccggcttctctttgtgagccaagcaaaaaaatgtgtcatagagctgggtaccattccactgacgacaattgagaagctaaatgacgatgtgaagctccaacccttgccccacctctctgataagaaccgcccccgtgaacttcttcaagtcattggcaaagacatgagaatcattgtgttcgcttttgttcccaaaacaaagcagaaaaatgaagtgtttgatgctttgaggagatacactaaacctgctaatttgtgggatctatacgcattttcttgtgacccatccgccattaagaatgattctgagccaaagtggcgtctcttgagggaatactttcgtctttttaggagaagtttaccactacagggagttgaggaagtttctttttgtaacgaatggtggaggctaactagagttaattctagttattcattgtgttcaacttacccctctgaactcattgtaccaagaagcataagtgatgaagatttatttcaagcctccacatttcgatcaggcaagcgcttgcctgttatttcatggtgtgaccctgggtctggagctgttctagcgaggtcatctcagccgatggtggggttgatgatgaactttagaaacaatgcggatgagaagcttgtctgtgctcttagcagcagaaccaccgatgagaaaggatctccaaggaaattgtacataattgatgcccggccaagagcaaatgctttagcaaatggggcaaagggtgggggctcagaatcatcttctaactaccccagatctgaggttctttttttaggaatacaaaacatccacacaatgagagatagtctttctcgccttagggactatgtggatgctcatggctcaatttcatcaaatggaagcccttcagctgtatctgttgttggagatcggaggaatcgtggatcaacctggggtggaggcaatctaaatagcatgacatcattttcttcaacactgggggaatggctaaaccatatccagaatattctggtcggtgcttcatggattgctgcacaaatttcagaagaagcagcgtcagttcttgtacattgcagtgatggatgggaccgtacaacccagttggttgcacttgcttgtttattgcttgatccctattatcgaactttcagtggattccaggctcttgttgaaaaggattggttagcatttggtcatccatttgcagagagaatgggagttccaacagtagctgagaatgtggggtcacagtatgagctactaaggcaaccttccctcggaaatttaagcagttctccaagtaggaacactttagggccatcaggaccatcctctaatccttcagttcaatctcagacatcaaacaactcttcaccgatattgttacagtggctcgattgtatctcgcagttgttacgtctgtacccatctgcatttcagttctcatcaaaattcctagttgattttatggattgtgtgctatcgtgtcgctttgggaacttcttgtgcaatagtgaacgggaaagggagcaatctggtgtcacaaactcctgtcgttgcatgtggtcatatttggctaatctaagagcttctggcggcagcttccatgagcactataatccattctatgatccagtaaagcacaatggtgcactattgccccctgctgcagcacttgccccaacactctggccccagttttatttgaggtggacatgccccattgagtcacaaggtggtgatcttgaatcccaatggcatgctatgaataaaaaatatgcagatgcaatgaaggcaaaggatattgctgagtggagggcaaaagatatcaaattgaaattggaatctatgaaacaagacttgcaaagggagaaacgtgctagtagtacagctttagccacagctcaaagtgctcaaagggagaatgctgccattaagaaggcgatagaatctataggatgcacaattaaattctcgacaagcgaagacgaggacaaaactgaagtgctgtcgtgttcattacgaagaggcgcagatggtagagctcagcaagatgaaaatggtgacttctctgtatcaatctctgcaattgaggacagcctggtctcggatgcaccaggggaccatttttgcgaatcactctgccccttccgcacaagagaagggtgcagatggccagatgctccgtgtgcacagcttggaagtcagtttgtcggtttgaaggcaaattttgatgcttttgaccggttgtctatacaggactgctattttggaccagagtagttgatcatgaaccagctgtgtcagtacatgcttggcagttgccaatggattttttcagtagttggcacctccaggtctgcatcaatagcaaaagaatgatgcatgtttgacgagtatttgcaaattccttcattcaacatttttttttcactatctgggtcctccgaatctgcatcaacagaatagcctggaaagcaaatcaaggatgcatacctgatatgcgtcacaggatttttcttgttccaatgatcttataagcttctgtgagggaattccagccttctatgatagtagttagcaatttgttaggaaccactgggattgaaatcagtccctgtatatagtttggcaagccattcataaaataagcaaaataaagtgaaacatgaaaaagaggaatagtttgttactctttttctgatagtgcagtgttcgactttgtaactcttagctttagaataagagccatgcacatcctgcttggaaaggaaatgttgtacatgaaagtatagacatgtggactggttcctgatccctccttacgattgtaatgatatagttttttcaagtgtcattgccttcctaatgttaactgtgggcaagactgtcaacgggtctgacaaacgttgttacttgtttagctgttcaggtgtgacatgcttcaacatcttgaaattgttactgaatttgtg

SEQ ID NO: 4146 - DNA, 3653 bp, Setaria italica
atggaaacggggcgtggacgccgtggtcgcggtgaccggcggcgtagcaggatcaggatcgccggcgatggcgatctagatcgaggtcggggggcaacgcccaagattggtggaaccaaactcctgcccgcgtcacgctacccccaccccccaccccccacagccaggtcgcgtcgggcacgacacggtcgggcgggtcgattccctccgcagcaagccaacccagcccaacccaaacaagaccagaccagcccaacaggcaagcaaacacgtttctttctttccccctgttcggttccgttccgttcgtccccaccgctcgccctcctcccctctctctctctctccgcgaccgcgaccgcgaggcgccgcgggcgcacggaacggggacccgccgccgccgcagccgctccgccggagatggacggctccggcagctgggacgccatcgactggaaccaaatcgaggatccgaggccgcggaggttggttcagagcgtcaaggagagcatggacgacttcctgctcgaggacgaggaggttatcgcccagggccatggagttgttctattaaacaaccgcgagcctggtacactttcagtgacaaatttccgacttctctttgtgagccaagcaagaaaatgtgtaatggagttgggtaccattccgctgacgacaatcgagaggctaaacgatgatgtgaagcttcaaccccttccccacctctctgataagagccgtccccttgaacttctccaagtcattggcaaagacatgagaatcattgtgttcgcttttctgcccaagcagaaaaaggaagtgtttgatgctttaagaagatgcactaaacctgctaatttgtgggacctatatgcattttcttgcgatccatccaccatcaagaatgattctgagccaaagtggcggctgttgagagaatactttcgtctttttaggaaaagtttacctcagttacggggagttgaggaagtttctttgtcaaatgattggtggaggctaactagagttaattctagttatgcattgtgttcaacttacccctctgaactgattgtaccaaggggcataagtgatgaagatttatttcaagcttctacttttcgatcaggcaaacgcttgcctgttatttcatggtgtgaccctgggactggagctgttctggcaaggtcagctcagccaatggttgggttgatgatgaactttaggaacaatgccgatgagaagcttgtctgtgctcttagcagcagaaccaccaatgataaagtatctccaaggaaattgtacataatcgatgcccggccaagagcaaatgctttagcaaatggggcaaagggagggggttcagagtcatcctctaactaccccagatctgaggttctttttctaggtatacaaaacatccacacaatgagagatagtctttctcgccttagggactatgtggatgctcatggctcaatttcgtcaaatggaaccccttcagctgtatctgttgttggagatcggaggaatcgtggatcaacttggggtggaggcaatctaaatagcatgacatcattttcttcaacgctaggggaatggctaaaccatatccaaaatattctggttggtgcttcatggattgctgcacaaattgcggaagaagcagcatcagttcttgtccattgcagtgatggatgggaccgtacaacccagttggtggcactagcttgtttattgcttgatccctattatcgaactttcagtggattccaggcccttgtggaaaaggattggttagcatttggtcatccatttgcagagagaatgggagttccaacagtagctgagaacggaggatcgcaatatgagctactaaggcaaccttcccttgggaacttaagcagttcaccaagcaggacccctttagggccatcaggaccatcctccaatgcttcagttcaatcccagacatcaaacaactcttcaccgatattgttacagtggctcgattgtatctcgcagttgttacgtctgtacccatctgcatttcaattctcttctaaattcctagttgattttatggattgtgtgttgtcatgccgctttggaaacttcttatgcaacagtgagcgggaaagggagcaatctggtgtcacaaactcttgtcgttgcatgtggtcgtatttggctgatctaagagcttctggcggcagcttccatgagcactataatccattctatgacccagtaaagcataatggtgcactattgccccctgctgcagcacttgctccaaccctttggccccagttttatctgagatggacatgccccaatgaatcacaaggtggtgatcttgaatctcagtggcatgctatgaataaaaaatatgcagaagcaatgaaggcaaaggacatcgctgaatggagagcaaaagatatcaaaatgaaaatggaatctgtaaaacaagacttgcaaagggagagacatgcaagtaacacagcctcagccacggctcaaagtgctcaaagggagaatgctgccattaaaaaggcgattgaatctataggctgtacaatcaaattttcgacgagtgaaaaccaggaggatagaactgaagtgctgtcatgttcattgcgaagaggcacagatgctaggggtcaagaagatgaaaatggtgacttctctgtatcaatctctgcaattgaggacagcttggtctcagaagcaccaggggaccatttttgcgagtcactgtgccccttccgaacaagagatgggtgcagatggccagatgctccatgtgcacagcttggaagccagtttgttggtttgaaagcaaattttgatgcttttgatcggttatcgatacaagactgctattttggtccagagtagttgaccatgagctgttcttgttggtgttagatgcacttggcagttgccaatggaatttttttgtggttggcacctccaggtctgcatcaacagtaaaaggatgcgtggaaagcaactccatgatccacatttgacctgcatgcccgcattcacaaattccttcattcaatgattttgtctttagtgtctggctactccgaatctgcatcaacagcaaaataaaccattggaagcaaatagaggatgcaaagttgatatccattcacagtcgacttcaatggtgttcatatagtctttgtgggtttcagctaaatttctctggggaaattcggccttgtacattaggagttagcaactggctaggaaccactgggactgaaaattagtccttgtgctgtatatagtttggcaattgattcatacataagcaaaataatgcgaaatgtggaagagaagaatactagttcttttcactaactttttacagtacatgtcttgtataggttagcgagaataaggacaatgcgcatcctgcttgaaaagaaatgctgtacatgaaaatacggacgtgtggaatgtttgcaccattgtttcagagtccctgacacttgcaatgacgtataccttttccttttctttcgcaaaatttgtggcattgctaaatactaataagaactgcggatgctagccaatcaacatgtataagtattacaaaatattctagcagttcagttttgataattgtattcaac

SEQ ID NO: 4147 - DNA, 2515 bp, Zea mays
tattctccaggctccagtccacccgatctattctacccaaattccccactccacgccgccgccgccgccgccgccatgggaagaaaagacacctcgtcctcctccgcggccaccggcggcgggaaaaaggagaaacctatgtcggtgtccgccatgctcgcctccatggacgctcccgcggccaaggccaagtcttccaaggccaaggccaaggccaagccttccaaggcgccggcgtcctcctacatgggcgacatcgacctgcccccctccgacgacgaggacgaggaggaggcccggctcgccgccgccgccaagcccaagccggcccgcgccgccgtcgtcgatctcagcgccggcgccgcgccgtcgcacaaggacgccaagaagaaggacaagcgcgaggccgtggcggccgcggccgccgaggccgccaggcaggaggcgctccgggacgaccgcgacgccttctccgtcgtgatcggcgcgcgcgtcccgggctcctccgccgacgacggcgccgtcgacgacaacgtcagggacgtcgtgctcgagaacttctccgtctccgcgcgcggcaaggagctgctcaagggcgcctccctccggatctcgcacggccgcaggtacggcctcgtcggccccaacggcatgggcaagtccaccctgctcaagctgctggcctggcgccaggtccccgtgccacggaacatcgacgtcctgctcgtcgagcaggagatcatcggcgatgaccgctcggcccttgaggcggtggtcgccgctgacgaggagctcactgccctccgagccgagcaggccaggcttgaggtctctaatgacgctgatgacaacgagcggctcttggaggtgtacgagaagctgaatctccgggactctgatgccgcccgtgcccgagcgtccaagattctcgcggggctggggttcgatcaggcgatgcaggccagatccacgaagtccttcagtggtggctggaggatgcggatttcgctcgcccgtgcgctcttcatgcagccaacgctgctgctccttgacgagccgactaaccacctggatctgcgagctgtgctgtggctggaggaatacttgtgctcgcagtggaagaagacattgatcgtcgtgtcccacgaccgcgactttctgaacacagtgtgcaatgagatcatacacttgcatgataaaagcctgcatgtctaccgtggaaactttgatgattttgaaagtgggtatgagcagaagaggaaggaaatgaaccgaaagtttgaggtgtatgagaagcagatgaaggcagccaggaagtctgggagcaaggccgcacaggataaggttaagggtcaggctctgtcaaaggctgctaaagaggccgccaagaacaaggggaaggggaagagtgctgcagatgatgacgatgaccagaaacatgtggctgtgccacagaagtggcgtgactacagcgtcgagttccatttcccagagccgacagagctcacaccacctctccttcagctcatcgaggtagggttcagctaccctggcaggccagacttcaagctctcaggtgttgatgttggcattgatatgggaacgcgcgtagccattgttgggcccaatggagctgggaagtctaccatacttaatttacttgccggtgatcttacccctactgaaggcgaggtaaggaggagccagaagctgaggattggacgatactcgcagcattttgttgacctactgacaatggaggaaaatgcagttcaatatttgttgaggcttcacccggaccaggagggaatgagcaaagcagaggctgtccgcgctaagctcgggaagtttgggttacctggacacaaccatctcacgccaatcgttaaactatccggcgggcagaaggcccgagttgtgttcacctctatatcaatgtctcagcctcacatactcctgctcgacgagccaacgaaccacttggacatgcaaagtatcgatgcattggcagacgcgctggatgagttcacaggaggtgtcgtcttggtcagccacgactcgcggttaatatcccgtgtctgcgatgatgagcaaaggagcgagatatgggttgtggaggacgggagtgtggataaatatgacggcacgtttgaggattacaaggatgaactcatggaagaaatcaagaaggaagttgaagagtaacgccgctccaaattagttgtgctttgctgttatttatagaacaagctgttttcttgaactgaaattgcatgtactgttagcgagttttcttactctggtttgcagagtattcatgtggttacaactctggagaacaatatggggcatgcctgttttatgttatacaaggggaacctgagaatatggtattatttgtttgtaccttttgttctgacatcatatatgtgactggacaggagcagtacttttcaatctgctctcatgtttgtagaagctgaacaacgagaaatgaagatatgacttgtatgcc

SEQ ID NO: 4148 - DNA, 2550 bp, Sorghum bicolor
aaaaatccccgatctattctactcccccctggccctaagccaaacccaaattccccacccacgacgacgccgccgccgccgccaccgccaccaccacctcctcctccatgggaagaaaagacacctcatcctcctccgcggccgccggcggcgggaaaaaggacaaacctatgtcagtatccgccatgctcgcctccatggacgcccccgcagcgaagcccaacaagtcgtccaagtcggcggcgccgtccaaggccaaggcgaagccctccaaggcgccggcgtcgtcctacatgggcgacatcgacctgcccccttccgacgacgaggacgaggaggaggccgcccagcgcgccgcagccaagcccaaggcggcccgcgccgcagtggtcgacctcagcgccggcgccgcgccgtcgcagaaggacgccaagaagaaggacaagcgcgaggccgtggcggccgcggccgccgaggccgccaggcaggaggcgctccgcgacgaccgcgacgccttctccgtcgtcatcggcgcgcgcgtcaccggcgacgacggcggcggcggcgtcgacgacaacgtcagggacatcgtgctcgagaacttctccgtctccgcgggcgggaaggagctgctcaagagcgcctccctccggatctcgcacggccgcaggtacggcctcgtcggccccaacggcatgggcaagtccacgctgctcaagctcctggcatggcgccaggtccccgtgccacggaacatcgatgtcctgctcgtcgagcaggagatcatcggtgacgaccgctcggcccttgaggctgtggttgccgctgatgaggagctcaccgccctccgggccgagcaggcgaggcttgaggcctctaatgatgctgatgataacgagcggctcgtggaggtctatgagaagctgaatctccgggactctgatgctgcccgggccagagcgtccaagattcttgcggggctggggttcgatcaggcgatgcaggctagatccacaaagtccttcagtggtggatggaggatgcgtatttcgcttgcccgtgcgctcttcatgcagccaacgctgctgctcctcgatgagccgactaaccacctggatctaagagctgtgctatggctggaggaatacttgtgctcgcagtggaagaagacattgattgttgtgtcccatgaccgtgactttctgaatacagtgtgcaatgagatcatacacttgcatgataaaagtcttcatgtctatcgtggaaactttgatgattttgagagtgggtatgagcagaagaggaaggagatgaacaagaagtttgtgatgtatgaaaagcagatgaaagcagccaggaagtctgggagcaaggccgcgcaggataaggttaagggccaggcgctgtcaaaggctgctaaagaggccgccaagaacaaggggaaggggaagagtgctgcagatgacgacgatgaccagaaacaggtggctgtgccacagaagtggcgtgactacagtgttgaattccatttcccagagcctacagagctcacaccacctctccttcagctcattgaggtagggttcagttaccctggtaggccagacttcaagctctcaggtgttgatgttggcattgatatgggaacacgtgtagctattgttgggccgaatggagctggaaagtctactctgcttaatttacttgctggtgatcttaccccaactgaaggggaggtaaggaggagccagaagctgagaattggacgatactcacagcattttgttgacttattgacaatggaggaaaatccagttcaatatttgttgaggcttcacccagatcaggagggaatgagcaaagcagagactgtccgtgctaagcttgggaagtttgggttacctggacacaaccatctgactccaattgttaaattatctggtgggcagaaggcccgagttgtgttcacttctatatcaatgtctcaacctcacatactcctgcttgacgagccaacgaatcacttggacatgcaaagtattgatgcattggcagacgcactggacgaattcactggaggtgtcgtcttggttagccacgactcacggttaatatctcgtgtttgtgaggatgagcaaaggagtgagatatgggttgtggaggatgggactgtgaatagatatgacggcacatttgaggattacaaggatgaactcatggaagaaataaagaaggaagttgaagaataatgctgctccaagttagttgtgctttgctgttcttttatagaacaggctgttttcttgaactaaaattgcatgtactattagtgagttttctttactctggtttgcagagtattcatatggttacaactctggaacaatatgagacatgcttgttttatgttatacaagagaacctgagaatatggtattatttgtttgtatgttttgttctgacatatatgtgactggactggagtggtacttcttaatctgctctcaagactatagaagctgaacaatgagaaatgaagatatgacaacc

SEQ ID NO: 4149 - DNA, 2774 bp, Sorghum bicolor
cacgaaaccccagcggacacggggctgggtctgggtctgggtaatccagttccaacccgagtggaatctgagccggagacggcccggaccggaccatctctcctgctccttcccctcctccagtccacaaaaaatccccgatctattctactcccccctggccctaagccaaacccaaattccccacccacgacgacgccgccgccgccgccaccgccaccaccacctcctcctccatgggaagaaaagacacctcatcctcctccgcggccgccggcggcgggaaaaaggacaaacctatgtcagtatccgccatgctcgcctccatggacgcccccgcagcgaagcccaacaagtcgtccaagtcggcggcgccgtccaaggccaaggcgaagccctccaaggcgccggcgtcgtcctacatgggcgacatcgacctgcccccttccgacgacgaggacgaggaggaggccgcccagcgcgccgcagccaagcccaaggcggcccgcgccgcagtggtcgacctcagcgccggcgccgcgccgtcgcagaaggacgccaagaagaaggacaagcgcgaggccgtggcggccgcggccgccgaggccgccaggcaggaggcgctccgcgacgaccgcgacgccttctccgtcgtcatcggcgcgcgcgtcaccggcgacgacggcggcggcggcgtcgacgacaacgtcagggacatcgtgctcgagaacttctccgtctccgcgggcgggaaggagctgctcaagagcgcctccctccggatctcgcacggccgcaggtacggcctcgtcggccccaacggcatgggcaagtccacgctgctcaagctcctggcatggcgccaggtccccgtgccacggaacatcgatgtcctgctcgtcgagcaggagatcatcggtgacgaccgctcggcccttgaggctgtggttgccgctgatgaggagctcaccgccctccgggccgagcaggcgaggcttgaggcctctaatgatgctgatgataacgagcggctcgtggaggtctatgagaagctgaatctccgggactctgatgctgcccgggccagagcgtccaagattcttgcggggctggggttcgatcaggcgatgcaggctagatccacaaagtccttcagtggtggatggaggatgcgtatttcgcttgcccgtgcgctcttcatgcagccaacgctgctgctcctcgatgagccgactaaccacctggatctaagagctgtgctatggctggaggaatacttgtgctcgcagtggaagaagacattgattgttgtgtcccatgaccgtgactttctgaatacagtgtgcaatgagatcatacacttgcatgataaaagtcttcatgtctatcgtggaaactttgatgattttgagagtgggtatgagcagaagaggaaggagatgaacaagaagtttgtgatgtatgaaaagcagatgaaagcagccaggaagtctgggagcaaggccgcgcaggataaggttaagggccaggcgctgtcaaaggctgctaaagaggccgccaagaacaaggggaaggggaagagtgctgcagatgacgacgatgaccagaaacaggtggctgtgccacagaagtggcgtgactacagtgttgaattccatttcccagagcctacagagctcacaccacctctccttcagctcattgaggtagggttcagttaccctggtaggccagacttcaagctctcaggtgttgatgttggcattgatatgggaacacgtgtagctattgttgggccgaatggagctggaaagtctactctgcttaatttacttgctggtgatcttaccccaactgaaggggaggtaaggaggagccagaagctgagaattggacgatactcacagcattttgttgacttattgacaatggaggaaaatccagttcaatatttgttgaggcttcacccagatcaggagggaatgagcaaagcagagactgtccgtgctaagcttgggaagtttgggttacctggacacaaccatctgactccaattgttaaattatctggtgggcagaaggcccgagttgtgttcacttctatatcaatgtctcaacctcacatactcctgcttgacgagccaacgaatcacttggacatgcaaagtattgatgcattggcagacgcactggacgaattcactggaggtgtcgtcttggttagccacgactcacggttaatatctcgtgtttgtgaggatgagcaaaggagtgagatatgggttgtggaggatgggactgtgaatagatatgacggcacatttgaggattacaaggatgaactcatggaagaaataaagaaggaagttgaagaataatgctgctccaagttagttgtgctttgctgttcttttatagaacaggctgttttcttgaactaaaattgcatgtactattagtgagttttctttactctggtttgcagagtattcatatggttacaactctggaacaatatgagacatgcttgttttatgttatacaagagaacctgagaatatggtattatttgtttgtatgttttgttctgacatatatgtgactggactggagtggtacttcttaatctgctctcaagactatagaagctgaacaatgagaaatgaagatatgacaaccaaatgcccttttctttacctttagcatagcgctactctagcagtaagcttcttagagtaagagtcagcagaagctgtgtccatctggcaaggcct

SEQ ID NO: 4150 - DNA, 2907 bp, Setaria italica
aatccccgatctaaccctgcggggctaagccaaacctaaatccccctcccacgccgccgtctccgccgccaccaccgcatcgatgggacgcaaagactcctcctcgtcgtcctcctccgccgccgccggcggcgggaagaaggacaagcccatgtcggtctccgccatgctcgcctccatggacgcgcccgcggccaagggcaagtcctccaagtcggcggcgccctccaagcccaagggcaagccatccaaggcgccggcctcctcctacatgggcgacatcgacctgcccccctctgacgacgaggaggacgaggccgagctcgccgccgccgccgccaagcccaagccgtcccgcgccgccaccgtcgacctcagctccggcgtcgcgccgacccagaaggacgcgaagaagaaggacaagcgcgaggccatggcggccgcggccgccgaggccgccaggcaggaggcgctccgcgacgaccgcgacgccttctcggtcgtcatcggcgcgcgcgtccccggatccgccacggccgatgacggcgccgtcgacgacaacgtcaaggatatcgtgctggagaacttctccgtctccgcgcgcggcaaggagctgctcaagagcgcctccctccggatctcacacggccggaggtacggcctcgtcggccccaacggcatgggcaagtccaccttgctcaagctcctggcctggcgccaggtccccgtgccccggaacattgatgtcttgctcgtggagcaggagattattggtgatgaccgatcggccctcgaggctgtggtcgctgctgatgaggagctcacagccctccgtgctgagcaggccaggcttgaggcgtccaataatgctgatgataatgagcggcttgttgaggtgtatgagaagctgaatctccgggactcagatgctgcccgagcgcgtgcatccaagatcctcgcggggctggggtttgatcagtctatgcaggcaagatccacaaagtccttcagcggtggctggagaatgcgcatatcacttgcccgtgcactcttcatgcagccaactctgctgctcctggatgagccgactaaccatctggatctccgagctgtgctatggttggaggaatacttgtgctcgcagtggaagaagacactgattgttgtgtcccatgaccgggacttcctgaatacagtttgcaatgagatcatacatttgcatgataagagtctgcatgtctaccgtggcaattttgatgattttgagagtggctatgagcagaagaggaaggagatgaaccgaaagtttgaggtatatgaaaagcagatgaaagcagccaggaagtctgggagcaaggctgctcaggataaggttaagggtcaggcgctgtcaaaggctgctaaagaggctgccaagaacaagggtaaggggaagaatacagcagatgatgatgatgaccagaaacaggcggctgtgccgcagaagtggcgtgactacagtgttgagtttcatttcccagaacctactgagcttacaccacctctccttcagctcattgaggtagggttcagctacccttgtaggccagatttcaagctgtctgatgttgatgttggcattgatatgggaactcgtgtagctattgttggtccaaatggagcagggaagtctaccctgcttaatttacttgccggtgatcttacccctacagaaggggaggttaggaggagccagaagctgaggattgggcgatactctcagcattttgttgacttgttgacaatggaggaaaatgcagttcaatatttgttgaggcttcacccagatcaggagggaatgagcaaagcggaggctgtccgtgctaagcttgggaaatttgggttacctgggcacaaccatctcaccccaattgttaaattgtctggtggtcaaaaggcccgtgttgtgttcacttctatatcgatgtctaaccctcacattctcctgctcgatgagccaacaaatcacttggacatgcaaagtattgatgcattggcagatgcactggatgagttcactggaggtgtcgtcttggttagccatgactcaagattgatatcacgtgtttgtgaggatgagcaaaggagcgagatatgggtagtggaggaaggcactgtgaagaaatatgatggcacgtttgaggattacaaggatgaactcatggaagaaataaagaaggaagttgaagaataatgctactccaaatgagttgtgctttgcttgttctttgtagaacaagctgttttcttgcactgaaattgcatgtactattagtgtcttttcttttctctggtttgcagagtattcatatatggttacaactctgaaagaatgtaagatgaggtaatatttgtttgtatgttctgttctgagttatggtttggtcagaaattttcagtggtatacctccacatgaaccgcatttggtctttaaccacataaatgttataaggtgatttttaactttaatgttaaatgcatatcaggatttttgtttgtgtctggcagatattcagatattgtacatttatctttcttagaatgttcctgacttcccatgttgtcttttttgcccttgcagtgcttgatcttgactgtttggtacctagtgttacactgtgcattgaactatcatagctatgtctgtcattggttccaagaactcatacaaacatggcgccataattaactgccaaatgatgaaaatgtgatgtggttaggtagttctgttttctctggttcggatactatttttatgattatgagtccaaaacactacaagatgagctctgctttatttgtgcttagtatatgagagtccaagactgattatttatgattgttgccatcaaggtatagttgttttt

SEQ ID NO: 4151 - DNA, 2463 bp, Pennisetum glaucum
ccaccgcatccgcatcggcatcgacatcgatgggacgcaaagactcctcgtcgtcctccgccgccgccggcggcgggaagaaggaaaagcccatgtctgtctccgccatgctcgcctccatggacgcgcccgcggccaagggcaagtccgccaagtcggcggcgccgtccaagcccaagggcaagccatccaaggcgccggcctcctcctacatgggcgacatcgacctgcccccctccgacgaggaggaggacgaggccgagctcgccgccgccgccgccaagcccaagccgtcccgcgccgccgccgtcgacctcagctccggcgtcgcgccgacccagaaggacgccaagaagaaggacaagcgtgaggccatggccgccgcggccgccgaggccgccaagcaggaggcgctccgcgacgaccgcgacgccttctccgtcgtcatcggcgcgcgcgtccccggatccgcctcggccgatgacggcgccgtcgacgacaacatcaaggatatcgtgctggagaacttctccgtctccgcgcgcggcaaggagctgctcaagagcgcctccctccggatctcgcacggccggaggtacggcctcgtcgggcccaacggcatggggaagtccaccctgctcaagctcctggcctggcgccaggtccctgtgccccggaacattgatgtcctcctggtggagcaggagattattggtgatgaccgatcggccctcgaggctgtggttgctgctgatgaggagctcacagctctccgtgctgagcaggccagacttgaggcgtccactaatgctgatgatgatgagcggcttgctgaggtgtatgagaagctgaatctccgggactcagacgctgcccgtgcccgtgcatccaagatcctggcagggctggggtttgatcagtctatgcaggcaagatccacaaagtccttcagtggtggctggaggatgcgcatatcacttgcccgtgcactcttcatgcagccaacgctcctcctcctggatgagccgactaaccatctggatctccgagctgtgctatggttggaggaatacttgtgctcgcagtggaagaagacacttattgttgtgtcccatgaccgggacttcctgaatacagtgtgcaatgagatcatacatctgcatgataagagtttgcatgtctaccgtggcaattttgatgattttgagagtggctatgagcagaagagaaaggagatgaaccgaaagtttgaggtgtacgaaaagcagatgaaagcagctaggaagtctgggagcaaggctgcacaggataaggttaaaggccaggctctgtcaaaggctgctaaagaggccgccaagaacaagggtaaggggaagaatgcagcagatgatgacgatgatcagaaacagttggctgtgccacagaagtggcgtgactatagtgttgagttccatttcccagagcctacggagcttacaccacctctccttcagctcattgaggtagggttcagctaccctggcaggccagatttcaagctctctgatgttgatgttggcattgatatgggcactcgtgtagctattgttggtcccaatggagcagggaagtctaccctgcttaatttactcgctggtgatcttacccctacagaaggggaggttaggaggagccagaagctgaggattgggagatactcacagcattttgttgatttgttgacaatggaggaaaatgcagttcaatatttgttgaggcttcacccagatcaggagggaatgagcaaagcggaggctgtccgtgctaagcttgggaaatttgggttacctgggcacaaccacctcaccccaattgttaaattgtcgggcggtcaaaaggctcgtgttgtgttcacttctatatcgatgtctaaccctcacattctcctgctcgacgagccaacaaatcacttggacatgcaaagtattgatgcattggcagatgcacttgatgagttcactggaggagttgtcttggttagccatgactcaagattgatatcacgtgtttgtgaggatgagcaaaggagcgagatatgggtggtggaggaaggcactgtgaagaaatacgatggcatgtttgaggattacaaggatgaacttatggaagaaattaagaaggaagttgaagaataatgctgctccgactgagttgtcctctgcttgttctatgtagaacaagctgttttattgcactgaaattgcatgtactagtagtgtcttttcttttctctggtttgcagagtattcatatggttacaaactctgaacattgtaagatgaggcatgattgctttactttatgttatataagaaagcctgagaatatggtaatatttgtttgtatattctgttctgagctatggtttggtcaaattttcagcggtatacctccaaaaaaaaacttccgtgcactatactatta

SEQ ID NO: 4152 - DNA, 2662 bp, Oryza sativa
cacagcagagccgtcccgatctaatcgaccgagcccaaaactaaccctaaattccccagctccccaccacgccgccgccgccgcctccatgggccgcaaagatacttcctcgtcgtcctccgccgccggcggcaagaaggacaagccgatgtcggtctccgccattctggcctccatggacgcgccggcgtccaaggccaagccatccaaggcggcgtccaagcccaagccctccaaggcgcccgcgtcgtcttacatgggcgacatcgacctgcccccctccgatgaggaggaggacgacgccgacctcgttgccatggccacgaagcccaaggcggcccgcgccaccgtcgacctcaacgccatcgcgccctcgcagaaggacgcgaagaagaaggacaagcgcgaggcgatggcggccgcgcaagccgaggcggccaagcaggaggcgctccgcgacgaccgcgacgcattctctgtcgttattggcgcgcgcgtcgctggatccgccggggcctccgagggtgactccgccgccgccgatgacaacatcaaggatattgtgctcgagaacttctctgtttctgcccgcgggaaggagctactcaagaacgcctcgctccggatctcgcacggccggcgctatggcctcgtcgggcccaacggcatgggcaagtccacccttctgaagctgctgtcatggcggcaggtcccggtgccccggagcattgatgtcctgcttgtggagcaggaaattattggagacaatcgttcagcgctcgaggctgttgttgctgctgatgaagagctcgcagcgcttcgtgccgagcaggcaaagctcgaggcctctaacgatgctgatgacaatgagcggcttgctgaggtttatgagaagctcaacctccgggattctgatgctgcccgggctcgtgcatccaagatccttgctgggctggggtttgatcaggctatgcaggccaggtccactaaatcgttcagtggtggctggaggatgcgcatctcgcttgctcgtgcgctgttcatgcagccaacattgttgctgcttgatgaaccgactaatcatcttgacctccgagctgttctttggttggagcaatacttgtgctcacagtggaagaaaacactgattgttgtgtcccatgatcgcgacttcctgaacacagtttgcaatgagatcattcatttgcatgataagaatctgcatgtttatcgtggaaattttgacgactttgagagtgggtatgaacagaagaggaaggagatgaataggaagtttgaggtgtttgaaaagcagatgaaggcagcaaagaagactgggagcaaggcagcgcaagacaaggtcaaaggtcaggcactatcaaaggctaataaggaggctgccaagagcaaggggaagggaaagaatgtagcaaatgatgacgacgacatgaagccagctgatcttccacagaaatggcttgactacaaggttgagttccacttcccagagccaactttgctcacaccaccgctccttcagctcattgaggtgggcttcagctaccctaataggccagatttcaagctgtctggtgttgatgttggcattgacatgggaacacgtgttgcaattgttggtcccaatggggcaggaaaatctacacttcttaatttacttgctggtgatcttaccccaaccaaaggagaggtaaggaggagtcagaagctgaggattgggcgatactcacagcattttgttgacttactgacaatggaggaaaatgcagttcagtatttgctcaggctccatcctgatcaggagggaatgagcaaagcagaggctgtacgtgcgaagctcggaaaatttggtttaccagggcacaaccatctcactccaatagttaaattatctggtggacagaaggcccgtgttgtgttcacttcaatatcaatgtcacatccccacattctcctgctggatgagccaacaaatcacctagacatgcaaagtatcgatgcattggcagatgcactggatgaattcactggtggtgtggtcttggttagccatgactcgagattgatctctagagtgtgtgacgatgagcagaggagtgagatatgggttgtagaagatggcactgtgaacaaatttgatggaacatttgaggactacaaggatgaacttttggaagaaatcaaaaaggaagttgaagagtaatgtgtttttatagttgcaggatactgcttattctttatagactgggctggtaaacttaatgtactagtacttattttctttggtttgcagagtatttgtatggttgagtccgaaacacctattcgagctgttcttgctttttgcatgatctaagaggttccaggatgagtctgataaatatgttttctatgattttgctgccaattactctgtactaagacttccatgatatacatccataataattcagtatgatttcatgttattggctcatataattaatattatattatgctcagcggtactttatgttggtcagattaatccaaattattatcaaattcttggtcaattagttcaatatatggttgaatgcctatatgcttatggatggaatgctcactgaacaatcatatggaactgcagcactgaattgaaagc

SEQ ID NO: 4153 - DNA, 2664 bp, Hordeum vulgare
ccgacccgtgcggtctcctgtcctcacaccccgcccgcgcggagctctaaccctaaccctagcgcgccgccgccgccgccgccgcctcccggtccgtcacgccgccaacccacccggaccccagccgccaccccggcacctccatatcctctcgagcttgacctcgccggaccacagccaaacccagattccccaacctcgccgttcttctcctcctcctccgccgccatgagtcgcaaaaacgcctcctcgtcctcctcagccgcgggggccgccggcaagaaggaaaaacctctctccgtgtcggccatgctagcttcgatggacggcacggggcccaaatccaagcccgccaaggcggctcccaaagccaagccctccaaggcgcccgcgtcgtcgtacatgggcggcatcgacctgcccccgtcggacgacgaggaggacgaggccgacgtcgccgccgtcgctgccaagcccaagccagctcgcgccaccgtcgacctcaacgccctcgcgccctcggacaaggactcgaagaagaaggagaagcgcgagatgatggcggcggccgtcgctgaggctgccaagcgggaggcgctccgcgacgaccgcgacgccttctccgtcgtcataggagcgcgcgtccccggatccgccgagggcgatgccgccatcgatgggaacatcaaggacatcgtgctcgacaacttctctgtctctgcgaggggaaaggagctgctcaagggcgcctccctccggatctcgcatggtcgccgctacggtctcgtggggcccaatggcatgggcaaatctaccctcctgaagctgctctcgtggcggcaggtgcccgtgcccaagaacattgatgtcctgcttgtggagcaggagattgttggtgatgaccgctcggcaaccgaggcggtggttgcagccaatgaggagctcaccgcgctccgagctgagcaggcaaagcttgaggcctctaacgaccccgatgacaacgacaagcttgctgaggtatacgagaagctaaatctatgcgactctgatgctgcacgagcacgtgcgtccaaaatcctcgcggggctgggttttgatcaggcgatgcaggcaaggtccacaaagtccttcagtggtggttggaggatgcgcatctcgcttgcccgtgctctcttcatgcagccaacgttgctgctccttgatgagcctaccaaccatttggacctccgagctgtgctttggttggagcagtacttgtgctcgcagtggaagaagaccctaattgtggtttcccatgaccgggacttcttgaacacagtgtgcaatgatatcattcatttgcacgataagagtctgcatgtctaccgtggcaattttgatgacttcgagagcgggtacgagcagaagaggaaggagatgaacaggaagtttgaggtgtatgaaaagcagatgaaagcagcaaggaagactgggagcaaggctgcacaagataaggttaaagaccaagcaatgtcaaaggcccataaagaagttgccaaggggaaggggaagggaaagaatgtggcaaatgatgatgataacgtgaagccagcggatctgccccaaaagtggcatgactacaaagtcgagttccacttcccagaacccactttgcttacaccaccactccttcagctcatcgaggtgggtttcggctaccccaaccgtccggacttcaagttatcagatgttgatgttggcattgacatgggaacacgtgttgccattgttgggcccaatggggcaggaaagtctactattctaaatttacttgctggtgatcttaccccatcagaaggagaggcaagaaggagccagaagctgaggattggacggtactcgcagcattttgttgacttgttgacgatggaggaaaatgcagttcagtatttgctcaggcttcacccagaccaggggggaatgagcaaagcggaggctgtccgtggcaagcttggaaaatttggcttgccaggtcacaaccatcttactcccattgttaaattatctggcggtcagaaggcccgtgttgtgttcacttcgatatcaatgtcgaatcctcacattctcctactggatgagcctacaaatcacttggatatgcaaagtattgatgctttggcagacgctctggatgaattcactggaggtgtggtcttggttagccatgactcgcggttgatatctcgagtttgtgacgatgagcagaagagccagatatgggttgtggaggatggcacggtgactaaatatgatggatcgtttgaggactacaaggatgaactaatggcagaaataaagaaggaagtcgaagagtaatgctgctcatattgagctgcacattgcttattctttgtagaatgagctggtttgttctcctgaaatcccatgtattaccagcagctttcgtttgctttgttttgcagaatatacatatggtttgtcatatgcgtactatctatatggccaagatgagttatttgttttgccttctctgcgttacaagatactggaaatctggtagtgtttcttttgtacgattttgcgtaacactgtcgtactaatgcatctttaactgttatgtctcatgatactaatagtcatgagtaaggatatctccttggcgat

SEQ ID NO: 4154 - DNA, 2624 bp, Brachypodium distachyon
caacttcaccagaacaagcctcccggagtccaaccctaattaacaagccaagcgcaaattccccaacctcaccgtcctccgccgccgccgtcctccatgagccgcaaaaattcctcctcgtcctcctcctcctcctccggcgccggtggtggcaagaaggagaagcctctctccgtttccgccatgctagcttcaatggacgggccggctcccaacgccaggccctccaaggcggcgtccaaacccaagccctccaagcagccagcgtcgtcgtacgtggacgacatcgacttgcccccgtccgacgaggaagaggatgaggccgacgtcgccgccatcaccgccaagcccaagtcctctcgtgccaccgtcgacctcaacgccctcgcgccgtcggataaggactcgaagaagaaggacaagcgcgagtcgatggcggccgcggccgccgaggccgccaagagggaagctctccgcgacgaccgcgacgccttctccgttgtcatcggcgcccgcgttcccggatccgccggggccgtcgacggcgatgccgccgatgggaacatcaaggacatcgttctcgagaacttctctgtgtccgcgcgagggaaggagttgctcaagagcgcctcgctccggatctcgcacggtcggcgctacggcctcgtggggcccaacggcatggggaaatcgacccttctgaagctgctcgcttggcggcaggtccctgtgcccaagaacattgatgtccttcttgtggagcaggaaattgttggtgacgaccgttcggcgaccgaggcagtggttgcagcaaacgaagagctcacggcactacgggctgagcaggtaaagcttgaggcttctgacgatcctgatgacaatgagaagctggccgagatctatgagaaactcaatctatgcgactcagacgctgcacgggctcgtgcagcgaaaatcctcgcggggcttgggttcgatcaggcgatgcaggcgaggtctacaaagtccttcagtggtggctggaggatgcgcatctcccttgcccgtgctcttttcatgcagccaacattgctgctgcttgatgagcctacaaaccatttggacctccgagctgtcctttggttggagcagtacttgtgctcgcagtggaagaagactctgattgtagtgtcccatgaccgcgacttcctgaacacagtgtgcaatgacatcatacatttgcacgataagagtctgcatgtttaccgtggcaattttgatgattttgagagtgggtatgagcagaagaggaaggagatgaataagaagtttgaggtatatgaaaagcagatgaaagcagctaggaagactgggagcaaggctgcacaagataaggttaaaggccaagcactgtcgaaggctcataaagaagtagccaaggggaaggggaaggggaagaatgtggctaatgatgatgatagcgtgaagccagcggatctgccgcagaagtggcttgactacaaagtcgagttccacttcccagaacctactttgctcacaccacccctccttcagctcattgacgtgggtttcagctaccccggtcggcctgacttcaagttatcagatgttgatgttggcattgacatgggaacacgtgttgccattgttgggcccaatggggctggaaagtctactcttctaaatttacttgctggtgatcttacccctggtgatggagaggcaagaaggagccaaaagctgaggattggacgctactcgcagcattttgttgacttgttgacaatggaggaaaatgcggttcagtatttgctcaggctccaccctgaccaggagggaatgagcaaagcagaggctgtccgtgccaagctaggaaaatttggcttgccaggtcacaaccatcttactcccatcgttaaattgtctggtggtcagaaggcccgtgttgtgttcacttcaatatcaatgtcgcatcctcacattctcttactggatgagccaacaaatcacttggacatgcaaagtattgatgcgttggcagatgctctggatgaattcactggaggtgtggtcttggttagccatgactcgaggttgatatctcgagtttgtgatgatgagcagaagagtcagatatgggttgtggaggatggcaccgtgaacaaatatgatggttcatttgaggattacaaggatgaactaatggcagaaataaaaaaggaagtggaagagtaaagctgctcatattgactcgcttattgcttattatttgtagaatgagctggtttcttgtcctgaaatctcatgtcttactggcagtttttgttttcattgatctgcatcatattcatatggttcatatgcataatatttgtatggtcaagatgagtacttttttccattataagttacaggagactgggaatcttttacgtttcttttgtgctaaattatcctgtactaagatatgttgcatggaatacctccatattacatttcctcattttgaactgccaaatgttcagtgtattatggttatatatgtgttcagcagattaatacaatgatattgttattcttagattactaacactatgggatgatcatgcacttctagtggttca

SEQ ID NO: 4155 - DNA, 2502 bp, Brachypodium distachyon
ctccgccgccgccgtcctccatgagccgcaaaaattcctcctcgtcctcctcctcctcctccggcgccggtggtggcaagaaggagaagcctctctccgtttccgccatgctagcttcaatggacgggccggctcccaacgccaggccctccaaggcggcgtccaaacccaagccctccaagcagccagcgtcgtcgtacgtggacgacatcgacttgcccccgtccgacgaggaagaggatgaggccgacgtcgccgccatcaccgccaagcccaagtcctctcgtgccaccgtcgacctcaacgccctcgcgccgtcggataaggactcgaagaagaaggacaagcgcgagtcgatggcggccgcggccgccgaggccgccaagagggaagctctccgcgacgaccgcgacgccttctccgttgtcatcggcgcccgcgttcccggatccgccggggccgtcgacggcgatgccgccgatgggaacatcaaggacatcgttctcgagaacttctctgtgtccgcgcgagggaaggagttgctcaagagcgcctcgctccggatctcgcacggtcggcgctacggcctcgtggggcccaacggcatggggaaatcgacccttctgaagctgctcgcttggcggcaggtccctgtgcccaagaacattgatgtccttcttgtggagcaggaaattgttggtgacgaccgttcggcgaccgaggcagtggttgcagcaaacgaagagctcacggcactacgggctgagcaggtaaagcttgaggcttctgacgatcctgatgacaatgagaagctggccgagatctatgagaaactcaatctatgcgactcagacgctgcacgggctcgtgcagcgaaaatcctcgcggggcttgggttcgatcaggcgatgcaggcgaggtctacaaagtccttcagtggtggctggaggatgcgcatctcccttgcccgtgctcttttcatgcagccaacattgctgctgcttgatgagcctacaaaccatttggacctccgagctgtcctttggttggagcagtacttgtgctcgcagtggaagaagactctgattgtagtgtcccatgaccgcgacttcctgaacacagtgtgcaatgacatcatacatttgcacgataagagtctgcatgtttaccgtggcaattttgatgattttgagagtgggtatgagcagaagaggaaggagatgaataagaagtttgaggtatatgaaaagcagatgaaagcagctaggaagactgggagcaaggctgcacaagataaggttaaaggccaagcactgtcgaaggctcataaagaagtagccaaggggaaggggaaggggaagaatgtggctaatgatgatgatagcgtgaagccagcggatctgccgcagaagtggcttgactacaaagtcgagttccacttcccagaacctactttgctcacaccacccctccttcagctcattgacgtgggtttcagctaccccggtcggcctgacttcaagttatcagatgttgatgttggcattgacatgggaacacgtgttgccattgttgggcccaatggggctggaaagtctactcttctaaatttacttgctggtgatcttacccctggtgatggagaggcaagaaggagccaaaagctgaggattggacgctactcgcagcattttgttgacttgttgacaatggaggaaaatgcggttcagtatttgctcaggctccaccctgaccaggagggaatgagcaaagcagaggctgtccgtgccaagctaggaaaatttggcttgccaggtcacaaccatcttactcccatcgttaaattgtctggtggtcagaaggcccgtgttgtgttcacttcaatatcaatgtcgcatcctcacattctcttactggatgagccaacaaatcacttggacatgcaaagtattgatgcgttggcagatgctctggatgaattcactggaggtgtggtcttggttagccatgactcgaggttgatatctcgagtttgtgatgatgagcagaagagtcagatatgggttgtggaggatggcaccgtgaacaaatatgatggttcatttgaggattacaaggatgaactaatggcagaaataaaaaaggaagtggaagagtaaagctgctcatattgactcgcttattgcttattatttgtagaatgagctggtttcttgtcctgaaatctcatgtcttactggcagtttttgttttcattgatctgcatcatattcatatggttcatatgcataatatttgtatggtcaagatgagtacttttttccattataagttacaggagactgggaatcttttacgtttcttttgtgctaaattatcctgtactaagatatgttgcatggaatacctccatattacatttcctcattttgaactgccaaatgttcagtgtattatggttatatatgtgttcagcagattaatacaatgatattgttattc

SEQ ID NO: 4156 - DNA, 2522 bp, Secale cereale
cgcgccgccaacccacccggaccccgtccgccgcagccaaacccaaatcccccaacatcgccgttcttctccacctccgccgccgccatgagtcgcaaaaacgcctcctcgtccacctcagccgccgccacgggtcgcaaaaacgccccctcgtcctcctcggccgcgggcgccgccggcaagaaggaaaagcctctctccgtgtcggccatgctagcttcgatggacggcacggcgcccaaacccaagcccgccaaggcggcgcccaaacccaagccctccaagacgcccgcgtcgtcgtacatgggcggcatcgacctgcccccgtcggacgacgaggaggacgaggccgacgtcgccgccgtcgccgccaagcccaagccggctcgcgccaccgtcgacctcaacgccctggggccctcggacaaggacgcgaagaagaaggaaaagcgcgagatgatggcggcggccctcgccgaggctgccaagcgggaggcgctccgcgacgaccgcgacgccttctccgtcgtcataggagcccgcgtccccggatccgccgctgagggcgatgccgccgatggaaacatcaaggacatcgtgctcgacaacttctctgtctctgcgcgaggaaaggagctgctcaagggcgcctccctccggatctcgcatggtcgccgctacggtctcgtggggcccaatggcatgggcaaatccaccctcctgaagctgctctcttggcggcaggtgcctgtgcccaagaacattgatgtcctgcttgtggagcaggagattgttggtgatgaccgctcagcaaccgaggcggtggttgcagccaatgaggagctcacggcgctccgggctgagcaggcaaagcttgaggcctctaacgaccctgatgacaacgacaagcttgccgaggtatacgagaagctaaatctatgcgactctgatgctgcacgcgcgcgtgcgtccaaaatcctcgcagggctggggtttgatcaggcgatgcaggcaaggtccacaaagtccgttcaggtggaggctggaggatgcgcatctcgcttgcccgtgccctcttcatgcagccaacattgctgctccttgatgagcctaccaaccatttggacctccgagctgtgctttggttggagcagtacttgtgctcgcagtggaagaagacccttattgtggtttcccatgaccgggacttcttgaacacagtgtgcaatgatatcattcatttgcacgataagagtctgcatgtttaccgtggtaattttgatgacttcgagagcgggtatgagcagaagaggaaggagatgaacaagaagtttgaggtgtatgaaaagcagatgaaagcagcaaggaagactgggagcaaggctgcacaagataaggttaaagaccaagcaatgtcaaaggcccataaagaagttgccaaggggaaggggaagggaaagaatgtggcaaatgatgatgataacgtgaagccagcggatctgccacaaaagtggcatgactacaaagttgagttccacttcccagaacccactttgctcacaccaccactccttcagctcattgatgtgggtttcggctaccccaaccgtccggacttcaagttatcagatgttgatgttggcattgacatgggaacacgtgttgccattgttgggcccaatggagcaggaaagtctactattctaaatttacttgctggtgatcttaacccatccgaaggagaggcaagaaggagccagaagctgaggattggacgatactcgcagcattttgttgacttgttgacgatggaggaaaatgcagttcagtatttgctcaggctccacccagaccaggggggaatgagcaaagcggaggttgtccgtgccaagcttggaaaatttggcttgccaggtcacaaccatcttactcccattgttaaattatctggtggtcagaaggcccgtgttgtgttcacttcgatatcaatgtcgaatcctcacattctcctcctggatgagcctacaaatcacttggatatgcaaagtattgatgctttggcagacgctctggatgaattcactggaggtgtggtcttggttagccatgactcaaggttgatatctcgagtttgtgacgatgaggagaagagccagatatgggttgtggaggatggcacggtgactaaatttgatggctcgtttgaggattacaaggatgaactaatggcagaaataaagaaagaagtcgaagagtaatgctgctcatattgagctgcacattgcttattctttgtagaatgagctgctttgttctcctgaaatcccatgtattatcagcagcttttgtttgcttcggtttgcagaatatacatatggtttgtcatatgcatactatctatatggccaagatgagttatttgtttgccttttctacatcaagatactggaaatctggtggtgtttcttttctacaatttttcgcaacactgtctactaatgcatcttggttggtatacttcc

SEQ ID NO: 4157 - DNA, 2673 bp, Triticum aestivum
cctgtcctcacaccccgcccgcgcggagctctaaccctaaccctagggcgccgccgcctccaccccgcctacccccggtccgtcgcgccgccaacccacccggaccccatccgccacagccaaacccaaattccgcaacatcgccgttcttctcctcctccgccgccgccatgagtcgcaaaaacgcctcctcgtccacctcagccgccgccacgagccgcaagaacgccccctcgtcctcctcggccgcgggcgccgccggcaagaaggaaaaacccctctccgtgtcggctatgctagcctcgatggacggcacggcgcccaaatccaagcccgccaaggcggcgcccaagcccaagccctccaaggcgcccgcgtcgtcgtacatgggcggcatcgacctgcccccgtcggacgacgaggaggacgaggccgacgtcgccgccgtcgccgccaagcccaagccgtctcgcgccaccgtcgacctcaacgccctcgcgccctcggacaaggactcgaagaagaaggagaagcgcgagatgatggcagccgccgtcgccgaggctgccaagcgggaggcgctccgcgacgaccgcgacgccttctccgtcgtcatcggagcgcgcgtccccggatccgccgccgacggcgatgccgccgatggaaacatcaaggacatcgtgctcgacaacttctctgtctctgcgcgaggaaaggagctactcaagggcgcctccctccggatctcgcatggtcgccgctacggtctcgtggggcccaatggcatgggcaaatccaccctcctgaagctgctctcctggcggcaggtgcctgtgcccaagaacattgatgtcctgcttgtggagcaggagattgttggtgatgaccgctcggcaaccgaggcagtggttgcagccaatgaggagctcacagcgctccgggctgagcaggcaaagcttgaggcctctaacgaccccgatgacaatgacaagcttgccgaggtatatgagaagctaaatctatgtgactctgatgctgcacgcgctcgtgcgtccaaaatcctcgcggggctggggtttgatcaggcgatgcaggcaaggtccacaaagtcattcagcggtggctggaggatgcgcatctcgcttgcccgtgctctcttcatgcagccaacattactgctgcttgatgagcctaccaaccatttggacctccgagctgtgctttggttggagcagtacctgtgctcgcagtggaagaagacccttattgtggtttcccatgaccgggacttcttgaacacagtgtgcaatgatatcattcatttgcacgataagagtctgcatgtttaccgtggtaattttgatgacttcgagagcgggtatgagcagaagaggaaggagatgaacaagaagtatgaggtgtacgaaaagcagatgaaagcagcaaggaagactgggagcaaggctgcacaagataaggttaaagaccaagcaatgtcaaaggcccataaagaagttgccaaggggaaggggaaaggaaagaatgtggcaaatgatgatgataacgtgaagccagcggatctgccacaaaagtggcatgactacaaagtcgagttccacttcccagaacccactctgctcacaccaccactccttcagctcattgatgtgggtttcggctaccccaaccgtccggacttcaagttgtcagatgttgatgttggcattgacatgggaacacgtgttgccattgttgggcccaatggagcaggaaagtctactattctaaatttacttgctggtgatcttaacccatccgaaggagaggcaagaaggagccagaagctgaggattggacgatactctcagcattttgttgacttgttaacgatggaggaaaatgcagttcagtatttgctcaggctccaccctgaccaggggggaatgagcaaagcggaggctgtccgtggcaagcttggaaaatttggcttgccaggtcacaaccatcttactcccattgttaaattatctggtggtcagaaggcccgtgttgtgttcacttcgatatcaatgttgaatcctcacattctcctactggacgagcctacaaatcacttggatatgcaaagtatagatgctttggcagacgctctggatgaattcactggaggtgtggtcttggttagccatgactcgaggttgatatctcgagtttgtgacgatgaagagaagagccagatatgggttgtggaggatggcacggtgactaaatatgatggctcgtttgaggattacaaggatgaactaatggcagaaattaagaaggaagtagaagagtaatgctgctcatattgagctgcacattgcttattctttgtagaatgagctggtttgttctcgtgaaatcccatgtattatttgcagcttttgtttgctttggtttgcagaatatacatatggtttgtcatatgcgtactatctatatggccaagatgagttatttgtttgccttttttacattacaagatactggaaatctggtggtgtttcttctgtgcgattttgcgcaacacagtcttactaatgcatcttgggtggtattacttccataatgcatcttgggttagcaaaattgttatggaaggatcgcccgcccttaagttggatgtttctt

SEQ ID NO: 4158 - DNA, 2126 bp, Panicum virgatum
gctgccgaggccgccaggcaggaggcgctccgcgacgaccgcgacgccttctccgtcgtcatcggcgcgcgcgtccccggatccgccaccgccgatgacggcgccgtcgacgacaacgtcaaggatatcgtgctcgagaacttctccgtctccgcgcgcggcaaggagctgctcaagagcgcctccctccggatctcgcacggacggaggtacggcctcgtcggccccaacgggatgggcaagtccaccctgctcaagctcttggcctggcgccaggtccccgtgcccaggaacattgatgtcttgctcgtggagcaggagattattggtgatgaccggtcggccctcgaggctgtggttgctgctgatgaggagctcacagcactccgtgctgagcaggccaggcttgaggcgtctaataacgctgatgacaacgatcgtcttgttgaggtgtatgagaagctgaatctccgggactcggacgctgcccggtcgcgtgcatcaaagatcctcgcggggctggggtttgatcaggctatgcaggccagatccacaaagtccttcagcggtggctggaggatgcgcatatcacttgcccgtgcgctcttcatgcagccaacgctgctgctcctggatgagccgactaaccatctggatctcagagctgtgctatggttggaggaatacttgtgctcacagtggaagaagacattgattgttgtgtcccatgaccgggacttcctgaatacagtgtgcaacgagatcatacatttgcatgataagagtctgcatgtctatcgtggcaattttgatgattttgagagtggctatgagcagaagaggaaggagatgaaccgaaagtttgaggtgtatgagaagcagatgaaagcagccaggaagtcaggtagcaaggctgcacaggataaggttaaaggtcaggcgctgtcaaaggctgctaaagaggccgccaagaacaagggtaaagggaagaatgcagcagatgatgatgatgaccagaatcaggtagctgtgccacagaagtggcgtgactacagtgttgagttccatttcccagagcctactgagctcacaccacctctccttcaactcattgaggtagggttcagctacccaggtaggccagacttcaagctgtctgatgttgatgttggcattgatatgggaactcgtgtagctattgttgggcccaatggggcagggaagtctacccttcttaatttacttgctggtgatcttagccctacagaaggggaggttaggaggagccagaagctgaggattgggcgatactcacagcattttgttgacttgttgacaatggaggaaaatgcagttcaatatttgttgaggcttcacccagatcaggagggaatgagcaaagcagaggctgtccgtgctaagcttgggaagtttgggttacctggacacaaccatctcactccaattgttaaattgtctggtggtcagaaggcccgtgttgtgttcacttctatatcgatgtctcaacctcacattctcctgcttgatgaaccgacaaatcacttggacatgcaaagtattgatgctttggcagatgcactggacgagtttactggaggtgttgtcttggttagtcacgactcaagattgatatctcgtgtttgtgaggatgagcaaaggagtgagatatgggttgtggaggatggcacggtgaagaaatatgatggtacattcgaggattacaaggatgaactcatggaagaaataaagaaggaagttgaagaataatgctgctccaaatgagaagtgctttgcatgttctttgtagaacaagctgttttcttgcactgaaattgcatgtactattagtgggttttttctctctagtttgcagagtattcatatggttacaactcttaaacaatgtaagatgaggcgtgcttgctttactttatgttataagaaagcctgagaatatggtagtattggagtgtatgttttgttctgagttgtggttctgtcaagacatttttcagtgatatacctccacatgaattgcatatgatctttaaccacataataaatgttgtaaggtgacatatacttcacttttaatattgaatgta

SEQ ID NO: 4159 - DNA, 857 bp, Zea mays
aatttgccaggaaatcaaagcaaacactggccataaccgcagcatcgtcagccgccggacgggagcagcttaggaagaggaggccgacgccgtactgctagcacaagccaagaaatgggcgcgctctgcctgctctacccatccacgccgccgcgctgcccatgcggcgcccgcgcggacgcgaccgcggccttcgcgccttcccctttcctctcatcatgtgctgccaccggtgcacaaacaaggctgcagctctgcggcaggagccagaggcgcggcggcgtggcgcgggtaggtggcggcggcggtgggggcaagggggagagtggcaagaacggcgcggcggcgttctttgatgaggacggggtggtggacgacatggacgggtacctcaactacctgtccctcgagtacgactctgtctgggacaccaagcctgcctggtgtcagccttggacaatattgcttacgggaactggtgccgttgcctgtagttgggtgcttatccaatctgctgtaattactgctggggtttcttttgtaatatgcgcatggtggtacatatttctctactcgtaccctaaggcatacaccgagatgatagcagagagaagaagaaatgtagccagtggagctgaagatacctacgggatggagaaaatccagtgaggatctacggcggcgctgcttgtagagtgcataactctcttgtgttgtgtctagcatttccttgctgagggtgatatttagaaatgaccgcacgctgtggcacgtactagcacgatttgtctgtaaatgtattcgccagaaattgcaacaataccatggaatcatgtcatgtgcttgctttgttcata

SEQ ID NO: 4160 - DNA, 846 bp, Sorghum bicolor
aaattgtctggaaatcaaagcaaacactggccataaccgcagcatcggcagccgccggacggaagcagctctaggaaggggaggcatacgccattctgcgagctcaaggcaagaaatgggcgcgctctgccttctctgcccgtgcccatccacgccgccgccctgcccatgcggcacccgcgcgaccgcgccttcccctttcttctcctgtgcccccaccgctgccgccacaaggctgcagctctgcggcaggagccagaggcgcgccggcgtggcgcgtgtaggtggcggcggcgggggcaaaggggagagtggcaagaccggcgcggcggcgttctttgatgaggatggggtggtggacgacatggatgggtacctcaactacctgtctctcgagtacgactctgtttgggacaccaagcctgcctggtgtcagccttggacaatattgcttacgggaactgttgtagtcgcctgtagttgggtgcttattcaatctgctgtaattactgctggagtttcttttgtaatatgtgcatggtggtacatatttctctactcctaccctaaggcatacaccgagatgatagcagagagaagaagaaaggtagcaagtggagctgaagatacctacgggatggagaaaatccagtgaggatctccggcagcgctgcttgtagagtacagtactctgttgtgtcttgcattttcttgctcagagtgatagttagaattgaccgcaggctgtggcacttagcacgatttgtctgtaaaaaatgtattccccagaaattgcaacaatgaatcatgctgcttgctttgttcataacttcatatcgtcggctc

SEQ ID NO: 4161 - DNA, 976 bp, Sorghum bicolor
ccggaacctctgagaattgccagaaactttttaattgcaagatgatatatggagtacggcataaaaatttgtctggaaatctattacaaaaaaaaaaaaattgtctggaaatcaaagcaaacactggccataaccgcagcatcggcagccgccggacggaagcagctctaggaaggggaggcatacgccattctgcgagctcaaggcaagaaatgggcgcgctctgccttctctgcccgtgcccatccacgccgccgccctgcccatgcggcacccgcgcgaccgcgccttcccctttcttctcctgtgcccccaccgctgccgccacaaggctgcagctctgcggcaggagccagaggcgcgccggcgtggcgcgtgtaggtggcggcggcgggggcaaaggggagagtggcaagaccggcgcggcggcgttctttgatgaggatggggtggtggacgacatggatgggtacctcaactacctgtctctcgagtacgactctgtttgggacaccaagcctgcctggtgtcagccttggacaatattgcttacgggaactgttgtagtcgcctgtagttgggtgcttattcaatctgctgtaattactgctggagtttcttttgtaatatgtgcatggtggtacatatttctctactcctaccctaaggcatacaccgagatgatagcagagagaagaagaaaggtagcaagtggagctgaagatacctacgggatggagaaaatccagtgaggatctccggcagcgctgcttgtagagtacagtactctgttgtgtcttgcattttcttgctcagagtgatagttagaattgaccgcaggctgtggcacttagcacgatttgtctgtaaaaaatgtattccccagaaattgcaacaatgaatcatgctgcttgctttgttcataacttcatatcgtcggctctgtggtcgtgttatgtgttacggcacacccccg

SEQ ID NO: 4162 - DNA, 1683 bp, Setaria italica
ggcccacgcatcagtaatggcctcagctcctcaccaccagataatctgcttgctttatcttctcccgattcctcgagggacacgcagcagcgccaagcagcgaggcatccatggaggtggtgggcggcgtgtcgctgaggccgtcgtcggcgcaggcgccggcgcgcatcgggaagctgtcgcccgtcgacgtgggcgggcgcttcgtgctcagggcggcgccgcggaggcaaccggcgaggcgcgcgctggtggtggaggcccgggggaggagctggtcggagcggcagatggagcagcagcggcgcatgccgcagcttcccaagatcgaggacgacggcaacccgcgcttcgtcatcttcattcgcaccgccaatgtctacttctggtacccgctcaacatcatcaccggcggcacgacggcgaagatcatgctcgccgccaaggacaacttcctcggcaagtacatctacaaggacacgctcgccaggaacctcgctgccgtcatttacaaagatgaggatgtgatcatcgacaccgcaaaagagcaataccgtgtgttgaagaccgaaaatgagtttagatatggctacaaagttgtggagaatgggaacgttaggtctgcgcttacgacaagtaatgtgatcgaacttccaaagaaagacgagctcaaaaccgttgttgacaaggtgaaagacttctttggcgacgtaactgctggcgccaaagaatcctttgcacagatcacaggatctgctgtgaccaaagaggacgaggaagcacaaggcaaagagaagttccgctcaaagagacgaaagaagcagcggaagtcgaagcagggactcaaaacggagaaatgattgtgtcattcagcacgtcaggggtcgttagacaagtgaagcaccggccgaagttttgttatctatgtccagagttgctctgtaatttctccagatttaaatttttgcaaagagacattgtgtaacctccttgcgactaacgtgtgtgatgactttctcgctaaatcttgcaaaattcggtgaaggttacagctgtatattaatttcatttcttggaagtttgaaagtgagtgtggctgtacagtgcggatacgattttggatcatatggcaactcaattttctttatgtgttaaatatcaaagcactttatgtaggttacaaaagggcaccagtgtcgagtatgtcaaaccagtaacttaacgaagattgcacagaaccacatatatgagacttgaaatgggaaaacaaggttggccacaaaagtaacgtccatgggatggagctgcaccttcctcattctacagacccttgggatacatgtaccgaattcacgcttaaaacacaagttctcttagaaacttgttcccggcgcaagaagagcaacgctcatgtcttaatggaagcctaggtgaagacgacgcaagaagtccagtgcgggaaacattggcagggcgctgaaggagctgcaacagaaacagcaactcttataggtcaatgactcgtgaaagcttctgtatgcggttcagcaagaagtccccttgcttgatggttgcctggtagaaagcattcctctcatctggtcggtttgtctccagaacaccagcaaccttatcaattttgcagtgaagctttccagctgcaatgaaccgtgagagttccct

SEQ ID NO: 4163 - DNA, 1672 bp, Setaria italica
gcaggatcccagtatccattgtttgtttccacaaaggattattttttgtttttcagatttttattcctgacaagccaaaaatgtagcaggaggagaggagcagggaggggcagccagctcggcggagccacatgatcctcgccatctcgccgtcactgcccctccaccactcaccccggctttgaataccccaccgtgctcagtctccacccaaacccaatccatccaaacccatttccctccctcccatcccgcccctctcccttccactccctcctccgccaccgccgccgctggtgttgatccccgtcgccgcggatccaccaccagccagccatgtcgtgctcccacctctccaccgcgtggtcctcctcggcgctcgccagcagcgcctcctccacccggcggcgctcctccgccccgcgctccggcggcagcggcctcgtggtgcggtgctccctccgcgagctccgcagccgcatcgactccgtccgcaacacgcagaagatcaccgaggccatgaagctcgtggccgccgccaaggtccggcgcgcgcaggaggccgtcgtctcctcccgccccttctcggaggcgctcgtggaggtcctctacaacatgaaccaggagatccagacggaggacatcgacctgccgctcacccgcacccgccccgtcaagaaagtggccctcgtggtcctcaccggcgagcgcggcctctgcggcagcttcaacaacaacgtgctcaagaaggcggacacccgcatcgacgagctcaagcagctgggcctcgaatacacgtcatcagcgtggggaagaagggcaacgcctacttccagcgccgccctacatcccgctggagcgggagctggaggtgagcggcgtgcccaccgtgaaggactcgcaggccatctgcgacctggtgtactcgctcttcgtctccgaggcggtggacaaggtggagctgctctactccaagttcgtgtccctggtgcgctccgaccccatcatccagacgctgctgcccatgtcccccaagggggagatctgcgacgtcaacggcgtgtgcgtggacgccacggaggacgagctgttccgcctcaccaccaaggaggggaagctcaccgtggagcgcgagaaggtgaagatcgagacgcagcccttctcccccgtggtgcagttcgagcaggaccccgtgcagatcctcgacgcgctgctcccgctctacctcaacagccagatcctccgcgccctgcaggagtcgctcgccagcgagctcgccgcccggatgagcgccatgagcagcgccaccgacaacgccatcgagctccgcaagaacctctccatcgcctacaaccgccagcgccaggccaagatcaccggggagatcctcgagatcgtcgccggcgccgacgccctcgctggctgagcttgagccgtcctccttatactaaaactgagccgagctgagccggtggtggcgttctttcttggtgcggtgctcctgctatatataattctttctctcgccttcttgctgttcagtctgtctgtaattcctgatagcacaaacacaaagggagttctgtattccatgctcgtcgtcgcgagatacacaagaatttcaattcagagatgccaaatgtataacccgagtatctttatcttgcaaatc

SEQ ID NO: 4164 - DNA, 1539 bp, Saccharum officinarum
cgtcagcggcatgctgcaaagcgggtgcagccagctcggcggagccacatgatcctctcgccatctcggcgtcactgcccctccaccactcagctcggcttgaataccccaccatgctcaactctccacccaaacccaatccatccaaacccatttccctccctcccgtcccgtcccgtacccccgtctcttccgcttgcaccccccgcgcgccgccgctggtgatccccgtcgccgcggaccagcagcagccatgtcgtgctcccacctctccaccgcctggtcctcctcggcgctcgccagcagcgcctccaccacccagcggcgctccgccccgcgctcgggcctcgtggtgcggtgctccctccgcgagctccgcacccgcatcgactccgtcaagaacacgcagaagatcacggaggccatgaagctagtggccgccgccaaggtccggcgcgcgcaggaggccgtcgtctcctcccgccccttctcggaggcgctggtggaggtgctctacaacatgaaccaggagatccagacggaggacatcgacctgcccctcacccgcacccgccccgtcaagaaggtggcgctcgtcgtcctgaccggcgagcgcggcctctgcgggagcttcaacaacaacgtgcttaagaaggcggagacccgcatcgaggagttcaagcagctgggcctccagtacagcgtcatcagcgtggggaagaagggcaacgcctacttccagcgccgcccctacatcccgctggagcgggacctggaggtgaacggcgtgcccaccgtcaaggattcgcaggccatctgcgacctcgtctactcgctcttcgtctcggaggaggtggacaaggtggagctgctctactccaagttcgtttcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatccttgacgcgttgctcccgctctacctcaacagccagatcctccgtgccctgcaggaatcgctcgccagcgagctcgccgcccggatgagcgccatgagcagcgccaccgacaacgccatcgagctcgccaagaccctctccatctcctacaaccgacagcgccaggccaagatcaccggtgagatcctcgagatcgtcgccggtgccgaagccctcgcctgagcctgagaccttgtgatttgtgtgagccgagcttgtgccctgtggtggccttcttggtgcggggctcctgctatatataattctttctcattttcttcttggccactctgcctgtaattcctgatagcacaaacgcagcggagttctgtgttcctcgcgacatacacaagaatttcaatccagagatgccaaaatgtataatccgagta

SEQ ID NO: 4165 - DNA, 1478 bp, Sorghum bicolor
cgcccctgtctgtctcttctgcttcccccccgcgcgccgccgcccgctggtgatccccgtcgccgcggaccagcagcagcagccatgtcgtgctcccacctctccaccgcctggtcctcctcggcgctcgccagcagcgcctccaccacccagcggcgcggaagctccgccccgcgctcgggcctcgtggtgcggtgctccctccgcgagctccgcacccgcatcgactccgtcaagaacacgcagaagatcacggaggccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctgagcccttgtgacttgtgtggtgcggggctcctgctatatataattctttttctcattttcctgctgtccactctgcctgtaattcctgattagcacaaacgcaacggagttccgtgttcctcgcgacatacagtacacaagaatttcaatccagagatgccaaaatgtataatctgagtattctaaatcttgccttgtcttgcgaatgtccacctagtttcgatgctttagctccatttgacacattatattagttgccctgtgcggctgtgcccagtctgaaactgaaatagaattgctgcatctagcact

SEQ ID NO: 4166 - DNA, 1726 bp, Sorghum bicolor
atcaaaaaatgaagtgtggagcgtcagcggtatgcagggggtgcagccagctcggcggagccacatgatcctccccatctcgccgtcactgcccctccaccactcagctcggcttgaataccccaccgtgctcacctctccacccaaacccaatccttccaacccatttccctccctcccgttccgtccccgcccctgtctgtctcttctgcttcccccccgcgcgccgccgcccgctggtgatccccgtcgccgcggaccagcagcagcagccatgtcgtgctcccacctctccaccgcctggtcctcctcggcgctcgccagcagcgcctccaccacccagcggcgcggaagctccgccccgcgctcgggcctcgtggtgcggtgctccctccgcgagctccgcacccgcatcgactccgtcaagaacacgcagaagatcacggaggccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctgagcccttgtgacttgtgtggtgcggggctcctgctatatataattctttttctcattttcctgctgtccactctgcctgtaattcctgattagcacaaacgcaacggagttccgtgttcctcgcgacatacagtacacaagaatttcaatccagagatgccaaaatgtataatctgagtattctaaatcttgccttgtcttgcgaatgtccacctagtttcgatgctttagctccatttgacacattatattagttgccctgtgcggctgtgcccagtctgaaactgaaatagaattgctgcatctagcactaactcttatctagttcattggattggattgctacaccaacttagctcattggattctg

SEQ ID NO: 4167 - DNA, 1515 bp, Panicum virgatum
cccaaacccaatccatccaaacccatttccctccctccctccaatcccgccccccttccttcccagtttccactgcctcctcccccgccgccgccggtgatccccgtcgccgcggaccaccagccatgtcttgctcccacctctccaccgcctggtcctcctcggcgctggccagcagcgcctcctccacccggcggcgctcctccgccccgcgctccggcggcagcggcttcgtggtgcggtgctccctccgcgagctccgcagccgcatcgactcggtccgcaacacgcagaagatcaccgaggccatgaagctcgtggccgccgccaaggtccggcgcgcgcaggaggccgtcgtctcgtcccgccccttctcggaggccctggtcgaggtgctctacaacatgaaccaggagatccagacggaggacatcgacctgccgctgacccgcacccgccccgtgaagaaggtcgccctggtggtcctcaccggcgagcgcggcctctgcggcagcttcaacaacaacgtgctgaagaaggcggacacccgcatcgaggagctcaagcagctggggctcgagtacaccgtcatcagcgtggggaagaagggcaacgcctacttcacgcgccgcccctacatcccgctggagcgggagctggaggtgaacggcgtgcccacggtgaaggactcgcaggccatctgcgacctggtctactccctcttcgtgtcggaggaggtggacaaggtggagctgctctactccaagttcgtgtccctggtgcgctccgaccccatcatccagacgctgctgcccatgtcccccaagggcgagatctgcgacgtcaacggcgtctgcgtggacgccaccgaggacgagctcttccgcctcaccaccaaggaggggaagctcaccgtcgagcgcgagaaggtgaagatcgagacgcagcccttctcccccgtcgtgcagttcgagcaggaccccgtgcagatcctcgacgcgctgctcccgctctatctcaacagccagatcctccgcgccctgcaggagtcgctcgccagcgagctcgccgcccggatgagcgccatgagcagcgccaccgacaacgccatcgagctccgcaagaacctctccatcgcttacaaccgccagcgccaggccaagatcaccggggagatcctcgagatcgtcgccggtgccgacgccctcgccggctgagctgaagccgtcctcctcgctctccttaacactgagccaagctgagccggtggtggcgtacgttcttcgtgcggtgctcctgctatatataattctttttctcacttttcttgctgttcagtctgtctgtaattcctgatagcacaaacacgagggagttctgtgttccatgctcgtcgtgatgccatgccgcgcgagatacacaagaatttaaattcagagatgccaaatgtataatccgagtaactttatcttgcaagtcctgcctccgtctcctatgcgatttatacactgcttg

SEQ ID NO: 4168 - DNA, 1862 bp, Sorghum bicolor
atcaaaaaatgaagtgtggagcgtcagcggtatgcagggggtgcagccagctcggcggagccacatgatcctccccatctcgccgtcactgcccctccaccactcagctcggcttgaataccccaccgtgctcacctctccacccaaacccaatccttccaacccatttccctccctcccgttccgtccccgcccctgtctgtctcttctgcttcccccccgcgcgccgccgcccgctggtgatccccgtcgccgcggaccagcagcagcagccatgtcgtgctcccacctctccaccgcctggtcctcctcggcgctcgccagcagcgcctccaccacccagcggcgcggaagctccgccccgcgctcgggcctcgtggtgcggtgctccctccgcgagctccgcacccgcatcgactccgtcaagaacacgcagaagatcacggaggccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctgagcccttgtgacttgtgtggtgcggggctcctgctatatataattctttttctcattttcctgctgtccactctgcctgtaattcctgattagcacaaacgcaacggagttccgtgttcctcgcgacatacagtacacaagaatttcaatccagagatgccaaaatgtataatctgagtattctaaatcttgccttgtcttgcgaatgtccacctagtttcgatgctttagctccatttgacacattatattagttgccctgtgcggctgtgcccagtctgaaactgaaatagaattgctgcatctagcactaactcttatctagttcattggattggattgctacaccaacttagctcattggattctgtatgaacaaaaaaaaaaatggttcattggattgtgcgccagcggcagaagacggccaaaagatgccagatggtgcaagggccaggtgcggttgtatctctgtcctattttacagatcaagtgcaagaaaattactt

SEQ ID NO: 4169 - DNA, 1695 bp, Panicum virgatum
cttggagttactgtgggatatcctgagcaggatcccagtatccattgtttgtttccacgaaggatttttttttcagttttttattcctgacaggccaaaaatgaagcagcaggaggagagccagctcggcggagccacatgatcctcgccatctcgccatcactgcccctccaccactcgccccggcttgaataccccaccgtgctcattctccacccaaacccaatccatccaaatccatttccctccctccctccaaacccgcatcccttcctttccagtttccactgcctcctcccccgccgccgccggtgatccccgtcgccgcgggccaccaaccatgtcttgctcccacctctccaccgcctggtcctcctcggcgctcgccagcagcgcctcctccacccggcggcgctcctccgccccgcgctccggcggcagcggcttcgtggtgcggtgctccctccgcgagctccgcagccgtatcgactcagtccgcaacacgcagaagatcaccgaggccatgaagctggtggccgccgccaaggtgcggcgcgcgcaggaggccgtcgtctcgtcccgccccttctcggaggcgctggtggaggtgctctacaacatgaaccaggagatccagacggaggacatcgacctgccgctgacccgcacccgccccgtgaagaaggtcgctctggtggtcctcaccggcgagcgcggcctctgcggcagcttcaacaacaacgtgctcaagaaggcggacacccgcatggaggagctcaagcagctggggatcgagtacaccgtcatcagcgtggggaagaagggcaacgcctacttcatgcgccgcccctacatcccgctggagcgggagctggaggtgaacggcgtgcccacggtgaaggactcgcaggccatctgcgacctggtctactccctcttcgtgtcggaggaggtggacaaggtggagctgctctactccaagttcgtgtcgctggtgcgctccgaccccatcatccagacgctgctgcccatgtcccccaagggcgagatctgcgacgtcaacggcgtctgcgtggacgccaccgaggacgagctcttccgcctcaccaccaaggaggggaagctcaccgtcgagcgcgagaaagtgaagatcgagacgcagcccttttcccccgtcgtgcagtttgagcaggaccccgtgcagatccttgacgcgctgctcccgctttatttcaacagccagatcctccgcgccctgcaggagtcgctccccagcgagctcgccgcccggatgagcgccatgagcagcgccaccgacaacgccatcgagttccgcaagaacctttccatcgcttacaaccgccagcgccaggccaagatcaccggggagatccttgagattgttgccggtgccgacgccctcgccggctgagctgaagccgtcctcctcgctttccttaacactgagccaagctgagccggggggggcttacgtttttcgtgcggggctcctgctatatataattttttttttcactttttttgctgttcagtctgtctgtaattcctgatagcacaaacacgagggagttttgtgttccatgctcgtcgggatgccatgccgcgcgagatacacaagaatttaaattcagagatgccaaatgtataatccgagtaactttatcttgcaagtcc

SEQ ID NO: 4170 - DNA, 8226 bp, Oryza sativa
aaaaagggcagtgctttgtctgttgtgtgttcttggttcactttacacattgccaatcctgaatagattaggatgatatcatttgccaaagcatgttacttacatatatgctcttctgcaaagtcatcatccgtgtcagctatagatttcacaagagtgacttccaccagttcatcgcaaagtgcaagggttgactccaaattatcttcattaaaactgagatcaatataaaagttgtatacatctggttctgctgtaagacgttccttcctcatcttctcaaataatcttctcgcttcagtaaatttcttttttttattcaacaatcttataagagcattgtatgagcttgcagtaagcctgaatcccttttctatcatttcactatggaaatacagagcctctttcatatttcttgccttacaatgtcccttgatcaaaatattatatgtgttttcatttggtaccacctcctgtgaaagcattcccttgtagatctcggtggttgatttcatgttcttttcaatgcaatactgcttcataagagaattgtatgttgtggtatttgggtggatgttcttctccagcatccattcaagcagcctcttacctccttctaccctacctgacatgcaaaagccattcattagaacattataagtcacaatagtaggcttaattcctttatctaacatctcttgcaaaaggctgtgagccctgtcaagctctttggactggcaaagagcaccaataatagttgtatatgtgtaaacgtctggtttaagacctgcttcatccatgtctatcatggtcctcatagcttgctccaaattgccagccttgcacaagccattgatcagggagttgtatgtgaaaatattcagctctaaccccttgctgcacatctcatgcaatagttcattagcagcacacacatccccctgcttgcagagtccatctgacagagccgtgtatgtcactacatttggtgtcactcgtttctgcaccattttgttatgcaccagaaaggcctccgtcatcttcccaaccttgcagtacccatcaatgagaactgtatatgtgaccgcatcaacatccaatcccttgtcctccatctcctgaagcactctctctgcctctttcaactctccagcccgacaaaggccattgatcagcgcagtatacgtcactccatcagctgccaaccctctcttctgcatctcatcaaaccaattccttgcagctgccaaatcacctttcctacagaacccactcattaccgttgtgaacaccgctgcatccaacaccactccatgcatcaccatatcctctaccaccctcacagcatctgaaacctgcccttcgtcgcacaacaatgcaataacactagtataggctactgggttgagttccaacccccttgctgccatttcacttaacagcttaatcgcagtctccagctcactaagagtacaatacccatgcaccataatgccatatgttacaacatctggcggcgatgccatttcatcaaacagttggtgcgcatccttgatgcggccagcggtgcacagcgccttgagtagtatattgtacgagcaggtgttcttctccgggagttcctgaaacaactgaacggcttcatcaagcgggaggcggcagagcaccgcgttacaggactccggggagggagagatgccgtactggcggaggcggaggaggagaggcgcggaggggaggcacaggaggaggaggtcgaatgagacagggtcggaggagaaggccttgtaggtggagatgaactgctcgacgaaatgccgatgaggggacgggaagcgaagggcgcgaacgaggatggcccgcgcggcgccgggatcgcgaacggcggcgaggtgggcagcgaccgcgaaggactggagcaggtgagggtgcgggcgaggcccggaggggaagaggaggaggagcggcaggaggatggtggggaggtgcgggtgcgaggcgagcagggggagcgcgaggaggaggtgaagtgggcggaggagagggaggaaggggaggggagggagagagcccgggttaggggaggagaggacggcggcggcgaggcggcgcgcgaggtcgtcgtcggccggcgagtccgggcggggcggggagtagtccgggaacgggcgtggcgcggcggtggttgtgagggcgttgctctcagccggcggcgcgcgacggcggccgtgacgatgttgggaggtggtggtggtggtgaggctagagcaggcagagcccgcgcgccggaggaggggtcgcgagtgcgataatcgggaggagcgctccgctacggcggcgacggcgcggcggaggagcatccggcgcgggcggatccggggattgggcctcctgccggaggcggcgacggcggcggcggcggcgggagacgggcagatcggttggcaaagaaaaatgaaaaactttcgggacgcgatagcatattgaatgtcactaaaacaagaataaattcagcccaaaggtgcacgtaaattggtccaaaagtttatttgcaagtcaaataggcccagaatttcatcccaataattgggctattttgtggcccatagaaaaatcagtgatgggccaaaccgttgcctgacgtcagctggttgcagggcagaccgacgcttcgagtcccaaaacggtcaaaccgaaaccgagccacctctcgccgtcgtctccggtcgccaacccgtcccacccgtgacgtcatgccgaccgccaacctcaggtcgcgcgccgccgcggccgcggccgccgccgcatgcctcgcggccctcgcggtggcggctctcctccaccgccggcgcagacggggtcgcgctcgcgcaccagcctcgcccggcctcctcgggggacggcgagggcgccgcccgcgccgagcctgcgaggaggaggagaagccgcaggcccggttcaggcgcgtggtcgcggacaactcctactccgccttcaagcacctgcgccgccagggtgctggaccggttggctccggccaccacggcagcgaggcccagccgacgtctcaagagtcatcacaaaaggtgcatccatttgaggaggaaatcacttccttgctgaacaacccacctgattttcagaattttatgcctggtgatcgatgcccagaaatgagcacttcatacaattgggtcgaaacagatgctcagttggaggacctggctaggttgttggatgatgaaaaagcttttgctgttgatacagagcaacatagccttcggtcattcttgggatacactgcactaatgcagatctctacccagaaggcagattatttaatagacacaatagcgctgcatgacgtgatgagcattctacgaccagtttttgccaatccttcaatctgtaagatcttccatggagctgacaatgatgttctttggcttcagagagactttcatatttatgttgtgaatatgtttgatactgccaaggcatgtgaggttctatcaaaaccacagaagtcattagcatatttgcttgaattatattgtggagtgaccacagacaagacaatgcagcgtgaggattggagattacgcccactaacaccagaaatgattcagtatgcccgttgtgatgcgcattatctgttgtacattgcaaattgtttggcatcagagcttcatgcaaaaacttacgatgcttcagactctcccaatgacaaaatcaattttttcttcgaggccagccatcgctcaaatatggtgtgtatgcaactgtatgcaaaggaaattgaatgtccaccaggagcatcctctgcggcgtctattttgtcaaaaaatttgcaaagccatggacttgactcctataaatcaagtgaagtgaaggatcttgtttggaaaatttgtgcatggagggatttaatggctcgcatgcatgatgagagcttacggtatgtcctgtcagaccaagctatagcttcccttgctgttagtgttccaagaggtccaactgaggtgtgttctgccatattagaaactgaaacaagcaattcaactgtgtatccttccttgccgccaccttcacctattgttgttgctcacgctgaagaacttcgctatctgattgaggacatcactgtcagcatggatgccatctttaaaaatttgcttgagaagtacaaagatccaagtagattatgtcgactatcagtttttaattataaccttgtatcacagctgagtttgaagcaaaaaaatatgttctcctttgcatcaagtggggagaagttgttgatggcaccaactaacaaaaaggcttcccgggaattattcattaaaaagttttcatgcaagtccccagtatatcacaattgcaggatctacgccagtgatggaagactgctttgctactgtgaccgtaaaaagttggaatggtatattcaacgtaatttagcaaaattaatagaagataatcctccagcaattgtgctcttgtttgaacctaagggtcgcccagaggatgaggataatgacttctatattcagagcaagaaaaatatttgtgtcggatgtggagaaaagagccactatatcagatatagaattataccatcgtgctacaggatgcattttccagagcatctgaagagccatcgttcacatgatattgtacttctttgcgtagactgccatgaaattgctcattcagcagctgagaagtacaagaggcaaatagccaaagaatttggggtgccgctttttgtacagaagatattaaactcaggtgatataagtttaatagctggtgcatcattatctgaagataaatcaaatggaacaggtgtgtctcctttgcagctgaggactgctgcaatggcccttttaagacatggatccaatatgcctttgaagagatatgaagagctaatgcagattgtgaagtcatactatggtggtagggatgtgactcctgaagatcttgagatggcattacttgttggcatgagtcccaatgagcgaaggcgacattcaaagaaaaatggtttttcttaccgatcccaggctcaaaatgttattagaaaaagcaacagcaacggcattgttgagaataatgaacatgatccagaaaatggatatgctgagcaattttctaaaaatggagttgagaataacagtcatccagacattgatgagaataacaatcagctaggtattgatgaacataccagtcagccaggctctgggggtaataagatacatggtccaactctgagcaaagaaagcacaatctatccaccccgtatggctaatcccatttctgactctagcattgaggcagacaccgtgcagcaagcaagcttaggtggtaatcctgcaaacggtgatcttgacagggatccatgcggcagtaacaattctaaccaagccattccccaaaacggtgacaagaagatctccctgttaggtcatgggcatcacggtaaacaggtcgtggagcttttgctttccaacggtggcgaggaggccattaaccagttcagccaacggtggaggcaggtcttcgtagcttctcttcaccctcgttatttgccttcgggctggaatataaagcacaggtgaattcacctgtcgttttgctactcggtttgttctcacacattgataattgcgcatgtttgtggtgcaaaatcaccctggttatctatcaactatgtgtaggtagatttggaagattttttctgttagatgatttttttttcctggacaattatctttgaccctctggacatgcataccttgtgttctttgctgtgtagtggacggcgggattttggcgatttcagtgtctacaagccatcaaagaaacctcctgctgcagatcaatccgagactttagctgctgctgctgttgtaccctgaggttctagtttacattcgaagttacttccatttcattaaacctgaaccttgtacctgtactgtgcccttctatattcatgtactaccttgtttctacatctggaaagaactgggttacatctgtttgttccctctgccatgaagttttgtgctcaccaattctatatatgcagaagaattacagcaaaactggtaaaataaataaaatcatttccttgctaaaattgaaagcaacaagcacaagtactaaggctgtgtttagttccacgctaaaattggaagtttgaataaaaaagttggaagtttacgtgtgtagaaaagttttgatgtgatggaaaagttagaagtttaaagaaaaagttgggaactaaacttggctaacctaaccatcatgtctaaagcttgtgttaatttttatttttttgggtagtatctgatatctactgcaggatgccaggatatcctcagcacgatcctgagtcccagccagtgtgagttactagtatctcttttccttttatttttcatttttccaatatgctagtatttctttcagtttcagatgggccaagccaaaaaatgattcgagtgaaatggaagcagcagaagcagcagcacatccatccacatgatccgaccactgcctcctccaccactcaccccgccttgaaaaccccacctgccctacttccgcctggagagcctcggcccctcgcctcgcctcgcctcacctccacccaaacccaatccgaaatctttccctccactcgccgccgccgccgccgccgctgttgccggtgacccgccagccatgtcgtgctcgcacctctccaccgcctggtcctcctccgccctggccacccgccgccgctccgctcctagctgcggcagcagcggccgcctgcaggtggtgcggtgctcgctgcgtgagctgcggagccgcatcgactcggtgcgcaacacgcagaagatcacggaggcgatgaagctggtggcggcggccaaggtgcggcgggcgcaggaggcggtggtgtcctcccgccccttctcggaggcgctggtggaggtgctctacaacatgaaccaggagatccagacggaggacatcgacctccccctcacccgcatccgccccgtcaagaaggtcgccctcgtcgtcctcaccggcgagcgcggcctctgcggcagcttcaacaacaacgtcctcaagaaggccgagacccgcatcgaggagctcaagcagctcggcctcgagtacaccgtcgtcagcgtcggcaagaagggcaacgcctacttcatccgccgccccttcatccccaccgagcggacgctggaggtgaacggcatccccaccgtgaaggactcccagtccatctgcgacctcgtctactcgctgttcgtgtccgaggcggtggacaaggtggagctcctctactccaagttcgtctccctcgtccgctccgaccccatcatccagacgctgctccccatgtcgcccaagggggagatctgcgacatcaacggcgtgtgcgtggacgccaccgaggacgagctgttccggctcaccaccaaggaagggaagctgaccgtggagcgggagaaggtgaagatcgagacgcagcccttctcacccgtggtgcagttcgagcaggaccccgtccagatcctcgacgcgctcctcccgctctacctcaacagccagatcctccgcgcgctccaggagtcgctcgccagcgagctcgccgccaggatgagcgccatgagcagcgccaccgacaacgccatcgagctccggaagaacctctccatggtctacaaccgccagcgccaggccaagatcaccggcgagatcctcgagatcgtcgccggcgccgacgccctcgcctaaatccaatcaactcatttcttcatcccatccacctcgcttgagctgctgaggttgctgctgttatatatactactctattcttttttacttcctttttctctcttgctattgtgtctgtaatttctgtgatagcacgaaaaaaaaaaggaaaaaagatcgatccgactcgatcgatgtaattgttaatcgcgcgagatacacaagatttcaattcagcgatgccaaatgtacaagcagagtattctactactatcttgcaatctcctctacttgcctttctagattaggagggatatcgccgtatgcagtttcttccttttcttgtgtgattttggtgttgacgacacttcctttttttcctttccttttcttttctgtttgcttcactttcctcgagcaagcaaacctgtg

SEQ ID NO: 4171 - DNA, 2142 bp, Brachypodium distachyon
atgtctctctgtgaattgtgattatcttttcctccaaatttatctttcgaaaactcagatatttaccgagcatcttctatgcagtggacgaagggatttcggtgacttcagtgtctacaaaccatccaaccaagagcctcagcctgctggcctataggggcagcggatcagtaccttcttttacagagttgcttccatttcatcaagcctgatatttacccgtttctttcggtatgtgacgcctggcttgtttcgaacactggaagtttacaaaagatttttgtatcagtttgacaagaaacatttatattcactttagacgaagtacctgatatgtactgtagtatattccttttattctctgtgttgttttaagagttttgttcgacaaggctaaaaaaagaagagaaatggaaacaggcgaggcaggcaggcagggcgctccacatgatccttggcaatctcggtcagtagcctccaccactcagcccggcttgaaaaccccaccagctcacttctccacccaaacccaatccaaaatctttccctccctcccgtccgttcccctccgcctccgcctctgcctctgcggccgccggtgacgcgccaggcgccagccagccatgtcgtgctcccacctctccaccgcgtggtcctcctccgcgctcgccagctcctccacccgccgccgcggcgcaagcagcagcagcagcagcagcctcgtggtgcggtgctccctccgcgacctccgcaaccgcatcgagtccgtccgcaacacgcagaagatcacggaggcgatgaagctggtggccgccgccaaggtccgtcgcgcgcaggaggccgtggtctcctcccgccccttctccgaggccctcgtggaggtgctctacaacatgaaccaggagatccagacggaggacatcgacctacccctcacccgccagcgctccgtcaagcgcgtcgccctcgtcgtcctcaccggcgagcgcggcctctgcggcgccttcaacaacaacgtgctcaagaaggccgagtcccgcatggaggagctcaggcagctgggcgtggagtacaccgtcatcagcgtcggcaagaaggggaacgcctacttccagcgccgcccctacatcccctccgagcgcttcctcgagctcgccggcatccccacagtcaaggactcgcaggccatctgcgacctcgtctactccctcttcgtcgccgaggaggtcgacaaggtggaactgctctactccaagttcgtctccctcgtccgctccgaccccatcatccagacgctgctgcccatgtcccccaagggcgagatctgcgacgtcaacggcatctgcgtcgacgccactgaggacgagctcttcaagctcactaccaaggaaggcaagctcaccgtcgagcgcgagaagatcaagatcgagacgcagcctttctcccccgtcgtccagttcgagcaggaccccgtccagatcctcgacgcgctcctcccgctctatctcaacagccagatcctgcgtgccctccaggagtcgcttgccagcgagctcgccgccaggatgagcgccatgagcagcgccacggacaacgccatcgatctccggaaaaatctctccattatctacaaccgtcggcgccaggccaagatcactggagagatcctggagatcgtcgccggcgcggacgccctctccggctgattcctcctcctagcctgagctgagccgccgctgttatatataattcttctttcactctttttctcctctcttctccttctgttctgttgttgggtctatctgtaatcatttgtcatagcacaaaaaaggatgtgtctgatctgttcgatcgcccgatacacaagatttgagttcagaggtgccaaatgtataatccagagtatttatctatcttcactgttaatcagatgatcctcgcctggtatttatctatcttcaaacaaatctacactgaattctcaagggatcatacacaagccgcagagatctactttgataattttgtgttctgtccctgtaaacagtcaactaatttacataaatctctccggggacctgttcggttccaggagtctgcgaggtttggagatttggccactcctcgaaagcaccaaca

SEQ ID NO: 4172 - DNA, 1437 bp, Brachypodium distachyon
aaaaccccaccagctcacttctccacccaaacccaatccaaaatctttccctccctcccgtccgttcccctccgcctccgcctctgcctctgcggccgccggtgacgcgccaggcgccagccagccatgtcgtgctcccacctctccaccgcgtggtcctcctccgcgctcgccagctcctccacccgccgccgcggcgcaagcagcagcagcagcagcagcctcgtggtgcggtgctccctccgcgacctccgcaaccgcatcgagtccgtccgcaacacgcagaagatcacggaggcgatgaagctggtggccgccgccaaggtccgtcgcgcgcaggaggccgtggtctcctcccgccccttctccgaggccctcgtggaggtgctctacaacatgaaccaggagatccagacggaggacatcgacctacccctcacccgccagcgctccgtcaagcgcgtcgccctcgtcgtcctcaccggcgagcgcggcctctgcggcgccttcaacaacaacgtgctcaagaaggccgagtcccgcatggaggagctcaggcagctgggcgtggagtacaccgtcatcagcgtcggcaagaaggggaacgcctacttccagcgccgcccctacatcccctccgagcgcttcctcgagctcgccggcatccccacagtcaaggactcgcaggccatctgcgacctcgtctactccctcttcgtcgccgaggaggtcgacaaggtggaactgctctactccaagttcgtctccctcgtccgctccgaccccatcatccagacgctgctgcccatgtcccccaagggcgagatctgcgacgtcaacggcatctgcgtcgacgccactgaggacgagctcttcaagctcactaccaaggaaggcaagctcaccgtcgagcgcgagaagatcaagatcgagacgcagcctttctcccccgtcgtccagttcgagcaggaccccgtccagatcctcgacgcgctcctcccgctctatctcaacagccagatcctgcgtgccctccaggagtcgcttgccagcgagctcgccgccaggatgagcgccatgagcagcgccacggacaacgccatcgatctccggaaaaatctctccattatctacaaccgtcggcgccaggccaagatcactggagagatcctggagatcgtcgccggcgcggacgccctctccggctgattcctcctcctagcctgagctgagccgccgctgttatatataattcttctttcactctttttctcctctcttctccttctgttctgttgttgggtctatctgtaatcatttgtcatagcacaaaaaaggatgtgtctgatctgttcgatcgcccgatacacaagatttgagttcagaggtgccaaatgtataatccagagtatttatctatcttcactgttaatcaga

SEQ ID NO: 4173 - DNA, 1395 bp, Triticum aestivum
aaatctttccctccctcccatcctttcttcccctccgcctccgcctctgcggccgccggtgacgcgccaggcgctagctagccatgtcgtgctcccacctctccaccgcgtggtcctcctccgcgcttgccagcacctccacccgccgccgcgcctccaccggcagcagcagcctggtggtgcggtgctccctccgggacctccgcaaccgcatcgactctgtccgcaacacgcagaagatcacggaggcgatgaagctggtggccgccgccaaggtccgtcgcgcgcaggaggccgtggtctcctctcgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggtctctgcggcgccttcaacaacaacgtgctcaagaaggccgaggcccgcatggaggacctcaggcagctgggcgtcgactacaccgtcatcagcgtcggcaagaagggcaacgcctacttccagcgccgcgactacatccccaccgagcgcttcctcgagctcgccgggatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgatgtcaacggcatctgtgtcgacgccaccgaggacgagctcttcaagctcaccaccaaggaaggcaagctcaccgtggagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgccgccaggatgagcgccatgagcagcgccacagacaatgccatcgacctccggaaaaatctctccatggtctacaaccgccgacgccaggccaagatcaccggagagatccttgagatcgtcgctggcgccgacgccctgtccggctgattcctcctcgccacctgagctgagccgccgctgttatatataactctttgcctccttttctcctctcttctacttatcttgcttggtctgtgtctgtctgtaataatttctcatagcacaaaaaaggatgtctgttctaagattcagttcggagatgccaaatgtataatccagagtaatttatctatgcaatcccgcctccacccatatgcaatttgtttatgcaaaaaaaaaa

SEQ ID NO: 4174 - DNA, 1361 bp, Triticum aestivum
aaaacccaattccaaaatctttccctccctcccatcctttcttcccctccgcctccgcctccgcggccgccggtgacgcgccaggcgctagctagccatgtcgtgctcccacctctccaccgcgtggtcctcctccgcgcttgccagcacctccacccgccgccgcgcctccaccggcagcagcagcctggtggtgcggtgctccctccgggacctccgcaaccgcatcgactctgtccgcaacacgcagaagatcacggaggcgatgaagctggtggccgccgccaaggtccgtcgcgcgcaggaggccgtggtctcctctcgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggtctctgcggcgccttcaacaacaacgtgctcaagaaggccgaggcccgcatggaggacctcaggcagctgggcgtcgactacaccgtcatcagcgtcggcaagaagggcaacgcctacttccagcgccgcgactacatccccaccgagcgcttcctcgagctcgccgggatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgatgtcaacggcatctgtgtcgacgccaccgaggacgagctcttcaagctcaccaccaaggaaggcaagctcaccgtggagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgccgccaggatgagcgccatgagcagcgccacagacaatgccatcgacctccggaaaaatctctccatggtctacaaccgccgacgccaggccaagatcaccggagagatccttgagatcgtcgctggcgccgacgccctgtccggctgattcctcctcgccacctgagctgagccgccgctgttatatataactctttgcctccttttctcctctcttctacttatcttgcttggtctgtgtctgtctgtaataatttctcatagcacaaaaaaggatgtctgttctaagattcagttcggagatgccaaatgtataatccagagtaatttatcta

SEQ ID NO: 4175 - DNA, 1384 bp, Hordeum vulgare
tctttccctccctcccatcctttctccgcctccgcctccgcctccgcctccgcctctgcggccgccggtgacgcgccagccgctagccagccatgtcgtgctcccacctctccaccgcgtggtcctcatccgcgcttgccagcacttccacccgccgccgcgcctccaccggcagcagcctggtggtgcggtgctccctccgggacctccgcaaccgcatcgactctgtccgcaacacgcagaagatcacggaggcgatgaagctggtggccgccgccaaggtccgtcgcgcgcaggaggccgtggtctcctcccgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggcctatgcggcgccttcaacaacaacgtgctcaagaaggccgaggcccgcatggaggacctcaggcagctgggcgtcgagtacaaagtcatcagcgtcggcaagaagggcaacgcctacttccagcgccgcgactacatccccaccgagcgcttcctcgagctcgccggcatccccaccgtcaaggactcgcaggccatttgcgaccttatctactccctctttgtcgccgaggaggtcgacaaggtggagctcgtttactccaagttcgtcaacctcgtccgctccgaccccatcatccagacgctgctgcccatgtcccctaagggcgagatctgcgacgtcaacggcatctgtgtcgacgccaccgaggacgagctcttcaagctcaccaccaaggaaggcaagctcaccgtggagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgcagccaggatgagcgccatgagcagcgccacagacaatgccatcgatctccgaaaaaatctctccatggtctacaatcgccgacgccaggccaagatcaccggagagatccttgagatcgtcgctggcgccgacgccctgtccggctgattcctccctgggctgagctgccactgttatatataactctttgcctccttttctcctctcttctagtacttatcttgcttggtctgtgtctgtgtttgtaataatttctcatagcacaaaaaaggatgtctgttctatcgcccggtgcgagatacataagatttcagttcggagatgccaaatgtataatcagagtaatttatctatgcagtcccgcc

SEQ ID NO: 4176 - DNA, 1571 bp, Hordeum vulgare
aggcaaggtgcagggtaggcggccagggcgcgccacatgatccgtggcaatctcgcagtgactagccctccaccactcagcccggcttgaaaaccccacctgctcacttctccacccaaacccaatccaaaatctttccctccctcccatcctttctccgcctccgcctccgcctccgcctccgcctctgcggccgccggtgacgcgccagccgctagccagccatgtcgtgctcccacctctccaccgcgtggtcctcatccgcgcttgccagcacttccacccgccgccgcgcctccaccggcagcagcctggtggtgcggtgctccctccgggacctccgcaaccgcatcgactctgtccgcaacacgcagaagatcacggaggcgatgaagctggtggccgccgccaaggtccgtcgcgcgcaggaggccgtggtctcctcccgccccttctcggaggctctggtggaggtgctctacaacatgaaccaggagatccagtcggaggacatcgacctgcccctcacccgccagcgcgccgtcaagcgcgtcgcgatcgtcgtcctcaccggcgagcgtggcctatgcggcgccttcaacaacaacgtgctcaagaaggccgaggcccgcatggaggacctcaggcagctgggcgtcgagtacaaagtcatcagcgtcggcaagaagggcaacgcctacttccagcgccgcgactacatccccaccgagcgcttcctcgagctcgccggcatccccaccgtcaaggactcgcaggccatttgcgaccttatctactccctctttgtcgccgaggaggtcgacaaggtggagctcgtttactccaagttcgtcaacctcgtccgctccgaccccatcatccagacgctgctgcccatgtcccctaagggcgagatctgcgacgtcaacggcatctgtgtcgacgccaccgaggacgagctcttcaagctcaccaccaaggaaggcaagctcaccgtggagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgcagccaggatgagcgccatgagcagcgccacagacaatgccatcgatctccgaaaaaatctctccatggtctacaatcgccgacgccaggccaagatcaccggagagatccttgagatcgtcgctggcgccgacgccctgtccggctgattcctccctgggctgagctgccactgttatatataactctttgcctccttttctcctctcttctagtacttatcttgcttggtctgtgtctgtgtttgtaataatttctcatagcacaaaaaaggatgtctgttctatcgcccggtgcgagatacataagatttcagttcggagatgccaaatgtataatcagagtaatttatctatgcagtcccgcctccatccatatgccaactacccgtgcgtcgccaccagacaataaaacatactccc

SEQ ID NO: 4177 - DNA, 1473 bp, Secale cereale
gactcggccagggcgcgccacatgatccgtggcaatctcgcagtgactagccctccaccactcagcccggcttgaaaaccccacctgctcacttctccacccaaacccaatccaaaatctttccctccgtccctcccaccctttcttcccctccccctccgcctcctcggccgccggtgacgcgccaggcgctaaccagccatgtcgtgctcccacctctccaccgcgtggtcttcctccgcgcttgccagcacctccacccgccgccgcgcctccaccggcagcagcagcagcagcctggtggtgcggtgctccctccgcgacctccgcaaccgcatcgactctgtccgcaacacgcagaagatcacggaggcgatgaagctggtggccgccgccaaggtccgtcgcgcgcaggaggccgtggtctcctcccgccccttctcggaggctctggtggaggtgctctacaacatgaaccaggagatccagtccgaggacatcgacctgcccctcacccgccagcgcgccgtcaagcgcgtcgcgatcgtcgtcctcaccggcgagcgtggcctctgcggcgccttcaacaacaacgtgctcaagaaggccgaggcccgcatggcggacctcaggcagctgggcgtcgactacaccgtcatcagcgtgggcaagaagggcaacgcctacttccagcgccgcgactacatccccaccgagcgcttcctcgagctcgccggcatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgacgttaacggcatctgtgtcgacgccaccgaggacgagctcttcaagctcaccaccaaggaaggcaagctcaccgtcgagcgcgagaagatcaagatcgagatgcagcccttctcccccgtcgtccagttcgagcaggaccccgtccagatcctcgacgctctcctcccgctctacctcaacagccagatcctgcgtgccctccaggagtcgctcgctagcgagctcgccgccaggatgagcgccatgagcagcgccacagacaatgccatcgatctccagaaaaatctctccatggtctacaaccgccgacgccaggccaagatcaccggagagatccttgagatcgttgctggtgccgacgctctgtccggctgattcctccctaagctgagctgccgctgttatatataattctttgcctctttttctcctctcttctacttatcttgcttggtcttgtgtctgtgtctgtaataatttctcatagcacaaaaaagatgtctcttctatcgcccggcgcgagatacatatgattcagttcggagatgcccaaatgtataatcc

SEQ ID NO: 4178 - DNA, 1372 bp, Avena sativa
aaaatccaaaaaaatacgttccctccctccactccgttcccctctgcttccgcctctgcggccgccggtgacgccccacgcgccagccagccatgtcgtgctcccacttatccaccgcgtggtcctcctccgcgctcgccagctcctccacccgccgccgcgcctcgaccggcggcagcagcagcagcagcctggtggtgcggtgctcccttcgcgacctccgtaaccgcatcgactctgtccgcaacacgcagaagatcacggaggcgatgaagctggtggccgccgccaaggtccgtcgcgcccaggaggccgtcgtctcctcccgccccttctccgaggccctggtggaggtgctctacaacatgaaccaggagatccagacggaggacatcgaccttccgctcacccggcagcgcgccgtcaagcgcgtcgccatcgtcgtcctcaccggcgagcgcggcctctgcggcgccttcaacaacaacgtgctcaagaaggccgaggcccgcatggaggacctcaggcagctcggcgtcgactacaaggtcatcagcgtcggcaagaagggcaacgcctacttccagcgccgcgagtacatccccaccgagcgcttcctcgagctcgccggcatccccaccgtcaaggactcgcaggccatctgcgacctcatctactccctcttcgtcgccgaggaggtggacaaggtggagctcgtatactccaagttcgtcaacctcgtccgctccgacccaatcatccagacgctgctgcccatgtcccccaagggcgagatctgcgacgtcaacggcatctgtgtcgacgccagcgaggacgagctcttcaagctcaccaccaaggaaggcaagctcaccgtcgagcgcgagaagatcaagatcgagatgcagcccttctcccccgtcgtccagttcgagcaggaccccgtccagatcctcgacgcgctcctcccgctctacctcaacagccagatcctgcgtgccctccaggagtcgctcgccagcgaactcgccgccaggatgagcgccatgagcagcgccacagacaacgccatcgacctccggaaaaatctttccatggtctacaatcgccggcgccaggccaagatcaccggagaaattctcgagatcgttgccggcgccgacgccctctccggctgattcctcctctcctcctgagatgagttgcggctcttatatataattctttgcctctttttctcctctcctctcctcttgttggtctgtaatactcatagcacaaaaatgatgtgtctgtactcaatcgcctgtcgcgagatacacaagatttcagttcagagatgcgaaatgtataatccagagtatttgtttac

SEQ ID NO: 4179 - DNA, 1363 bp, Leymus cinereus x Leymus triticoides
ctttccctccctcccatcctttcttcccctccgcctccgcatcctcggccgccggtgacgcgccaggcgctagccagccatgtcgtgctcccacctctccaccgcgtggtcctcctccgcgcttgccagcacctccacccgccgccgcgcctccaccggcggcggcagcagcagcagcagcctggtggtgcggtgctccctccgggacctccgcaaccgcatcgactctgtccgcaacacgcagaagatcacggaggcgatgaagctggtggccgccgccaaggtccgtcgcgcgcaggaggccgtggtctcctcccgccccttctcggaggctctggtggaggtgctctacaacatgaaccaggagatccagtcggaggacatcgacctgcccctcacccgccagcgccccgtcaagcgcgtcgcgatcgtcgtcctcaccggcgagcgtggtctttgcggcgccttcaacaacaacgtgctcaagaaggccgaggcccgcatggacgacttcaggcagctgggcgtcgactacaccgtcatcagcgtcggcaagaagggcaacgcctacttccagcgccgcgaatacattcccaccgagcgcttcctcgagctcgccggcatccccaccgtcaaggactcgcaggccatttgcgacctcatctactccctctttgtcgccgaggaggtcgacaaggtggagctcgtctactccaagttcgtcaacctcgtccgctccgaccccatcatccagacgctgctgcccatgtcccctaagggcgagatctgcgacgtcaacggcatctgtgtcgacgccaccgaggacgagctcttcaagctcaccaccaaggaaggcaagctcaccgttgagcgcgagaagatcaagatcgagatgcagcccttctcccccgtcgtccagttcgagcaggaccccgtccagatcctcgacgctctcctcccgctctacctcaacagccagatcctgcgtgccctccaagagtcgctcgctagcgagctcgccgccaggatgagcgccatgagcagcgccacagacaatgccatcgatctccagaaaaatctctccatggtttacaaccgccgacgccaggccaagatcaccggagagatccttgagatcgtcgctggcgccgacgccctgtccggctgattcctcctcctcgccacctgagctgagctgccgctgttatatataactctttgcctctttttctcctctcttctacttatcttccttggtctgtgtctgtgtctgtaataatttctcatagcacaaaaaaggatgtctgttctatcgcccggcgcgagatacataagatttcagttgggagatgccaaaaaaaaa

SEQ ID NO: 4180 - DNA, 1193 bp, Pennisetum glaucum
cggtgctccctccgcgagctccgcagccgcatcgactccgtccgcaacacgcagaagatcaccgaggccatgaagctcgtggccgccgccaaggtccggcgcgcccaggaggccgtcgtctcctcccgccccttctcggaggcgctcgtcgaggtgctctacaacatgaaccaggagatccagacggaggacatcgacctgccgctcacccgcacccgccccgtcaagaaggtggccctcgtggtcctcaccggcgagcgcggcctctgcggcagcttcaacaacaacgtgctcaagaaggcggaaacccgcatcgacgagttcaagcagctgggcctccagtacaccgtcatcagcgtggggaagaagggcaacgcctacttccagcgccgcccctacatcccggtggagcgggagctggaggtgggcgccatccccacggtgaaggactcgcaggccatctgcgacctggtgtactcgctcttcgtctccgaggaggtggacaaggtggagctgctctactccaagttcgtgtccctggtgcgctccgaccccatcatccagacgctgctgcccatgtcccccaagggggagatctgcgacgtcaacggcgtgtgcgtcgacgccacggaggacgagctgttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatactccgcgccctgcaggagtcgctcgccagcgagctcgctgctcggatgagcgccatgagcagcgccaccgacaatgccatcgagctccgcaagaacctctccatcgcctacaaccgccagcgccaggccaagatcaccggggagatcctcgagatcgtcgccggcgccgacgcccatcttgatgagccgtcctccttatactaaaactgaaccgagctgagccggtggcggcgttctttcttggtgcggtgctcctgctatatataattctttctctcgccttcttgctgttcagtctgtctgtaattcctgatagcacaaacacaaagggagttgtgtgttccatgctcgtcgtcgcgagatacacaagaattttcaattcagagataccaaatgtataa

SEQ ID NO: 4181 - DNA, 1238 bp, Sorghum bicolor
ctcttctgcttcccccccgcgcgccgccgcccgctggtgatccccgtcgccgcggaccagcagcagcagccatgtcgtgctcccacctctccaccgcctggtcctcctcggcgctcgccagcagcgcctccaccacccagcggcgcggaagctccgccccgcgccatgaagctggtggccgccgccaaggtccggcgcgcgcaggaggccgtcgtctcctcccgccccttctcggaggcgctggttgaggtgctctacaacatgaaccaggagatccagacggaggacatcgacctgcccctcacccgcacccgccccgtcaagaaggtggcgctcgtggtcctgaccggcgagcgcggcctctgcgggagcttcaacaacaacgtgctcaagaaggcggaggcccgcatcgaggagctcaagcagctgggcctccagtacagcgtcatcagcgtggggaagaaaggcaacgcctacttccagcgccgcccctacatcccgctggagcgggacctggaggtgaacggcgtgcccaccgtcaaggactcgcagtccatctgcgacctcgtctactcgctcttcgtctcggaggaggtggacaaggtggagctgctctactccaagttcgtgtcgctggtgcgctccgaccccatcatccagacgctgctccccatgtcccccaagggcgagatctgcgacatcaacggcgtctgcgtggacgccaccgaggacgagctcttccgcctcaccaccaaggagggcaagctcaccgtggagcgcgagaaggtgaagatcgagacgcagcccttctcccccgtggtgcagttcgagcaggaccccgtgcagatcctcgacgcgctgctcccgctctacctcaacagccagatcctccgtgccctgcaggagtcgctcgccagcgagctcgccgcccggatgagcgccatgagcagcgccaccgacaacgccatcgagctcgccaagaacctctccatcgcctacaaccgacagcgccaggccaagatcaccggggagatcctcgagatcgtcgccggtgccgaagccctcgcctgagcccttgtgacttgtgtggtgcggggctcctgctatatataattctttttctcattttcctgctgtccactctgcctgtaattcctgattagcacaaacgcaacggagttccgtgttcctcgcgacatacagtacacaagaatttcaatccagagatgccaaaatgt

SEQ ID NO: 4182 - DNA, 1336 bp, Festuca arundinacea
  misc_feature (462)..(462): n is a, c, g, or t
  misc_feature (702)..(702): n is a, c, g, or t
  misc_feature (723)..(723): n is a, c, g, or t
  misc_feature (1157)..(1157): n is a, c, g, or t
  misc_feature (1228)..(1228): n is a, c, g, or t
  misc_feature (1279)..(1279): n is a, c, g, or t
  misc_feature (1317)..(1317): n is a, c, g, or t
  misc_feature (1331)..(1331): n is a, c, g, or t
ggcacgaggcctccgcctccgcctctgcggccgccggtgacgccccaggcgcagccagccatgtcgtgctcccacctctccaccgcgtggtcctcctccgcgcttgctagctcttccacccgccgtcgcgcctcgaccggcggcagcagcagcagtagcctggtggtccggtgctccctccgcgacctccgcaaccgcatcgactctgttcgcaacacgcagaagatcacggaggcgatgaagctggtggccgccgccaaggtgcgtcgcgcgcaggaagccgtggtctcctcccgccccttctccgaggccctggtggaggtgctctacaacatgaaccaggagatccagacggaggacatcgacctgcccctcacccgccagcgctccgtcaagcgcgtcgccatcgtcgtcctcaccggtgagcgcggcctctgcggcgccttcaacaacaacgtgctnaagaaggccgagtcccgcatggaggacctcaagcagctcggcgtcgactacaccgtcatcagcgtcggcaagaagggcaacgcctacttccagcgccgggaatacatccccaccgagcgattcctcgagctcgccggcatccccaccgtcaaggactcgcaggccatctgcgacctcatctactccctcttcgtcgccgaggaggtggacaaggtggagctcgtctactccaagttcgtntccctcgtccgctccgacccnatcatccagaccctgctgcccatgtcccccaagggcgagatctgcgacgtcaacggcatctgcgtcgacgccaccgaggacgagctcttcaagctcaccaccaaggaaggcaagctcactgtcgagcgcgagaagatcaagatcgagacgcagcccttctcctccgtcgtccagttcgagcaggaccccgtccagatcctcgacgccctcctcccgctctacctcaacagccagatcctgcgtgctctccaggagtcgctcgccagcgagcttgccgccaggatgagcgccatgagcagcgccactgacaacgccatcgatctccggaaaaatctttctatggtctataaccgccggcgccaagccaagatcaccggagagatctcgagatcgttgctggcgccgacgccctcgccggctgattcctcctcgcnacctgagctgagctgccgctcttatatataattctttgcctctttttctcctctcttctcttgttggcctntgtctgtaataatttctcatagcacaaaaatgatgtgtctgtactcaattnctcgtcgcgagatacacaagattccagttcagagatgngaaatgtataatcnagagt

SEQ ID NO: 4183 - DNA, 1275 bp, Panicum virgatum
gaggccatgaagctcgtggccgccgccaaggtccggcgcgcgcaggaggccgtcgtctcgtcccgccccttctcggaggccctggtcgaggtgctctacaacatgaaccaggagatccagacggaggacatcgacctgccgctgacccgcacccgccccgtgaagaaggtcgctctggtggtcctcaccggcgagcgcggcctctgcggcagcttcaacaacaacgtgctcaagaaggcggacacccgcatcgaggagctcaagcagctggggatcgagtacaccgtcatcagcgtggggaagaagggcaacgcctacttcatgcgccgcccctacatcccgctggagcgggagctggaggtgaacggcgtgcccacggtgaaggactcgcaggccatctgcgacctggtctactccctcttcgtgtcggaggaggtggacaaggtggagctgctctactccaagttcgtgtcgctggtgcgctccgaccccatcatccagacgctgctgcccatgtcccccaagggcgagatctgcgacgtcaacggcgtctgcgtggacgccaccgaggacgagctcttccgcctcaccaccaaggaggggaagctcaccgtcgagcgcgagaaggtgaagatcgagacgcagcccttctcccccgtcgtgcagttcgagcaggaccccgtgcagatcctcgacgcgctgctcccgctctacctcaacagccagatcctccgcgccctgcaggagtcgctcgccagcgagctcgccgcccggatgagcgccatgagcagcgccaccgacaacgccatcgagctccgcaagaacctctccattgcttacaaccgccagcgccaggccaagatcacgggggagatccttgagatcgtcgccggtgccgacgccctcgccggctgagctgaagccgccgtccccctcgctctacttaacactgagccgagctgagccggtggtggcgtacgttcttcgtgcggtgctcctgctatatataattctaattctttttctcatccttcttgctgttcagtcttctgtctgtaattcctgatagcacaaacacgagggagttctgtgttccatgctcgtcgtgatgccgcgcctcgccagatacacaagaatttaaattcagagatgccaaatgtataatccgagtaacttttaccttgcaaatcctgtgcctccgtctcctatggtattcacactgcttgtaagagatttgttagcaagcttcaatgctttatgcagcttcattcggca

SEQ ID NO: 4184 - DNA, 438 bp, Triticum aestivum
gcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatctgtcaactgcaccgccattatcgatcatggtcgctcctggggtt

SEQ ID NO: 4185 - DNA, 470 bp, Triticum aestivum
accacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagattctgtcaactgcacccgccattatcgattcatggtcgctcctggggttcatgttcatctgtaacgtgctcgcggtcatt

SEQ ID NO: 4186 - DNA, 494 bp, Triticum aestivum
gcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagttctgtcaactgcacccgccattatcgatcatggtcgctcctggggttcatgtcatctgtaacgtgctcgcggtcatgtccgtctcgtgccggattaatatta

SEQ ID NO: 4187 - DNA, 458 bp, Triticum aestivum
cacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggttcgaggcggccaccgagggcggcggctgcgactgcaacacctgcaactgcggcaccagctgcggtgtcctgctgcaactgcaactgagccggtcaagcgatggcgcacgagatccgagaggacgacgacgagccgtataaatataataccgggctctaaataaatcctgtcaactgcaccgccattatcgctcatggtcctcctggggctcatttatctgtaactgctcccggtcatt

SEQ ID NO: 4188 - DNA, 2500 bp, Sorghum bicolor
ttccgccacgtgtcccctacccaacgcccaatggccttcgtctccgtccttccgtgagaagcctccgtccgcgttcaccgtttctctctcctctggctccgaccctccgacgactctcgtggtggcgtcgcctgcttgtgcttggaggttccggtcctctggaggaggccttgcccctcggcctcgggagagagggagggagggaaggaaggaatcttctagaagcctttcccgcggccgatgaaggaagccagcagcagccgtgtcggcgccgccggtgccggcgctgaggacgtcggttcctcgtccgtgtccaacaattgtttcccacaagatgagggtacaagctccagcgaaatggacaatactgaattctctgagacgtcctcagaggtgtcaggttctgagagaacaagacctgtagatagcaaaaatgcatcttccgtacttgatacgatatctattaaaaagaagctaaaattgtttagtcgaatggctacactgaaagatgatggaactgtagttgttgatatccccactaatattgaagctgcgtcacttgatcttccttctgaggatcaccacaatgtggcctttggtggcggaacattggactcttcagatcttcagtacaggccaccaatgcaaattgctatgctgattgttggtacaagaggggatgttcagccattcatagctataggaaaacgtttgcaggactacggtcatcgtgttagattagcaacccatgccaacttcaaggacttcgtgatgactactgggttggagttttatccccttggtggagatccaaaaattcttgctggatacatggttaagaacaaaggattcttgcctgcaactccatcagaaattcctatccagcgcaagcagattagggacatcatattctccttgcttcctgcttgcaaggatccggacattgatactggtgtttcttttagtgcggacgccataatagctaatccagcagcatatgttcaactgctgaccgaaatgagtgcctatacaggacatgtacatgtggcagaggctctcaatataccgattcacataattttcacaatgccgtggacgcctacctgtgaatttccacatcctttctctcatgtgaagcaacctgctggatatagactttcataccagattgttgactcttttgtctggcttggcataagggatatgataaatgatctccgaaaaaggaaattgaaattgagaccagttacatacctaagtggtacacatgcttattcgaatgatattcctcatgcatatatctggagtccttaccttgtcccaaaaccaaaagactggggacctaaaattgatgttgttggattttgtttccttgatcttgcttcaaattatgagcctcccgagccccttttgaggtggttagggagtggtgagagtcctatttatattggttttggtagccttccaatcccagaaccagataagttgacaagaatcattgtccaagcgcttgaaattactggacaaagaggtatcattaacaagggttggggcgggcttggaaatttggaagaatcaaaggaatttgtgtatgtacttgataatgttccacatgattggctctttttgcaatgcaaagctgtggtacaccatggtggtgctggcactactgctgctggtcttaaggctgggtgccccactaccatcataccattctttggtgatcaattcttttggggcagcatggtgcatgccagaggattgggggcgccacctatacctgtggagcaattacaattgcaatcactgattgatgcaatcaaatttatgattgatccaaaggtaaaggaacgagctgttcagctagcaaaggcaatcgaatcagaagatggtgttgatggggctgtaaaatcctttttaaaacatcttccacagaaaagggattccgaggcaacgccaactgcaccacagtcaacattcatgcaaccgctgcttctccctgtaaagaggtgttttggcatggcatcctaattcctaaccccgcatttccaagcacctgctttggctttgtggcaagtggcatcaccggtccggaacaagttgcgccacatgcttaggagaaggggaagtaccaacatgcgtagccagtcgtttcatcctacctataaagattaaagaatgtagaggcctgtttggttccccttactaaattttaatcagctgtgactagtggaactaaactattttagctccttttagtcagtgtgtttggaagtttagctactaaagtgactaaaatttagctggctaaaatttagaaagggaatcaaacatgccctatgtagagctactaagtttttgaatttttatatatatgtatatagcttgtggtaagtgtgcatacaatacggtaacttgagacttcggctccttacaactgtatatatattacaaaactaagcgggatatacggaatttcatccaaacttttgtccaccca

SEQ ID NO: 4189 - DNA, 1878 bp, Brachypodium distachyon
caacaaagcacttgtccatctctcttccttagccaagacaccaccattttcctcttcctcctccttcaaagttaaaacaaacagagcattcaagaagaagagggaggaagaagaggaagaaagggaagatggtgcttgctgtattgattggcgttttggtggggattgtgctggtcagcagcctgctgctgcgatggaacgaggtgaggtacagcaggaagcaggggcttcccccgggcacaatggggtggcctctcttcggcgagaccaccgagttcctcaagcaagggccgagcttcatgaaggccaggaggcttaggtacgggagcttgttccggacccacatcctgggctgccccacggtggtgtgcatggacccggagctgaaccggcagatgctgcagcaaggggaaggccgcggcttcgtcccgggctacccgcagtcgatgctggacatcctgggccgcaacaacatcgccgccgtccacggcccgctccaccgcgccatgcggggctccatgctcgccctcgtccgccccgcctccatccgctccagcctcctccccaagatcgacgccttcatgcgctcccacctccacggctgggccggcgacctcgtcgacatccaggacaagaccaaggagatggccttgctatctgcactcaggcagattgctggtatcactgctggcccactctctgatgccctcaagactgagctctacacccttgttctcggcaccatctccttgcccatcaaccttccaggaacaagctactaccaaggcttccaggcgaggaagaagctcgtatccatgctagagaagatgattgctgaacgacgatcctctggtcttgttcacaatgacatgctggatgctctcttaagcggcaatgatggaaccagggaaaggcttagtgacgagcagatcattgatttgatcatcaccctcatttactctggatatgaaaccatgtcgacgacttcaatgatggcggtcaagtacctgtcagaccatccaaaagctcttgaagaactcaggaaagagcattttgatatcaggaagggaaaatcgccagaggaagctatcgactataatgattttaagtccatgaccttcactcgagctgtaattttcgagacgctaagattagctacagttgtgaatgggctgctgagaaaaactactcaagacgtagaaatgaatgggtatgtcattccaaaaggttggagaatttatgtttacacaagggagataaattacgacccgtgcctgtatcctgacccaatgaccttcaatccatggaggtggctggagaagaacatggaatcacatccacacttcatgttgttcggaggaggtggtcggatgtgccctgggaaggaagtaggcacagcggaaattgcaacgttcctccactacttcgttactcgatacagatgggaggaagaaggcacaaacacaattttgaagtttccccgggtggaagctcccaacgggctacatatccgagttcaaaattactgatcttgcaacattttgcaaagtttagataggacccaaactcaggcaagagtgatgctgatgctgccctgaggaaaagattagaacagttcagcacttgtaagaaataggaaacatagggatagtataggtattataggttcactaggaaactaacgtaaaaggccacaaggtgctcctgtattctcttggtagatgaattctcaaaatgaaacagaagtatcatttggcttctatgatcttcaaactggatacagacatgagctgtccaaactgaggtaaaagattatcagaaagctgaaagttcctgctccccatgcccactagtagtatacaaatgaacaaactgact

SEQ ID NO: 4190 - DNA, 1721 bp, Brachypodium distachyon
ttttcctcttcctcctccttcaaagttaaaacaaacagagcattcaagaagaagagggaggaagaagaggaagaaagggaagatggtgcttgctgtattgattggcgttttggtggggattgtgctggtcagcagcctgctgctgcgatggaacgaggtgaggtacagcaggaagcaggggcttcccccgggcacaatggggtggcctctcttcggcgagaccaccgagttcctcaagcaagggccgagcttcatgaaggccaggaggcttaggtacgggagcttgttccggacccacatcctgggctgccccacggtggtgtgcatggacccggagctgaaccggcagatgctgcagcaaggggaaggccgcggcttcgtcccgggctacccgcagtcgatgctggacatcctgggccgcaacaacatcgccgccgtccacggcccgctccaccgcgccatgcggggctccatgctcgccctcgtccgccccgcctccatccgctccagcctcctccccaagatcgacgccttcatgcgctcccacctccacggctgggccggcgacctcgtcgacatccaggacaagaccaaggagatggccttgctatctgcactcaggcagattgctggtatcactgctggcccactctctgatgccctcaagactgagctctacacccttgttctcggcaccatctccttgcccatcaaccttccaggaacaagctactaccaaggcttccaggcgaggaagaagctcgtatccatgctagagaagatgattgctgaacgacgatcctctggtcttgttcacaatgacatgctggatgctctcttaagcggcaatgatggaaccagggaaaggcttagtgacgagcagatcattgatttgatcatcaccctcatttactctggatatgaaaccatgtcgacgacttcaatgatggcggtcaagtacctgtcagaccatccaaaagctcttgaagaactcaggaaagagcattttgatatcaggaagggaaaatcgccagaggaagctatcgactataatgattttaagtccatgaccttcactcgagctgtaattttcgagacgctaagattagctacagttgtgaatgggctgctgagaaaaactactcaagacgtagaaatgaatgggtatgtcattccaaaaggttggagaatttatgtttacacaagggagataaattacgacccgtgcctgtatcctgacccaatgaccttcaatccatggaggtggctggagaagaacatggaatcacatccacacttcatgttgttcggaggaggtggtcggatgtgccctgggaaggaagtaggcacagcggaaattgcaacgttcctccactacttcgttactcgatacagatgggaggaagaaggcacaaacacaattttgaagtttccccgggtggaagctcccaacgggctacatatccgagttcaaaattactgatcttgcaacattttgcaaagtttagataggacccaaactcaggcaagagtgatgctgatgctgccctgaggaaaagattagaacagttcagcacttgtaagaaataggaaacatagggatagtataggtattataggttcactaggaaactaacgtaaaaggccacaaggtgctcctgtattctcttggtagatgaattctcaaaatgaaacagaagtatcatttggcttctatgatc

SEQ ID NO: 4191 - DNA, 1776 bp, Setaria italica
caacagcaaagcaagcacccttctccttgctctgccgagtgccgaggcaccaccaccaccaccattcctgcagcagcagcagcatccgaggagaaagatggcggtgctgttgctggtggcggtcctcgccgcggcggtgttggccagcagcctgctgcttcggtggaacgaggtgcggtacagccgccgccggggcctgccgccgggcacaatggggtggccgcttttcggcgagaccaccgagttcctcaagcaggggcccagcttcatgaaggccaggaggctcaggtacgggagcctcttccggacgcatatcctagggtgccccacggtggtgtgcatggacccggagctgaaccgccggacgctggccagcgagggcgccggcttcgtcccgggctacccgcagtccatgctcgacatcctggggcccaacaacatcgccgccgtgcacggcccgctccaccgcgccatgaggggcgccatgctcgcgctcacccgccccaccatgatccgcgccgcgctcctccccaagatcgacgccttcatgcgcgcccacctccatggctgggccggccgccgcgtcgacatccaggagatgaccaaggagatggccttgctctcagctctcaggcagattgctggcatctctgctggcccactctctgatgccctcaaggcagagctgtacacccttgtacttggcaccttctccctgccaatcaacatcccaggaaccaactacagcaaagggcttcaggcaaggaagaagcttgtggcaatgctgaggcagatgattgcggaccggaggtcctctggttgtgctcaagatgacatgctggatgcgctcttgagcggcaacgagggtaccagggccaagctcaacgatgaccagatcattgacctgctcatcaccctcatatactctggatatgagaccgtgtcgacgacctccatgatggcggtgaagtacctgtcagacaatccaaaagctcttgaacaaatcaggaaagagcaccttgacatcaggaagggaaaatcgccagaggatgcccttgactggaacgattataagtcaatgaccttcaccagagctgtcatttatgagactctaagattagctacggttgtcaatgggctactgaggaaaactacccaggatgtcgaaatgaatgggtatgttattccaaaaggttggagaatttatgtctacacaagggagataaattatgatccattcctgtacccggaaccgatggttttcaacccatggagatggctggagaagggcctggaatcacatccccacttcatgttgtttggaggaggcgctcgtatgtgcccagggaaggaagtaggaacagttgaaattgcaactttccttcactatttcgtcacgcgatacagatgggaggaggaaggaaacaacacaatatcaaagtttcccagagtggcagctcccaatgggctacatatccgagttcaagattactgaacttgcgagacattttgcaaagtttagataggatttagactcagatagaataactctgcgatgctgttgctgctagcttcttgtaaagattagaacagccattggtgtccgtgccaataggaatgttatagggagggtataggtatcataggtttactaggaaattgatgtagaaagccatcagatgctccagtattcttttggtcgatcaattttcaaattataacaggtgtcatttggcttctatgcttttcaacttgatgcagaaaccagctacccat

SEQ ID NO: 4192 - DNA, 1792 bp, Triticum aestivum
gagaggaacacttgttgccaacacaggcaccaccagctctgctctgctctgcctgcctcttgaaccaaaacagagcatccaagaggaggcggtggcagaggtagaagaagaagaagatggcgctcctcctcttggtgctggtcggcgttgtggtcggcgtggtggtggcgagcagcctgctgctgaggtggaacgaggtgaggtatggcaacggccggaggaaggagggccgcttgccgccggggacaatggggtggccgctcttcggggagaccaccgagttcctcaagcaagggccatccttcatgaagcagaggaggctcaggtacgggcggctgttccggacgcacatcctgggctgcccaacggtggtgtgcatggacccggagctcaaccgccggatgctgctccagggcgaggccggcggcctcgtcccgggctacccgcagtccatgctcgacatcctcggccgcaacaacatcgccgccgtgcacggcccgctccaccgcgtcatgcgcggcgccatgctcggcctcgtccgtcccgccatgctccgcaccagccttctccccaagatcgacgccttcatgcgcgaccacctcagcggctgggccggcagcgtcgtcgacgtccaggccaagaccaaggagatggccttgctgtccgcactcagacagatcgccggcataaccgcaggccctctctctgacgccctcaagacggagctatgcacccttgtgctcggcaccatttccttgccaatcaatctccccggaaccagctactaccaaggcttccaggctaggaagaagcttgtgtccatgctagagcagatgatcgccgagcggcggtgctctggtgaagtgcatgatgacatgctggatgctctcttgagaagcggcaatgatgggaccagagagaagctcactgatgagcagatcattgacttgctcatcgcgctcatttactctgggtatgagaccatgtcgacgacctcgatgatggccgtcaagtacctgtcagatcacccgcaagctctcgaagaactcaggagagagcatcttgatatcagaaaggggaaatcgccagaggaagccatcagctacgaagattttaagtccatggccttcactcgagctgtcatttttgagacactaagattagctacagttgtgaatgggctgctgaggaaaactactaaggatgtagaaatgaatgggtatgtcattccaaaagggtggagaatctatgtttacacgagggagataaactacgatccattcatgtatcctgacccaatgactttcaatccgtggaggtggctggagaagaacatggaatcgcacccgcacttcatgttgttcggaggaggcggccggatgtgccccgggaaggaggtgggcacggcagagatcgcgactttcctccactatttcgtgacccgatacagatgggaggaagaaggcaagaacaccatcttgaaattcccccgtgtggaagctcccaacgggctacatatccgggttcaagattactgatcttgcaacatacattttgcagagtttaggtagatatggccctgactgaggcgacgagagtgcaattctgcgccgatggaaatattagatcagccttgtaagaaataggaaacatagatatagtgtaggtattataggtttaggaggcaactgatgtagaaggccacaagaggcaacaatgttcttctttgtgatcaattacatatgcatgataagcagcactaaacgtgtgtgatatgtctgctggcttcaat

SEQ ID NO: 4193 - DNA, 1777 bp, Triticum aestivum
gagaggaacacttgttgccaacacaggcaccaccagctctgctctgctctgcctgcctcttgaaccaaaacagagcatccaagaggaggcggtggcagaggtagaagaagaagaagatggcgctcctcctcttggtgctggtcggcgttgtggtcggcgtggtggtggcgagcagcctgctgctgaggtggaacgaggtgaggtatggcaacggccggaggaaggagggccgcttgccgccggggacaatggggtggccgctcttcggggagaccaccgagttcctcaagcaagggccatccttcatgaagcagaggaggctcaggtacgggcggctgttccggacgcacatcctgggctgcccaacggtggtgtgcatggacccggagctcaaccgccggatgctgctccagggcgaggccggcggcctcgtcccgggctacccgcagtccatgctcgacatcctcggccgcaacaacatcgccgccgtgcacggcccgctccaccgcgtcatgcgcggcgccatgctcggcctcgtccgtcccgccatgctccgcaccagccttctccccaagatcgacgccttcatgcgcgaccacctcagcggctgggccggcagcgtcgtcgacgtccaggccaagaccaaggagatggccttgctgtccgcactcagacagatcgccggcataaccgcaggccctctctctgacgccctcaagacggagctatgcacccttgtgctcggcaccatttccttgccaatcaatctccccggaaccagctactaccaaggcttccaggctaggaagaagcttgtgtccatgctagagcagatgatcgccgagcggcggtgctctggtgaagtgcatgatgacatgctggatgctctcttgagaagcggcaatgatgggaccagagagaagctcactgatgagcagatcattgacttgctcatcgcgctcatttactctgggtatgagaccatgtcgacgacctcgatgatggccgtcaagtacctgtcagatcacccgcaagctctcgaagaactcaggagagagcatcttgatatcagaaaggggaaatcgccagaggaagccatcagctacgaagattttaagtccatggccttcactcgagctgtcatttttgagacactaagattagctacagttgtgaatgggctgctgaggaaaactactaaggatgtagaaatgaatgggtatgtcattccaaaagggtggagaatctatgtttacacgagggagataaactacgatccattcatgtatcctgacccaatgactttcaatccgtggaggtggctggagaagaacatggaatcgcacccgcacttcatgttgttcggaggaggcggccggatgtgccccgggaaggaggtgggcacggcggagatcgcgactttcctccactatttcgtgacccgatacagatgggaggaagaaggcaagaacaccatcttgaaattcccccgtgtggaagctcccaacgggctacatatccgggttcatgattactgatcttgcaacatacattttgcagagtttaggtagatatggccctgactgaggcgacgagagtgcaattctgcgccgatggaaatattagatcagccttgtaagaaataggaaacatagatatagtgtaggtattataggtttaggaggcaactgatgtagaaggccacaagaggcaacaatgttcttctttgtgatcaattacatatgcatgataagcagcaaaaaaaaaaaaaaaacga

SEQ ID NO: 4194 - DNA, 1833 bp, Zea mays
gcaaccaaagcacacccctcctccttgctctgcggtgctcggagttggggagttggagcaccaccaccaccactcttcccctctcctcgctcgtcctgttggaagcagcacacgcacgagagagaaagagagacacaagagatggcgctgctgttgctcctgctggccgtgctcggcgtggtgctggcgagcagcctgctgctgcggtggaacgagctgcggtacagccgccgccggggcctgccgccgggcacaatggggtggccgctcttcggcgagaccaccgagttcctcaagcaggggcctagcttcatgaagcagaggaggctcaggtacgggagcctgttccggacgcacatcctgggctgccccacggtggtgtgcatggagccggagctgaaccggcgggcgctggccagcgagggcgccggcttcgtcccgggctacccgcagtccatgctcgacatcctggggcccaacaacatcgccgccgtgcacggcccgctccaccgcgccatgcggggcgccatgctcgcgctcacgcggccacacatgatccgcgccgcgctcctccccaagatcgacgccttcatgcgcgcccacctccacggctgggccggacgccgcgtcgacatccaggagatgaccaaggagatggctttgctctcggctctcaggcagatcgctggcatctctgcgggcccactctccgacgccctaaaggcagagctgtacacccttgtacttggcaccttctccctgccaatcaacgtcccaggaaccaactacagcaaagggctccaggcaaggaagaagctcgtggcaatgctgcggcagatgatcgctgaccggaggtcctctggctgcgcccgagacgacatgctggacgcgctgctcagcggcaacgagggtaccagggcgaagctcagcgacgaccagatcatcgaccttctcatcaccctcatatactctgggtacgagactgtgtcgaccacctcgatgatggcggtgaagtacctgtcggacaaccccaaagctctcggacagatcaggaaagagcaccttgacatcaggaaggctaagtcaccggaggatccccttgactggaacgactacaagtccatgaccttcaccaaagctgtcatttatgagactctaaggctagctacagtagtcaacgggctgctgaggaaaactacccatgacgtagaaatgaatgggtatgttattccaaaaggctggagaatttatgtctacacaagggagataaactacgacccgttcctgtacccggaacccatggttttcaacccatggagatggatggagacgaacctggaatcacatccgcacttcatgctgttcggaggaggtgcccgcatgtgcccagggaaggaggtaggaacagttgaaatcgcaacgttccttcactatttcgtgacgcgttacagatgggaggaggagggaaacaacacaatatcgaagttccccagagtggcggctcccaatgggctacatatccgagttcaagattactgaacttcgtgaggcgttttgtgaagtttaggtagggattcagacagatagaaataacccatgcgatgctgatgctgctggcctcttcgaaaggactagaacagccattagtgcctgtaaaatgtgtccatgccgatagtaatgttattatagggaggatataggtatcataggtttattagaaatttgatgtagaaagccaacagatgctcctgtattcttttgctccatcaaaacagtggtatcatttggcttctatgcttttgaatcgaacatggtacagaacccaactatcca

SEQ ID NO: 4195 - DNA, 1884 bp, Sorghum bicolor
agcgagcaaagcactctgcctgccgtgctcggagttggagttgggagttgaagcaccaccaccattcctgcagcctgcctcctcctcccccctcctcttcctcctcctgctccaagcacacgagagatagatagaggagatggcggtgctgttgctcctggtggccgtgcttggcgtggtgctggcgagcagcctcctcctgcggtggaacgagctccggtacagccgccgccggggcctgccgccgggcacaatggggtggccgctcttcggcgagaccaccgagttcctcaagcagggccccagcttcatgaagcagagaaggctcaggtacgggagcctgttccggacgcacatcctgggctgccccacggtggtgtgcatggagccggagctgaaccgccggacgctggccagcgacggcgccggcttcgtcccgggctacccgcagtccatgctcgacatcctggggcccaacaacatcgccgccgtgcacggcccgctccaccgcgccatgcggggagccatgctcgcgctcacgagggcacacatgatccgcgccgcgctgctccccaagatcgacgccttcatgcgcgcgcacctccatggatgggccggacgacgcgtcgacatccaggagatgaccaaggagatggctttgctctcagctctcaggcagattgctggcatctctgctggcccactctctgatgccctaaaggcagagctgtacacccttgtacttggcaccttctccctgccaatcaacatcccaggaaccaactacagcaaagggctccaggcaaggaagaagcttgtggcaatgctgcggcagatgatagcggaccggaggtcctctggttgcgctcaagatgacatgctggatgcactgttgagcggcaacgagggcaccagggcgaagctcactgatgaccagatcattgaccttcttatcaccctcatatactctgggtatgaaaccgtgtcaaccacctcgatgatggcggtgaagtatctgtcggacaatccgaaagctcttgaacaaatcaggaaagagcatcttgacataaggaaggctaaatcaccagacgatgcccttgactggaatgattataagtcaatgaccttcaccaaagctgtcatttatgagactctaagactagctacagttgtcaatgggctgctgaggaaaactacccaggatgtagaaatgaatgggtatgttattccaaagggctggagaatttatgtctacacaagggagataaattatgatccattcctgtacccggaaccgatggttttcaacccatggagatggctggagacgaacctcgaatcacatccacacttcatgttgtttggaggaggtgcccgcatgtgcccagggaaggaagtgggaacagttgaaattgcaacgttccttcactatttcattacgcgttacagatgggaggaggagggaaacaacacaatatcaaagttccccagagtggcagctcccaacgggctacatatccgagttcaagattactgaacttgtgagacgttttgtgaagtttagataggattcaaactcagatagaaataaccctgagatgctgatgctgctggcctcttgaaaggattagaacagccattggtgcttgtaaaatgtgtccatgccaataggaatattatagcgaggatataggtatcataggattactaggaaattgatgtagaaagccaccagatgctcctgtattcttttggtccatcaattttcaaatttaaacagaagtatcaattggcttatatgcttttgaacatgatacagaatgagctattcctatgcaaatttccagcttcatgagcccgttgaataaaaaatgccaatagcca

SEQ ID NO: 4196 - DNA, 2971 bp, Sorghum bicolor
cgttgatctcttccgtctccggtctctcgtaggagggcagcaggattatcacattttcacacacaaacctctgatctctgctgacagtgctcctgcctgagctctgacgcttgtcgtgaccccacggtcaagcctcctcactccgctagctccgcctcggaatgtggacccctagctccgacctcctactcctcctctatctatcctgcagacgcaatttaaactgctactgtagagaaaaataataaatgaaagaaaacgaggaaaactttttttttggggggaaaagatgccgggtggcaattcataaaatagttcttggtctcgcctcggtgacctgctgggtgtgcctgcctgtgcctgtggtggtctatataaaggcctcctcggcgccccagtacaacagcgagcaaagcactctgcctgccgtgctcggagttggagttgggagttgaagcaccaccaccattcctgcagcctgcctcctcctcccccctcctcttcctcctcctgctccaagcacacgagagatagatagaggagatggcggtgctgttgctcctggtggccgtgcttggcgtggtgctggcgagcagcctcctcctgcggtggaacgagctccggtacagccgccgccggggcctgccgccgggcacaatggggtggccgctcttcggcgagaccaccgagttcctcaagcagggccccagcttcatgaagcagagaaggctcaggtacgggagcctgttccggacgcacatcctgggctgccccacggtggtgtgcatggagccggagctgaaccgccggacgctggccagcgacggcgccggcttcgtcccgggctacccgcagtccatgctcgacatcctggggcccaacaacatcgccgccgtgcacggcccgctccaccgcgccatgcggggagccatgctcgcgctcacgagggcacacatgatccgcgccgcgctgctccccaagatcgacgccttcatgcgcgcgcacctccatggatgggccggacgacgcgtcgacatccaggagatgaccaaggagatggctttgctctcagctctcaggcagattgctggcatctctgctggcccactctctgatgccctaaaggcagagctgtacacccttgtacttggcaccttctccctgccaatcaacatcccaggaaccaactacagcaaagggctccaggcaaggaagaagcttgtggcaatgctgcggcagatgatagcggaccggaggtcctctggttgcgctcaagatgacatgctggatgcactgttgagcggcaacgagggcaccagggcgaagctcactgatgaccagatcattgaccttcttatcaccctcatatactctgggtatgaaaccgtgtcaaccacctcgatgatggcggtgaagtatctgtcggacaatccgaaagctcttgaacaaatcaggaaagagcatcttgacataaggaaggctaaatcaccagacgatgcccttgactggaatgattataagtcaatgaccttcaccaaagctgtcatttatgagactctaagactagctacagttgtcaatgggctgctgaggaaaactacccaggatgtagaaatgaatgggtatgttattccaaagggctggagaatttatgtctacacaagggagataaattatgatccattcctgtacccggaaccgatggttttcaacccatggagatggctggagacgaacctcgaatcacatccacacttcatgttgtttggaggaggtgcccgcatgtgcccagggaaggaagtgggaacagttgaaattgcaacgttccttcactatttcattacgcgttacagatgggaggaggagggaaacaacacaatatcaaagttccccagagtggcagctcccaacgggctacatatccgagttcaagattactgaacttgtgagacgttttgtgaagtttagataggattcaaactcagatagaaataaccctgagatgctgatgctgctggcctcttgaaaggattagaacagccattggtgcttgtaaaatgtgtccatgccaataggaatattatagcgaggatataggtatcataggattactaggaaattgatgtagaaagccaccagatgctcctgtattcttttggtccatcaattttcaaatttaaacagaagtatcaattggcttatatgcttttgaacatgatacagaatgagctattcctatgcaaatttccagcttcatgagcccgttgaataaaaaatgccaatagccaactgatctaaaaatatggatggacactgactgtaaaacattaagcacatactgaggatatgctaaattggtaactgccaattgctaatggaggaacagagtaagagtttttaccttattcaggatatagatgataactgcttcaatggtagaggcttccaattgcttatataaagatgcaagtttcttcaattggttaggcaacacattgatgaaagcaaaagcactctcttcccatggacggtccaacataagcaatattcattgctgcttcaaaagatgccaaatagttgtttagaacaatcgccattaatgttcggtgcaaatgaaactgcattatccaacgtctctgagaaggcaagaacaatgctgttattgagctactagtaaaatctcaaaattgtagataaaagacttcagaatccaacgtactccgagaacaatgctgttaatgcgctactagtaaatctcaaaattgaagatactacaagacttcagctttcggcaaggggcaaaatttccctggaacaaccaatatccttgaccagacatgtaaataaagagcgcacaaagaagaatctaacatagagttttggtaacttgattctatctgtttcaactctgttgcagtaaaacctatcatcagggcatccataattggtgatctcattcacttaagtttaa

SEQ ID NO: 4197 - DNA, 1724 bp, Hordeum vulgare
cgcgtccgtccagtacacacacttgttgccaccagctctgctctcctctgctctgcctcttgagccagaagagagcatccaagaggcaaggtaggaggagaggaagaagatggcgctcctcctcttggcgctggtcgtcgtcggcgtggtggcgagcagcctgcttctgaggtggaacgaggtgaggtacggcaacggcaggaggaagcatggcgatgcctgcctgccgccgggcacaatggggtggccgctcttcggcgagaccaccgagttcctcaagcagggcccctccttcatgaagcagaggaggctcaggtacgggcggctgttcaggacgcacatcctgggatgccccacggtggtgtgcatggacccggagctcaaccgccggatgctgctgcagggcgaggccggcggcatggtgcccggctacccgcagtccatgctcgacatcctcggccgcaacaacatcgccgccgtccacggcccgctccaccgcgtcatgcgcggcgccatgctcggcctcgtccgccccgccgcgctccggcaaagcctcctccccaagatggacgccttcatgcgccaccacctcgccggctgggccggcaccgtcgtcgacgtccaggccaagaccaaggagatggcattgctgtctgcactcaggcagatcgccggcatcaccgccggcccgctctccgacgccctgcagacagagctgtacacccttgtgctcggcaccatctccttgcccatcaatcttcccgggaccagctactaccagggctttcaggcgaggacgaagcttgtgtccatgctagagcagatgatcgccgagcggcggtcgtctggtgaagcccacgatgacatgctggatgctctcttgagaagcggtgatgacgggaccagggaaaagattagcgacgagcagatcattgacttgctcatcgccctcatctactccggatacgaaaccatgtccacgacttcgatgatggccgtcaagtacctatcagaacatccgcgggcgctccaagaactcaggagagaacatctggatatcaggaaggggaaattgccggaggaggcaatcggctacgacgatttcaagtccatgtccttcactcgagctgtcatctttgagacgctaagattagctactgtcgtcaatggtctgctgaggaaaactactcaggatgtagaaatgaatgggtatgtcattccaaaaggctggagaatctatgtttacacgagggagataaactatgatccgttcatgtatcctgacccaatgaccttcaatccatggagatggctggagaagaacatggaatcacacccgcacttcatgttgttcggaggaggcagccggatgtgccctggaaaggaagtgggcacggcggagatcgcgacattcctccaccgtttcgtgacccaatacagatgggaggaagaaggcaagaacacgatcttgaaattcccccgggtggaagctcccaacgggctgcacatccgagttcaggattactgatttcttgcagcgtacattttgcagagtttagatagataggaacgatgagagcgatgaaaattctagatcagccttgtaagaaatagcaaacataagcacatagggatagaatgcagaggccggggctcgtttcctccttttcaaaaaaaagcacatagggatagaagtaggtatacagctctgctaggtaattgac

SEQ ID NO: 4198 - DNA, 1836 bp, Secale cereale
gctctgcctcttgaaccaaaacagagcatcacagaaaccagaagaggtagacgaagaagatggcgctcctcctattggtgctggtaggtgttatcatcggggtggtgctggcgagcagcttgctgctgcggtggaacgaggtcaggtacggccggaggaaggagggcgatggccgcttgccgccggggacaatggggtggccgctgttcggcgagaccaccgagttcctcaagcagggcccgccttcatgaagcagaggaggctcaggtacgggggctgttccggacgcacatcctgggctgccccccggtggtgtgcatggacccggagctcaaccgccggatgctgctccagggcgaggccgcggcctcgtccccggctacccgcagtccatgctcgacatcctcggccgcaacaacatcgccgccgtgcacggcccgctgcaccgcctcatgcgcggggccatgctcggcctcgtccgccctgccatgctccggcaaagcctcctccccaagatcgacgccttcatgcgcgaccacctccagggatgggccggctccgtcgtcgacgtccaggccaagaccaaggagatggccttgctgtccgcactccggcagatcgccggcatcaccgccggcccactctccgacgccctcaagacagagctctacacgcttgtgctcggcagcatctccttaccgattaacctcccggggaccagctactaccaaggctttcaggcaaggaagaagctcgtgtccattctagagcagatgatcgcggaacggcgatcctctgctgatgctcacgatgacatgctggatgctctcttgagaagcggtgatgacgggaccagggagaagattagcgacgagcagatcattgacttgctcatcgccctcatctactccggctacgagaccatgtcgacgacttcgatgatggccgtcaagtacctatcggaacatccgcgggctctcgaagaactcaggagagagcatcttgatatcagcaagggaaaatcgccggaggaagccatcagctacgatgatttcaagtccatggccttcactcgagctgtcatctttgagacactaagattagccacagttgtgaatggactgctgaggaaaactacccaggatgtagaaatgaatgggtatgtcattccaaaaggctggagaatctatgtttacacaagggagataaactatgatccgttcatgtatcctgacccgatggccttcaatccgtggagatggctggagaagaacatggaatcgcacccgcacttcatgttgttcggaggaggcggccggatgtgccccgggaaggaggtgggaacggcggagatcacgactttcctccactatttcgtgacccgatacagatgggaggaagaaggcaagaacacaatcttgaaattcccccgggtggaagctcccaacgggctgcatatccgagtccaagattactgaactcttccaacaaacattttgcagagtttagatagatatgacaaagacaaagcgattctgcgacgatgaatagattagattagcaatttgatgcctgtataaatataggaacatagggatagtatagatgttatagggtagctgaggtagctgaggtagaaggcaataagatgctcctgtgttcttttgttctaccaattctgaagtcgacaaaggagtatggtgtgaatagcttcaactctctgtttcttgttgacccgtgcaggagagctgcatgtcaaatgatagatagagataaatacaattgtctgaagaataggagtgtaaagaataaaattatgcagtaaaatgaagctga

SEQ ID NO: 4199 - DNA, 1045 bp, Zea mays
aagagttcagcactcctctcgcgtcctcattcttcaaccgccacacaaacccctcgcttactgcacctttgcagcaccgctctctcgatcgaatcccaaggaacgaagacgacgacgatggcgtcgtctgcctgcttgctccaagcttccacggccttcgctccacgcttctccctcccgtcccgaccccagcccccgctacacctgcgtctccgcggctcccccaaccgtcgccgtggcatctcactcactgcttcctccgccgcgtccccggaagtcgagaaagagtcctcgccctcgtcctcgccgcaggaatctctgtctgctgtcgcggacagtgtgaaggtgctcaaggtggcagccaagacgaggaaagtacctgccccggaaattctctcggcgctgtccaagatcaagaaggcaaaactcgacacgtcggcattctttgagacactcggtggtaccgagtctccaggcaggacgtggatgcttatcttcactgcaaagggtcggctggagaaagggcagtatttcccagtgacagcagtccaacgcttcgatgctgcgggcaaacgcatcgagaatggcatatatttgggccccatcgggtgcttgaccttcgaagggaggctgtcatggaaaaagaaaatacttgcgttcatcttcgagcgggttcgcatcaaggtcggaccgtttggtcccctggaaatcagcctcggaagcggtgacggtggtagggagcccagcacgaaggaccccttcttcgtttggttctatgttgacgaagagatcgctgttgcgcaaggcagaggcgggggcgtagcttactggtgccgatgtcagcgtgtcccctgaagatccagacatcctcatctcgcttcaatgatcactgtacaatatcaggataaatggataatgttgagtctctagtttgtagggttcatgttcatctttgtactatctgctttgtctccgaaaacgagaaaaaaaggcaattggaggtgtaaataatgaaatgctatttgttgataactaaaattttcta

SEQ ID NO: 4200 - DNA, 1165 bp, Setaria italica
atggtgaccaagagttccgcgctcctcttgcgtcctcgttcctcaatcgccacacaccccgcgctacaccttgcaactctgctctctctcgatccgaatccaagagcgaagaagacgatggcgtcgtctgctgccttgctccaagcttccacggccttcgctcctgtcttctgcccgctcccgtgccggccccagcccgcgccacggctccatctccgcggctcccccaaccgtcgccgccgcggcgtcgcactcgccgcttcctccgccgcgtcgtcggaggtagagaaagagccgtcgacatcgccctcgtcctcgccgcaggagtctgagtcggctgtcgcggacagtgtgaaggtgctcaaggaggcggccaagacaaggaaggtgcctgcatcagaggtgctttcagcattgtccaagatcaagaaggcaaagcttgacacatcgacattctttgagacactcggcgggacagagtctccaggcaggacatggatgctcatcttcactgctaaggggcggctagagaaagggcagtatttcccagtgactgcagtccagcgcttcgatgctgcgggaaaacggatcgagaatggtatatatttgggccccattgggtgcttaacctttgaagggaggctatcatggaaaaagaaaatacttgcattcatcttcgagcgggttcgcataaaggttggacctttcggtcccctggaaatcggccttggaagcggcgatgatggcagggaacccagcacaaaggacccgttctttgtttggttctatgttgacgaggaaatcgctgttgcgcaaggcagaggcgggggagtagcttactggtgcagatgtcagcgcgtaccctgaaagagtgaaggttcagttcacttcaatcgttactgtacaagatcaggaaacttcctctgtagtctgtatagttagtgttcatctttgcaatgcctgctttgtctccggaaaataaaaataaaaggaggtgcacatgatggaatattgaggtgatacacttgtaggcttcaattgaggttctgtaatgaactggtgttttcactgaaaacttaggccgtgtttcagcttctcaggtcagctttccggcttctaacagccagaagctagaaagctgaaacaaacagctggaaagctaaac

SEQ ID NO: 4201 - DNA, 930 bp, Avena sativa
cgcccttccctgaaaagaaatttccccaccgagcagggcaccgagatcgggcgagatggcggctcggctgctgggcggcgcgcgccgcgtcgcgctgctgcccaacgtccggcggcgggcgaccaattcctgggccgccgtccgcgacaccttcttctccaccaaggaagtgttcgagagccaccgcgtcgtgttcaccgtcggcacctccatcgcctccgtcctcacggcctgggccggttattcttttcgtcatatgcagcaatcgaagattgacaagaggcttcattcaattgagcaatctttgaaggatactcacagaaatgaacatgatgagattaaaaagattgtcacttcctacaatatcagcactccagcttgtatagccacggcattgactacttcggttgttgggtatgccctagggtggcgcggcggggcttggtatgcccggcgggccttcaggagagagcagcagaagctgatgggccaaataaagtcacacaacaggtggcactggcggcccttcagcaagcttagaaacaggctcaggagcaaccgacacgcctccaagagctccgatgcccctcggctaccgggtaatggcgccgaggccccctcaattaacggggcctccacgaagggtcttggcaccgaggtccccttgagtaatgggtcctctgcgagcgttagcagtagctctcaggcagcagcaggctgaacatgactgctttgatagcactaagttttgtactccctctatccggaaaaggacgtcgcatatctgatctgatgaccgctctgatagcagaaacatttgtctgatctgatgtacccccgagaatagaaattaaagtagccctaggtttgttcgactggacagatggagatgctgtctacgctgatgtatcaatcgctatttctggtggt

SEQ ID NO: 4202 - DNA, 910 bp, Oryza sativa
gtccagacaacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccggtccaggagatggaggcggcttacaagttcgggccgtacaagatcgacgcgagggaggtgttccactccacgccgctgtcctacgccatggtcaacctccgcccactcctccctggtcatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggatggtccacaagctggtcaaactgttccacatgtccacatccatgtcatccctagaaagaaaggagattttgagaaaaatgatgagatatatgatgcgattgatgtcaaagagagggaattgaaggagaaacttgatctggacatagagagaaaagatagaaccatgaaagaaatggctcatgaggccaatgagtaccgtggtctcttctcttagatgtaatttttgcgataaatttcttgtaaactatctctaaattgcagttactcttctccagaaattatttttgtaactgtttgtcatccatcatgggaattcaagtcttcgaatgatattatgaaattatctaatttggtacgata

SEQ ID NO: 4203 - DNA, 322 bp, Eragrostis curvula
ggggagagcagggaggataggagaagacgacggcaaccatggcgacggcgcaggcggcctcggattcccccacccaccgcgcgtactccccggccacgtccaacccaccgtaccccagcgctgccaggatcgccgactccgcctgcttcccccagtacacagcttcactgaagtgtttggaggcccaccaagacaagagcaagtgccagcagcagtttgacgattacaaggagtgcaagaagaaagagagggaggctcgccttgagagtaacaaaaccaggtcactctttggatgaaaagttgtgctcgttttgagcgatct

SEQ ID NO: 4204 - DNA, 601 bp, Pennisetum glaucum
cccaaaagaggagaggaggaagacggacgacgcggcacccacccatggcgacggcacaggcagcatcggcgtccccaacccaccaccaccgcgcgtccccggggacgtcgccgccgcagccgccgtacccgagcgccgccagaatagccgactccgactgcttcccccagtacaccgcctccctcaagtgtttggaggctaaccaagacaagagcaagtgccagcagcagttcgacgattacaaggagtgcaagaagaaagagagggaggctcggcttgaacggaacaaaagccgatcactctttgggtgaacaagggcattccgcctgagcaattttctggtcatgtgcaataaggtttttcctgaagtgatggagtgaaatcacagcttctttggtttcgtgatgatcctttgtaacttgtgcaaggagcaatgtaggaaatagtcggtctctaaggttgagggaaatgtaatgtctgagaacagctcattagctcaatggctctggctagcaaatcatatgagcaatgatgtattttgagagtcatcaggtgttatgacacgaggacttattcaataaaattgtatttctgagatgcg

SEQ ID NO: 4205 - DNA, 681 bp, Sorghum bicolor
agataaacagcccattactaaagccctgtccatctcatccagaaagacgacggctaatcgaaagcccaaaagagagagcggagaggaggaagaagacgacgcggcaccatggcgacggcacaggcagcgtcggcggcccctacccaccaccgcgcgtctccagggacttcgccgccgcagccgccgtaccccagcgccgccaggattgccgactccgcctgcttcccccagtacaccgcctcgctcaagtgtttggaggccaaccaggacaagagcaagtgccagcagcagttcgacgattacaaggagtgcaagaagaaagagagggaggctcggctcgaacggaataaaacaagatcactctttgggtgaacaatggtgtcccatctgagcgatttgctggcgatgtgtaataagtcgtttccagtttcctgatgtgagcgaaatcacggcttgtttggtgtcatgatgatcccttgcgacttgtgcaaggtagggactagtatactggtctgttgtctctaggtgagggagctgtaaggttcgtctgagaacagctcattaacacaatggctatggtgaaagaatcaaatgagtgaggctgtattttgagaacgagcaggtgtcatgacaccacagtttgttcaataaaattgtagccctggatgttgtactccaaaa

SEQ ID NO: 4206 - DNA, 744 bp, Sorghum bicolor
aaagccctgtccatctcatccagaaagacgacggctaatcgaaagcccaaaagagagagcggagaggaggaagaagacgacgcggcaccatggcgacggcacaggcagcgtcggcggcccctacccaccaccgcgcgtctccagggacttcgccgccgcagccgccgtaccccagcgccgccaggattgccgactccgcctgcttcccccagtacaccgcctcgctcaagtgtttggaggccaaccaggacaagagcaagtgccagcagcagttcgacgattacaaggagtgcaagaagaaagagagggaggctcggctcgaacggaataaaacaagatcactctttgggtgaacaatggtgtcccatctgagcgatttgctggcgatgtgtaataagtcgtttccagtttcctgatgtgagcgaaatcacggcttgtttggtgtcatgatgatcccttgcgacttgtgcaaggtagggactagtatactggtctgttgtctctaggtgagggagctgtaaggttcgtctgagaacagctcattaacacaatggctatggtgaaagaatcaaatgagtgaggctgtattttgagaacgagcaggtgtcatgacaccacagtttgttcaataaaattgtagccctggatgttgtactccaaaatattttcatgttttactaattactagcagctttgcatccaccttttcgaccagccttgctctgtggaaatggaagtttccct

SEQ ID NO: 4207 - DNA, 598 bp, Panicum virgatum
  misc_feature (22)..(22): n is a, c, g, or t
  misc_feature (73)..(73): n is a, c, g, or t
  misc_feature (121)..(121): n is a, c, g, or t
  misc_feature (152)..(152): n is a, c, g, or t
  misc_feature (262)..(262): n is a, c, g, or t
  misc_feature (287)..(287): n is a, c, g, or t
  misc_feature (298)..(298): n is a, c, g, or t
  misc_feature (301)..(301): n is a, c, g, or t
  misc_feature (311)..(311): n is a, c, g, or t
  misc_feature (318)..(318): n is a, c, g, or t
  misc_feature (326)..(326): n is a, c, g, or t
  misc_feature (332)..(332): n is a, c, g, or t
  misc_feature (356)..(356): n is a, c, g, or t
  misc_feature (365)..(365): n is a, c, g, or t
  misc_feature (367)..(367): n is a, c, g, or t
  misc_feature (382)..(383): n is a, c, g, or t
  misc_feature (388)..(388): n is a, c, g, or t
  misc_feature (407)..(407): n is a, c, g, or t
  misc_feature (411)..(411): n is a, c, g, or t
  misc_feature (422)..(422): n is a, c, g, or t
  misc_feature (432)..(432): n is a, c, g, or t
  misc_feature (436)..(436): n is a, c, g, or t
  misc_feature (443)..(443): n is a, c, g, or t
  misc_feature (467)..(467): n is a, c, g, or t
  misc_feature (471)..(471): n is a, c, g, or t
  misc_feature (495)..(495): n is a, c, g, or t
  misc_feature (497)..(497): n is a, c, g, or t
  misc_feature (508)..(508): n is a, c, g, or t
  misc_feature (518)..(518): n is a, c, g, or t
  misc_feature (524)..(524): n is a, c, g, or t
  misc_feature (532)..(533): n is a, c, g, or t
  misc_feature (539)..(539): n is a, c, g, or t
  misc_feature (547)..(547): n is a, c, g, or t
  misc_feature (562)..(562): n is a, c, g, or t
  misc_feature (564)..(564): n is a, c, g, or t
  misc_feature (575)..(575): n is a, c, g, or t
  misc_feature (583)..(583): n is a, c, g, or t
caaagcccaaaagaggagaggnagacgacgacgacgcggcaccatggcgacggcacaggcagcctcggcgtcncccacccaccaccgcgcgtccccggggacgtcgccgccgcagccgccntaccccagcgccgccaggatcgcggactccncctgcttcccccagtacaccgcctccctcaagtgtttggaggccaaccaggacaagagcaagtgccagcagcagttcgacgattacaaggagtgcaagaagaaagagagngaggctcggctcgaacggaataaangccgatcactnttngggtgaacantggcgtnccccctgngcaatntgctggtgatgtgcaataagttgnttcctgatncnagtgaaatcacagcnnctttngtttcgtgatgatcctttntaanttgtgcaaggnaggaaatagnagancagtctntaggttgagggagatgtaaggtcngagnacagctcattagctcaatggcttngncgagcgaatcngatgagcaangatgtnttttgagnntcatcnggtgtcangacacgaggatttgntnaataaaaattntatttctngaacgcttttactcc

SEQ ID NO: 4208 - DNA, 609 bp, Secale cereale
ccaacgcgaagcccacccaggaagtgagcggagtggaggaagaagcagacgcggcatcatggcggcggctcatgcggcggcggcgtcccccacccaccgcgcgtccgtccaggcgacgtcgaccccgccgtaccccagcgcggcccggatcgccgactcctcctgcttcccccagtacaccgcctccctcaagtgtctggagaccaaccaggacaagagcaagtgccagcagcagttcgacaactacaaggagtgcaagaagagagagagggaggctcggctggaacggaaccggagccggacattgttcgggtgagcaatccgaggaccactgtgcagtgaactggaagagttaatgctagtgaaaccatgactcgtttgatttcctgatgttaatttaagctgttgaagttagaaaacagtagagaactctgggttcagagagatgtaaggacaagatgtcactagagagtttattcaataaaatgttactcccggaaacgcctgaaaccgcgtcaagccgacgtgggatgcttttgtatttcaatgatgtatgttgtttttatgtcctattgaattctgaaagactgcaagaggtttataaacaaa

SEQ ID NO: 4209 - DNA, 533 bp, Pseudoroegneria spicata
  misc_feature (58)..(58): n is a, c, g, or t
  misc_feature (72)..(72): n is a, c, g, or t
  misc_feature (78)..(78): n is a, c, g, or t
  misc_feature (124)..(124): n is a, c, g, or t
  misc_feature (196)..(196): n is a, c, g, or t
  misc_feature (202)..(202): n is a, c, g, or t
  misc_feature (387)..(387): n is a, c, g, or t
  misc_feature (390)..(390): n is a, c, g, or t
  misc_feature (398)..(398): n is a, c, g, or t
  misc_feature (418)..(418): n is a, c, g, or t
aagaagacgcggcatcatggcggcggctcgcgcggcagcggcgtcccccacccaccgngcgtccatccaggngacgtngaccccgccgtaccccagcgcggcccggatcgcggactcctcctgnttcccccagtacaccgcctccctcaagtgtctggagaccaaccaggacaagagcaagtgccagcagcagttngacgantacaaggagtgcaagaagagagagagggaggctcggctggaacggaaccggagccggacattgttcgggtgagcaatcggaggagcactgtgcagtgaactggaagagttgatgctagtgaaaccatgactcatttgatttcctgatgttaatttaagctgttgaagttagaaaacagtagagcnctntgggttcngagagatgtaaggacaagangtcactagagagtttcttcaataaaatggtactcccggaaacgcctgaaaccgtgtcaagacgacttggttgtatttcaatgatgtatgttgttttgatggcctattgaattctg

SEQ ID NO: 4210 - DNA, 652 bp, Zea mays
aaagccctgtccatcacttcgccccatccagaaagacgacggccaatcgaaagcccgaaaaggaggaagaaccgaagtagcgaagaagaggacgcggcaccatggcgacggcacaggcagcgtcggcgtccccaacccaccaccgcgcgtctccagggatgtcgccgccgcagccgccgtaccccagcgccgccaggatcgccgactccgcctgcttcccccagtacaccgcctcgctcaagtgtttggaggccaaccaggacaagaccaagtgccagcagcagttcgacgattacaaggaatgcaagaagaaagagagggaggctcggctggaacggaataaaaccagatcactctttgggtgaacaatggcgtcccacctgagcaatatgctggcggtgcaataagtctcctgctgatgtgagcgaaatcacggcttttttctttggtttcatgatgatcctctgcaacttgtgcaaggtagggaatagaaataccgatctcgagattgagggagatgtaagggcgtctgggaacagctcattaacacaatggctacggtgaatgaatcgaatgagcgaggatgtattttgagaacaaccaggcgtcatgaaacgacagtttgttcaataaatttgtattccacccctgt

SEQ ID NO: 4211 - DNA, 951 bp, Brachypodium distachyon
atgccaaaattaattctcgaggtctttgtgaaagatattctggccctggattttgttaacataggtggtggaacccacttttattatccaaatgacacttggctatcacatgaacctgtcctgtctgaacttgccattcagcagacgtgcagcggtattgtttgggcctttcttctagaacaagcccgtctaataagcccaggattgcaaacgagaaggcaaaagcccattagcttccctgtaaagccgtggacaagagaaaggaacaagaccccattgcaagagtactccctttgcaaaagcccaagaagggagcgaagaggaagaagaagaagacggcaccatggcggcggctcatgcggcagcggcggcgtcccctacccaccgcgcgtcctcccaggcgacgtcgaccccgccctaccccagcgcggccaggatcgctgactcctcctgcttcccgcagtacaccgcctccctcaagtgtttggagagcaaccagaacaagagcaagtgccagcagcagtttgacgactacaaggaatgcaaaaagaaagagagggaggctcggcttgaacgaaaccgaagccgaacattgttcggatgagaaattcgagcgccaatttgcagtggaactgttagagctgacagcgagtgaaatcatggcttgttttcttttgcgagggaaatcatgacttgtttgatttccagctgatgtctctttaacttatgaaaggtacttgatataatagtggatcacttctccaataaaatgctacttccagaaacgcttgtatatcgaacgcccaaaacaatgccgtctcatccagattgttttatccatatcctttgtatttcaatgcttattgttatttcgatggcatactgaatcccaagagacatgcaacatgctatgtgcaagatagatgtggagaaatcttctgattgtgaaaa

SEQ ID NO: 4212 - DNA, 470 bp, Brachypodium distachyon
gggagcgaagaggaagaagaagaagacggcaccatggcggcggctcatgcggcagcggcggcgtcccctacccaccgcgcgtcctcccaggcgacgtcgaccccgccctaccccagcgcggccaggatcgctgactcctcctgcttcccgcagtacaccgcctccctcaagtgtttggagagcaaccagaacaagagcaagtgccagcagcagtttgacgactacaaggaatgcaaaaagaaagagagggaggctcggcttgaacgaaaccgaagccgaacattgttcggatgagaaattcgagcgccaatttgcagtggaactgttagagctgacagcgagtgaaatcatggcttgttttcttttgcgagggaaatcatgacttgtttgatttccagctgatgtctctttaacttatgaaaggtacttgatataatagtggatcacttctccaataaaatgctacttcc

SEQ ID NO: 4213 - DNA, 589 bp, Triticum aestivum
agagagcggagtggaggacgagaggaggaagaagaagacgcggcatcatggcggcggctcatgcggaggcggcggcgtcccccacccaccgcgcgtccatccaggcgacgtcgaccccgccgtaccccagcgcggcccggatcgccgactcctcctgcttcccccagtacaccgcctccctcaagtgtctggagaccaaccaagacaagagcaagtgccagcagcagttcgatgactacaaggagtgcaagaagagagagagggaggctcggctggaacggaaccggagccagacattgttcgggtgagaaattggaggagcactgtgcagtgaactggaagagttaatgctagtgaaaccatgactcggttgatttcctgatgttaatttaagctgttgaagttagaaaacagtagagcactctgggttcagagagatgtaaggacaagatgtcactagagagtttcttcaataaaatggtacccccagaaacgcttgaaaccacgtcaagccgatgtgggatgtttctgtatttcagtactgtatgttgttttgatgtcctattgaattctgaaagactgtaagagg

SEQ ID NO: 4214 - DNA, 589 bp, Triticum aestivum
gaggaggaagaaaaagacgcggcatcatggcggcggctcatgcggaagcggcgtcccccacccaccgcgcgtccatccaggcgacgtcgaccccgccgtaccccagcgcggcgcggatcgccgactcctcctgcttcccccagtacaccgcctccctcaagtgtctggagatcaaccaccaggacaagagcaagtgccagcagcagttcgacgactacaaggagtgcaagaagagagagagggaggctcggctggaaaggaaccggagccggacattgttcgggtgagcaattggaggagcactgtgcagtgaactggaagagttaatgctagtgaaaccatgactcgtttgatttcctgatgttaatttaagctgttaaagttagagaacagtagagcactctgggttcagagagatgcaaggacaatatgtcactagagagtttcttcaataaaatggtactcctggaaacgcctgaaaccgcgccaggccttttgtatttcaatgatgtatgttgttttgatgacctattgaattctgaaagactgtaagaggtttataaacaaatagttgggcagaaaaaaaaaa

SEQ ID NO: 4215 - DNA, 620 bp, Triticum aestivum
aggcgagaggaggaagaagaagacgcggcatcatggcggcggctcatgcggaagcggcgtcccccacccaccgcgcgtccatccaggcgacgtcgaccccgccgtaccccagcgcggcccggatcgccgactcctcctgcttcccccagtacaccgcctccctcaagtgtctggagaccaaccaccaggacaagagcaagtgccagcagcagttcgacgactacaaggagtgcaagaagagagagagggaggctcggctggaacggaaccggagccggacattgttcgggtgagaaattggaggagcactgtgcagtgaactggaagagttaatgctagtgaaaccatgactcggttgatttcctgatgttaatttaagctgttgaagttagaaaacagtagagcactctgggttcagagagatgtaaggacaagatgtcactagagagtttcttcaataaaatggtacccccagaaacgcttgaaaccgcgtcaagccgatgtgggatgtttttgtatttcagtaatgtatgttgttttgatgtcctattgaattctgaaagactgtaagaggtttataaacaaatagttgggcagaagtcttgtgattgcgaagtttc

SEQ ID NO: 4216 - DNA, 706 bp, Secale cereale
gactagagagcggagtggaggaggaagaagcagacgcggcatcatggcggcggctcatgcggcggcggcgtcccccacccaccgcgcgtccgtccaggcgacgtcgaccccgccgtaccccagcgcggcccggatcgctgactcctcctgcttcccccagtacaccgcctccctcaagtgtctggagaccaaccaggacaagagcaagtgccaggagcagttcgacaactacaaggagtgcaagaagagagagagggaggctcggctggaacggaaccgtagccggacattgttcgggtgagcaaacggaggagcactgtgcagtgaactggaagagttaatgctagtgaaaccatgactcgtttgatttcctgatgttaatttaagctgttgaagttagaaaacagtagagcactctgggttcagagagatgtaaggacaagatgtcactagagagtttcttgaataaaatggtactcccggaaacgcctgaaaccgcgtcaagcccacgtgggatgcttttgtatttcaatggtgtatgttgttttgatgtcctattgaattctgaaagactgtaagaggtttatataaacaaatagttaggacaaaaagaaaaaaaaaaaaaaaaagaaaaaaaaaaaaagaaaaaaaaaaacaaaaaaaataaagaaagaactagacgaagacgaacacgaaggagtagaga

SEQ ID NO: 4217 - DNA, 529 bp, Secale cereale
tggaggaagaagcagacgcggcatcatggcggcggctcatgcggcggcggcgtcccccacccaccgcgcgtccgtccaggcgacgtcgaccccgccgtaccccagcgcggcccggatcgctgactcctcctgcttcccccagtacaccgcctccctcaagtgtctggagaccaaccaggacaagagcaagtgccaggagcagttcgacaactacaaggagtgcaagaagagagagagggaggctcggctggaacggaaccgtagccggacattgttcgggtgagcaaacggaggagcactgtgcagtgaactggaagagttaatgctagtgaaaccatgactcgtttgatttcctgatgttaatttaagctgttgaagttagaaaacagtagagcactctgggttcagagagatgtaaggacaagatgtacactagagagtttcttgaataaaatggtactaccggaaacgcctagaaccgcgtacaagccacgtggatgtctttgtatttcaatggtgtatgttgttt

SEQ ID NO: 4218 - DNA, 583 bp, Lolium multiflorum
agagagcgagaggacggcaaacatggcggcggctcatgcggcagcggcagcggcgtcccccacccaccgcgcctcccttcaggcgacgtcgaccccgccgtaccccagcgcggcccggatcgccgactcctcctgcttcccccagtacaccgcctccctcaagtgtttggagaccagccaagacaagagcaagtgccagcagcagtttgacgattacaaggagtgcaagaagaaagagagggaggctcggcttgaacgaaaccggagccggacattatttgggtgaacattggaggagcactgtgcagtgaaccgaagagttaatgttggcgaaaccatgaagtgtttgatctcctgatgttacttttaagttattgaagttagaaaatagtcgagcactctgggttcagagaaatgtaagaacaagatggcactagaaaatctctaaaataaattgctactcccagaaacaactgtacatcgaaagcctgaaaccgcgttgtcttgacgtggagtcatgatgtttgtatttcgatgatgtttgttgattctctggtatatatatttaattctaaaaaaaaaa

SEQ ID NO: 4219 - DNA, 461 bp, Avena sativa
acgagaacgagaggaagaagacggcatcatggcggcggctcatgcggcagcggcgtcccccacccaccgcgcctccgttcaggcgacgtcgaccccgccgtaccccagcgcggccaggatcgccgactcctcctgcttcccccagtacaccgcctccctcaagtgtttggagaccagccaagacaagagcaagtgccagcagcagtttgacaactacaaggagtgcaagaagaaagagagggaggctcggctggagcgaaaccggagccggacactattcgggtgagcatcgggcaccattgtgcagtgaaccgaagagttaatcctagtgaaaccatgatctgtttaatttgctgatgttccttttaagttgttggagatagacaagagtacagcactctggattcagagatatgtaaggacagtatgagaatttctgcaataaaatggtactacttcca

SEQ ID NO: 4220 - DNA, 538 bp, Secale cereale
cggcatcatggcggcggctcatgcggcggcggcgtcccccacccaccgcgcgtccgtccaggcgacgtcgaccccgccgtacccccgcgcggcccggatcgctgactcctcctgcttcccccagtacaccgcctccctcaagtgtctggagaccaaccaggacaagagcaagtgccaggagcagttcgacaactacaaggagtgcaagaagagagagagggaggctcggctggaacggaaccgtagccggacattgttcgggtgagcaaacggaggagcactgtgcagtgaactggaagagttaatgctagtgaaaccatgactcgtttgatttcctgatgttaatttaagctgttgaagttagaaaacagtagagcactctgggttcagagagatgtaaggacaagatgtcactagagagtttcttgaataaaatggtactcccggaaacgcctgaaaccgcgtcaagcccacgtgggatgcttttgtatttcaatggtgtatgttgttttgatgtcctattgaattctgaaagact

SEQ ID NO: 4221 - DNA, 3906 bp, Sorghum bicolor
actttagagttacgtattcgttgtatttgataagacttatcttcatagagacaatgttttgaaatggaatgtagaagcttttgctggtggtaaaaaaaaaatcaaacagttgactgatctcaacgtgccacacctgaaatggtcagaactcaaaacgaaacagccagatcattctaaccccacagccacagtaacaccagacacaatatgcgatggcaaacacaaacacaaccaactggttctagttgccagctcgaatcaacattcagtcagtaaaataggcagtaaaccagatcaataagctactgctagtgctaaatttgtttgacagctacaagcgatcaaaagcaactgtttgcagaacaacagacttaagattcgtagaaaatacaacttttagactagtatatctcatcatctgggacatctggtgtaagaaacttctgtgggtccttgtacagctcttcatagttatacttaggcttcaccctctctgggacaggctcaagtgggatgatactgtctccatcgatcacaccatcaataagtccataatcaacagcctcaagagggcccatgtaacgatctctgtcaatatctttctctacctgctccagagtgcggcccgtgaagcctgacacgatccgaatgacattcctcttgttcgtcaatatctccttcgcttggacctctacatctagggcctgcccacttgcacctccgacaggctgatggatcataatcctggtgttgggcatggcaaatcgcttgcccttcgtgccaccaccaaggattatagaagctgttgatccagctatgcccattccaatagtggagacatccgccctcacaagctgcattacatcatagatggccattgttgccctgagggacccccctggtgagttgacgaagaggcggatgtcagagtccggatcgatggcgtcgaggaggaggagctggctgacgacggcgtccgcgaggaagtcctcgatctcgttgccgaggaagactatgcgctcccggagaaggaggcccatgacgtcgccggcgccggcaccaccgcccgcggcatccgactccgcccgccacagaggcgcgtgtggtgccagtgaggcgcaaggcttgaggctgaggagtgccccttgctgcggccgctgcgagggggcccaagcgcgagcgcgagcgcatggccgcctgacgcgcagagcagcagccgctgccgccgccacggagagagacgccgtggcactggcactcccggccgccataactaccgaactggactgcagcagcggcagcgggagcggcggcggcgagcagagcagaggagaagaaatggataacacacagcacactctcctcttggcacagcagcactgcaggagaagacgaccttgcgttgcgtgggcctagtcctatgtggtctgggccgtcattctctttttcttgcgacttgggccgtcattctctttgggcctaactataatcttggtccacataaccgcgagcagatatgttagcggcgttcgttgccgttggtccaacaagccaaggaaagcgggccgagcgccatcacggcgtcggagaagaggacgacgaggactttcagctgcggcgactggccggcgctgcgacggggatgggggacgggcgcgcgggcggcgccaaccgtccggcgtggctgcagcagtatgagctgattggcaagatcggcgaggggacctatggactcgtcttccttgcgcgcctcaagccgtcccacccggcgcccggccgccggggcccccctatcgccatcaagaagttcaagcagtccaaggagggggacggagtatcacccaccgcaattagagagatcatgctcctgcgcgaaatcaaccacgagaatgtcgtcaagctcgtcaatgtgcacatcaaccacgctgacatgtccctatacctcgcattcgattacgcagagcacgacctttatgagattatcaggcatcacagggagaagctgagctcctctattaacccatacactgtcaaatccttgctgtggcaactgctcaatggcctcaactatcttcacagtaactggattatacatcgagatctaaagccttccaacatactggtcatgggagaaggagacgaacatggaattataaagatagctgattttggacttgctaggatatatcaagctccactgaaaccattatgtgacaatggggttgttgtaactatctggtatcgtgctcctgagctgttacttgggggaaaacactacacgagtgctgttgatatgtgggcagttggttgcatttttgctgaactgctcacactgaaacccctgttccaaggtgtggaagcgaaaaatactccgaacccattccagcttgatcaacttgacaagatttttaaggtcttaggccaccctacagttgaaaagtggcctacccttgccaatcttccatggtggcaaaacgaccagcaacatattcaaggccataagtatgacaaccccggtctccataacattgttcatttgccaccgaagagtcctgcatttgatcttctctcaaaaatgcttgagtatgatccccgaaagcggataacagctgcacaagctttggagcatgaatactttcggatggaaccactacctggacgaaacgcgcttttaccatcccaaccaggggagaaaattgtaccgtatcctgttcgtccagtagatacaacaacagattttgaaggaacaacaagccttcaaccaactcaaccgccatcagggaatgctcctcctggaggtcaatctgtagcaagacccatgccaagacaaatgccgcagcaacctatggttgggggaatgccaagagtggcagctggagcaaacatggctgccttcaatgctgcatcacaggctggcatggctgggctcaatcctggaaacatccctatgcagagaggcgcaggtggtcagtctcatccgcaccagttgagaaggaaggcggatcaagggatggggatgcagaaccctgggtatcctcagcagaagagacggttctgaccctgacaagagggagccatctggcatctgactgatgtgtagtactgtctgttgtgacgtatatcaggtgtttgaaacacgttgcctgtgtaaaagctggctgctgccgcagtgttgtaattttgttatcagcttccgaatgcgaatgctggtacatgtaaaacacattaatcagtttagacttcagactcgagatacctggccttgtttagtttcaaaaaaaatttgcaaaatttttcagatttttcgtcacatcgaatctttagacgtatgcatgaagtattaaatatagacgaaaataaaaactaattacacagtttggtcggaattgacgagacgaaccttttaagtctagttagtccatgattggacaatatttgtcaaatacaaacgaaattggtactattcacattttgcaaaatattttcggaactaaacaaggccctaagctgcttgaatttggctgctttggtttgcaacggaaaggtgttacttatggccttgtttagtttcaaaatattttgcaaaatcgatactgtagctctttcgtttgtatttgacaaatattgtccaatcatggactaactaggctcaaaagattcgtttcgtcaattccgaccaaactgtgcaattagtttttatttttgtctatatttaatacttcatgcatgtgtctaaagattcgatgtgacggagaatttgaaaaattttgcaaaatttcttgggaactgaacaaggccatgtaagtggcccagtgaatcaagcaagttatgcacatgcgttggaaatttagcatctatttgatttgagacaaattttggccattgtccaaaaatttatgaccggac

SEQ ID NO: 4222 - DNA, 1352 bp, Sorghum bicolor
caagaggagagtgtgctgtgtgttatccatttcttctcctctgctctgctcgccgccgccgctcccgctgccgctgctgcagtccagttcggtagttatggcggccgggagtgccagtgccacggcgtctctctccgtggcggcggcagcggctgctgctctgcgcgtcaggcggccatgcgctcgcgctcgcgcttgggccccctcgcagcggccgcagcaaggggcactcctcagcctcaagccttgcgcctcactggcaccacacgcgcctctgtggcgggcggagtcggatgccgcgggcggtggtgccggcgccggcgacgtcatgggcctccttctccgggagcgcatagtcttcctcggcaacgagatcgaggacttcctcgcggacgccgtcgtcagccagctcctcctcctcgacgccatcgatccggactctgacatccgcctcttcgtcaactcaccaggggggtcctctttcagtgcaacaatggccatctatgatgtaatgcagcttgtgagggcggatgtctccactattggaatgggcatagctggatcaacagcttctataatccttggtggtggcacgaagggcaagcgatttgccatgcccaacaccaggattatgatccatcagcctgtcggaggtgcaagtgggcaggccctagatgtagaggtccaagcgaaggagatattgacgaacaagaggaatgtcattcggatcgtgtcaggcttcacgggccgcactctggagcaggtagagaaagatattgacagagatcgttacatgggccctcttgaggctgttgattatggacttattgatggtgtgatcgatggagacagtatcatcccacttgagcctgtcccagagagggtgaagcctaagtataactatgaagagctgtacaaggacccacagaagtttcttacaccagatgtcccagatgatgagatatactagtctaaaagttgtattttctacgaatcttaagtctgttgttctgcaaacagttgcttttgatcgcttgtagctgtcaaacaaatttagcactagcagtagcttattgatctggtttactgcctattttactgactgaatgttgattcgagctggcaactagaaccagttggttgtgtttgtgtttgccatcgcatattgtgtctggtgttactgtggtggctgtttcgttttgagttctgaccatttcaggtgtggcacgttgagatcagtcaactgtttgattttttttttaccaccagcaaaagcttctacattccatttcaaaacattgtctctatgaagataagtcttatcaaatacaacgaatacgtaactctaaagt

SEQ ID NO: 4223 - DNA, 1379 bp, Zea mays
ccaggtgtcaactgcaagggaaaacaaagagtgtgtgctgtgtgttatccatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatgccgcggggggtggtgccggcgccggcgatgtcatgggcctcctcctccgggagcgcatagtcttcctcggcaacgagatcgaggacttcctcgcggacgccgtcgtcagccagctcctcctccttgacgccatcgacccggactctgacatccgcctcttcgtcaactcaccagggggatcccttagcgcaacaatggccatctatgatgtaatgcagcttgtgagggcagacgtgtccactattggaatgggcatagctggatcaacagcttctataatccttggtggtggcacgaagggcaagcgatttgccatgcccaacaccaggattatgatccatcagcctgtcggaggtgcaagcgggcaggccctagatgtagaggtccaagcgaaggagatattgaccaacaagaggaatgtcattcggatcgtatcaggcttcacaggccgcactcctgagcaggtagagaaagacattgacagagatcgttacatgggccctctcgaggctgtcgattatggactcattgatggcgtgatcgatggagacagtattatcccacttgagcctgtcccggagagggtgaagcctaagtacaactacgaagagctgtacaaggatccacagaagtttcttacaccagatgtcccagatgatgagatatactagtcgaaaagttgtattttgtgcgaatgttaagtctgttcttcagcaagcagatgtttttcgtcgcttgtagctgtcaaaccaaccatagcactagtagcttattgatcttgtttactgactggatggtgattcgagcaggcaactagaacctgttggttgtgtttctggtgttacattgtggtgttagaatggtccggctgtttcgttttgagtcctgaccatttcaggtgtggtacgttgagatcagttaactgttcgtttttttttttttgaccaccagcaaaagcttctacatcccatttcaaaacattttctttatcatgataagtcttataaaatacaaagaatacataactgtaaagtc

SEQ ID NO: 4224 - DNA, 1085 bp, Saccharum officinarum
cggccgggagtgccagtgccacggcgtccctctccgtggcggcggcagctgctgctgctctgcgcgtcaggaggccatgcgctcgttctcaagcttgggccccctcgcagcggcagcaaaagggggcactcctcagcctcaagccttgcgcctcactggcaccacacgctcctatgtggcgggcggagtcggatgccgcaggcggtggtgccggcgccggcgacgtcatgggcctcctcctccgggagcgcatagtcttcctcggcaacgagatcgaggacttcctcgcggacgccgtggtcagccagctcctcctcctcgacgccatcgatccggactctgatatccgcctcttcgtcaactcaccaggggggtccctcagtgcaacaatggctatctatgatgtaatgcagcttgtgagggcggatgtctccactattggaatgggcatagctgggtcaacagcttctataatccttggtggtggcacgaagggcaagcgatttgccatgcccaacaccaggattatgatccatcagcctgtcggaggtgcaagtgggcaggccctagatgtagaggtccaagcaaaggagatattaaccaacaagaggaatgtcattcggatcgtatcaggcttcacaggccgcactccggagcaggtagagaaagacattgacagagatcgttacatgggcccccttgaggccgtcgattatggacttattgatggcgtgatcgatggagacagtatcatcccacttgagcctgtcccggagagggtgaagcctaagtataactatgaagagttgtacaaggatccgcagaagtttctaacaccagatgtcccagatgatgagatatactagtctaaaagttgtattttatgcgaatcttgagtcagttcttctgcaagcagttgcttttgatcgcctgtagctgtcaaacaaattctagcaccagctgtagcttattgatctggtttactgcctgttttactgactgaatgttgattcgagcagccccgagaacctgttggttgtgttggccgtggcgccggtgggtacttgaggattgggggggcatgt

SEQ ID NO: 4225 - DNA, 1412 bp, Setaria italica
tggaggggggtgaagactgaagagtgtgctgtgttatccatttctccccttgtctctctgctgtgctcgctcccttcactctctggcggggaacgccgccgccggccgctcctccagggcatcccagctcgatcccattcgttaggtatggcggccgggagtgccagcgccacagcgtcgctctccgtcgcggcggcggcggcggctgctctgcgcgtcaggcggccgtgcgcgcgcgctcgcgcttgggccccctcgcagccgacgcaacaagggtccctcctcaggctcaagccttgcgcctcactggcgccgcatgctcccgtgtggcgggcggagtcggatggcgcgggcggtggggcaggcgccggcgacgtcatgggtctcctcctccgggagcgcatcgtcttcctcggcaacgagatcgaggacttcctcgcggacgccgtcgtcagccagctcctcctcctcgacgccatcgacccggactccgacatccgtcttttcgtcaactcgtcaggggggtcccttagtgcaacaatggccatctatgatgtaatgcagcttgtgagggcagatgtctccactattggattgggcatagctggatcaacagcttctataatccttggtggtggaacaaagggcaagcgatttgccatgcccaacaccaggattatgatccatcagcctgtgggaggtgcaagtgggcaggccttagatgtagaggtccaagccaaggagatactggctaacaagaggaacgtcattcggctcgtatcaggcttcacgggccgcactctggagcaggttgagaaagacattgaccgagaccgttacatgggtcctcttgaggctgttgattatggactcatcgatggtgtgattgatggagacagtatcatcccacttgagccggtcccagagagggtgaagcctaagtacaactacgaagagatgtacaaggttccgcagaagtttcttacaccagatgtcccggatgatgaaatatactagtttaaaagttgtgttttgcgccaatctgaagcttgttcttcagcaaccagtttcttttgattacctgtagctgtcaaacaaatcctaccactagctgtagcttattgatctggttcgctgcctatgttactgtctgaatgttgattttgagcaggcagctaggcctgttggttgtgttatggcattgcatgtttctggtgatattgagggtaggaatggtctagctgattccgagtcctgaccattcctggtatggcacgttggacgagaccaggcaatcctttgaatttttgaccaagcaataaacgaaccaaacggaagcttcttcatttcgtttcaagcatttccctcgagaagataagtctaaccaaacacaacaattacgtagccgcaaa

SEQ ID NO: 4226 - DNA, 1226 bp, Panicum virgatum
tgctcttatccatttcttcccttctctgctgtgctccccttccctccggcggggaacgccgccgccggccgctcctccagagcacctcagctcgatcccgttggttagatatggcggccgggagtgccagtgccacggcgtcgctctccgtcgcggcggcggcggcggccctgcgcgtgaggcggccgtgcgctggcgctcgcgcttgggtcccctcgcagccggcgcaacaagggtccctcctcaggctccggccctgcgccgcactggcgccacatgcccctctgtggcgggcggagtcggatggcgcgcgcggcggggccggcgccggcgacgtcatgggcctcctcctccgggagcgcatcgtcttcctcggcaacgagatcgaggacttcctcgcagacgccgtcgtcagccagctcctcctcctcgacgcccttgacccggactccgacatccgcctcttcgtcaactcgcctgggggctcgctcagcgcaacaatggccatctatgatgtaatgcagcttgtgagggcagatgtatccactattggattgggcatagctggatcaacagcttctataatccttggtggtggcacaaagggcaagcgatttgccatgcccaacacgaggattatgatccatcagcctgtgggaggtgcaagtgggcaagccttggatgtagaggtccaagccaaggagatattggctaacaagaggaatgtcattcggcttgtatcaggcttcacgggccgcactcccgagcaggttgagaaagacatcgaccgagaccgttacatgggtcctcttgaggctgttgattatggaatcatcgatggtgtgatcgatggagacagtatcatcccacttgagcctgtcccagagagggtgaagcctaagtacaactatgaagagttgtataaggatccgcagaagtttcttacgccagatgtcccagatgatgagatatactagtaacttaaaagttgtgtttttgcgtgaatctgagcttgttcttcagcaaccagttgcttttgattacctgtagctgttaaacaaatccaagcactagcagtagcttattgatttggtttgcgcctattactgactgaatgttgattttgagcactcagctagtcctattggttgtgttttggcattgcatgtttctggtgttattgaaggttgaaaattggaatggtccgtctgattctgagttcggac

SEQ ID NO: 4227 - DNA, 1372 bp, Pennisetum glaucum
gcgggctgcaccagactgaagcgtgctgtgttatccatttctcccccttcctctctctgctgtgcccgctcgctgcccagctcgctcccccttccctctggcgggggacgccgccgccggccgctcctccagggcagcccagctcgttcccactcgttaggtatggcggtagggagtgccagcgccacggcgtcgctctccgtcgcggcggcggctctgcgcgtcgggcggccgtgcgcgcgagctcgcgcttgggccccctcgcagccgacgcaacaagggtccctcctcaggctcaagccttgcgccgcactggcaccgcatgctcccgtgtggcgggcggagtctgatggcgcgggcggtggggccggctccggcgacgtcatgggcctcctcctccgggagcgcatcgtcttcctcggcaacgagatcgaggacttcctcgcggacgccgtcgtcagccagctcctcctcctcgacgccatcgatccggactccgatatccgtctcttcgtcaactcatcaggggggtccctcagtgcaacaatggccatctatgatgtaatgcagcttgtgagggcagatgtctcaactattggattgggcatagctggatcaacagcttctataatccttggtggtggaacaaagggcaagcgatttgccatgcccaacaccaggattatgatccatcaacctgtgggaggtgcaagtgggcaggccttagatgtagaggtccaagccaaggagatattgtctaacaagaggaacgtcattcggctcgtatcaggcttcacgggccgcactctggagcaggttgagaaagacatcgacagagaccgttacatgggccctcttgaggctgttgattatggaatcatcgatggtgtgatcgacggagacagtatcatcccacttgagcctgtcccagagagggtgaagcctaagtacaattacgaagagatgtacaaggttccacagaactatcttacgccagatgtcccagatgatgaaatatactagtgtaaaagttcaattttgtgagaatctaaagcttgttctccagcaaccagctgcttttgattatctgtagctgtcaaacaaatcctagaactagcagtagcttattgatctgatttgctgcctatgttactgactgactgttgattttgagcaggcagctaggcctgttggttgtgttatttcattgcatttttctggtgatattgagggttggagacttggagtggtctgtctgattccgagttctgaccgttcctggcatggtttgttggactagaccagacaacccttgaattttttaccaagcaataaacgaaccaaacagaagcactcttcatttcatttaacg

SEQ ID NO: 4228 - DNA, 1310 bp, Oryza sativa
aaagagaaagggcaagagacaagggcaacccaaccaagaagtaggttagccgagggcaggatagagataattgcgagcgatgtcggctgcgagtgcgagtgccactgcctccctctccgcggcggcggcggtggcggtggcggcggccgctctccgccccacgcagcagcgacgcctgcgcgttgtcgcgccaccgcgccccctcaggctcaccagtctcaacccccctcgcgcggcttccgccccctctactcctctgtgggaggccggcgtccgagctgagtcgtccgactcgcccggagccggagccgggggtgacgtcatgggcctcctcctccgggagcgcatcgtcttcctcggcaacgagatagaggacttcctcgccgacgcagtcgtcagccagctcctcctcctcgacgccgtcgaccccaactctgacatccgcctcttcgtcaactcccctgggggatcactcagcgcaacaatggccatctatgatgtaatgcagctcgtgagggcagatgtttccactattggattgggcatagctggttccactgcttctataatccttggtggtggcacaaagggcaagcgattcgccatgcccaacaccaggataatgatccatcagcccgttggaggcgcaagtgggcaggccttggatgtcgaggtccaggccaaggagatattgactaacaagaggaatgtcatccggcttatatcaggtttcacaggacgcactccggagcaggttgagaaagacattgatagagacagatatatgggtcctcttgaggctgttgattacgggctcatcgacagtgtaatcgacggagacagtatcatcccacttgagcctgtcccggagagggtgaagccgaaatacaactacgaggaactgtacaaggatccacagaagttccttacacctgatgtcccagatgatgagatatactaggtaatgagcctgcctgcctgtcgtttgcatttcgcacggcaagggggctgcttgcaatcaaagacgatgctcctagtcctagcactagttgatttttcctgtcacatgttaaccaactagtgccatattacgattgttgagcacgcagttagacttattggttgtgtttgtcgttgaaattgcatgcgtttggtgtgcgaatgtggatggattgatgaggtggtttgtgtactgggcaatttgaccaaagtgcgtggcagctcatgtaggctgtagctacgccccggtgcttaattgaccaaataaactctagtactctatacacacacgcacgcacaaagttccttca

SEQ ID NO: 4229 - DNA, 1169 bp, Avena sativa
ttacactcagcgagggagacaagggagcactccgccgccgccgccggctgctccacaactgacggagctagatagagatggcggccaccagtgcgagcgcagctgcctccctctccgtcgcggccagcctcgggcaccggcagctatgctctagcgcacgcgtgaccgcgcaaccccatcccctcctcaagctgaaccgccgcagccacgcggtatcggcgtcggcggcttccttgtctcctctgtctctgtgggaaggccaaggtatccgagcggagtcggatgcacatggaggtgcagcgagcggtgatgtcatgggccttctcctccgggagcgcatcatcttcctcggcaacgagatcgaggacttcctcgccgacgccgtcgtcagccagctcctcctcctcgacgccatggactccgaatctgacatccgcctcttcgtcaactcccctggtggatcgctcagtgcgacaatggccatctatgatgtaatgcagcttgtgagggcagacgtatccactattgggatgggcatggctggatccacagcttctatactccttggtggtggcacaaagggcaaacgattcgccatgcctaacaccaggattatgatgcatcagcccgtgggaggcgcgagtggccaggccttggatgtggaggtccaagccaaggaaatattgaccagcaagaggaatgtaatccggataatatcaggctttacagggcgcacactagagcaggtggagaaagacatcgatagagaccgatacatgggtcctcttgaggctgttgattacgggatcattgatggcgtgatcgatgcagacagcatcatcccacttgagcctgtcccggagagggtgaagcctaaatacaactacgaggaattgtacaaggaccctcagaagttccttacaccagatgtcccagatgatgagatatactagctagtttgtcattgcttgtattttgcttatcaagcagttactggagctttttgtcaaaacaaagatgatgtaatccttagcaatagactttaatatttatcgttgcagttggtgtgacggtgtttgatgtagctgttgtgctctggcattgaccaagcaaatgaaaccgcttgtgttctgacatttgacagcaaaagaagccgctggtgttctggc

SEQ ID NO: 4230 - DNA, 4045 bp, Brachypodium distachyon
taccgccgtggtgagtccgtgagtgcctaaaataagaggaacagaataaaagaccgcgccgccgtgagaccgtgtaagagagagatggggagacgtcgagccggcggcggggggcgtggaggaggccgaggtcgaggcggaggaggagaaggccgaggccgaggcagaggagaggaagaggacctgcccctgcacaaggctgcgaggtcgggtgatgcggcggcggcggagtcgctgtgcgaatccgaccctcttgccctcaactcccgagaccgcctctcccgcaccccgctccatttggcggcatgggctgggcatatcgaggttgtgaaatgcctttgcaagcacaaagctgatgttggggctgcagcaatggatgacactgctgcaattcattttgcctcccagaaaggtcacatggaagttgtgcgtgagctgctggcttcgggggcctctgtcaaagcaaagaacaggaaaggtttcacggcattgcactttgctgctcagaattcacacctggagcttgtgaagtatttggtaaagaagggcctggacatcacagcaaagacaaacggggggcagacggctctacatgttgcagaaaacgacgatgtgcgtgctttcctgaaagaatgtgagcaggcattaaagaagggagaggagctgccatcggagaagaaggatgattctgtatccgagaagagtggtgacggcaaggtctcagatgaagccgtaaaagatggtgctgaggcagcgcagggcgagaagaggaaaagtgatgacagtggtgtgccggagcagaagaaggccaaagtttcgctcaggcatcttgaaaatgacatggaagaagaagaagagggagaacagtagaatcgaatagccttgagagtgtaatctgatggtgccaccttgtgctatgtttaacaaccaaaatataactgtaagagttttagctgttcatgagcctggtatctgtatcatgggtgactagcagtactacatatctttttgatttaagtaaatgatgatgatttcactcctgcagtaaagaagtttattacatctgctttttgtgttctcctaatctcaataaataaataaatttggtttgagaggaaagacaagctaggcccaacccagctcaggaaagagcaggcccaatcgaccgatgaaaggaaaaagaagagagtagctattacgttatccactccgtccatccagtctaaacactgttgactcactctgccggaggggaaggagggagcaccccgccgccgccgccccacgaagaagacgagtagaatatggcggcgaccactgccactgcctccttctccgtcacgtctgccgctctccgcctcaggcaccggcagctatgcgctcgcgtaagtgggcccgcgcaaccgtatcccctcctcaagctgaaccgccgcagccacgcggtttctgcttcggcgccggctgctgcttcttccttgtctcctctgtgggagggcctaggtatccgagcggagtccgatgggccggggggaggagccagcggcgacgtcatggggcttcttctccgggagcgcatcatcttcctcggcaacgagatcgaggacttcctcgccgacgccgttgtgagccagctcctcctcctcgacgccatggactccgaatctgacatccgcctcttcgtaaactcccccggtggatcacttagtgcgacaatggccatctatgatgtaatgcagctcatcagggcagatgtatccactattggaatgggcatagctggatccacagcttctataatccttggtggtggcacaaagggcaaacgatttgccatgcccaacaccaggattatgatgcatcagcccgtgggaggtgcgagtgggcaggccttggatgtagaggtccaagccaaggagattctgactagcaagaggaatgtcattcgcctgatatcaggattcacggggcgcactctggaacaggtagagaaagacatcgatagagaccgatacatgggtcctcatgaggctgttgattatgggctcattgatggtgtgatcgacggagacaggatcatcccactcgagcctgtgccggagagggtgaagcctaaatacaactacgaggaattgtacaaggaccctcagaagttcctcacaccggatgtccccgatgatgagatatactagctagcacgtcgtccttcccttgtattttgaacagcaagcagttgctggagcttctgttgaaacaaagatgatgtaatccttagcagtagactttatttgccgttgtgtttgttgtgatgaggtagccgtcgtgttctggcatttgaccgagctaaatgaaagcacatggaacattgaactgatctaacgtacgtatagaagcaaaatgtcttaaatttattcgctggtcccaagccaaacgcatgatgacagactgggagaaaaccccaagtaatcctttacaaagacacaacacaatgaatacaccaaacaatgaattatgaactctgatgcaccagccggaatgaacattatcaatacagagcaccaacagtacttgggacaagaactggggatacggtgctttccactctgagggccagcggatcccaaaattggacggccccgtagctcccggttttcaggctcaccggagcttcaatctgcgcagcatggccatgtccctctgctgccaactttgctctcttcaatctgatacgttcggctcttgaaccaattgtctgacccaatattgaggcagctatggtaagggccatggcactcttcggcatcagaatagacttcctcagcattcctatgaaaggcaccgcagcatggaccgccgcaaaccactgcactgaaaacttcgtagtgtgttccctccagatgccaagaggaacgtttgctgccatgccgagcagtgcgatcaccactacttttgtcggcagtggctgagggcgaagccccttcgcaaacgccgtgcgggatattgctgcacgggcagcaacaatcgcaggtgggcatgtcagtttcataccagctgggggtgtcatcatctttgcgaggagtggcacgactccacccattgctctatatgactttgcaagagggcattgaccattctcaagccattcattgctcatagcttcatggttactgttagactggcctttattctgaaatgacaatcaaagcgaaatcaggtaaataaattgtatggtccaattgtaaagaatgatatttgattccttgcccattttactgcttgctctatgtatggcggttcataaatatcatgtggagcatttacttgctgctgcaaagatagatttacttaatttcttttggtactaaaaagtggtctcatctaaaggctcctatgataggataatggaacactgacaaaggatggtaatttgaagaaagggataaatgcttgagccaaagagaaaccaaaattacctgggggaggttgttgggattctttttgttggagtttttcttattgcgcttgtttgagaaatcaccgaagctaaaaaagcctccaaatgctgagagactgatggtagctgctttggctgccaaggggttgaattcaggaaccggctttggtagtggcttctcaatctgtggaaaggatccttctgaaagtggaacaaccccgtctctgccgtggaatactcgaaatgcggtgtcaaagttgggcccatcttcgaaaattggacccttggctcccgttgccttcacgagcagaaaatgatacatacagttgagcaatcacatgcataacatatacaattattgtcaagaaaaagaagggtggttcataaggacatacaggagcaggaaaattgacagatgataaggaaaaacttgtaggctcattgatgttcctcaggaatgggcatctttcaattccttgttggacaacattattctcttccaagcacactgaaccaccaaaagctctttggaaaaaggaatccatacgaataagagcagcaacctgtttgatgagagagcaatgagagtcaaga

SEQ ID NO: 4231 - DNA, 1175 bp, Brachypodium distachyon
atccactccgtccatccagtctaaacactgttgactcactctgccggaggggaaggagggagcaccccgccgccgccgccccacgaagaagacgagtagaatatggcggcgaccactgccactgcctccttctccgtcacgtctgccgctctccgcctcaggcaccggcagctatgcgctcgcgtaagtgggcccgcgcaaccgtatcccctcctcaagctgaaccgccgcagccacgcggtttctgcttcggcgccggctgctgcttcttccttgtctcctctgtgggagggcctaggtatccgagcggagtccgatgggccggggggaggagccagcggcgacgtcatggggcttcttctccgggagcgcatcatcttcctcggcaacgagatcgaggacttcctcgccgacgccgttgtgagccagctcctcctcctcgacgccatggactccgaatctgacatccgcctcttcgtaaactcccccggtggatcacttagtgcgacaatggccatctatgatgtaatgcagctcatcagggcagatgtatccactattggaatgggcatagctggatccacagcttctataatccttggtggtggcacaaagggcaaacgatttgccatgcccaacaccaggattatgatgcatcagcccgtgggaggtgcgagtgggcaggccttggatgtagaggtccaagccaaggagattctgactagcaagaggaatgtcattcgcctgatatcaggattcacggggcgcactctggaacaggtagagaaagacatcgatagagaccgatacatgggtcctcatgaggctgttgattatgggctcattgatggtgtgatcgacggagacaggatcatcccactcgagcctgtgccggagagggtgaagcctaaatacaactacgaggaattgtacaaggaccctcagaagttcctcacaccggatgtccccgatgatgagatatactagctagcacgtcgtccttcccttgtattttgaacagcaagcagttgctggagcttctgttgaaacaaagatgatgtaatccttagcagtagactttatttgccgttgtgtttgttgtgatgaggtagccgtcgtgttctggcatttgaccgagctaaatgaaagcacatggaacattgaactgatctaac

SEQ ID NO: 4232 - DNA, 1313 bp, Hordeum vulgare
atccactccttccatctactctctcacactcaaagagggaggagagaagggagcactccgccgccgccggctgctgctccacaacccacgaagctaggcagataggcatggcggctaccagcgcgagtgccgctgcctccctctccgtcacggctgccgctcaccgcctcaggcaccggcagctatgtgcttgcgcacgtgggccggcggcgcgaccgcatcccctcctcaagctgaaccgccgcagctacgcggcttcggcatcgtccgcggcggccatgtctcctctgtcccggtgggagggccaaggcatccgagcggagttggatgcgccgggaggagtggccagcggtgacgtcatgggccttcttctccgggagcgcatcatcttcctcggcaacgagatcgaggacttcctcgccgacgccgtcgtcagccagctcctcctcctcgacgccatggactccgaatctgacatccggctcttcgtcaactcccccggtggatcactcagtgcgacaatggctatctacgatgtaatgcagctggtgagggcagatgtatccactattggaatgggcatagctggatccacagcttctatactccttggtggtggcgcaaagggcaaacggttcgccatgcccaacaccaggattatgatgcatcagcccgtgggaggcgcgagtggccaggccttggatgtagaggtccaagccaaggaaattctggctagcaagaggaatgtcatccggctgatatcaggctttacgggacgcacactggagcaggtagagaaagacatcgatagggaccgatacatgggtcctcttgaggccgtggattacgggatcattgatggtgtgattgacgaagacagcatcatcccacttgagccggttccagagagggtgaaacctaaatacaactatgaggaaatgtacaaggaccctcagaagtttcttacgccggatgtcccagatgatgagatatactaagctagcctgtcagtcatatactaagctagcctgtcagtcatctgtatttcgaaccaggcagtcgctggagctttcatcgaacaaagatgatgtaatccttagcagtagactttatctgccgttgcatttggtgtgatggtgtagctgttgtgttctggcatttgaccaagcaaatgaaagcgcatggaacatacaactggtctaaccagctagcctcgcatgtattttgcacagcaagcaactgctggagcttttgtcaaaacaaagatgtaacacttttttttagtacgagtagtagactttgttggccgttgc

SEQ ID NO: 4233 - DNA, 2117 bp, Hordeum vulgare
atctactctctcacactcagagagggaggagagaagggagcactccgccgccgccggctgctgctccacaacccacgaagctaggcagataggcatggcggctaccagcgcgagtgccgctgcctccctctccgtcacggctgccgctcaccgcctcaggcaccggcagctatgtgcttgcgcacgtgggccggcggcgcgaccgcatcccctcctcaagctgaaccgccgcagctacgcggcttcggcatcgtccgcggcggccatgtctcctctgtcccggtgggagggccaaggcatccgagcggagttggatgcgccgggaggagtggccagcggtgacgtcatgggccttcttctccgggagcgcatcatcttcctcggcaacgagatcgaggacttcctcgccgacgccgtcgtcagccagctcctcctcctcgacgccatggactccgaatctgacatccggctcttcgtcaactcccccggtggatcactcagtgcgacaatggctatctacgatgtaatgcagctggtgagggcagatgtatccactattggaatgggcatagctggatccacagcttctatactccttggtggtggcgcaaagggcaaacggttcgccatgcccaacaccaggattatgatgcatcagcccgtgggaggcgcgagtggccaggccttggatgtagaggtccaagccaaggaaattctggctagcaagaggaatgtcatccggctgatatcaggctttacgggacgcacactggagcaggtagagaaagacatcgatagggaccgatacatgggtcctcttgaggccgtggattacgggatcattgatggtgtgattgacgaagacagcatcatcccacttgagccggttccagagagggtgaaacctaaatacaactatgaggaaatgtacaaggaccctcagaagtttcttacgccggatgtcccagatgatgagatatactaagctagcctgtcagtcatatactaagctagcctgtcagtcatctgtatttcgaaccaggcagtcgctggagctttcatcgaacaaagatgatgtaatccttagcagtagactttatctgccgttgcatttggtgtgatggtgtagctgttgtgttctggcatttgaccaagcaaatgaaagcgcatggaacatacaactggtctaaccagctagcctcgcatgtattttgcacagcaagcaactgctggagcttttgtcaaaacaaagatgtaacacttttttttagtacgagtagtagactttgttggccgagcggccgctcgcggacgtgccccagtacctaagcgggaggcagggtggtagaattcttggattgcagtgcaactacaggtacgagcagtatcccttcttcaccgggccttctctgctgcagctcccggcaccatccgtgggggaagctccatctccagcgccggacaacgtgacgccaccaccagtcagaggaggaggcacaaggaatggaacttttagaattttagccattgcactaccgataatcgttgcaatactggctgctgttgtaatttgcttttgtctatggaggaggaagagcaaaccggcggcactaaaggcatcattatcatatccaaaaaatccagaggacatacagagtatcgattcactcattcttgatctatcaactctacgagccgcaacagataattttgatgaaagcaataaacttggtgaaggagggtttggtgtggtttataagggaatccttcctaacaatgaagaaatagcagttaaaagactctcacaaagttctggccaagggatagaggagctaaaaaatgagcttgttttggttgctaagcttcaacacaagaatttagtgagacttcttggtgtttgcttggaggaacaagaaaagttacttgcatatgagtacatgcccaacaaaagcctcgacaccatcctttttgatcctgataggagcagtcagctagattgggggaagagatttaggatagtgaatgggattgctcgtggcttacaataccttcatgaagattctcagctgaagatattcaccgggaccctcaagcgagcaacgttcttttagactctg

SEQ ID NO: 4234 - DNA, 2072 bp, Zea mays
acgccacagaaaaaacgcaggtgtcgaaacacattttcttgctccagagaatttaaaccgctgcgaattcaattcgaaagccccaagagagcatccatggcttccgctaccacctccatctcgtcgcaccccgccgccctccgcgacgtcaaagctgcgaggattggcgggctgaggcagcagcaggcgagcgtggccccgtcggcggcggcagcgcgtggccagcgcgctcgggcggtgcgatcgctgcgcgcggcggagcctgcgaggcagccggtggcggcttccgcggccgcggcggcgccggccgcgcccgtggccgacgaggcggcggcccttgcggccgtggactacgaggccctggcgcgtgagctggagggcgcgtcgccgctggagatcatggatcgggcgctggccatgttcggctccgaaatcgccatcgccttcagcggcgcggaggacgtggcgctgatcgagtacgccaagctgacggggcgtccgttccgggtgttcagcctggacacggggcgtctgaacccggagacgtaccagctattcgacaaggtggagaagcactacggcatccgcatcgagtacatgttcccggacgcgagcgaggtgcaggagctggtgcgcaccaagggcctcttctccttctacgaggacggccaccaggagtgctgccgggtgcgcaaggtgcggcccctgcgcagggcgctcaaggggctcagggcgtggatcaccggccagaggaaggaccagtcccccggcaccagggccagcatcccccttgtccaggttgatccttccttcgaaggcctggatggcggggctggtagcttggtcaagtggaaccccgtggccaacgtcgacggcaaggacatctggactttcctgcggaccatggacgtacctgtcaacaccctgcatgctcagggctacgtgtccatcgggtgcgagccgtgcaccaggcccgtcctgccggggcagcacgagcgtgaaggccggtggtggtgggaggacgccaaggccaaggagtgcggcctccacaagggcaacatcgacaaggacgcccaggcggcggcccccaggtccgccaacggcaacggctcggcgggcgccccggacatcttcgagagccccgccgtggtgtccctcacccgcaccgggatcgagaacctgctgcgcctggagaaccgcgccgagccgtggctcgtggtgctgtacgcgccctggtgcccgttctgccaggccatggaggcctcctacgtggagctggccgagaagctggcggggtccggggtgaaggtggccaagttccgcgcggacggcgagcagaagccgttcgcgcaggccgagctgcagctgcagagctttcccaccgtgctcctgttcccgggccgcaccgccaggcccatcaagtacccgtcggagaagagggacgtcgactcgctcctcgccttcgtcaacagcctccggtgagagacgacctccagtgagcgagaaccatcgttctctgtcagtctgtatgatcttatgttggtctttatgagtttatctaggttcgtagagaagggaggtggaggggactgggtttggtagtgacacaggaaggaacgagggttcaggggggaaaaatcaggtgtagcttttgtaactgcaaaatgattgcagcatgtatacctgaagtctgagcttctgaggccctgtgcttggtagctgagggagaggttacttgtgtgtgcttatagtcagtggcgagtgcctactataaggttcaccggtcatctaaagcactgttgtaaactgtattatttggagagtggagttttaatataggcataagaatgggtaagtcgctggagatagtctaagaaaaatcaaataagagaccaagatttgagagttttcgtttgtttataggttggttgtcaactatatagactgtagaaatcggagggtttgcatattgttagaccccgtttatttagtgctaaagtttagcataacatttttcactaaagtttaccacatatagaactaaacatgtatattaaaaagacagtgctaaa

SEQ ID NO: 4235 - DNA, 1862 bp, Setaria italica
cgccacagaaaaaacgcaggagtcaaaaacacatttgctccagagaagaaatattaccagctgcgaatttttttcaaagccccaagagagcttccaatggcttccgccaccgcctccatctcgtcgcaccccgccgcgctccgcgacgtcaaagccgcgaggattggcgccgtgaggcagcaggtggccgtggccccgtcagcggcggcgcggggccagcgcgctcgggcggtgcgcccgctgcgcgcggcggagcaggggaggcagccggtgtcggcctccgcggcgtcggcggcgccggtggcgcccgtggccgacgaggccgcggcccccgccgcggtggactacgaggccctggcgcgtgagctggagggcgcgtcgccgctgcaggtcatggatcgggcgctggccatgttcggatccgagatcgccatcgcgttcagtggcgcggaggacgtggcgctgatcgagtacgcgaagctgacggggcgccccttccgggtgttcagcctggacacgggccgcctgaacccggagacctaccagttcttcgacaaggtggagaagcactacggcatccgcatcgagtacatgttcccggacgccggcgaggtgcaggagctggtgcggaccaagggcctcttctccttctacgaggacggccaccaggagtgctgccgggtgcgcaaggtgcggccgctgcgcagggccctcaagggcctcagggcctggatcaccggccagaggaaggatcagtcccccggcaccagggcaagcatccccgtcgttcaggttgatccttcatttgaaggccaggatggcggagctggtagcttgatcaagtggaaccccgtggccaacgtcgacggcaaggacatctggacattcctgaggaccatggacgtccctgtcaacaccctgcacgctcaaggttacgtgtcaattggttgcgagccgtgcaccaggccggtcctgccggggcagcacgagcgtgaaggccggtggtggtgggaggacgccaaggccaaggagtgcggccttcacaagggcaacatcgaaaaggacgggcaggcggcggcgcccaagtccgccaacggcaacggctcggcgggcgccccggacatcttcgagagccccgccgtggtgtccctgacccggaccgggatcgagaacctgctgggcctggagaaccgcgcggagccgtggctcgtggtgctgtacgcgccgtggtgccccttctgccaggccatggaggcctcctacgtggagctggcggagaagctggcggattccggtgtgaaggtggccaggttccgcgccgacggcgagcagaagccgttcgcgcaggcggagctgcagctgcagagcttccccaccgtgctcctgttcccgagccgcaccgccaggcccatcaagtacccgtccgagaagagggacgtcgactcgctcctcgccttcgtcaacagcctccggtgagaggccgccagggagcgagagtcatcgttctctgtctgtgtctgtccatggtggtggtgttggcgattggtgtcgttggtccgtctagcattgtacttagagagggaggagaggtatcagagagagggaattggggacgataggaacagagggaggggttcagaaatacttcagatgcagatgattgatgcatctctagcttttgtcactgcaaatgattgcaggtaaacctgaaggtccggtggtgtagggcaaaaggtcgaggttatttatgtacttatagctagtgggtgagttggtgacagaggattgtacgggtaaaatcaaataagaaaaatcagttttggtagttctttattgttcatgcgttagaaacttagaatgac

SEQ ID NO: 4236 - DNA, 1771 bp, Zea mays
acgccacaggaaggggaaaaaaaacgcaggtgcccaaaacacgttcgccccagagaattgaaaacttaccactgcgaattcaattcgaaagcctcagacccagagagcttcccatggcatccgctaccacctccatctcgtcgcaccctgccgccctccgcgacgtcaaagctgcgaggattggtggcgcgctgaggcaggtgggcgtggcggcgcgtggccagcgcgctcgggcggtgcccccgctgcgcgcggcggagcctgcgaggcggccggtggcggcctccgcggccgcggcgccgccggccgcgcccgtggccgacgaggcggcggtggactacgaggccctggcgcgcgagcttgagggcgcgtcgccgctggagatcatggatcgggcgctggccatgttcggctccgaaatcgccatcgccttcagcggcgcggaggacgtggcgctgatcgagtacgcgaagctgacggggcgtcccttccgggtgttcagcctggacacggggcggctcaacccggagacgtaccagctcttcgacagggtggagaagcactacggcatccgcatcgagtacatgttcccggacgccagcgaggtgcaggagctggtgcggaccaagggcctcttctccttctacgaggacggccaccaggagtgctgccgcgtgcgcaaggtgcggcccctgcgcagggcgctcagggggctcagggcgtggatcaccggccagaggaaggaccagtcccccggcaccagggccagcatccctctggtccaggttgacccttccttcgaaggcctggacggcggggctggtagcttggtcaagtggaaccccgtggccaacgtcgacggcaaggacatctggactttcctgcggaccatggacgtccctgtcaacgccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggcaacatcgacaaggacggccaggcggcggcggcggcggcggcccccaggactgccaacggcaacggctcggcgggcgccccggacatcttcgagagccccgccgtcgtgtccctcacccgcgccggggtcgagaacctgctgcgcctggagagccgcgccgagccgtggctcgtggtgctgtacgcgccctggtgcccgttctgccaggccatggaggcctcctacgtggagctggccgagaggctggcggggtccggcggcgtgaaggtggcccggttccgcgccgacggcgagcagaagccgttcgcgcaggccgagctgcagctgcagagcttccccaccgtgctcctgttccccagccgcaccgcccggcccatcaagtacccgtcggagaagagggacgtcgactcgctcctcgccttcgtcaacagcctccggtgaggcccgccagtgagcgagaaccatcgttctctgtcagtatgtactgtattacatgttggtatccatctaggtgcgctgtacgtagagagggaggcggagggaactgggatgctagaaaaaacagatgcaggtgttgcttgtaactgcagaatgatggtaggtatgcatgaagtctgaggtcctgtgttatttggcagctgagggagagatttgtgcgtgcttgtagttgtagctagtggcgatggagtattctaaggaaaatcaaataagaatcgaagttttgagag

SEQ ID NO: 4237 - DNA, 2021 bp, Brachypodium distachyon
tcccgcccgagctatatgtaaccactcagccccattcccccgtacgccacagaaaaacacagcagtcaaacaaaaacatttgccaaccaggagcatcataatcctcggaattcgagaggcggaggagaagggcttctgaggagtaataatcaatggcttccgctactgcttccatctcgtcgcacgcgatcgccctccgcgatctcaaagccgcgaggattggtgccgtgaggcagcaagtggccgcggccccggcggccccggcggtgaggtcccagcgcgcgagggcggtgcgcccgctgtgcgcggcggagccggcgaggaagccgctgtcggcgtccgcggccgcggcgccggtggcgccagtgttggtggaggaggaggcatcggccgtccccgcggccgtggactacgaggccctggcgcaggagctgcagggcgcgtcgccgctggagatcatggatcgggcgctctccatgttcggatccgaaatcgccatcgccttcagtggagccgaggacgtggcgctgatcgaatacgcgaagctgacagggcggcccttcagggtgttcagcctggacacggggcggctgaacccggagacgtaccagctgttcgacaaggtggagaagcactacgggatccacatcgagtacatgttcccggaggccgccgaggtgcaggagctggtgaggaacaaaggcctcttctccttctacgaggacggccaccaggagtgctgccgggtgaggaaggtgcggccgctgaggagggccctcaagggcctcaaggcctggatcaccggccagaggaaggaccagtcccctggcaccagagccagcatccccgttgttcaggttgatccgtcttttgaagggctggatggtggagctggtagcttgattaagtggaaccctgtggccaatgtggagggcaaggacatctggaccttcctcaggaccatggatgtccctgtgaacaccctgcatgctcaaggatacgtctccattgggtgcgagccgtgcaccaggcccgtcttgccggggcagcacgagagggaagggaggtggtggtgggaggacgccacggccaaggagtgcggcctccacaaaggcaacatcgagaaggaaggccaggcacccaaggtcggcgtcaacggcaacggctcggccgaggccagcgccccggacatcttccagagccaggccgtcgtcagcctcacccgccccgggatcgagaacctattgaagctcgagaaccgcaccgagccctggctcaccgtcctctacgctccatggtgcccgtactgccaggcgatggaggcttcctaccttgagctggcagagaagctgagcgggtcgggcgtcaaggtggccaagttccgcgccgacggcgagcagaagccgttcgcgcaggcggagctgcagctgcagagcttcccgacgatcctgctgttccccagccgcaccgcgaggcccatcaagtacccgtccgagaagagggacgtcgagtcgctcctcgcattcgtcaacagcctcagatgagtgggcagagaacaggagaaccatcgttctctgctgcattgcactcgtgcaattgtactccgtatttaggaagtagaggatggttcaaaacatcacacgggattgagggggtccgtcgaatgcagcggctgcaaaagctgtatcctgaaactgaaacccctccattataatggggtggggactttgtagttgtagttagcataagagaggattgtaaggataattccaataagagaatagttttggaaattttgatcatatgctcggaggcttcaccaatggaaatatccggcagcatattctatgcactcagcataaattgcatggcgggtacactaacttggcaaggatgttcacttaaattattaacttgaaaatctgaaaagtggatccatgaacttggcaagttggttcaaattagtctaaattaacgatttcggtccaaactatgccacgcttgacagtgggccacacatg

SEQ ID NO: 4238 - DNA, 1654 bp, Brachypodium distachyon
taataatcaatggcttccgctactgcttccatctcgtcgcacgcgatcgccctccgcgatctcaaagccgcgaggattggtgccgtgaggcagcaagtggccgcggccccggcggccccggcggtgaggtcccagcgcgcgagggcggtgcgcccgctgtgcgcggcggagccggcgaggaagccgctgtcggcgtccgcggccgcggcgccggtggcgccagtgttggtggaggaggaggcatcggccgtccccgcggccgtggactacgaggccctggcgcaggagctgcagggcgcgtcgccgctggagatcatggatcgggcgctctccatgttcggatccgaaatcgccatcgccttcagtggagccgaggacgtggcgctgatcgaatacgcgaagctgacagggcggcccttcagggtgttcagcctggacacggggcggctgaacccggagacgtaccagctgttcgacaaggtggagaagcactacgggatccacatcgagtacatgttcccggaggccgccgaggtgcaggagctggtgaggaacaaaggcctcttctccttctacgaggacggccaccaggagtgctgccgggtgaggaaggtgcggccgctgaggagggccctcaagggcctcaaggcctggatcaccggccagaggaaggaccagtcccctggcaccagagccagcatccccgttgttcaggttgatccgtcttttgaagggctggatggtggagctggtagcttgattaagtggaaccctgtggccaatgtggagggcaaggacatctggaccttcctcaggaccatggatgtccctgtgaacaccctgcatgctcaaggatacgtctccattgggtgcgagccgtgcaccaggcccgtcttgccggggcagcacgagagggaagggaggtggtggtgggaggacgccacggccaaggagtgcggcctccacaaaggcaacatcgagaaggaaggccaggcacccaaggtcggcgtcaacggcaacggctcggccgaggccagcgccccggacatcttccagagccaggccgtcgtcagcctcacccgccccgggatcgagaacctattgaagctcgagaaccgcaccgagccctggctcaccgtcctctacgctccatggtgcccgtactgccaggcgatggaggcttcctaccttgagctggcagagaagctgagcgggtcgggcgtcaaggtggccaagttccgcgccgacggcgagcagaagccgttcgcgcaggcggagctgcagctgcagagcttcccgacgatcctgctgttccccagccgcaccgcgaggcccatcaagtacccgtccgagaagagggacgtcgagtcgctcctcgcattcgtcaacagcctcagatgagtgggcagagaacaggagaaccatcgttctctgctgcattgcactcgtgcaattgtactccgtatttaggaagtagaggatggttcaaaacatcacacgggattgagggggtccgtcgaatgcagcggctgcaaaagctgtatcctgaaactgaaacccctccattataatggggtggggactttgtagttgtagttagcataagagaggattgtaaggataattccaataagagaatagttttggaaatttt

SEQ ID NO: 4239 - DNA, 1856 bp, Triticum aestivum
tcccgcccgagctatatgtaaccactcagccccgtttcccccgccacagagaaaaacacaggagttaaaacacatttgccagctccgacaaacatccctgcgaatttgagaggaaggagggattcattcagcggcccgtaatcaatggcttccgctactgcttccatctcgtcgcactccatcgccctgcgcgatctcaaagccacgaggattggagccgtgaggcagcaggtggccgtggttccagcgggcctgccggcaacagcgcccaagggccagcgcgcgagggcggtgcgcccgctgtgcgcggcggagccagcgaggaagccagtatcggcctccgcggcctcgtcgcctgtggcgccggtggaggaggaggcatctgccgcggcggccgtggactacgaggccctggcgcaggagctggtgggcgcgtcgccgctggagatcatggatcgtgcgctcgacatgttcggctccgaaatcgccatcgccttcagtggtgccgaggacgtggctctcatcgaatacgcgaagctgactggacgccccttcagggtgttcagccttgacacggggcggctgaacccagagacataccaactcttcgacaaggtggagaagcactacggtatccacatcgagtacatgttccctgaggccagcgaggtgcaggaccttgtgaggagcaagggtctcttctctttctacgaggacggccaccaggagtgctgcagggtgaggaaggttcggccgttgaggagggccctcaagggcctcaaggcctggatcaccgggcagaggaaggaccagtcccctggcaccagggccagcatccctgttgttcaggttgatccgtcttttgaagggctggatggtggagccggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctccacaagggtaacatcgacaaggaaggtcaggcacccaaggtcggcgtcaacggcaacggctcggccgaggccagcgccccagacatcttccagagccaggcaatcgtcaacctcacccgtcccgggatcgagaacctcctgcggctggagaaccgcgccgagccgtggctcaccgtcctctacgctccctggtgcccatactgccaggcaatggaggcgtcctacgttgagctggccgagaagctgagcggctccggcatcaaggtggccaagttccgtgcagacggtgagcagaagccattcgcgcaggcggagctgcagctgcagagcttcccaacgatcctcctcttccccggccgcaccgtgaagcccatcaagtacccgtccgagaagagggacgtccagtccctcctcgccttcgtgaacagcctcagatgagtggtcagagaaccggagaaccatcgttctctgcattggtatcggcggtgtctaggcactattatgtagtggtagcaagagaggatggttcagaacatcaacggaaatgttggagacagtgtggggaggcagggacagcggctcaaagcccctccattataagggggtggggatttgtgtgtagttgtagctagatgattgtaaggaagttcaaataagagtactagttctgaaattttgatccaaggcttcatccagagtttggacaatgtattctatgcgctctgtcttgtcgttcactcgtagtcacaggtcagcta

SEQ ID NO: 4240 - DNA, 1943 bp, Hordeum vulgare
gttaaaacacatttgccaacccggagaaacattccctgcgaattcgagagggaggagggattcagcggcccggtaatcaatggcttccgctactgcttccatctcgtcgcactcgatcgccttgcgcgatctcaaagccgcgaggattggagccgtgaggcagcaggtggccgtgccggcagcggcgcccaagggccagcgcgcgagggcggtgcgcccgctgtgcgcggcggagccatcgaggaagccagtgtcggcctccgcggcctccgcgccggtggcgccagtcgaggaggaggcatctgctgcggcgtccgtggactacgaggccctggcgctggagctggtggacgcgtcgcctctggagatcatggatcgtgcgctcgacatgttcggctctgaaatcgccatcgccttcagcggtgccgaggacgtggccttgattgaatacgcgaagctgactggacgccccttcagggtgttcagcctcgacacggggcggctgaacccagagacataccaactcttcgacaaggtggagaagcactacggtatccacatcgagtacatgttcccagaggcaagcgaggtgcaggaccttgtgaggaccaagggcctcttctctttctacgaggacggacaccaggagtgctgcagggtgaggaaggttcggccattgaggagggccctcaagggcctcaaggcctggatcaccgggcagcggaaggaccagtcccctggcaccagggcgagcatccctgttgttcaggttgatccgtcatttgaagggctggatggtggagctggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggtctccacaagggtaacatcgacaaggaaggtcagacacccaaggtcggcgtcaacggcaacggctcggctgaggccagtgccccagacatcttccagagccaggcaatcgtcaatctcacccgtcccgggatcgagaacctcctgcggctcgagaaccgcgcggaaccgtggctcgccgtcctatacgctccctggtgcccgtactgccaggcgatggaggcgtcctacgttgagctggccgagcagctgagcggctcgggcatcaaggtggccaagttccgcgcggacggcgagcagaagtcattcgcgcaggcggagctgcagctacagagcttcccgacgatcctcctcttccccggccgcaccgtgaagcccatcaagtacccgtccgagaagagagacgtacagtccctcctcgccttcgtgaacaccctcagatgagtggtcagacaaccggagaaccatcgttctctgcattgatgtctaggcatcattatacagtggtagcaagagaggatggttcagaacatcaacggaaatattggagacaagaggagtgtggggaggcagagactgcggctgaaagcccctcccttataaggaggtggggatatgtgtgtagttgtagctagatgattgtaaggaagttcaaataagagtactagttttgaaaaagttttgatccaaggcttcatccaatcccttttacttcaggctaagtgggctgggattgcaactaaatattcttgggttaattggatagatgccgctacaatttccggctatttgagaaacgccactgcaactttcatctttcgaaaaatgccattgcaactctgtgtacatttgacagatgtcattatgcccacttccatgcatataccggccaatataccaacgtattcctgtcgtatgtaaaaaaaaaaaa

SEQ ID NO: 4241 - DNA, 1993 bp, Hordeum vulgare
cccgcccgagctatatgtaaccactcagccccgtttccctcgccacagagaaaacacaggagttaaaacacatttgccaacccggagaaacattccctgcgaattcgagagggaggagggattcagcggcccggtaatcaatggcttccgctactgcttccatctcgtcgcactcgatcgccttgcgcgatctcaaagccgcgaggattggagccgtgaggcagcaggtggccgtgccggcagcggcgcccaagggccagcgcgcgagggcggtgcgcccgctgtgcgcggcggagccatcgaggaagccagtgtcggcctccgcggcctccgcgccggtggcgccagtcgaggaggaggcatctgctgcggcgtccgtggactacgaggccctggcgctggagctggtggacgcgtcgcctctggagatcatggatcgtgcgctcgacatgttcggctctgaaatcgccatcgccttcagcggtgccgaggacgtggccttgattgaatacgcgaagctgactggacgccccttcagggtgttcagcctcgacacggggcggctgaacccagagacataccaactcttcgacaaggtggagaagcactacggtatccacatcgagtacatgttcccagaggcaagcgaggtgcaggaccttgtgaggaccaagggcctcttctctttctacgaggacggacaccaggagtgctgcagggtgaggaaggttcggccattgaggagggccctcaagggcctcaaggcctggatcaccgggcagcggaaggaccagtcccctggcaccagggcgagcatccctgttgttcaggttgatccgtcatttgaagggctggatggtggagctggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggtctccacaagggtaacatcgacaaggaaggtcagacacccaaggtcggcgtcaacggcaacggctcggctgaggccagtgccccagacatcttccagagccaggcaatcgtcaatctcacccgtcccgggatcgagaacctcctgcggctcgagaaccgcgcggaaccgtggctcgccgtcctatacgctccctggtgcccgtactgccaggcgatggaggcgtcctacgttgagctggccgagcagctgagcggctcgggcatcaaggtggccaagttccgcgcggacggcgagcagaagtcattcgcgcaggcggagctgcagctacagagcttcccgacgatcctcctcttccccggccgcaccgtgaagcccatcaagtacccgtccgagaagagagacgtacagtccctcctcgccttcgtgaacaccctcagatgagtggtcagacaaccggagaaccatcgttctctgcattgatgtctaggcatcattatacagtggtagcaagagaggatggttcagaacatcaacggaaatattggagacaagaggagtgtggggaggcagagactgcggctgaaagcccctcccttataaggaggtggggatatgtatgtagttgtagctagatgattgtaaggaagttcaaataagagtactagttttgaaaaagttttgatccaaggcttcatccaatcccttttacttcaggctaagtgggctgggattgcaactaaatattcttgggttaattggatagatgccgctacaatttccggctatttgagaaacgccactgcaactttcatctttcgaaaaatgccattgcaactctgtgtacatttgacagatgtcattatgcccacttccatgcatataccggccaatataccaacgtattcctgtcgtatgta

SEQ ID NO: 4242 - DNA, 1704 bp, Leymus cinereus x Leymus triticoides
  misc_feature (570)..(570): n is a, c, g, or t
  misc_feature (925)..(925): n is a, c, g, or t
  misc_feature (1192)..(1192): n is a, c, g, or t
  misc_feature (1248)..(1248): n is a, c, g, or t
atttgccagctccgagaaacatccctgggaatttgagagggaggagggattcagcggtcgataatcaatggcttccgctactgcttccatctcgtcgcactcgatcgccctacgcgatctcaaagccgcgaggattggagccgtgaggcagcaggtggccgtggttccagcgggcctgccggcaacggcacccaagggccagcgcgcgagggcggtgcgcccgctgtgcgcggcggagcccgcgaggaagccagtgtcggcctccgcggtctcggcgccggtggcgccggttgaggaggaggcatctgctgccgcccccgcggcggccgtggactacgaggccctggcgcaggagctgctgggcgcgtcgccgctggagatcatggatcgtgcgctggacatgttcggctccgaaatcgccatcgccttcagtggtgccgaggacgtggccctcatcgaatacgcgaagctgaccggacgccccttcagggtgttcagcctcgacacggggcggctgaacccagagacataccagctcttcgacaaggtggagaagcactacggtatccncatcgagtacatgttcccagaggccagcgaggtgcaggacctggtgaggaccaaaggcctcttctctttctacgaggacggccaccaggagtgctgcagggtcaggaaggttcggccgttgaggagggccctcaagggcctcaaggcctggatcaccgggcagaggaaggaccagtcccctggcaccagggcgagcatccctgttgttcaggttgatccgtcttttgaagggctggatggtggagccggtagcttgatcaagtggaaccctgtggctaatgtggatggcaaggatatctggaccttcctcaggaccatggatgtccctgtgaacaccctgcatgctcaaggctangtctccattgggtgcgagccgtgcaccaggccagtgttgccggggcagcacgagagggaagggaggtggtggtgggaggacgccacggccaaggagtgcggcctccacaagggtaacatcgacaaggaaggtcaggcacccaaggtcggcgtcaacggcaatggctcggccgaggccagcgccccagacatcttccagagccaggcagtcgtcaacctcacccggcccgggatcgagaacctcctgcggctcgagaatcgcgcgganccgtggctcaccgtcctctacgctccctggtgcccatactgccaggcgatggaggngtcctacgttgagctggccgagaagctgagcggctcaggcatcaaggtggccaagttccgcgccgacggcgagcagaagccattcgcgcaggcggagctgcagctacagagcttcccgacgatcctcctcttccccggccgcaccgtgaagcccatcaagtacccgtccgagaagagggacgtccagtccctcctcgccttcgtgaacaccctccgatgagtggtcagagaaccggagaaccatcgttctctgcattggtaccggcggtgtctaggcattactattatatagtggtagcaacagaggatggttcagaacatcaacggaacagaggagtgtggggaggcagggactgcggctgaaagcccctccgttataagggggtggggatttgtgtgtagttgtagctagatgattgtaaggaagttcaaataagagtactagttttgaaatta

SEQ ID NO: 4243 - DNA, 2448 bp, Triticum aestivum
ccacgcgtccgcacaggagttaaaacacatttgccagctccgacaaacatccctgcgaatttgagagggaggaagggttcattcagcggccggtaatcaatggcttccgctactgcttccatctcgtcgcactccatcgccctgcgcgatctcaaagccgcgaggattggagccgtgaggcagcaggtggccgtggttcctgcgggcctgccggcaacggcgcccaagggccagcgcgcgagggcggtgcgcccgctgtgcgcggcggagccagcgaggaagccagtgtcggcctccgcggcctcgtcgccggtggcgccggtggaggaggaggcatctgccgtggcggccgtggactacgaggccctggcgcaggagctggtgggcgcgtcgccgctggagatcatggatcgtgcgctcgacatgttcggctccgaaatcgccatcgccttcagtggtgccgaggacgtggccctcatcgaatacgcgaaactgactggacgccccttcagggtgttcagccttgacactgggcgactgaacccagagacatacgaactcttcgacaaggtggagaagcactatggtatccacatcgagtacatgttccctgaggccagcgaggtgcaagaccttgtgaggagcaagggcctcttctctttctacgaggacggacaccaggagtgctgcagggtgaggaaggttcggcccttgaggagggccctcaagggcctcaaggcctggatcaccgggcagaggaaggatcagtcccctggcaccagagccagcatccctgttgttcaagttgatccgtcttttgaagggctggatggtggagccggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctgcacaacggtaacatcgacaaggaaggtcaggcacccaaggtcggcgtcaacggcaacggctcggccgaggccagcgccccagacatcttccagagccaggccatcgtcaacctcacccgtcccgggatcgagaacctcctgcggctcgagaaccgcgccgagccgtggctcaccgtcctctacgctccctggtgcccatactgccaggcaatggaggcgtcctacgttgagctggccgagaagctgagcggctcaggcatcaaggtggccaagttccgcgcggacggcgagcagaagccattcgcgcaggcggagctgcaactacagagcttcccgacgatcctcctgttccccggccgcaccgtgaagcccatcaagtacccgtccgagaagagggacgtccagtccctcctcgccttcgtgaacagcctcagatgagtggtcagagaaccggagaaccatcgttctctgcattggtaccggcggtgtctaggcattattatgtagtggtagcgagagaggatggatcaacggaaatgttggagacagaggagtgtggggacgcagggacagcggctcaaagcccctccattataagggggtggggatttgtgtgtagttgtagctagatgtttgtaaggaagttcaaataagagtactagttttgaaattttgatccaaggcttcatcgagagtttggacaatatactcgtggttcactcggtcacaggcagctacccgaaaaagaaaaaaaatagcagtcacaggtcagttatcacattcttcagttatcacattgtggtgcccattgatgctcaatcagattctggttgatgctgaatttgttgatgcatttgaataaattgaaatgtggccggattctagttcggaagttggatagtatcactcatgttctcaaatttcagagttgcggcagtatctcctcatcctcgatgatcatattgtgcatgatcacacgacatgtcatcacctctcacaaggttttcgggtctcattgttttgcaagtccacgaacaactacaaaacgggtctgaagaacttcaaatgccctcttgacatgctttttagctgcttcttgtctttgagcaaagtgagctgccatctcgacatgctttctaactgtttcttgtctttgagcaaagtgagcttttttctggccaattgcgtttgagatggtgctggtaaaggtagtccatggaggatatatagcgtcaaccagatagtagctcatgttgtactcatgtccattgacagtatagtggcaaggaggagcttctccttcagtcagcctcacaaacaatggttatcgttgcagcacattagtgtcattgtgagacccgagcatgccaaagaagcgtgccaaatacaaagatc

SEQ ID NO: 4244 - DNA, 2442 bp, Triticum aestivum
gaaaacacaggagttaaaacacatttgccagctccgacaaacatccctgcgaatttgagagggaggaagggttcattcagcggccggtaatcaatggcttccgctactgcttccatctcgtcgcactccatcgccctgcgcgatctcaaagccgcgaggattggagccgtgaggcagcaggtggccgtggttcctgcgggcctgccggcaacggcgcccaagggccagcgcgcgagggcggtgcgcccgctgtgcgcggcggagccagcgaggaagccagtgtcggcctccgcggcctcgtcgccggtggcgccggtggaggaggaggcatctgccgtggcggccgtggactacgaggccctggcgcaggagctggtgggcgcgtcgccgctggagatcatggatcgtgcgctcgacatgttcggctccgaaatcgccatcgccttcagtggtgccgaggacgtggccctcatcgaatacgcgaaactgactggacgccccttcagggtgttcagccttgacactgggcgactgaacccagagacatacgaactcttcgacaaggtggagaagcactatggtatccacatcgagtacatgttccctgaggccagcgaggtgcaagaccttgtgaggagcaagggcctcttctctttctacgaggacggacaccaggagtgctgcagggtgaggaaggttcggcccttgaggagggccctcaagggcctcaaggcctggatcaccgggcagaggaaggatcagtcccctggcaccagagccagcatccctgttgttcaagttgatccgtcttttgaagggctggatggtggagccggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctgcacaacggtaacatcgacaaggaaggtcaggcacccaaggtcggcgtcaacggcaacggctcggccgaggccagcgccccagacatcttccagagccaggccatcgtcaacctcacccgtcccgggatcgagaacctcctgcggctcgagaaccgcgccgagccgtggctcaccgtcctctacgctccctggtgcccatactgccaggcaatggaggcgtcctacgttgagctggccgagaagctgagcggctcaggcatcaaggtggccaagttccgcgcggacggcgagcagaagccattcgcgcaggcggagctgcaactacagagcttcccgacgatcctcctgttccccggccgcaccgtgaagcccatcaagtacccgtccgagaagagggacgtccagtccctcctcgccttcgtgaacagcctcagatgagtggtcagagaaccggagaaccatcgttctctgcattggtaccggcggtgtctaggcattattatgtagtggtagcgagagaggatggatcaacggaaatgttggagacagaggagtgtggggacgcagggacagcggctcaaagcccctccattataagggggtggggatttgtgtgtagttgtagctagatgtttgtaaggaagttcaaataagagtactagttttgaaattttgatccaaggcttcatcgagagtttggacaatatactcgtggttcactcggtcacaggcagctacccgaaaaagaaaaaaaatagcagtcacaggtcagttatcacattcttcagttatcacattctggtgcccattgatgctcaatcagattctggttgatgctgaatttgttgatgcatttgaataaattgaaatgtggccggattctagttcggaagttggatagtatcactcatgttctcaaatttcagagttgcggcagtatctcctcatcctcgatgatcatattgtgcatgatcacacgacatgtcatcacctctcacaaggttttcgggtctcattgttttgcaagtccacgaacaactacaaaacgggtctgaagaacttcaaatgccctcttgacatgctttttagctgcttcttgtctttgagcaaagtgagctgccatctcgacatgctttctaactgtttcttgtctttgagcaaagtgagcttttttctggccaattgcgtttgagatggtgctggtaaaggtagtccatggaggatatatagcgtcaaccagatagtagctcatgttgtactcatgtccattgacagtatagtggcaaggaggagcttctccttcagtcagcctcacaaacaatggttatcgttgcagcacattagtgtcattgtgagacccgagcatgccaaagaagcgtgccaaatacaaagatc

SEQ ID NO: 4245 - DNA, 2173 bp, Oryza sativa
cctgtggctccgcgtgacgccactgcttcgatcgccccctccccgtgcggccagccaatgaagccgtgacacgtgtccctcccgtccgccgctcccgattccgtccaggtgcattgaacccagcctcccgcgcgagctatatgtaacccgccctcctctttagcccccgtacgccacagaaaactcgcagaagtgagggaaaaccaagaaaaaaaaacatttcctgcttccaaattttgtcggaattttgaagggaagaggaaggattcggaggtggtgatggcttccgctaccgcttccatctcgtcccactccgtcgccctccgcgacctcaaagctgcgaggattggagccgtgaagcagcaggtggccgcggccccggcggcgggcacggcggcggcgagggcccagcgcgcgagggcggtgcgcccgctgcgcgcggcggagccggcgaggcagcccgtctccgcctccgcggcggcggcgccggccgccgcgcccgtggcggaggacgccgccgccgccgccgtcgacgcccctgctccggccgtggactacgaggccctggcccaggagctgcagggcgcgtcgccgctggagatcatggatcgggcactcgccatgttcggatccgacatcgccatcgccttcagcggggcggaggacgtggcgctgatcgagtacgcgaagctgacggggcgtccgttccgcgtgttcagcctggacacggggcggctgaacccggagacgtaccagctgttcgacaaggtggagaagcactacgggatccggatcgagtacatgttcccggacgccggcgaggtgcaggcgctggtgcgcgccaagggcctcttctccttctacgaggacggccaccaggagtgctgccgcgcccgcaaggtgcgcccgctccgccgcgcgctccgcggcctcagggcctggatcaccggccagcgcaaggaccagtccccgggcacccgcgccgccatccccgtcgtccaggtcgacccctccttcgagggcctcgctggcggcgccggcagcctcgtcaagtggaaccccgtcgccaacgtcgacggcaaggacgtgtggaccttcctccgcgccatggatgtccccgtcaacgccctgcacgcccaggggtacgtctcgatcgggtgcgagccgtgcaccaggcccgtgcttcccggccagcacgagcgggaagggcggtggtggtgggaggacgccaaggccaaggagtgcggcctccacaaggggaacatcgacgaccagggtggggcggcggcggcggcggcgcacaaggccggcggcgccaacggcaacgggtcggccggcgcgccggacatcttcgagagcagcggcgtggtgagcctcacccgcgccggcgtcgagaacctgctccgcctggagagccgcgcggagccgtggctggtggtgctgtacgcgccgtggtgccccttctgccaggccatggaggcgtcctacctggagctcgccgagaggctgggcggcgcgggcggcggcgtgaaggtgggcaagttccgcgccgacggcgagcagaaggcgttcgcgcagcaggagctgcagctgcagagcttcccgaccatcctcctcttcccgagccgcaccgcgaggccgatcaagtacccgtcggagaagcgggacgtcgactcgctcctcgccttcgtcaacagcctccgatgagggagagacccgatcggcacagccatcatttgttcttggcatccaatggcaatcgacttggcgacgaccatgatccggtgtattagtattagggtgagatgggttaagttgggaatcggggaggtcagaggaaggggtcggggtcagggttcagatgcagttgctgcatctatagcttttgctgctactgcgggttaatcctggaaagcttctcttctttcggaggaagagggtaatttgggtcgtcgtgtgtacttgtagctagtaataacagaggattgtaagggtaaatttaaataaaaaattttggttatggagctttttgtcatgttataattgtggataggtgctggcagcaaattaacaagcaaaacttcgtcccttggcctatggatcagctaattcaatagacgcaatctaacaaactaacttaagatagtgatgatgttctctctcatggcctaat

SEQ ID NO: 4246 - DNA, 1926 bp, Secale cereale
gcggggtcgaggcgagttatgagggaggtagggaagtttccaattcagcggccggtaatcaatggcttccgctactgcttccatctcgtcgcactccatcgccctgcgcgatctcaaagccgcgaggattggagccgtgaggcagcaggtggccgtggttccagcgggcctgccggcaacggcgcccaagggccagcgcgcgagggcggtgcgcccgctgtgcgcggcggagccagcgaggaagccagtgtcggcctccgcggcctcgtcgccggtggcgccggtggaggaggcggtggccgtggaatacgaggccctggcgcaggagctggtgggcgcgtcgccgctggagatcatggatcgtgcgctcgacatgttcggctccgaaatcgccatcgccttcagtggtgccgaggacgtggccctcatagaatacgcgaaactgactggacgccccttcagggtgttcagccttgacaccgggcgcctgaacccagagacatacgaactcttcgacaaggtggagaagcactacggtatccacatcgagtacatgttccctgaggccagcgaggtgcaggacctggtgaggagcaagggcctcttctctttctacgaggacggccaccaggagtgctgcagggtgaggaaggtccggccgttgaggagggccctcaagggcctcaaggcctggatcaccgggcagaggaaggaccagtcccctggcaccagggccagcatccccgttgttcaggttgatccgtcttttgaagggctggatggtggagcgggtagcttgatcaagtggaaccctgtggctaatgtggatggcaaggatatctggaccttcctcaggaccatggatgtccctgtgaacaccctgcatgctcaaggctacgtctccattgggtgcgagccgtgcaccaggcccgtcttgccggggcagcacgagagggaagggaggtggtggtgggaggacgccactgccaaggagtgcggcctccacaagggtaacatggacaaggaaggtcaggcacccaaggtcggcgtcaacggcaacggctcggccgaggccagcgccccagacatcttcgagagccaggcaatcgtcaacctcacccgtcccgggatcgagaacctcctgcggctcgagaatcgcgcggagccgtggctcaccgtcctctacgctccctggtgcccatactgccaggcgatggaggcgtcctacgttgagctggccgagaagctgagcggctcgggcatcaaggtggccaagttccgcgccgacggcgagcacaagccattcgcgcaggcggagctgcagctacagagcttcccgacgatcctcctcttccctggccgcaccgtaaagcccatcaagtacccgtccgagaagagggacgtccagtccctcctcgcctttgtgaacagcctcagatgagtggtcagagaaccggagaaccatcgttctctgcattggtactggccttgtcttaaggcgttatactagtagcaagggagaatgaatgcttcagaacatcaaccgaaatgttgtagacggtggaaggagactgcggcttagagccctccattataagggggtggggatttgtgtctagttttgtagctagaggatcgtaagcaagttcaaataagagtatacagtagttatgaaatttttgatccaaggctttaccgagagttttgaaagaaaaaaaatatgcgcttggccttgtggttcactcgtcataggccaactatcagtttacgcttgaagctcgaagctcggcctcgtgcttcatttaaccaccaatcctcggtctgggtaccaactatcattatgttctggaacgttcaggggaaatgggggatttgatctcgcgaggaggaatgacaatgaacgatatcatttctttacttcagtac

SEQ ID NO: 4247 - DNA, 1683 bp, Avena sativa
caggagtcaaacgcatttgccaactcggagaaacacacctgtgaatttgagagggcggaaggattcggcgataatcaatggcttccgctactgcttccatctcgtcgcacgcgatcgctctacgcgatcttaaagccgtgagaattggaggcgtgaggcagcaggtggccgtggttccagcgggcccgacggtgaagagccagcgcgcgagggcggtgcggccgctgtgcgcggcggagccagctaggaagccgttgtccgcctcggcggcctcagcgccggtggcgccagtggaggaggaagaggcgtccgcggcggcggtggactacgaggccctggcgcaggagctggtgggcgcgtcgccgctggagatcatggatcgggcgctcgacctgttcggatccgaaatcgccatcgccttcagcggtgccgaggacgtggcgctgatcgaatacgcgaagctgacggggcggcccttcagggtgttcagcctggacacggggcgcctgaacccggagacgtaccagctcttcgacaaggtggagaaacactacggcatccacatcgagtacactttcccggaggcgggcgaggtgcaggacctggtgaggagcaagggcctcttctccttctacgaggacggccaccaggagtgctgcagggtgaggaaggtgcggccgttgaggaaagccctcaaggggctcaaggcctggatcaccgggcagaggaaggaccagtcccctggcaccagagccagcatccctgttgtccaggtcgatccttcttttgaagggctggatggtggagctggtagcttgattaagtggaaccctgtagccaatgtggagggcaaggacgtgtggaccttcctcaggaccatggatgtccctgtcaacgccctgcacgctcaaggctacgtctccattggatgcgagccgtgcaccaggcccgtcttgccggggcagcacgagagggaagggaggtggtggtgggaagacgccgctgccaaggagtgcggcctccacaagggcaacatcgagaaggatggccagggacccaaggtcggtgtcaatggcaatggctcggcagaggccagcgcccctgacatcttccagagccaggccatcgtcaacctcacgcggcccgggatcgagaacctcctgcggctcgagaaccgcacagagccgtggctcaccgttctctatgctccctggtgcccgtactgccaggcgatggaggcgccgtatgtcgagctggccgagaagctgagcggctcaggcatcaaagtggccaagttccgcgccgatggcgagcaaaagccgtttgcgcaggcggagctgcagctgcagagcttcccgacgatcctcctctttcccagccgcaccgtgaggcccatcaagtacccatccgagaagagggacgtcgactcgctcctcgctttcgtcaacagcctcagataagtggttggagaaccggagggagaaccatcgttctctgcattgtactggcggcgtctagtaggcaatgtaggagtattattagcaagagaggaggatggttctaaacgtcaaatggaatgttggagacagggacagcgtggaggctgaaaacccctcggatggggatatgtgtgtagctgtagttttagcaataagggaggatttgtaagggtttgaaataaga

SEQ ID NO: 4248 - DNA, 1607 bp, Saccharum officinarum
ggcggcgccggccgcgcccgtggccgacgaggctgcggccctcgcggccgtggactacgaggccctggcgcgtgagctggagggcgcgtcgccgctggagatcatggatcgggcgctggccatgttcggctccgaaatcgccatcgccttcagcggcgcggaggacgtggcgctgatcgagtacgcgaagctgacggggcgtccgttccgggtgttcagcctggacacggggcgtctcaacccggagacgtaccagttcttcgacaaggtggagaagcactacggcatccgcatcgagtacatgttcccggacgcaagcgaggtgcaggagctggtgcgcaccaagggcctcttctccttctacgaggacggccaccaggagtgctgccgggtgcgcaaggtgcggcccctgcgcagggcgctcaaggggctcagggcctggatcaccggccagaggaaggaccagtcccccggcaccagggccagcatccccctggttcaggtcgatccttccttcgaaggcctggatggcggagctggtagcttgatcaagtggaaccccgtggccaacgtcgacggcaaggacatctggacgttcctgcggaccatggacgtccctgtcaacaccctgcatgctcagggctacgtgtccatcgggtgcgagccgtgcaccaggcctgtcctgccagggcagcacgagcgtgaaggccggtggtggtgggaggacgccaaggccaaggagtgcggcctccacaagggcaacatcgaaaaggacgcccaggcggcggcccccaggtccgccaacggcaacggttcggcgggcgccccggacatcttcgagagccccgccgtggtgcccctcacccgcgccgggatcgagaacctgctgcgcctggagaaccgcgccgagccgtggctcgtggtgctgtacgcgccctggtgccccttctgccaggccatggaggcctcctacgtggagctggccgagaagttggcggggtccggcgtcaaggtggccaagttccgcgccgacggcgagcagaagccgttcgcgcaggccgagctgcagctgcagagcttccccaccgtgctcctgttcccgagccgcacagccaggcccatcaagtacccgtcggagaagagggacgtcgactcgctcctcgccttcgtcaacagcctccggtgaggccgccggtgagcgagaaccatcgttctctgtcagtatgtacttgtaccgtgttatgttggcgtccatctaggtgctgtacgtagagagggaggtggagggaattgggatgatagaaagacagggagggggttcagggaggaaaattaacaaatgcaggttatccagacaaacaacaaatcagatgcaggtgttgcatctctactttttgtaactgcagaatgatgggaggtatacccgaagtctgaggtcctgtgttattcggcagctgagggagaggttatttgtgtgtgcttatagctagtggcgagtggccatagagtattgcaaggaaaatcaaataagataatcaaataagaatcgaagttttgagaaaaacaaaaaaaacgccggcttccggacgcgtggtcgacacgacacc

SEQ ID NO: 4249 - DNA, 1712 bp, Triticum aestivum
gttaaaacacatttgccagctccgacaaacatccctgcgcatttgagagggaggagggattcattcagcggccggtaatcaatggcttccgctactgcttccgtctcgtcgcactccagcgccctgcgcgatctcaaagccgcgaggattggagccgtgaggcagcaggtggccgtggttccagcgggcctgccggcaaaggcgcccaagggccagcgcgcgagggcggtgcgcccgctgtgcgcggcggagccagcgaggaagccagtgtcggcctccgcggcctcgtcgccggtggcgccggtggaggaggaggaagcatctgccgtggactacgaggccctggcgcaggagctggtgggcgcgtcgccgctggagatcatggatcgtgcgctcgacatgttcggctccgaaatcgccatcgccttcagtggtgccgaggacgtggccctcatcgaatacgcgaaactgactggacgccccttcagcgtgttcagccttgacactgggcggctgaacccagagacatacgaactcttcgataaggtggagaagcactacggtatccacatcgagtacatgttccctgaggccagcgaggtgcaagaccttgtgaggagcaagggcctcttctctttctacgaggacggccaccaggagtgctgcagggtgaggaaggttcggcccttgaggagggccctcaagggcctcaaggcctggatcaccgggcagaggaaggaccagtcccctggcaccagggccagcatccctgttgttcaggttgatccgtcttttgaagggctgcacggtggagccggtagcttgatcaagtggaaccctgtggctaatgtcgatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctccacaagggtaacatcgacagggaagatcaggcacccaaggtcggcgttaacggcaatggctcggccgaggcccgcgccccagacatcttccagagccaggccatcgtcaacctcacccgtcccgggatcgagaacctcctgcggctggagaaccgcgccgagccgtggctcaccgtcctctacgctccctggtgcccatactgccaggcaatggaggcgtcctacgttgagctggccgagaagctgagcggctcaggcatcaaggtggccaagttccgcgcagacggcgagcagaagccattcgcgcaggcggagctgcagctacagagcttcccgacgatcctcctcttccccggccgcaccgtgaagcctatcaagtacccgtccgagaagagggacgtccaatccctcctcgccttcgtgaacagcctcagatgagtggtcagagaaccggagaaccatcgttctctgcattggtaccggcggtgtctaggcactattatgtagtggtagcaagagaggatggttcagaacatcaacggaaatgttggagacaaaggagtgtggggaggcggggacagcggctcaaagcccctccattataatggggtggggatttgtgtgtagttgtagctagatgattgtaaggaagttcaaataagagtactagttttgaaattttg

SEQ ID NO: 4250 - DNA, 1822 bp, Triticum aestivum
caggagttaaaacacatttgccagctccgacaaacatccctgcgcatttgagagggaggagggattcattcagcggccggtaatcaatggcttccgctactgcttccgtctcgtcgcactccagcgccctgcgcgatctcaaagccgcgaggattggagccgtgaggcagcaggtggccgtggttccagcgggcctgccggcaaaggcgcccaagggccagcgcgcgagggcggtgcgcccgctgtgcgcggcggagccagcgaggaagccagtgtcggcctccgcggcctcgtcgccggtggcgccggtggaggaggaggaggcatctgccgtggactacgaggccctggcgcaggagctggtgggcgcgtcgccgctggagatcatggatcgtgcgctcgacatgttcggctccgaaatcgccatcgccttcagtggtgccgaggacgtggccctcatcgaatacgcgaaactgactggacgccccttcagcgtgttcagccttgacactgggcggctgaacccagagacatacgaactcttcgataaggtggagaagcactacggtatccacatcgagtacatgttccctgaggccagcgaggtgcaagaccttgtgaggagcaagggcctcttctctttctacgaggacggccaccaggagtgctgcagggtgaggaaggttcggcccttgaggagggccctcaagggcctcaaggcctggatcaccgggcagaggaaggaccagtcccctggcaccagggccagcatccctgttgttcaggttgatccgtcttttgaagggctgcacggtggagccggtagcttgatcaagtggaaccctgtggctaatgtcgatggcaaggatatctggaccttcctcaggaccatggatgtccctgtgaacaccctgcatgctcaaggctacgtctccattgggtgcgagccgtgcaccaggcccgtgttgccggggcagcacgagagggaagggaggtggtggtgggaggacgccacggccaaggagtgcggcctccacaagggtaacatcgacagggaagatcaggcacccaaggtcggcgttaacggcaatggctcggccgaggcccgcgccccagacatcttccagagccaggccatcgtcaacctcacccgtcccgggatcgagaacctcctgcggctcgagaaccgcgccgagccgtggctcaccgtcctctacgctccctggtgcccatactgccaggcgatggaggcgtcctacgttgagctggccgagaagctgagcggctcaggcatcaaggtggccaagttccgcgcagacggcgagcagaagccattcgcgcaggcggagctgcagctacagagcttcccgacgatcctcctcttccccggccgcaccgtgaagcctatcaagtacccgtccgagaagagggacgtccaatccctcctcgccttcgtgaacagcctcagatgagtggtcagagaaccggagaaccatcgttctctgcattggtaccggcggtgtctaggcactattatgtagtggtagcaagagaggatggttcagaacatcaacggaaatgttggagacaaaggagtgtggggaggcggggacagcggctcaaagcccctccattataatggggtggggatttgtgtgtagttgtagctagatgattgtaaggaagttcaaataagagtactagttttgaaattttgatccaaggcttcatccagagtttggaccatgtattctatgcgctctgtcttttggttcactcgcagtcactcggtctctcttgtggttcagtccctcctagtcac

SEQ ID NO: 4251 - DNA, 1343 bp, Pennisetum glaucum
cgccggtggcccccgttgccgacgaggccgcggcccccgcggcggtggactacgaggccctggcgcgtgagctggagggcgcgtcgccgctgcaggtcatggatcgggcgctggccatgttcggatccgagatcgccatcgccttcagtggcgcggaggatgtggcgctgatcgagtacgcgaagctgacggggcgccccttccgggtattcagcctggacacgggccgcctgaacccggagacctaccagttcttcgacaaggtggagaagcactacggcatccgcatcgagtacatgttcccggactccggcgaggtccaggagctggtgcgcaccaagggcctcttctccttctacgaggacggccaccaggagtgctgccgggtgcgcaaggtgcgcccgctgcgcagggcgctcaagggcctcagggcatggatcaccggccagaggaaggaccagtcccccggcaccagggccagcatccccgtcgttcaggttgatccttcattcgaaggccaggatggcggagccggcagcttgatcaagtggaaccccgtggccaatgttgacggcaaggacatctggacattcctgaggaccatggacgtccctgtcaacaccctgcacgctcaaggttacgtgtccatcggttgcgagccgtgcaccaggccggtcctgccagggcagcacgagcgtgaaggccggtggtggtgggaggacgccaaggccaaggagtgtggcctccacaagggcaacatcgaaaaggacgggcaggcggcggcgcccaagtccgccaacggcaacggctcggcgggcgccccggacatcttcgagagccccgccgtggtgtccctgacccgggccgggatcgagaacctgctgcgcctggagaaccgcgcggagccgtggctggtggtgctgtacgcgccgtggtgccccttctgccaggcgatggaggcctcgtacgtggagctggccgagaagctggcgggttccggcgttaaggtgggcaggttccgcgccgacggcgagcagaagccgttcgcgcaggcggagctgcagctgcagagcttccccaccgtactcctgttcccgagccgcaccgccaggcccatcaagtacccgtccgagaagagggacgtcgactcgctcctcgccttcgtcaacagcctccggtgagaggccgccgccagggagcgagaatcatcgttatctgtctgtgtctgtctgcattgtacttagagagggaaaagggggtactagagagagggaattggggatgataggaagagatggaaggggttcagaaatacttcagatgcagatcgatgatgcatctct

SEQ ID NO: 4252 - DNA, 722 bp, Saccharum officinarum
aaagaaaaaaaacgccaagaaagccaagtcgtttgctcatttcatggagagctcttctcacaagcgggcgcgggaggtggtcgacctcgccgccggaggacccggagaggcctctgcgttgccggaggcagccgacgcgaagaggctgcggccgcaggacctgctggacatgctcgacgacgacaccgacgcggcggccgccggcgacctagcgtccgtcatgcggagcctggaggaggagatagctagcttcgacgaggccgtggccgcgccgacgcagcagcagcagcagccggagctggggttcctgctggaggcctcggacgacgagctggggctgccgccggcgggcgcctccgcctcctcgtcggaagaggccggcggcctcgccggggcgccggagtccgcgggcgccgcgctggacggccagatctggggcttcgaggacgagatagacggaggagagatagacggaggagcaggcttcggtggatactcgccggaggccgcggccgcggccgcggcggcggcggcgtgggacgacgacggcttcgacgccggcctgttcgcattcggcgaaaacgacgcatacgggccgtcggatctcgccgcgctgcgccacgagaccatgccggccgtctgatgctggttcccggcagccgcagccagtggaatagccttgttttcttgcttttggtttacctttggctacctctaccggg

SEQ ID NO: 4253 - DNA, 1677 bp, Setaria italica
accaaaccgcgcggcgcgagttttttgcggaaacccccctgcgagagccgtcgcccacccgcggccaacgctatataaggcggcccccaactcggcgacgctgcgcaaaacacctcgctttttgtactcttccgtctttgccctcgcgctatcgcctccggtgcattgctcggccggcgtgtacttgtacacccagcgagggagggaggagggaaatacaaagaaagaaaagcaagtcttccttcgttcgttcatggagagctcttctcataagcgggcgcgggaggcggcggcggacctctccgccggcgagggcggcgcgctgccggaggccgacgccaagaggctgcggcccgaggacctgctcgacatgctcgacgatgacaccgacgcggcaaccgccggcgacctggcgtccgtcatgcgaagcctcgaggaggagatagccagcttcgacgaggccggagccaccgccgccgctgcgccgccggcgcaccaccagcagcagccggagctcgggttcctgctcgaggcctcggacgacgagctcgggctcccgccggcgggggcctcctcttcgtcggaggacgccggcggcgcggccggggaggagccggacgtggccgccgggctcgacggccagatctgggggttcgaggacgagatagacggaggcttcggcggctactcgccggaggcggccgccgcggccgccgcggcggcggcgtgggacgacgacggcttcgacgccggcctattcgcgttcggcgacgacgcttgcgggccctcggatctcgcggccctgcgccacgagaccatgccggccgtctgatgacgggccccggccggccggctgaccggcccgccagtggattagcgttttttctttttcttgctcttttatttttacccttggctaaccttagctggtactacccttttttttaaccttggtgtaaagtttttagaagggtaaaaacagaggcgtgggaacttgggggaaggttccgacttccgaccgggggaaaagaatctgaaaatggtttccctttttgcccttgggatttatttctcgcctattatatagcatgaaaaaaagaagaaataagctagcgagcaagtaaaatacagcagtgaagtcaaaacaaagatgcggccacgttggttgcgtggatggaggttaatacaatgacatgtggctgctgcaagggtgctgacctactgacgtgacagaccgaaatcttagaaaaaaagatctgcgatgaattgtggactgaaaaattaatggccattgtttttcatcagacaaaaaaataatggatgggaatactcgtaaagttccaccactccagtttgaagaatccgtgaattccaccaatttattttgtaatatactataattaactgccaagaactttacttggatggagaggataattctggccggtatggttgacctggtggaacagagaactgttcgcatttcctgtgaatgcgataagtccacaggaaaagggcgtgagccaccggctgccatggttcggccgttgccgtcgtcgtgaggcaatcgatgggcgcggtggaaatgttcgcgagggaacagcgagcggtggagctgtctcgtgtcaaattctgaacctgagcttcctcatacattttatttttcgtcactgacac

SEQ ID NO: 4254 - DNA, 1532 bp, Zea mays
cattgccatccctaaaccagacagacagtttcggcctcagcccaactggtgccgtgacgtctcctctcctctcttcgtctcatccccagcccacccacaacaatgccctcctcccttcccacctgacctgcgccgcgccgcgccgcgctgcgcagccatccttgttctgtcccgggtacgccgccacacacatcagttcaagcgcttctctccctccctcctcttcgtggatcggaatcgacgcctggaagtggatgacgatggcgggttcttgcgccgcggtgcccgttgccggtctcccctcgttgaggacgccgatgccaactcacctcagacttggcggctttatgccctgttcctcggccgcgcggagtcgcggcgccgccgtgctgggatgcgctcttggggccaggaagcagacgccgggagttctgaaccagttgctctgcagatacatgcgaagagatgggcatgaaggtgatgtgagcaatcaaggaagggatggtgctgttatgtttgggccagatgatgatggtgtaaagattcctactcaggtagagactcttgtaaagggcactgcagcggttgctgaaccagaatacaagcagatcccagatgtagattacctacaggagctgctggctattcagcagcaaggacctcgtgcaataggtttctttggaacccgcaacatgggatttatgcaccaacagcttattgagatcctgagctatgctatggtcataacaaaaaatcatatattcacatctggggcttctggaacaaatgcagctgttattaggggcgctttaagagctgaaaagccagagttgcttactgtaattttacctcaaagtctaaagaagcagcctcctgaaagccaagaactgttgtctaaagtacaaaacttactcgagaaaccacagtatgatcatttgccactaattgaggctagcaggttatgcaatatggacatcatctctaaggtccaacaggtaatctgcttcgcgttccacgacagcaaactgctgatggaaacatgccaggaggccatgaaccttcggaagatcgtgacactcttctacttggattagctccggtagggatctagtctcctttttttttgggtccgtggcgtaggctaacgttggggggataaaaagcaagctgaacagtttagttagtttcggaatatattggataggtggtgcggtgaccttctattggaggagaaagtcattttgtttctcccattgttttgattcttgtcacaaagaaaccaataatcttgtcgatatgcctaattcgtcattgaagggaataagattattagctggagtatatttgttgttgacctcaaggattatagttagttcgtgctccagtttttccatctattttatgtcagtttcctgcttttttatttgagatgagatgtttatcttgattgatgtcttatttttcatttttcaagtgcattattaatatggttatatctttcaaaaagcgagttgggtaaaattaaatttcaa

SEQ ID NO: 4255 - DNA, 1378 bp, Setaria italica
cagcccaactggtgccgtgccgtgccgtctcctctcctctcctctctcgtctcatccccagcccacccagcaatgccctccccctcctcctcccctcccacatgacctgcgccgcgccgcgccgcgcagccaccctcggtttggtcacgggagcgccgccacgcacatcacttcacgcggtggttctccccctccctcctcttcgtagattggaatcggcgggccggatgacgatggcgggttcttgtgccgctgcgcccgttgccggcctcccctcgttgaggacgccgccgccaacgaacctgaggcttggcggattcttccactgctcctcggcctcgcggagccccggcggcgccgtcctgggatggactcagggagccaagaagcagaccccgacgccgccggcagtggcgcggctcaaccggttgctctgcggatacatgcgaagagatgggcacgaaggtgatgtgaggagtcaaggaagagatgatgctattatgtttgggccagatgatgatggtgtaaagattcctactcagacagagactctcgtcaagggtactgcaatggttgctgaaccagaatacaagcctatccctgacctagattacctacaggagctgttggctattcagcagcaaggacctcgtgcaataggtttctttggaacccgcaacatggggtatatgcatcaacagcttattgagatcctgagctatgctatggtcataacaaaaaatcatatattcacatctggggcttccggaactaatgcagctgttatcaggggcgctttaagggctgaaaagccagagttgcttactgtaattttacctcaaagtctaaagaagcagcctcctgaaagccaagaactgttgtccaaagtacaaaacttgattgagaaaccacagtatgaccatttgccactgattgaggctagcaggttatgcaacatggacatcatctcgaaggtccaacaggtgatctgcttcgcattccatgacagcaagctgctgatggagacatgccaggaggccaagaaccttcggaagatcgtgacgcttttctacttggattagcagcttctctacttggattagctcctgctcagggatcttctctcctttttgtccgtggtgggggtaggctgtggtggctggggattaaaaggcaagctgaaaggtttagttagtttcggtataatgggaataggtgtggtgcgatgacctcccactggagaaagtcattttttgtttcacccattgtttcgattcttgtcgcgaataaaccggaggtaatcttgtcgatatgcctagttcggcggtgaaaggaataatattattaaaagtttatttattgttgctgaagatctcag

SEQ ID NO: 4256 - DNA, 1409 bp, Setaria italica
gtccagtctcactccctccctccctctctctcgtctcatccccagcccacccagcaattccctccccctcctctgacatgacctgcgccgcgccgcgcggccatcctcggtttggtcacgagagcgccgccacgcacagcagttcacgcggttctccccctccctcctctgcgtagattggaatcggcggccggatgacgatggcgggttcttgcgccgcggcgcccgttggcggtcttccctcgttgaggacgccgccgcgaatgaacttgagactcggcggcttcttgcactgttcctcggccgcgaggagccccggcggcgtcttgctgggatgggctcaggcgaccaagcagccgccggcagtggcacggctgaaccggttgctctgcggatacatgcaaagagatgggcatgaaggtgatgtgaggagtcaaggaagagatgatactattatgtttgggccagatgatgatggtgtaaagattcctactcagacagagactcttgtcaagggtactgcaatggttgctgaaccagaatacaagccgatccctgatctagattacctacaggagctgttggctattcagcaacaaggacctcgtgcaataggtttctttggaacccgcaacatggggtatatgcatcagcagcttattgagatcctgagctatgctatggtcataacaaaaaatcatatattcacatctggggcttccggaactaatgcagctgttatcaggggcgctttaagagctgaaaagccagagttgcttactgtaattttacctcagagtctaaagaagcaacctcctgaaagccaagaactgttgtccaaagtacaaaacttgattgagaaaccacagtatgaccatttgccactgattgaggctagcaggttatgcaacatggacatcatctcgaagatccaacaggtgatctgcttcgcgttccatgacagcaagctgctgatggagacatgccaggaggccaagaaccttcggaagatcgtgacgcttttctacttggattagcttctaatcggagatcttctctcttttttgtccgtgaggtaggctggtggtggggggaaaagcaagctgaacggtttagttagttcctatattatggtataggtgctgccatgaccttccattggagaagaaagtcatttttggtccaccaattgttttgattcttgtcacaaataaacagataatcttgtcgatatgcctagttcgtcagggaaaggaataagattataagttcaagtttattgttgctgacctcaggcttataattagttgaggccccaggttcatcggctctttcatgcctgtttggctgttttcctttctccctctgatgaaatattctcaactttttgctatcttgatggatatctt

SEQ ID NO: 4257 - DNA, 1290 bp, Panicum virgatum
cccagcaatgccctccccctcgtcctcccctcccacatgacctgcgccgcgccgcgcagccatcctcggtttggtcacgggagcgccgccacgcgcaccacttcacgcggttctccccctctctcctcttcgtagattggaatcggcgggccggatgacgatggcgggttcttgcgccgcggcgcccgttgccggccttccctcgttgaggacgccgccgccagcgaacctgagacttggcggcttctcgtactgttcctcggccgcgcggagcccccggcggagccctgctgggatggactcaggaggccaagaagcagaccacgacgccgccggcagtggcgcggctgaaccggttgctctgcggatacatgcgaagggatgggcatgaaggttatgtgacgagtcaaggaagagatgatgctattatgtttgggccagatgatgatggtctgaagattccaactcagacagagactctcgtcaagggtactgcaatggttgctgaaccagaaaacaaggcgatccctgatctagattacctacaggagctgttggctatccagcagcaaggacctcgtgcaataggtttctttggaacccgcaacatggggttcatgcatcaacagcttattgagatcctgagctatgctatggtcacaacaaaaaatcacatattcacgtctggggcttccggaactaatgcagctgttatcaggggcgccttaagagctgaaaagccagagttgcttactgtaattttacctcaaagtctaaagaagcagcctcctgaaagccaagaactgttgtctaaagtacaaaacttgattgagaagccacagtatgaccatttaccattgattgaggctagcaggttatgcaacatggacatcatctcgaaggtccaacaggtgatctgcttcgcgttccatgacagcaagctgctgatggagacatgccaggaggccaagaaccttcggaagatcgtgacgcttttctacttggattagctcctgatcagggggtcttctctcttttttttgtccgtggggtaggctggcggtagtggaagaaaaggcaagctgaacggtttagttagtttcgaaatatgggataggtggtgcgatgaccttccattggagaaggaagtcatttttgtttcgccaattattttgattcttgtcacaaataagcagattatcttgtcgatatgcctagttcgtcagtgaaagggaataagattataagttaaagtttattgttgctcatttcaggtttttaatttgtttt

SEQ ID NO: 4258 - DNA, 762 bp, Zea mays
aaaacgaaacggctaagaaatccccaccttcacttcacccacaaactagccggacaagcgaacaaaaggtgtaagagcttacgaccgacgcggccaaatagagataagagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgcggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatagggagcgttgtgttaacaaaggagacaactgtgcaagctactggagtagcctcgaacctggtggaagctatccagggagctgggttcaagctgcaaactctaagcttgagcttcgatgatttcgacgagccagcagcaggagcgggaggcactgtccaatccagcgagtgagctaatttgtggtgccgtgcgtggtgccaaatgcatataattcggtctcctgattttgtttaccctgctccttacctttgatttcccaagcacgatcttgttttttttttggcaaatggtcgagaaatcaatgaatatttttaaggaaaaacatttgttttt

SEQ ID NO: 4259 - DNA, 837 bp, Setaria italica
ctttcccacaaacgagtcggccaagcgaacaaagagggaagctaagcaagcaagaactgaagcagccaaattgagataagaggcggaggaggaaggagccgctctggacaagatgatgtcgttgccggcctccacccacctgctcccctcggccgccgcggtatccctcctccctcgccgcgtctcccttcagctctcctacgccactgggtggagggcaggaagccgccgcccggcggtggtgcgcgcggccacggcggaggcggcggcgcccgcctacacgtccgactccctcatcctctacttcaaggcggagggcaccatggaagagagggctattcccaagatcaccgaatcactcgagggtatggagggggtcaaggacttggaggtgctcatcgaagaaggcattgcaagtgttgtgttaacaaaggagacaactgtacaagctacgggtgtggcatcgaacctggtggaagccatccagggagctgggttcaagctgcaaacactaagcctcagcttcaacgatttcgatgaggcaacagcaggagtaggaggtggtgtccaatccagcgagtgagctaatttgtgttgccctttgctgagccaaatgcatataactcgctctcatccttggtggttccttctgattttgtttagtttctgtaccctcttgccccttgccttgtaatttttgagcacggcctcataatttctagcaaattgtcaagaaagctatgattcttttttgtactgttgttttatcttgaatcacagctgttgtataagttaatctatggaacgttaatatttcaggttgaactagattagcta

SEQ ID NO: 4260 - DNA, 975 bp, Saccharum officinarum
gcctacgaccgacgcggccaaaccgagataagagcaagataatgtcgtcgacggcgtttagccacctcttcccctccgccgccgtcgccgctgtatccctcctccctggccgcgtctccctgcagctcttctgcaacagcggtgaagttgcccctggatggaggagaagaagcccccgcatggccgtagtgcgcgcggccaccgcggacgcggcggcgcccgcctacacctccgactccctcatcctctacttcaaggcggagggcaccatggaggagagggccattcccaagatcactgagtctcttgagggtatggaaggagtcaaggacctagaggtgctcattgaagaaagcataacgagtgttgtgttaacaaaggagacaaccgtgcaagctactggagtagcctcgaacctagtggaagctatccagggagctggggtcaaactgcaaacactaagcttgagcttcgacgatttcgacgacataacagcagcaggaggcaatgtccaacccagcgagtgagctaatttgtgctgccgtgcggagtgccaaatgcatataattctgtcgggtacttttacattttgtttaccccgttgctccttgcctttaatttcccgagtacgcccttgtaactttttgcaaatggtgaagaaatcaatgattcttttctaaaaacaacttttgattatttgattcaccggtgtcgtgtaagtttatttttggaaggttaatctttttaggtcgaagtagtttagcttgttttttttagggttcgaagaagtttagctagcctagccattttggttgatccgtgaagttagtcgtggtgttcttttgccagcacgtccaatcgttgggaattctgggccgaaactgccttaatatcctatccttgtttgttttggctcaaaacaaaatgaatgcgtaccaaaccgtgccacctgaacacccaaaagcccagttgccc

SEQ ID NO: 4261 - DNA, 1870 bp, Zea mays
catcctcctagtttttttcttttctatttttcagctaaccttatcttcttcccgcgtcctttccagcctcccgtcccgtgtggcgtctggcgtgtgcgcacgcacctccccaggccccagtgccaccttccctcctcggctcgacccgcccggcgctccgccgcagctggctcatcccaatcccctcgtacagtcgtgctccgcgcccgcttcaccgcctgaacaaagatggaggccttcctagccggcctcttcagggcgcctccacgggccgtccccgcccctcggggcacgcctctccccagccttcctctcttctacggcaggcgccgcaggaggccgtcctcctccgtggtctgcatggcggagccctatctgattgccaagctggactctgcggagaaggcctggaaagaaatgtcggttaggttggcagatcctgacattgtctcggatccaagcgaataccaaaaaatcgcgcagtctgtttctgaactggatcaggtcgtgaccacatacaggcaattcaaggattgtgagaggcaacttgaagcgacaaaagctctggaaaaagagaacgaaggtgaccccgatatgttagagatgatagcttctgagttggaggctctatctaaccagctcgcagagcttgaagaaaaaatgaagtttctactgcttcccagcgatcctctagattcacgcaacatcttacttgaagtaagagcaggtgctggtggtgatgaagctgggatttgggctggtgaccttgtaggttcgcatgtaccagagatactgtgagcgcaacaattggaagtttaagccagtttcttgctcagaagcagaaatgggtgggtacaagacatacgtgatggaggtcaaggggaaacaagtctatagtaaactgaagtttgagtcaggtgtacaccgtgttcagcgtgttcccttgacagaggctatgggtcgtgttcatacgtcaacagcaactgtagctattatgccagaggctgatgaagttgatgtggttattgatccgaaagatattgagcttaaaacagcaagatctggtggagctggagggcagaatgttaacaaggtggagacggctgttgatcttattcacaagccgacaggaatacggatattctgtacggaagagagatcacagctacagaacagagagcgggcatttcaattgttgagagcaaaactttacgagataaaattaagggagcaacaagaatcattaagaaaccagaggaaattgcaggttggtactggtgcccgatccgagaagataaggacgtacaactacaaggataacagagtgacagaccatcgcttaaagatgaactttgagctgacaagcttccttttaggagacatcgaatcggctattcagtcttgtgctacgatggagcagcaggagctgttggaggaaatggccagttccgtgggcgcagtaaacgtatgattcaggcaaattcggcgttgaggccaggccatcaaactgaaccgcgaaactcatgacgtgctcggactcggtgaagatgattgatagctgtacatgaagaaaactgacaagatgaactccccccataggaactttttccccccctgtagtccgcagggtacaacacacacccacccatgcatctcagcttccttgacggcagcagagttactagtagaaaatatacatggtttgtgcagttcaacgcttcaactgctccagtattcacagtttaatgcattttaggtatgttgctccagtttctcaacaattcactgcttgcaattaaatctacagagcaaagttctcagctagctacatttgaaccaatcaatcaaccacttttctttttgaaacgag

SEQ ID NO: 4262 - DNA, 1591 bp, Setaria italica
ctgctgctgctgctttgcatccccacctctcgtgctcctcctcctcctcctcccccgcctcaccaccatggaggccttcctcgccggcttcttcagggcccctccccgctgcggccccgccgctcgcgctgctccgaccttctccggccttcctctcttccacggcaggcggcgcaggcggccctcctcctccgtggtctgcatggcggagccgtatctcatagcgaagctggattctgcggagaaggcctggaaagaaatgtcggttaggttagcagatcctgacattgtctcagatcctagcgagtaccaaaaacttgcgcagtctgttgctgaactggatcaggttgtgactacatacaggcagtttaaggattgtgagaggaacctcgaagagacaaaagctttggaaaaggagaatgaagaggaccctgatatggctgagatgatagcttcagagctagaggctctatctaaccagcttgcagagcttgaggaaaaattgaagttactactgattcccagcgatcctctagatgcacgcaacatcttacttgaagtaagagcaggcgctggtggtgatgaagctggaatttgggctggtgaccttgtacgcatgtatcagagatattgtgagcggaataattggaagttcaagccggtttcttgctcggaagcagagatgggtggatacaagacatatgtgatggaggtcaagggaaaacaagtctatagtaaattgaagtttgagtcaggcgtgcaccgtgttcagcgtgttcctcagacagagactatgggacgtgttcatacgtcaacagcaactgtagctattatgccagaggctgatgaagttgatgtggttattgatccaaaagatattgagcttaaaacggcaagatctggtggagctggagggcagaatgttaacaaggtggaaacggctgttgatcttattcacaaacctacgggaatacgtatattctgtacagaagagagatcacaacttcaaaacagggagcgggcatttcaattgttgcgagcaaaactctacgagataaaattaagggagcaacaagagtcaataagaaaccagagaaaattgcaggttggtactggtgctcgatctgagaagataaggacgtacaattacaaggacaaccgagtgacagaccatcggttgaagatgaattttgaactgactagcttccttttaggagacattgaatcggctgttcagtcttgtgctacattggagcagcaggagctcttggaggaaatggccagttctgtgggcgtggcgaaggtatgatttgcggaattggcccctgagaaataggtcatcaaactgatggtgtgtttaaacggatgaaaattggtgtataagctgtagatgaagaaatccgacaaaactccacataggcacattttttcagtagttcatgatcatggtcatgactaatgtgacagaacatagcaatgcatctcagcttccctgctggtggcaggtttttgagtggtagaaaatagacatgcttgtacaattcgactgctccggttttcataattcaatatacttcaaatatgctgttcg

SEQ ID NO: 4263 - DNA, 1665 bp, Oryza sativa
agctgctactgctcctcttctcatcgccacgctacctctcaatggaggccttcctcgccggcttccgggcgccgcggccgcgggtcccggccgtctccgccgccgcccggagcctccctcccaacacctccttcttctccggcggaaggcggcgcaggaggcttctttcctcatcggtggtctgcatggcggagccctatctcatagcaaagttggattctgcagagaaggcttggaaggaaatgtcggttagattggctgatcctgatatagtttcggatcccagcgagtaccaaaaacttgcacaatcagttgctgaactagatcaggttgtgagtacgtacaggcagtttaaggactgtgagaagcaaattgaagaaacaaaagttttgcaaaaagagaatgaagatgacccagatatggcagagatgattgattcagagatggagtctctatctaaccagcttgaagagcttgaggaaaaactgaagttactactgcttcccaatgatcctcttgatgcacgcaacatcttacttgaagtaagagcaggtgctggtggtgatgaagctggaatttgggctggtgaccttgtgcgtatgtatcaaaaatactgtgagcgcaactcctggaagttcaaaccagtttccagctcagaagcagaaaagggtgggttcaagacatatgtgatggaggtgaagggcaaacaagtctacagtaaactgaagtttgagtcaggtgtacaccgtgttcagcgcgttcctcagacagagactatgggccgtgttcacacatcaacagcaactgtagctattatgccagaggctgatgaagttgatgtggttatcgatccgaaagatattgaactcaaaactgcaagatctggtggagctggagggcagaatgttaacaaggtggaaactgctgttgatcttattcacaaacctacgggaattcggatattctgtacagaagaaaggtcacaactccaaaatagagaacgcgcattccaattgttgagagcaaagctttacgagataaaattacgggagcagcaggaatctataagaaaccagaggaaactgcaggttggaactggtgctcgttctgagaagataaggacgtacaattataaggacaacagagtgacagatcaccggttgaagatgaactttgaactcactggtttcctcatgggagatatcgagtcggctgtgcagtcctgttcttcaatggagcagaaggaactcctggaggagatggccacatctgtgggcgcagcgaaggtatgatcagcgcgatcgatctgtctgcagtcctccttccacctgagtaccagaccatcagatagaaatcatccaatggacattgtgttgaaacgggtggtgatcaatggacaaatgtacatgaagaaatccgaagatacatatacatatgcttccgttgctcatgagcatgactaatgtcagaaaacacactgatgcattttcagttcctcttacagttacaaattttgagtagttggatatatgcaatgtgtacatctcaacagttgcatagctacaatatgcattatgcacaattcaacctgttaatagatgggaatgaattatggtgatttgtcaatgtgttcaattgaaatgaatgtgttaaatgatgggtagc

SEQ ID NO: 4264 - DNA, 1569 bp, Triticum aestivum
cctcggcagaaaagaaagatggaggccttcctcgccggcttccgggcgccgcctcgagcttccgccgtacccaccgcccggagcccacctcccagccccttttttctcggcacacggcgcaggaagccctcctcctccgcctccgtggtctgcatggcggagccacatctcatatcaaagttggattctacagagaaggcatggaaagaaatgtcgattagattgggtgaccctgacattgtctcagatccaagcgaataccaaaaacttgcacagtctgtttccgatctgggagaggttgtgacggcatatagggaatttaaggaatgtgaaaggcagattgaagaaacaaaagctttgcaaaaagagaatggtgatgaccctgatatggctgagatgatagcttcagagctagagtctctctctgatcagcttgcggagctcgaggaaagactgacggtacttctgcttccaagcgaccctctaaattcacgtaacatcttacttgaagtaagagctggcactggaggtgatgaagctggaatttgggctggtgaccttgtacgcatgtaccaaagatattgtgagctcaacaattggaagtttaaaccagtttcttgctcagaagcagaaaagggtggatacaagacatatgtgatggaggtgaagggaaagcaagtctacagtaaactgaagtttgagtcaggtgtgcaccgtgttcagcgtgtaccacagacagagactatgggtcgtgttcacacgtcaaccgcaactgtggctattatgccagaggccgacgaagtggacgtggttattgatccaaaagatattgaacttaaagctgccagatctggtggagctggagggcagaatgttaacaaggtggagactgctattgatcttattcacaagcctacgggaataaggatattctgcacagaagaaaggtcacaacttcaaaacaaagaacgcgcgttccagttattaagagcaaaactatatgagataaagttaagggagcaacaagagtccataagaacccagaggttactgcaggtcggtactggtgctcgctcggagaagatacggacgtacaattataaggacaacagagtgactgatcatcggttgaagatgaattttgtattgtctagcttccttttaggagatattgaatcagctgttcagtcctgcgctgcattggagcagaaggaactcttggaggaaatggccacttcttctgcagtgaaggcgtgatcaggttaactattccttttgcttctagccatatcctaaaggagaacagatccaatggcatcttacagtcgatggagatcgacgaccaagatgtacatgaaaaaactcgcgagtagcgaatcatattccttgcgtgcacacactcttctgtttgctcatggtcattttgcatatacactagtgtctgtagacaatttaatgcactccagttgccctgatgggagcagattttgagtagctccaaccgacatttcttctaaaatacagcggggacactggttgaaatctacaaaaaaaaaaaaagggcggccg

SEQ ID NO: 4265 - DNA, 1719 bp, Brachypodium distachyon
ctcggctgttctatcctcagctcgccatcaccacctctcgtcctcccccccgctgcaagaaaagatggaagctttcctcgccggcttccgggcgccgcctcgggctccgaccgcatccaccgcccggagcccgcctcccagccccttcttcctcggctccaagcggcggaggaagccctcctcctccgtggtctgcatggcggagccccatctcatatcgaagctggaatctacggagaaggcatggaaagaaatgtcggctagattgggtgaccctgacattgtctcagatccgagcgaataccaaaaacttgcacagtctgttgctgatctgggcgaggttgtgagtgcatatagacaatttaaggagtgtgagaggcagattgaagaaacaaaagctttgcaaaaagagaatggagatgaccctgacatggcagagatgatagcttcagagctggagtctctctctaaccagctcgcagagctcgaggaaaaactgacggtactgctgcttcccagcgatcctcttaattcacgcaacatcttgcttgaagtaagagcaggcaccggcggtgatgaagctggaatttgggctggtgaccttgtgcgcatgtatcaaaaatattgtgagctcaacaattggaagtttaaaccagtttcttgctcagaagcagaaaaaggtggatataagacgtatgtgatggaggtgaagggcaaacaagtctacagcaaactgaagtttgagtcaggcgtgcaccgtgttcaacgtgttccacagacagagactatgggccgtgtccacacgtcaaccgcaactgtagctattatgccagaggccgatgaagttgatgtggttattgatccaaaagacattgaacttaaaaccgcaagatctggtggagctggagggcagaatgttaacaaggtggaaacagccattgatcttattcataagcctacgggaattaggatattctgtacagaagaaaggtcacaacttcaaaataaagaacgtgcattccaattactgagagcaaaactatacgagattaagttaagggaacaacaagagtcgataagaacccagaggttactgcaggttggtaccggcgctcgttcggagaagatacggacgtacaattataaggacaacagagtaactgaccatcggctgaagatgaatttcgtattgtctagcttccttataggagatatcgagtcggctgttcagtcctgtgctgcgatggagcaaaaggaactcttggaggaaatggctacttcttctgcagtgaaggcatgatcagccaattattccttttgcttcaagcagaccctgtaaaaggacacccaaggacattttacaaccgacagagatcgtgaccaagaccaagttgtacacgaagcaactcggcgattggatttcctcacatacacgcttattgttttgttcatgatcactttgcatatacactaatatcgtgagacataatgctacacttgaagagatctctggtggcagcagattttgactagttggaagtagacatgctgtgtacaactgaaaatagacatgggttgcatactgttgatttttcttatgggtcagcagattttgactagttggattttttattaaatccatcatgatacatatcttatacttatttatacatttttctataaatttgatcaaactttaaaaagtttgaattaggacct

SEQ ID NO: 4266 - DNA, 1614 bp, Brachypodium distachyon
ctcgccatcaccacctctcgtcctcccccccgctgcaagaaaagatggaagctttcctcgccggcttccgggcgccgcctcgggctccgaccgcatccaccgcccggagcccgcctcccagccccttcttcctcggctccaagcggcggaggaagccctcctcctccgtggtctgcatggcggagccccatctcatatcgaagctggaatctacggagaaggcatggaaagaaatgtcggctagattgggtgaccctgacattgtctcagatccgagcgaataccaaaaacttgcacagtctgttgctgatctgggcgaggttgtgagtgcatatagacaatttaaggagtgtgagaggcagattgaagaaacaaaagctttgcaaaaagagaatggagatgaccctgacatggcagagatgatagcttcagagctggagtctctctctaaccagctcgcagagctcgaggaaaaactgacggtactgctgcttcccagcgatcctcttaattcacgcaacatcttgcttgaagtaagagcaggcaccggcggtgatgaagctggaatttgggctggtgaccttgtgcgcatgtatcaaaaatattgtgagctcaacaattggaagtttaaaccagtttcttgctcagaagcagaaaaaggtggatataagacgtatgtgatggaggtgaagggcaaacaagtctacagcaaactgaagtttgagtcaggcgtgcaccgtgttcaacgtgttccacagacagagactatgggccgtgtccacacgtcaaccgcaactgtagctattatgccagaggccgatgaagttgatgtggttattgatccaaaagacattgaacttaaaaccgcaagatctggtggagctggagggcagaatgttaacaaggtggaaacagccattgatcttattcataagcctacgggaattaggatattctgtacagaagaaaggtcacaacttcaaaataaagaacgtgcattccaattactgagagcaaaactatacgagattaagttaagggaacaacaagagtcgataagaacccagaggttactgcaggttggtaccggcgctcgttcggagaagatacggacgtacaattataaggacaacagagtaactgaccatcggctgaagatgaatttcgtattgtctagcttccttataggagatatcgagtcggctgttcagtcctgtgctgcgatggagcaaaaggaactcttggaggaaatggctacttcttctgcagtgaaggcatgatcagccaattattccttttgcttcaagcagaccctgtaaaaggacacccaaggacattttacaaccgacagagatcgtgaccaagaccaagttgtacacgaagcaactcggcgattggatttcctcacatacacgcttattgttttgttcatgatcactttgcatatacactaatatcgtgagacataatgctacacttgaagagatctctggtggcagcagattttgactagttggaagtagacatgctgtgtacaactgaaaatagacatgggttgcatactgttgatttttcttatgggtcagcagattttgactagttggattttttatt

SEQ ID NO: 4267 - DNA, 1658 bp, Triticum aestivum
ttgttctatcctgaactcgccatcaccacctctcgtcctcttcctcggcagaaaagaaagatggaggccttcctcgccggcttccgggcgccgcctcgagcttccgccgtacccaccgcccggagcccgcctcccagccccttttttctcggcacacggcgcagtaagccctcctcctccgcctccgtggtctgcatggcggagcgacatctcatatcaaagttggattctacagagaaggcatggaaagaaatgtcgattagattgggtgaccctgacattgtctcagatccaagcgaataccaaaaacttgcacagtctgtttccgatctgggagaggttgtgacggcatatagggaatttaaggaatgtgaaaggcagattgaagaaacaaaagctttgcaaaaagagaatggtgatgaccctgatatggctgagatgatagcttcagagctagagtctctctctgatcagcttgcggagctcgaggaaagactgacggtacttctgcttccaagcgaccctctaaattcacgtaacatcttacttgaagtaagagctggcactggaggtgatgaagctggaatttgggctggtgaccttgtacgcatgtaccaaagatattgtgagctcaacaattggaagtttaaaccagtttcttgctcagaagcagaaaagggtggatacaagacatatgtgatggaggtgaagggaaagcaagtctacagtaaactgaagtttgagtcaggtgtgcaccgtgttcagcgtgtaccacagacagagactatgggtcgtgttcacacgtcaaccgcaactgtggctattatgccagaggccgacgaagtggacgtggttattgatccaaaagatattgaacttaaagctgccagatctggtggagctggagggcagaatgttaacaaggtggagacggctattgatcttattcacaagcctacgggaataaggatattctgcacagaagaaaggtcacaacttcaaaacaaagaacgcgcgttccagttattaagagcaaaactatatgagataaagttaagggagcaacaagagtccataagaacccagaggttactgcaggtcggtactggtgctcgctcggagaagatacggacgtacaattataaggacaacagagtgactgatcatcggttgaagatgaattttgtattgtctagcttccttttaggagatattgaatcagctgttcagtcctgcgctgcattggagcagaaggaactcttggaggaaatggccacttcttctgcagtgaaggcgtgatcaggttaactattccttttgcttctagccatatcctaaaggagaacagatccaatggcatcttacagtcgatggagatcgacgaccaagatgtacatgaaaaaactcgcgagtagcgaatcatattccttgcgtgcacacactgttctgttttctcatggtcattttgcatatacactagtgtctctagacaatttgatgcactccacttgccctgatgggagcagattttgagtagctgaaatcgacattttttttacaacaaagcggtgacactggttgaaaatatacataaaagttctgtgtggttgaagtcctgaagagtggtgatgtgtctgtgggtaatctgtgcaccagga

SEQ ID NO: 4268 - DNA, 1195 bp, Zea mays
ccacccactgctttcagctttccatcttccatttccaccctcttcctcacgcatccgacgctataaaatccaatccaaccccgtgcaagctccaaataccatagccctcctagtcctggcagcaccacactctcgcgctcctctcgggcaggaaaaaaaaaagaagatcggtgtggttgcgcctagcttcccgcgaagcgagacgtcacgggcgtagcgtagtagagctagcaagccataccatacatatcccaccgattccgatcggcatggccgggagcgcgaggtcggcggccgcgaagcacgcgtaccggatgttcgtcgcgccgtccaggggcggcgccgcggcgaggggccccggcgccggcgccgcggaggagttcgacgagtcggacgtctggggctcgttcggcgcggactcccagtactccagccccggggccgagctgggcgccggctgggcgcgcccgatccccggctccggcgccaggcggaagaagcccgtggacggcggcggcggcggcggcggggtcgctgccgatgaacataccggactggcagaagatcctcggggtggagtaccgggaccaccaccgcgcgggcgagtgggagcctggcgcggacgacgacgacgacgacgacggcagcagctacggcagggcgcgcggcggggcggagatggtgccgccgcacgagctggcgtggcgcagccgggcggcgtcgctgtcggtgcacgaggggatcggcaggacgctcaaggggcgcgacctcagccgggtccgggacgccgtctggaagaagaccggattcgaggactgagctagcgctgatccaccgccatgatcgggtgtaggtatcggtaggttagaaaaacgagcagtgctgcactaattgctttatctctcgatcgactttttttttcttgctatcacttttctttttccccttttgcgttgcatgcttaaaaggggagaaagtcgaggtagtaagcttttttttcttcttcctgtttttcgttcgtgttggtgcgagctggagggtgggggtgtgtgttcattcatggtgtgacagttttaagggcacctggaaaagagagagagagagaggacgaacagtacgatcgatcagatggttgatccattatattatgtttttttcccttctttcgataatggaaaaattttcaattctatct

SEQ ID NO: 4269 - DNA, 1991 bp, Panicum virgatum
cccactcgccgaggtccatgtgacctcacttacctcacctgtcagaccagctttagctttgctttgcctgccgctgccgggatccgaggagatggaggcggggacgtggtgggcggtggccgcggcggccgtggccgtgtacatggcgtggttctggcggatgtcgcgcgggctcagcgggccgcgggtgtggccgctggtcggcagcctcccggggctggtgcggcacgcggaggacatgcacgagtggatcgccgccaacctgcgccgggccgggggcacgtaccagacctgcatcttcgccgtgcccggggtggcgcgccggggcggcctggtcaccgtcacctgcgacccccggaacctggagcacgtcctcaaggcgcgcttcgacaactaccccaagggccccttctggcacgccgtgttcggggacctgctgggcgacggcatcttcaactccgacggggagacgtgggtggcgcagcgcaagacggccgcgctcgagttcaccacccgcaccctgcgcaccgccatgtcgcgctgggtctcgcgctccatccacggccgcctgctgcccatcctgggcgacgccgccgccgacggcgcggccgtcgacctccaggacctcctgctccgcctcaccttcgacaacatctgcggcctcgcgttcggcaaggaccccgagacgctcgccaggggcctgccggagaacgacttcgcctcggccttcgaccgcgccacggaggccacgctcaaccgcttcatcttccccgagtgcgtgtggcgctgcaagaagtggctgggcctcggcatggagaccacgctggcgcgcagcgtccgccacgtcgaccgctacctctccgccgtcatcaaggcgcgcaagctcgagctcaccgccggcaggaagggcgacgacacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctcgtctccacgcaccccgccgtggagcgcaaggtcgtgcgcgagctctgcgccgtcctggccgcgtcccgcggcgtcgacgacccggcattgtggctcgccgcgccctttgacttcgaggagctcgaccgcctcgtctacctcaaggccgcgctctcggagacacttcgcctgtacccgtccgtgcccgaggactccaagcacgtggtcgccgacgacgtcctcccggacggcaccttcgtgccggccggttcgtcggtcacctactccatctactccgcggggcgcatgaagacggtgtggggcgaggactgcctcgagttccgccctgagcgctggctgtcggccgacggcaccaggttcgagccgcacgactcgtacaggttcgtggccttcaacgccggcccgcggatatgcctgggcaaggacctcgcgtacttgcagatgaagaacatcgccgggagcgtgctcctccgccaccgcctcgccgtcgcgccgggccaccgcgtggagcagaagatgtcgctcaccctgttcatgaagcacgggctccggatggaggtgcgcccgcgcgacctcgcacccttcgtcgacgagctccgcggcgcgggggcggagtacgacgcggcggccagggccaccgcggcctgcgcgtagaaagatcggtcgacggatcaccccgccggcgaccgcatgcgccgatgatcgtgcccgcgggctgagaaggaaggaacagttgggaagggaaaaaagacaaatcaaaagttatgtagatagacagcaagtaattaatgggttggtgagctatattagtccatttggaacaaaaatgattgtgtaaaaaagtccatatcattttgatttggattgaagaaaaaaaaaagaagaagcccggagagcaataatctctgatgtaatctgaagcggcggcggatgcgcc

SEQ ID NO: 4270 - DNA, 2385 bp, Zea mays
ccccgcgcaagtaggtgaggaaagccgaggctccagctgcccgtcgggtttggagcggtccgctcgaccaaccaacgacccctgacggcaatttatgggtgggttagttccggtccggtccggcttcagtcgactccacgcagcagcagccactctgctaggggcagccgtcggtcagtggagtgttgtgggtattgattgccgtccgtcgacggcttcaatcgctgcccgttccggtgcgactgcccgactgctatataggcatgcacatagcctcgcgctctatcgcaaccctgcactgcgtgcgctccatgtgactctcacttatttctcctgtcagcgcagcagcagcagcagcagcctactactactactactgcttttaccggccggtggatcggatcaccaaaccggaacgacagcgatggaggccgggacgtgggcggcggcggccgtggcggccgtggcgctgtacgtggcctggttctggcggatgtcgcgcgggctcagcgggccgcgggtgtggccgctgctcggcagcctgccggggctcgtgcagcacgccgaggacatgcacgagtggatcgccgccaacctgcgccgcgcggggggcacgtaccagacctgcatcttcgccgtgcccggggtggcgcgccgtggcggcctggtcaccgtcacgtgcgacccccggaacctggagcacgtcctcaaggcgcgcttcgacaactaccccaagggccccttctggcacgccgtcttcagggacctgctcggggacggcatcttcaactccgacggcgacacctgggtggcgcagcgcaagacggccgcgctcgagttcaccacgcgcacgctccgcaccgccatgtcgcgctgggtctcccgctccatccacgcccgcctgctgcccatcctcgccgacgcgcacgtcgtcgacctgcaggacctcctgctccgcctcaccttcgacaacatctgcggcctcgccttcgggaaggaccccgagacgctcgcccggggcctccccgacaacgccttcgcctccgcgttcgaccgcgccacggaggccaccctcaaccgcttcatcttccccgagtgcgtctggcgctgcaagaagtggctgggcctcggcatggagaccacgctggcgcgcagcgtccgccacgtcgaccgctacctctcggccgtcatcaaggcgcgcaagctcgagctctccgccgccacgaggaaggacctcctctcggccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctggtctccacgcaccccgccgtggagcgcaacatcgtgcgcgagctgtgcgccgtcctggccgggtcccgcggcgtcgaggacccggcactgtggctcgccgcgcccttggacttcgaggagctcgaccgcctcgtctacctcaaggcggcgctctccgagacgctccgcctgtacccctccgtgcctgaggactccaagcacgtcgtcgccgacgacgtcctcccggacggcacgttcgtgccagcgggctcctcggtcacctactccatctactcggcggggcgcatgaagacggtgtggggggaggactgcctccagttccgccccgaacgctggctgtcggacgacggcaccaggttccagccccacgactcgtacaggttcgtggcgttcaacgccggcccgcggatatgcctgggcaaggacctcgcctacctgcagatgaagaacatcgccgggagcgtgctcctccgccaccgcctaaccgtcgcgccgggccaccgcgtcgagcagaagatgtcgctcacgctcttcatgaagcacgggctccgcatggaggtgcgcccgcgcgacctcagcgtcgtcatcgacgagctccgcggcgccggggagtacgacgcggcggcaagagccaccgcggcctccgcatagaggttcgtgcagtgcaggtcgggaaggaaaccaacggacagattggaaacgtcaaatgaaaagttatgtagatattgacagtaagtaattaaagagtttggtgaggtatattactcaattgggaacaaaaatgcatgtgtaaaaagtccatatcattttgatttgcatttgaatgggaggacgaagaaaagcgggccggagagcaataataactctctcatgtaacctgacggggaggcgccaaattggtttcggcagcttgtgttaatgggccgccaaaactgttgttgtttgtaaaaacaaaactcaagcgatcattcattcgatcacttttagcctttatttggatc

SEQ ID NO: 4271 - DNA, 2557 bp, Oryza sativa
cgcgcgccattgaaatcacggcttcaattcggtgtgccgcccgccgatgcattgaatggcgtaggtgagagccgcagcgaccggcaggcaggcaagcgacgcgcgcgcactggccgcgccgcgccttcgatcgatcgacggccacccaacggcccctgccggcgatttatggtccgcccggacgctcgatatatactgtaccgagcatgcacttgcagctggagtagagtggcatcctggcaactctgtatatatatatttttcccttctgtatattaattgccatccatcgcattgcttctcgggcaggttctactcctatatatcgtctcgcttctctctctcgatctcaggtcaggggcgctagctggccactggcgactcacacagtcacacacacacacactctctcgtccttgctgctagctatctatcgctgcttgccccggcccatgcatgtgagctcacttattatagatcgatcgccatagcctagcttggtggtggtggtggtgatggaggcggggacgtgggcggtggtcgtggcggccgtggccgcgtacatggcgtggttctggaggatgtcgcgcgggctgagcgggccgagggtgtggccggtggtggggagcctgccggggctggtgcggcacgcggaggacatgcacgagtggatcgccgccaacctccgccgcacgcggggcacctaccagacgtgcatcttcgccgtgcccgggctggcgcgccgcggcgggctggtcacggtgacgtgcgacccgaggaacctggagcacgtcctcaagtcccggttcgacaactaccccaagggccccttctggcacggcgtgttcggggacctcctcggcgacggcatcttcaactccgacggggagacgtgggtggcgcagcggaagacggcggcgctggagttcaccacgcgcacgctgcgcaccgccatgtcgcggtgggtgtcgcggtccatccacagccgcctgctgcccatcctgtccgacgccgccgcggccggtggcggtggcggcggcgccaccgtcgacctccaggacctcctcctccgcctcaccttcgacaacatctgcggcctcgcgttcggcaaggaccccgagacgctcgcccgcggcctgccggagaacgacttcgcctcggcgttcgaccgcgccaccgaggccactctcaaccgcttcatcttcccggagtgcgtgtggcggttcaagaagtggatggggctcggcatggagaccacgcttgcgcgcagcgtccagcacgtcgaccgctacctctcggcggtcatcaaggcgcgcaagctcgagctcgccgccggcaacggcaagggcgacgcgtcgtcggccacgccgcacgacgacctcctgtcgcgcttcatgcggaaggggacctactccgacgagtcgctgcagcacgtggcgctcaacttcatcctcgccggccgcgacacctcctcggtggcgctctcctggttcttctggctggtctccacccaccccgccgtcgagcgcaagatcgtccgcgagctctgcaccgtcctggccgcgtcgcgcggcgccgacgacccggcattgtggctcgccgcgccgctcaacttcgaggagctcgaccagctcgtctacctcaaagcggcgctctcggagaccctccgcctgtacccctccgtgccggaggactccaagcacgtcgtcgccgacgacgtcctccccgacggcacgttcgtgccggcggggtcgtcggtcacgtactccatctactccgcggggcgcatgaagacggtgtggggcgacgactgcctggagttccggccggagcggtggctgtcggccgacggcacgaagttcgagccgcacgactcgttcaggttcgtggcgttcaacgccgggccacgcatttgcctcgggaaggacctcgcgtacctgcagatgaggaacatcgccggcagcgtgctcctccgccaccgcctggccgtggcgccgggccaccgcgtcgagcagaagatgtcgctcacgctgttcatgaagcacgggctccggatggaggtgcgcccgcgcgacctcgccccgatcgtcgacgagctccgcggcgccggggagtacgccgccgcggcgcgcgccaccgcggcctgcgcttagaagatcccgggcgttggacgaagtcaattggaaatggcaaaaaaatatgtagatagatgagagtccaagatagtaattactaaagggtttgtatggttggtgaggtcatttaaatcacttgcttttacagttcattaccagtcgatagaggaaatgtctaaagaaaactccaaacctaagattcttagatcatgtagtactatgattttggttgtgcagccaccaaaattaaggagcaataattaataattaatctcctgtgtgtaacccaaactggcaagtccaaattcgtctgggcggtttgtgttaatgtgccgccaattgttgttggatggttgcttgttcagagagctgaaacatgtcgatcaattggttaatctctcttaattttgggcattttaatt

SEQ ID NO: 4272 - DNA, 2244 bp, Triticum aestivum
acgggccgcgctcgggcgactgccttggcctactccagctgcagtgatcactggccgccttcccagtagctcccaagtcgtcgcgacagcggcaagccaattcattgccaaccatcttgctcgccccggccggccgcttctatatagcctcgtcctgccgagcacattccatattgcaccacctctcccgtcctcagctctcactgcggtccggcgatcgagcttggccagcttagcgatggaggcagggacgtgggcggtggtggtggcggcggcggccgcgtacctggcgtggttctggcggatgtcgcgcgggctcagcgggcccagggtgtggccgctggtgggcagcctgccggggctgctgcagcacgcggaggacatgcacgagtggatcgtcggcaacctgcgccgcaccgggggcacctaccagacctgcatcttcgcggtgccgggcgtggcccgccgcggcgggctggtcacggtcacgtgcgaccccaggaacctggagcacgtcctcaaggcgcgcttcgacaactaccccaagggccccttctggcacggcgtcttcagcgacctgctcggcgacggcatcttcaactccgacggcgacacctgggtggcgcagcgcaagacggccgcgctcgagttcaccacccgcaccctccgcaccgccatgtcccgctgggtctcccgctccatccaccaccgcatgctccccatcctgtccgacgcggcggcctccggcgcgcacgtcgacctgcaggacctcctcctccgcctcaccttcgacaacatctgcggcctcgccttcggcaaggacccggagacgctcgcccgtggcctccccgagaacgccttcgccacctccttcgaccgcgccacggaggccacgctcaaccgcttcatcttcccggagttcgtgtggcggtgcaagaagtggctggggctcggcatggagaccacgctggcgcgcagcgtcgcgcacgtcgaccggtacctctccgccgtcatcaagacgcgcaagctcgagctcgccagcaagagcgacgggtccacgccgcacgacgacctcctgtcgcgcttcatgcgcaaggggacctactccgacgactccctgcagcacgtggcgctcaacttcatcctcgccggccgcgacacctcctcggtggcgctctcctggttcttctggctggtctccacccacccggacgtcgagcgcaagatcgtgcgcgagctctgcgccgtcctggcggcgtcccgcggcgcagacgacccggcattgtggctggccgccccgttcgactacgaggaactggaccgcctagtgtacctcaaggcggcgctctcggagaccctccggctgtacccgtccgtgccggaggactcgaagcacgtggtcgccgacgactacctccccgacggcacgttcgtgccggccgggtcgtcggtgacgtactccatctactcggccgggcgcatgaagacggtgtggggcgaggactgcctcgagttccggccggagcggtggctgtcggccgacggcaccaagttcgaaccgcacgactcgtacaggttcgtggcgttcaacgccgggccgcgcatatgcctgggcaaggacctggcgtacctgcagatgaagaacatcgccgggagcatcctcctccgtcaccgcctcgccgtggcgccggggcaccgcgtggagcagaagatgtcgctcacgctgttcatgaagcacgggctccggatggtggtgcgcccgcgcgacctcgccccgaccctcgacgagctccgcgccgcggccgcggcgcccgccgtcgcggcctgcgcgtagaagatcagtagacccccccggtgccgtgcatgcatgctccacgtacggttcgtgccatatggggaaggtccggaggacaaagttggaagtggcaagaaaattgtgtagatacacgagtccaacacaccaacaggtactacttagtaggtgagtatatctacatcgggataaaaggatctgtctaaaaatatccaaatcacaaagaaaaggaaaacacaggggcagcaaacaataatgctcctctcctgtactgcaatgtactgtactgcgtgtgacaaattagaagtgtgagcaccaaattcgtctgggcggtttgtgttaatgcgccgccgattgttgttgttagcagagaggttgcgtgtgcaaacgcaaggtgaaacatatacaacccaaaaaaaaaaaaaaaacga

SEQ ID NO: 4273 - DNA, 2581 bp, Triticum aestivum
cctccatatatctcgcgcacacgcagggcggatggggtacgggccgcgctcgggcgactgccttggcctactccagctgcagtgatcactggccgccttcccagtagctcccaagtcgtcgcgacagcggcaagccaattcattgccaaccatcttgctcgccccggccggccgcttctatatagcctcgtcctgccgagcacattccatattgcaccacctctcccgtcctcacctcacctctcactgcgctccggcgatcgagcttggctagcttggcgatggaggcagggacgtgggcggtggtggtggcggcggcggccgcgtacctggcgtggttctggcggatgtcgcgcgggctcagcgggcccagggtgtggccgctggtgggcagcctgccggggctgctgcagcacgcggaggacatgcacgagtggatcgtcggcaacctgcgccgcaccgggggcacctaccagacctgcatcttcgcggtgcccggcgtggcccgccgcggcgggctggtcacggtcacgtgcgaccccaggaacctggagcacgtcctcaaggcgcgcttcgacaactaccccaagggccccttctggcacggcgtcttcagcgacctgctcggcgacggcatcttcaactccgacggcgacacctgggtggcgcagcgcaagacggccgcgctcgagttcaccacccgcaccctccgcaccgccatgtcccgctgggtctcccgctccatccaccaccgcatgctccccatcctgtccgacgcggcggcctccggcgcgcacgtcgacctgcaggacctcctcctccgcctcaccttcgacaacatctgcggcctcgccttcggcaaggacccggagacgctcgcccgtggcctccccgagaacgccttcgccacctccttcgaccgcgccacggaggccacgctcaaccgcttcatcttcccggagttcgtgtggcggtgcaagaagtggctggggctcggcatggagaccacgctggcgcgcagcgtcgcgcacgtcgaccggtacctctccgccgtcatcaagacgcgcaagctcgagctcgccggcaagatcgacgggtcgggtgcgaccacgccgcacgacgacctcttgtcgcgcttcatgcgcaaggggacctactccgacgattccctgcagcacgtggcgctcaacttcatcctcgccggccgcgacacctcctcggtggcgctctcctggttcttctggctggtctccacccacccggacgtggagcgcaagatcgtgcgcgagctctgcgccgtcctggcggcgtcccgcggcgcagacgacccggcattgtggctggccgccccgttcgactacgaggagctggaccgcctagtgtacctcaaggcggcgctctcggagaccctccggctgtacccgtccgtgccggaggactcgaagcacgtggtcgccgacgactacctccccgacggcacgttcgtgccggccgggtcgtcggtgacgtactccatctactcggccgggcgcatgaagacggtgtggggcgaggactgcctcgagttccggccggagcggtggctgtcggccgacggcaccaagttcgaaccgcacgactcgtacaggttcgtggcgttcaacgccgggccgcgcatatgcctgggcaaggacctggcgtacctgcagatgaagaacatcgccgggagcatcctcctccgtcaccgcctcgccgtggcgccggggcaccgcgtggagcagaagatgtcgctcacgctgttcatgaagcacgggctccggatggtggtgcgcccgcgcgacctcgccccgaccctcgacgagctccccgccgcggcgcccgccgtcgcggcctgcgcgtagaagatcgatgggtatggccccccggtgccgtgcatgcatgctccacgtacggttcgtgccatatggggaaggtccggaggacgaagttggaagtggcaagaaaactgtgtagatacacgagtccaacacaccaacaggtactacttagtaggtgagtatatctacatcgggataaagggatctgtctaaaaatatccaaatcagaaagaaagggaaacacacaggggcaacaaacaataatgctcctctcctgtactgtaatgtactgtactgaactacgtgtgacagattagaagtgtataagctccaaattcgtctgggcggtttgtgttaatgcgccgccgattgttgttgttgttggcagagaggttgcgtgtgcaaatgcgaggtgaaacatacaactcgatcgagtgattattttctgtatggacccgttggtccgggcttattaattccccgttctatttctggcgtcttgattgccggtagctcgctgctcatggcgttattgcacgaggtggagatgagatcagtgtacatcgctgttgtccatcttaaggttgtttgaggctcgtgcacgggaccgagagagcgatttgatagtgggagtttctttgttgagggagttcgatacatcaaactctgatccaggacagtgcatcaaagaggcaatacaaactgataaagaatttcgacgtgcc

SEQ ID NO: 4274 - DNA, 2100 bp, Secale cereale
tgatcactggaccgccttccgagtcgctcccaagtcgtcgcgacagcggcaagccaattcattgccaaccaatcttagctcgctcgccccggccggcagcttctatataagttacgtcctgccgatcaacattccatattgcaggcgtctctcctgtcctcagctctcactgcgctccggcgatcgggctcggttaccttggcgatggaggctgggacgtgggcggtcgtggtggcggcgctggccgcgtacctggcctggttctggcggatgtcgcgcgggctcagcggccccagggtatggccgctggtgggcagcctgccggggctcctgcagcacgcggaggacatgcacgagtggatcgtcggcaacctgcgccgcaccgggggcacctaccagacctgcatcttcgcggtgcccggcgtggcccgccgtggcgggctggtcacggtcacctgcgaccccaggaacctggagcacgtcctcaaggcgcgcttcgacaactaccccaagggccccttctggcacggcgtcttcagcgacctgctcggcgacggcatcttcaactccgacggggacacctgggtggcgcagcgcaagacggccgcgctcgagttcaccacgcgcacgctccgcaccgccatgtcccgctgggtctcccgctccatccaccaccgcatgctccccatcctgtccgacgcggccgccgcgggcgcgcacgtcgacctgcaggacctcctcctccgcctcacattcgacaacatctgcggcctcgccttcggcaaggacccggagacgctcgcccgtggcctccccgaaaacgccttcgccacctccttcgaccgcgccaccgaggccacgctcaaccgcttcatcttcccggagtgcgtgtggcggtgcaagaagtggctggggctcggcatggagaccacgctggcgcgcagcgtcgcgcacgtcgaccggtacctctccgccgtcatcaagacgcgcaagctcgagctcgccggcaagagcgacgggtcgggcgcgaccacgccgcacgacgacctcctgtcgcgcttcatgcgaaaggggacctactccgacgattccctgcagcacgtcgcgctcaacttcatcctcgccggccgcgacacctcctcggtggcgctctcctggtttttctggctggtctccacccaccccggcgtggagcgcaagatcgtgcgcgagctctgcgccgtcctggccgcgtccgcggcgcagacgacccggcattgtggctggccgccccgttcgactacgaggagctggaccgcctcgtgtacctcaaggcggcgctctcggagacgctccgcctgtatccgtccgtgccggaggactcgaagcacgtggtggccgacgactacctccccgacggcacgttcgtgccggccgggtcgtcggtgacgtactccatctactcggccgggcgcatgaagacggtgtggggggaggactgcctggagttccggccggagcggtggctgtcggccgacggcaccaagttcgagccgcacgacgcgtacaggttcgtggcgttcaacgccgggccgcgcatatgcctgggcaaggacctggcgtacctgcagatgaagaacatcgccgggagcatcctcctccggcaccgcctggccgtggcgccggggcaccgcgtggagcagaagatgtcgctgacgctgttcatgaagcacgggctccggatggtggtgcgcccgcgcgacctcgccccggccctcgacgagctccgcgccgcggcgcccgccgtcgcggcctgcgcgtagaagatcaatgggcctcccccggtgccgtgcatgcatgctccacgtacggctcgtgccatatggggaaggtccggaggacaaagttggaaatggcaagaaaattgtgtagatacacgagtccaacacaccaacaggtaccacttagtaggtgagtatatctccatctggataaagggatctgtctaaaaatatccaaatcacaaagaaagggaaaacacaggggcaacaagcaataatgctcctctcctgtactgtactgaactattacgtgacacattagaagtgtatacgctccaaa

SEQ ID NO: 4275 - DNA, 2431 bp, Oryza sativa
gctaggagtagcagcgtagcaggaccggtgcgcgacctgcaataaattggcatccatctcgactgtgctccgaccagttctataaaaacctcggtctctccctgctgcactctgccatcctcattgcttgctccatgtggagtcacttagcgcagtgtagctagccatcaccgggcattctcatcggatccatacagccctagctagcagctgtacgtacattacagagtttgttgccagaggaaaatggaggtggggacgtgggcggtggtggtggcggtggcggcggcgtacatgacgtggttctggcggatgtcccgggggctgagcgggccgcgtgtgtggccggtggtcggcagcctgcctgggctggtgcagcacgccgagaacatgcacgagtggatcgccgccaacctgcgccgcgccggcggcacgtaccagacgtgcatcttcgcggtgcccggggtggcgcgccgcggcgggctggtcaccgtcacctgcgacccgcgcaacctggagcacgtcctcaagtcgcggttcgacaactaccccaagggccccttctggcacgccgtcttccgcgacctgctcggcgacggcatcttcaactccgacggcgagacgtgggtcgcgcagcggaagacggcggcgctcgagttcaccacgcgcacgctgcggacggcaatgtccaggtgggtctcgcggtccatccaccaccggctgctgcccatcctggacgacgcggccgccggcaaggcgcacgtcgacctgcaggacctcctcctccgcctcaccttcgacaacatctgcggcctggcgttcggcaaggaccccgagacgctcgccaagggcttgccggagaacgccttcgcctccgcgttcgaccgcgcgaccgaggccacgctcaaccggttcatcttcccggagtacctgtggcgctgcaagaagtggctgggcctcggcatggagaccacgctggccagcagcgtcgcgcacgtcgaccagtacctcgccgccgtcatcaaggcgcgcaagctcgagctcgcgggcaacggcaagtgcgacaccgtggcgatgcatgacgacctgctgtcccggttcatgcggaagggctcctactcggacgagtcgctgcagcacgtggcgctcaacttcatcctcgcgggccgcgacacatcctccgtggcgctctcctggttcttctggctcgtgtccacccaccccgccgtggagcgcaaggtcgtgcacgagctctgcgccgtgctcgcggcgtcccggggcgcccatgacccggcattgtggctggcggcgcccttcaccttcgaggagctcgacagtctggtctacctcaaggcggcgctctcggagacactccgcttgtacccctccgtcccagaggactccaagcacgtcgtcgccgacgactacctcccggacggcacgttcgtgccggccggctcgtcggtcacgtactccatatactcggcggggcgcatgaagacggtgtggggggaggactgcctcgagttcaggccggagcggtggctgtcggccgacggctccaagttcgagccgcacgactcgtacaagttcgtcgcgttcaacgccgggccgaggatttgcctcggcaaggacctcgcctacctgcagatgaagaacatcgccgggagcgtgctcctccgccaccgcctcgccgtcgcgcagggacaccgagtcgagcagaagatgtccctcacgctcttcatgaagaacgggctccgaatggaggtacgtccacgcgacctcgcgcccgtcgccgacgagctccgcggcgcggacgtgagggccaccgcaccatgcgcgtagaagatccgagggccccgctcgcgccaagattcgtgctgatggaggcatggaacattcaatgtgtagataaagagagagtacgagacagtaagtaaattaaatgggtttggtgggaacatttaagccgcttcttctctgaatttaccatccggatcagagaaacttggatttttttttttttgcaaagacgagatctacttggatttggatctgagagagcagaagcggagaagcaaaaaagagaactaaagaaagagcaataatttgtgatgtagctaagatgcagagtactttgatagtatttgttcgagttagtttgtgttggtgaccagccaactattatatttattttattctattcttaagagacattttcttcttttccaagcctcgatctatcactatgtgattctattagcgacttgctaattaatttgtcaaatagatctataagtagtagtaaacgtgtacttaaggttgcctacttcttcacgagaagttcctcagttttccgcatgtaaggcacaatcgttttgctagatttccattgcgaaaagcagaaactctgaggttggcatgatgccgt

SEQ ID NO: 4276 - DNA, 3200 bp, Sorghum bicolor
tcactcacaggcgcgcatcctggtcaaaacacacggcgccggccggcccgtgcctggctggggcacgccggcacggctccacggccatctatttatgccccaggtctcgtccagctccagcccgtctcgctgccacgccgcgccacatgcttctgctacctcatctcccctcatttcattgagaagtcagctagccaaccaggcgaagccgtagagtcgtgtgcaccggttcgaagcagcagcagcagcagtcagcattcactccggccacctgcatcgcgttctacagtgccactactcaccacactgattcggccgatccaccgagtccgagtccactggcgccatcctcgatcgaccggtggacaagccaagcctgttgttccagcctagctgcgcacggcttcaatgcctccccggccgtgcattcaatggccttggcacggttaggtgcgcgacgtcgcggcggattggcccgtgcgagcgcgccgcgccggccagttgttggcgggtgacacgccgcgcgcggccccggacaccgagcgtcccccggcggcaatttatgggcgaccgcccgtgccgtttctcgttccaccgcctactgctactagccgccatccacaaaccacaaccacaaccaccggccgatcatctggccgcctcttctcttcgccggtgaaactgtgttttgctttcgttcagctagccgctgatcgatcaccacccatttccacagtaaaatgtgctgtacagtacgcacgcgctgtacgtgtacgcagctgccgcatcaggtacggcagttttttttaacacgctggtcgttgctgaaagctttgcaggtatgaggcggcactggagtagggactttgggagtactagtgcgtactgtgccagcaactaatcaccatccctctcaactgtgcaaccagttctataaaacctctgccatcccgtcacctcccatcgcagcattgcttgctccatgtggagtcactttattactgcattacactagctagcgcagccagccagccagcttcatcttcatcctcgtcgatccgatccgatccggcggtgctgtgtgtactgtacgccagccggcaagcggcaatggaggtgggcacgtgggcggtggtggtggcggccgccgccgcgtacctggcgtggttctggcggctgtcgcgggggctgagcgggccgcgggtttggccggtgctcggcagcctgccggggctggtgcagcacgccgaggacatgcacgagtggatcgtgggcaacctgcgccgcacgggcggcacctaccagacgtgcatcttcgcggtgcccggggtggcgcgccgcggcgggctggtcaccgtgacgtgcgacccgcggaacctggagcacgtcctcaaggctcgcttcgacaactaccccaagggccccttctggcacgccgtcttccgggacctgctcggcgacggcatcttcaactccgacggggacacgtgggtggcgcagcgcaagacggccgcgctcgagttcaccacgcgcacgctccgcaccgccatgtcccgctgggtgtcgcgctccatccacctccggctgctgcccatcctggacgaggccgccagcgaggggacgcacgtcgacctccaggacctcctcctccgcctcaccttcgacaacatctgcggcctcgcgttcggcaaggaccccgagacgctcgcgccgggcctgccggagaacgcgttcgccacggcgttcgaccgcgccacggaggcgacgctcaaccggttcattttcccggagtgcctgtggcggtgcaagaagtggctgggcctcggcatggagaccacgctggcccgcagcgtcgcgcacgtggaccagtacctcgccgccgtcatcaaggcgcgcaagctcgagctcgccgggaacggcaagtgcgacagcgacaccaccgcgccggtggcagcgcacgacgacctgctgtcccggttcatgcgcaagggctcctactcggacgagtcgctgcagcacgtggcgctcaacttcatcctcgccggccgcgacacctcctccgtggcgctctcctggttcttctggctcgtgtccacgcaccccgacgtggagcgcaagatcgtgcgcgagctgtgcgccgcgctcgccgtgtcccggggctcccacgacccggcattgtggctggcgtcgcccttcaccttcgaggagctcgaccgcctggtgtacctcaaggcggcgctctcggagacgctgcgcctgtacccgtccgtgcccgaggactccaagcacgtggtggccgacgactacctccccgacggcacgttcgtcccggcgggttcgtcggtgacctactccatctactcggcggggcgcatgaagacggtgtggggggaggactgcctcgacttccgcccggagcggtggctgtccgccgacggcacccggttcgagccgcacgactcgtaccggttcgtggcgttcaacgccgggccgaggatctgcctcggcaaggacctcgcgtacctgcagatgaagaacatcgccggcagcgtgctcctccgccaccgcctggccgtcgcgcagggccaccgcgtggagcagaagatgtcgctgacgctgttcatgaagcacgggctccggatggaggtgcacccgcgcgacctggccccggtcatcgacgagctccgtggcgcgggcgcgggtgcggcagcaaggctggccacggcgccctgcgcgtagaagatccgtcccgtccgtgcgccaagatccgtgctgcggaggagacactgggaattcaatgtgtagataagcgtacaagtacaagacaggagtaagtaattaaatgggtttggtgagaccattcaagtctcttctctcatgaatttaccattctgatgagggagatggggaatttttttgcgattggcaagatctagctggatttggatctgagcgtttacaaattactgaagatttgttcgagtgaggcagttagtgttggcgaccggttgccaactgttctactactctagtactactactactattctttgaaacttctcatatatattttttaagactactacagtagtatattctatttttagagggttgttaaatttaccaagaaacgtgtaagtaaacgtgtattgaaggttctttgcttctttgattgatatataccatcactttcatggtca

SEQ ID NO: 4277 - DNA, 2260 bp, Hordeum vulgare
gccactgccgtggcctactacagctgcagctgcagtgccactgatcatcagtggccgccttccaagtcgctcccaagtcgtcgcgacagaggcaaatcaattcgttgccatccgtcgccccgcccccgcccgcttctatatagcctcgcccgtcctgcccatcacattccatattgcagcatctctcctgtcctcgcttctcactgcttagcttagcctagcgacgatggaggctgggacgtgggcggtggtggtggcggcggtggcggcgtacctggcgtggttctggcggatgtcgcgcgggctgagcgggcccagggtgtggccgctggtgggcagcctgccggggctcctgcagcacgcggaggacatgcacgagtggatcgtcggcaacctgcgccgcaccggcggcacgtaccagacctgcatcttcgcggtgccgggcgtggcccgccgcggcgggctggtcacggtcacctgcgaccccaggaacctggagcacgtcctcaaggcgcgcttcgacaactaccccaagggccccttctggcacggcgtcttccgcgacctgctcggcgacggcatcttcaactccgacggggacacctgggtggcgcaccgcaagacggccgcgctcgagttcaccacgcgcacgctccgcaccgccatgtcccgctgggtctcccgctccatccaccaccggatgctccccatcctctccgacgcggccggcgccggcgcgcacgtcgacctgcaggacctcctcctccgcctcaccttcgacaacatctgcggcctcgccttcggcaaggacccggagacgctcgcccgtggcctccccgacaacgccttcgccacatccttcgaccgcgccacggaggccacgctcaaccgcttcatcttcccggagttcgtctggcggtgcaagaagtggctggggctcggcatggagaccacgctggcgcgcagcgtcgcgcacgtcgaccgatacctctccgccgtcatcaagacgcgcaagctcgagctcgccggcaagagcgacgggcccacgccgcacgacgacctcctgtcgcgcttcatgcgcaaggggacctactccgacgactccctgcagcacgtggcgctcaacttcatcctcgccggccgcgacacctcctcggtggcgctctcctggttcttctggctggtctcgacccaccccgccgtggagcgcaagatcgtgcgcgagatctgcgccgtcctggccgcgtcccgcggcgcggacgatccggcattgtggctggccgccccgttcgactacgaggagctggaccgcctcgtgtacctcaaggcggcgctctcggagaccctccggctgtacccgtccgtgccggaggactcaaagcacgtggtcgccgacgactacctccccgacagcactttcgtgccggcagggtcgtcggtgacctactccatctactcggccgggcgcatgaagacggtgtggggggaggactgcctcgagttccggccggagcggtggatgtcggccgacggcaccaagttggagccgcacgactcgtacaggttcgtcgccttcaacgccgggccgcgcatatgcctgggcaaggacctggcgtacctgcagatgaagaacatcgccgggagcatcctcctccggcaccacctcgccgtggcgccggggcaccgcgtggagcagaagatgtcgctcacgctcttcatgaagcacgggctccggatggtggtgcgcccgcgcgacctcgccccgaccgtcgacgagctccgcgccgccgcggcgcccgccgtcgcggcctgcgcgtagaagatcaacagacccacccccggtgccgtgcgtgcatgcatgctccacgtacagttcgtgccatatggggaaggtccgatggacgaagttggaaatggcaaaaaaatatcatgtagatacacgagtccaacacaccaacacgtatggttcaaaaaaaacacacacaccaacacgtacttaatgaaagggtttggtaggtgagtacgtatatctccatggggataaaacataaaaggatttgtctaaaaaaaatatccgaatcggaaagaaagggaaaacacaggagcaacagacaataatgctcctctcctgtactgtactgtattgtagtgtactacgtgtgacagaatacaagtgtgagctacaaactcgtctgggcggtttgtgttaatgcgccgccgattgttgttagcggtaagctgcgtatagagaggttacgtg

SEQ ID NO: 4278 - DNA, 4327 bp, Sorghum bicolor
ggcaatggaggtgggcacgtgggcggtggtggtggcggccgccgccgcgtacctggcgtggttctggcggctgtcgcgggggctgagcgggccgcgggtttggccggtgctcggcagcctgccggggctggtgcagcacgccgaggacatgcacgagtggatcgtgggcaacctgcgccgcacgggcggcacctaccagacgtgcatcttcgcggtgcccggggtggcgcgccgcggcgggctggtcaccgtgacgtgcgacccgcggaacctggagcacgtcctcaaggctcgcttcgacaactaccccaagggccccttctggcacgccgtcttccgggacctgctcggcgacggcatcttcaactccgacggggacacgtgggtggcgcagcgcaagacggccgcgctcgagttcaccacgcgcacgctccgcaccgccatgtcccgctgggtgtcgcgctccatccacctccggctgctgcccatcctggacgaggccgccagcgaggggacgcacgtcgacctccaggacctcctcctccgcctcaccttcgacaacatctgcggcctcgcgttcggcaaggaccccgagacgctcgcgccgggcctgccggagaacgcgttcgccacggcgttcgaccgcgccacggaggcgacgctcaaccggttcattttcccggagtgcctgtggcggtgcaagaagtggctgggcctcggcatggagaccacgctggcccgcagcgtcgcgcacgtggaccagtacctcgccgccgtcatcaaggcgcgcaagctcgagctcgccgggaacggcaagtgcgacagcgacaccaccgcgccggtggcagcgcacgacgacctgctgtcccggttcatgcgcaagggctcctactcggacgagtcgctgcagcacgtggcgctcaacttcatcctcgccggccgcgacacctcctccgtggcgctctcctggttcttctggctcgtgtccacgcaccccgacgtggagcgcaagatcgtgcgcgagctgtgcgccgcgctcgccgtgtcccggggctcccacgacccggcattgtggctggcgtcgcccttcaccttcgaggagctcgaccgcctggtgtacctcaaggcggcgctctcggagacgctgcgcctgtacccgtccgtgcccgaggactccaagcacgtggtggccgacgactacctccccgacggcacgttcgtcccggcgggttcgtcggtgacctactccatctactcggcggggcgcatgaagacggtgtggggggaggactgcctcgacttccgcccggagcggtggctgtccgccgacggcacccggttcgagccgcacgactcgtaccggttcgtggcgttcaacgccgggccgaggatctgcctcggcaaggacctcgcgtacctgcagatgaagaacatcgccggcagcgtgctcctccgccaccgcctggccgtcgcgcagggccaccgcgtggagcagaagatgtcgctgacgctgttcatgaagcacgggctccggatggaggtgcacccgcgcgacctggccccggtcatcgacgagctccgtggcgcgggcgcgggtgcggcagcaaggctggccacggcgccctgcgctatgccaccatggtggggaaaatcttcatccaaagaagtgaaaaagacagccaaagaaaacctcattgacacatttcagcgtctcataagttcaaatgagcaaaagggaagcagaaaatcacgaggtagtcgtaaacatggtaaagacacagctggtgacaaaggttgctggtctactgcccaatcccgctcaacatccccttcaaaagaggtctctcggtgtcagagctttgcagcagatagaccacctgcgcaaccacttcctcttcctaaatcacgtgctagggtgacgcgtacttcttctgatattaccaactcaaagtccactttggaaaagcatggcaaaggacaactgcttccactcccccctactcagcctagaaaaagacctgaagctactgaacctgttactgaagtagctactgcttctgtctccagcaactgttctattgatagtgatgatcctggtgattctcggcttcagagccctgtgggaaatgaggttgaaaatgcgactagaattactgcaacaagtagttcaagtgttttgcacaaagagcgttctagtgctatcaccaaaaagagcaccaaggaagttgcaaagccaaacaatgcttttctcagtaaccaaatcttgtcaacatctccaagaggtaccgttgctgatggttatcaatccaatttacaaagcccccgacagattgccctggagagtgctccgaatagtttgatgtcaagtccttctcgaagcccaaggattatatgtcctgatcagattccaacttcagctttttgggcagtaaagcctcatactgatataactttccttgggtctggtcagtgctcgagtccaggttctggtcagacatctgggcataattcagtgggaggtgatatgctaggcccaatcttttggcagcctagccgaggtagtccagagtgttcaccaattccaagcccaagaatgacaagtcctggtccaagttctagggtgcatagtggaagtgtctctcctttgcatccaagagctggtggggtcactcctgaatctccaacaaatcgacacgctgaagggaacaagaaacaaacccacagattgccgcttcctccaataagcacagctaatatttccacctttttgccaaacagctctaccccagctagtcctatatctcgtagtcctggtagaacagagaatccaccgagtcctggttcacggtggaagaagggaaaactgattggccgtgggacatttggccatgtatacgttggttttaacagtgacagaggtgaaatgtgtgcgatgaaggaggttacccttttcgcagatgatcctaaatcaaaagaaagtgcaaaacagctgtgccaggaaatatcacttctgagccgactgcagcacccaaacattgtgcgatactatggatctgaaactgttgatgataagctttacatatacctggagtatgtttctggtggatctatacataagcttctccaagagtacggccagtttggtgaacaggccattcgcagttatactaagcaaatacttttgggcctagcttatttgcatgcaaagaatacagtacacagggacatcaaaggtgcaaacatattggtagaccctaatggccgtgtaaagcttgctgacttcgggatggcaaaacatatcaatgggcagcagtgccctttctcatttaagggtagcccgtactggatggctcctgaggttataaaaaatgctagtggatgtaaccttgcagttgatatatggagtttaggatgcacggtcctagagatggctacttcaaaaccaccatggagccaatatgaagggattgctgcaatgtttaagataggaaacagtaaggagcttccgccaataccagatcacctctcagaagaggggaaagacttcataagaaagtgcttgcaacgcgatccatccagccgtccaacagcagtggatcttttgcagcatgcattcgtacgaaatgcaccaccacttgaaaaatcatctgcctctcatccactggaggtggaacagttgacggctatatcatgcagaacaaattcaaaggtggttgagcatgccagaaatatgtcctcgcttggtttggaaggccaatcaattttgcagagaagagctgccaaattttctttgccaattagtgatatccatatacggagtaacatatcttgtcctgtatctccatgtggaagtcctcttctgagatcaagatccccacaacatcaaaatggtagaatgtcaccttctccaatttctagccccagaacaacttcgggtgcttcaactcctctgactggtggtagtggagctgttcctttaaaccatgtgaggcaaccagcttacagaaatgagggcttcacagtcacatcaagaggttttgatgaccacatacctagccggcctgttgatccagtacatggacgttttattcgagtgcagcaattttctgcgggccgtcaggagagggtagtctccgaagctgacattctgagctctcaatttggaaagatgaggcatgcaaatgtgtgggattcgcatgataggccattgccttctgagcgttcctctcagcagtgctttggggatcatgtgaagctaaaaccttcactggacttgaggtctggtcctcggcaccctgggcgcaaccatggccattgattctctagc

SEQ ID NO: 4279 - DNA, 5110 bp, Sorghum bicolor
gtcacctcccatcgcagcattgcttgctccatgtggagtcactttattactgcattacactagctagcgcagccagccagccagcttcatcttcatcctcgtcgatccgatccgatccggcggtgctgtgtgtacgtcgtacgtgtgtgtgtgtgtgtgcgcgcgctgtacgccagccggcaagcggcaatggaggtgggcacgtgggcggtggtggtggcggccgccgccgcgtacctggcgtggttctggcggctgtcgcgggggctgagcgggccgcgggtttggccggtgctcggcagcctgccggggctggtgcagcacgccgaggacatgcacgagtggatcgtgggcaacctgcgccgcacgggcggcacctaccagacgtgcatcttcgcggtgcccggggtggcgcgccgcggcgggctggtcaccgtgacgtgcgacccgcggaacctggagcacgtcctcaaggctcgcttcgacaactaccccaagggccccttctggcacgccgtcttccgggacctgctcggcgacggcatcttcaactccgacggggacacgtgggtggcgcagcgcaagacggccgcgctcgagttcaccacgcgcacgctccgcaccgccatgtcccgctgggtgtcgcgctccatccacctccggctgctgcccatcctggacgaggccgccagcgaggggacgcacgtcgacctccaggacctcctcctccgcctcaccttcgacaacatctgcggcctcgcgttcggcaaggaccccgagacgctcgcgccgggcctgccggagaacgcgttcgccacggcgttcgaccgcgccacggaggcgacgctcaaccggttcattttcccggagtgcctgtggcggtgcaagaagtggctgggcctcggcatggagaccacgctggcccgcagcgtcgcgcacgtggaccagtacctcgccgccgtcatcaaggcgcgcaagctcgagctcgccgggaacggcaagtgcgacagcgacaccaccgcgccggtggcagcgcacgacgacctgctgtcccggttcatgcgcaagggctcctactcggacgagtcgctgcagcacgtggcgctcaacttcatcctcgccggccgcgacacctcctccgtggcgctctcctggttcttctggctcgtgtccacgcaccccgacgtggagcgcaagatcgtgcgcgagctgtgcgccgcgctcgccgtgtcccggggctcccacgacccggcattgtggctggcgtcgcccttcaccttcgaggagctcgaccgcctggtgtacctcaaggcggcgctctcggagacgctgcgcctgtacccgtccgtgcccgaggactccaagcacgtggtggccgacgactacctccccgacggcacgttcgtcccggcgggttcgtcggtgacctactccatctactcggcggggcgcatgaagacggtgtggggggaggactgcctcgacttccgcccggagcggtggctgtccgccgacggcacccggttcgagccgcacgactcgtaccggttcgtggcgttcaacgccgggccgaggatctgcctcggcaaggacctcgcgtacctgcagatgaagaacatcgccggcagcgtgctcctccgccaccgcctggccgtcgcgcagggccaccgcgtggagcagaagatgtcgctgacgctgttcatgaagcacgggctccggatggaggtgcacccgcgcgacctggccccggtcatcgacgagctccgtggcgcgggcgcgggtgcggcagcaaggctggccacggcgccctgcgctatgccaccatggtggggaaaatcttcatccaaagaagtgaaaaagacagccaaagaaaacctcattgacacatttcagcgtctcataagttcaaatgagcaaaagggaagcagaaaatcacgaggtagtcgtaaacatggtaaagacacagctggtgacaaaggttgctggtctactgcccaatcccgctcaacatccccttcaaaagaggtctctcggtgtcagagctttgcagcagatagaccacctgcgcaaccacttcctcttcctaaatcacgtgctagggtgacgcgtacttcttctgatattaccaactcaaagtccactttggaaaagcatggcaaaggacaactgcttccactcccccctactcagcctagaaaaagacctgaagctactgaacctgttactgaagtagctactgcttctgtctccagcaactgttctattgatagtgatgatcctggtgattctcggcttcagagccctgtgggaaatgaggttgaaaatgcgactagaattactgcaacaagtagttcaagtgttttgcacaaagagcgttctagtgctatcaccaaaaagagcaccaaggaagttgcaaagccaaacaatgcttttctcagtaaccaaatcttgtcaacatctccaagaggtaccgttgctgatggttatcaatccaatttacaaagcccccgacagattgccctggagagtgctccgaatagtttgatgtcaagtccttctcgaagcccaaggattatatgtcctgatcagattccaacttcagctttttgggcagtaaagcctcatactgatataactttccttgggtctggtcagtgctcgagtccaggttctggtcagacatctgggcataattcagtgggaggtgatatgctaggcccaatcttttggcagcctagccgaggtagtccagagtgttcaccaattccaagcccaagaatgacaagtcctggtccaagttctagggtgcatagtggaagtgtctctcctttgcatccaagagctggtggggtcactcctgaatctccaacaaatcgacacgctgaagggaacaagaaacaaacccacagattgccgcttcctccaataagcacagctaatatttccacctttttgccaaacagctctaccccagctagtcctatatctcgtagtcctggtagaacagagaatccaccgagtcctggttcacggtggaagaagggaaaactgattggccgtgggacatttggccatgtatacgttggttttaacagtgacagaggtgaaatgtgtgcgatgaaggaggttacccttttcgcagatgatcctaaatcaaaagaaagtgcaaaacagctgtgccaggaaatatcacttctgagccgactgcagcacccaaacattgtgcgatactatggatctgaaactgttgatgataagctttacatatacctggagtatgtttctggtggatctatacataagcttctccaagagtacggccagtttggtgaacaggccattcgcagttatactaagcaaatacttttgggcctagcttatttgcatgcaaagaatacagtacacagggacatcaaaggtgcaaacatattggtagaccctaatggccgtgtaaagcttgctgacttcgggatggcaaaacatatcaatgggcagcagtgccctttctcatttaagggtagcccgtactggatggctcctgaggttataaaaaatgctagtggatgtaaccttgcagttgatatatggagtttaggatgcacggtcctagagatggctacttcaaaaccaccatggagccaatatgaagggattgctgcaatgtttaagataggaaacagtaaggagcttccgccaataccagatcacctctcagaagaggggaaagacttcataagaaagtgcttgcaacgcgatccatccagccgtccaacagcagtggatcttttgcagcatgcattcgtacgaaatgcaccaccacttgaaaaatcatctgcctctcatccactggaggtggaacagttgacggctatatcatgcagaacaaattcaaaggtggttgagcatgccagaaatatgtcctcgcttggtttggaaggccaatcaattttgcagagaagagctgccaaattttctttgccaattagtgatatccatatacggagtaacatatcttgtcctgtatctccatgtggaagtcctcttctgagatcaagatccccacaacatcaaaatggtagaatgtcaccttctccaatttctagccccagaacaacttcgggtgcttcaactcctctgactggtggtagtggagctgttcctttaaaccatgtgaggcaaccagcttacagaaatgagggcttcacagtcacatcaagaggttttgatgaccacatacctagccggcctgttgatccagtacatggacgttttattcgagtgcagcaattttctgcgggccgtcaggagagggtagtctccgaagctgacattctgagctctcaatttggaaagatgaggcatgcaaatgtgtgggattcgcatgataggccattgccttctgagcgttcctctcagcagtgctttggggatcatgtgaagctaaaaccttcactggacttgaggtctggtcctcggcaccctgggcgcaaccatggccattgattctctagctaaagttaatggataagctttcagtcgtgtctatgtgatagctagtggtcctaagctggttcaccaaaacctttaattgtatcatagtagaagagatgttcattaattatttcagatgctgacagttggcagtggataaagattctccaatgtcaatcccatattcccattactctaaaaaaagatgaaacatgccctatctggaaggggatgttgtatactagactgtccagataccgaaggacccaaaacagtgactctgaacctgtatactcttactctcgtatctacagcaatttagttttcgttttcttttatgggtttggaggccattgtacagaagggaactctcaacaagaaatccagattaaaaggcacaggagaaagcaaatgagccattcaccaaccttttctttttctttttaatcttataacagatacatatatgccggctgctcactgtaaagtgttgattcagctctggttgtaataccggttcgatccattaaacgtatccgttactctgaatatcatgtgaagagtctaatcgttaatcaaattaactggtccagttctaaagcagatatttttcccgtgg

SEQ ID NO: 4280 - DNA, 2597 bp, Brachypodium distachyon
ctacaagatcctacgtggtagtacacgggcaatgccaatgcgcgctggccggcgaacaataaatttagccaggccatctcaactgtgctagctccgaccacttctataaaaccctggtctccccctgttgcgctctgccatcctacttacttgctccatgtggagtcacttattacagccactcagccagccagacctttaactcgatcgatcgcgttggatccatccatcccttctagcttagctcagctgagccgagtgagtatatacgtactgtacgcacgcttgcagctttgcttgagctgtgccggccggctggtcagtctatcgagacgctggtgtggcagcagctcttgacagcagcaagcaatggaggcggggacgtgggcggtggtggtcgcggcggtggccgcgtacatggcgtggttctggcggatgtcccgcgggctgcgcgggccgcgggtgtggcccgtgctgggcagcctgccggggctcgtgcagcacgccgaggacatgcacgagtggatcgcgggcaacctccggcgcgcgggcggcacgtaccagacgtgcatcttcgcggtgcccggcgtggcgcggcgcggcgggctggtcacggtcacgtgcgacccgcggaacctggagcacgtcctcaaggcccgcttcgacaactaccccaagggccccttctggcacgccgtcttcctcgacctcctcggcgacggcatcttcaactcggacggcgagacgtgggtggcgcagcgcaagacggccgcgctcgagttcaccacgcggacgctccggacggccatgtccaggtgggtctcccgctccatccaccacaggctcctgcccatcctggccgacgcgtccgcgggcaaggcccacgtcgacctccaggacctgctactccggctcaccttcgacaatatctgcgggctggcgttcggcaaggacccggagacgctcgcccagggcctgccgcacaacgagttcgcctccgcgttcgaccgcgccacggaggccacgctcaaccgcttcatcttccccgagtgcctgtggcggtgcaagaagtggctgggcctcgggctggagaccacgctgacgcgcagcatggcgcacgtcgaccagtacctggccgccgtcatcaaggcgcgcaggctcgagctcgcgggcaagtgcggcgacacggccgtgcacgacgacctgctctcccgcttcatgcgcaagggctcctactcggacgagtcgctgcagcacgtggcgctcaacttcatcctggccggccgcgacacctcctccgtcgcgctctcctggttcttctggctcgtctccacgcacccggccgtggagcacaagatcgtgcgcgagctctgctccgtcctcgccgcgtcccgcggcgccgggggcgagcgcgtcgacccggcattgtggctcgcggagcccttcacctacgaggagctcgaccgcctggtgtacctcaaggcggcgctctcggagacgctccgcctctacccttccgtgcccgaggactccaagcacgtcgtggcggacgactacctcccggacggcacgttcgtgcccgccggatcctcggtcacgtactccatatattcagcggggaggatgaagactgtgtggggggaggactgcctggagttccggccggagcgctggctgtcggccgacgggacaaagttcgagccgcacgactcgtacaagttcgtggcgttcaacgccgggccgaggatttgcctgggcaaggacctggcctacctgcagatgaagaacatcgccgggagcgtgctcctccggcaccgcctggccgtcgcgccgggccaccgcgtcgagcagaagatgtcgctcacgctcttcatgaaggacgggctgaggatggaggtacgtccacgcgacctctctgctgccctcgacgagccctgcggcgccgccgccgacgcgaaaagagccacggcgccgtgcgcgtagaagaagaccctgctgctggctggtggtgtccttcgttcgcgtgcgccgagattcgtgccgatcgggaagaacgtacgtacgggggggcattgaatgtgtaggtatatacaggagtacaagaccgtaagtaaattgatggggtttggtgacaacatttatgtcactcctttccagaatttaccatccggataagtgaaactgggagactttgcaaatgacaaagatctacttggatttggatctgcatgcaagcaagcacagtggacgatggaaagaaaagaaacaaataacagtaacagagagcaataatttgtgatgttgccaaggcgatcgaagacgagaaattacttcagatttgtttgcggtagctcggtgttggtgaccagccaactagccctacttatattctattatttttggacatttttttttcaaacctactacctattgttccattcttagagagttcatattttgtccaagaaacatgtaagtaaacgtacgtgtacttaaggttgtttgcctctttggcatcatgatgatcatccttgacaagttccttctttcagccgaatgcatgtttcttctagctttccccagctagacttggtgct

SEQ ID NO: 4281 - DNA, 4775 bp, Brachypodium distachyon
tcctacttacttgctccatgtggagtcacttattacagccactcagccagccagacctttaactcgatcgatcgcgttggatccatccatcccttctagcttagctcagctgagccgagtgagtatatacgtactgtacgcacgcttgcagctttgcttgagctgtgccggccggctggtcagtctatcgagacgctggtgtggcagcagctcttgacagcagcaagcaatggaggcggggacgtgggcggtggtggtcgcggcggtggccgcgtacatggcgtggttctggcggatgtcccgcgggctgcgcgggccgcgggtgtggcccgtgctgggcagcctgccggggctcgtgcagcacgccgaggacatgcacgagtggatcgcgggcaacctccggcgcgcgggcggcacgtaccagacgtgcatcttcgcggtgcccggcgtggcgcggcgcggcgggctggtcacggtcacgtgcgacccgcggaacctggagcacgtcctcaaggcccgcttcgacaactaccccaagggccccttctggcacgccgtcttcctcgacctcctcggcgacggcatcttcaactcggacggcgagacgtgggtggcgcagcgcaagacggccgcgctcgagttcaccacgcggacgctccggacggccatgtccaggtgggtctcccgctccatccaccacaggctcctgcccatcctggccgacgcgtccgcgggcaaggcccacgtcgacctccaggacctgctactccggctcaccttcgacaatatctgcgggctggcgttcggcaaggacccggagacgctcgcccagggcctgccgcacaacgagttcgcctccgcgttcgaccgcgccacggaggccacgctcaaccgcttcatcttccccgagtgcctgtggcggtgcaagaagtggctgggcctcgggctggagaccacgctgacgcgcagcatggcgcacgtcgaccagtacctggccgccgtcatcaaggcgcgcaggctcgagctcgcgggcaagtgcggcgacacggccgtgcacgacgacctgctctcccgcttcatgcgcaagggctcctactcggacgagtcgctgcagcacgtggcgctcaacttcatcctggccggccgcgacacctcctccgtcgcgctctcctggttcttctggctcgtctccacgcacccggccgtggagcacaagatcgtgcgcgagctctgctccgtcctcgccgcgtcccgcggcgccgggggcgagcgcgtcgacccggcattgtggctcgcggagcccttcacctacgaggagctcgaccgcctggtgtacctcaaggcggcgctctcggagacgctccgcctctacccttccgtgcccgaggactccaagcacgtcgtggcggacgactacctcccggacggcacgttcgtgcccgccggatcctcggtcacgtactccatatattcagcggggaggatgaagactgtgtggggggaggactgcctggagttccggccggagcgctggctgtcggccgacgggacaaagttcgagccgcacgactcgtacaagttcgtggcgttcaacgccgggccgaggatttgcctgggcaaggacctggcctacctgcagatgaagaacatcgccgggagcgtgctcctccggcaccgcctggccgtcgcgccgggccaccgcgtcgagcagaagatgtcgctcacgctcttcatgaaggacgggctgaggatggaggtacgtccacgcgacctctctgctgccctcgacgagccctgcggcgccgccgccgacgcgaaaagagccacggcgccgtgcgcactgtatgacctcatcaccttgctatggatatatagctcagttaattcctgcacaaccaatttcatattcaatatgccaccatgggggggaaagtcttcatccaaagaagttaagaagactgccagagaaaatataattgacacatttcagcagttcataagtccaagtgagcataaggggagcacaaaatcgcgagggaatcgcggacgctgtaaagactcaactgctgagaaaggttgctggtctactgcccaatcacggtccacatccccttcaaaagaggtttctcgttgtcaaagctttgcagcagatagaccaaatgcacaaccacttcctcttcctagatcacgtgctggggtgacgcgcactgtttctgatgttaccgactcaaagcccattttgcaaaggcatgacaaaggacagcagctaccactgcctacccagaatcggcttcagaaaagacctgaaactactgaatgtgttgcagaattagcaactgcatctgtctccagcaattgttctattgatagtgatgattgtggagattctcagtttcacagtcctgtgggaaatgatgctgaaaatgtgactaaagttacaacaatgattagttcaagcgttgtgcataaagaatgttcaagtgctatcaccacaaagagcactaaggaagtgacaaagttgggcagtgcttttctcaggaaccaaattctgcccacatctccaactggtactgtttcagaccgttaccaaaccaatttacaaaacacatgccaggttgctctggagagtgctccaaacagtttgatgtcaagcccttctcaaagcccaagaacaatatttcctgaccagattccaagttcagctttttgggcagtgaagcctcatgcagatataacattccttgggtctggtcagtgctccagtccaggttcagggcaaacatctgggcataattcagtgggaggtgatatgctagctcagctcttctggcagcctagccgaggcagtccagagtgttcaccaattcctagcccaagaatgatgagtcctggtccaagttcgagggtgcatagcggaagtgtctctccattgcatccgagggctggtgggatggcacctgaatctccaacaaatcggcatgatgaggtgaagaagaagcaaacccacagattgccgcttccaccgttaagcatctctaatagttccacctttttgccgaacaactccgccccaacaagtcctatatctcgtagtcctggtagagcagagaatccacccagtcctggatcacgttggaagaagggaaagctgattggacatgggacattcggccatgtatatgttggctttaacagtgatagaggcgaaatgtgtgcaatgaaggaggttacccttttctcagatgatcctaagtcaaaagaaagtgcaagacagttgggtcaggaaatattagttctgagccggctgcaacatccaaatattgtacgatactacggatctgaaacggttgacaataaactttatatatacctggagtatgtgtctggcggatccatccataagcttctgcaggagtatggacggtttggtgaacaagcaattcgcagttatactaagcaaattcgtttgggcttagcttatttgcatgcaaagaatacagttcacagggatatcaaaggtgcaaacatattagtagaccctaacggccgtgtaaagcttgctgactttggaatggcaaaacatatcaatgggcagcagtgtcctttctcattcaagggtagcccgtactggatggctcctgaggttataaagaattctactggatgtaacctagctgtggacgtatggagtttagggtgcacagttctagagatggctacctcaaaacctccatggagccaatatgaagggattgctgcgatgtttaagataggaaacagcaaggagcttccaccaataccagatcatctctctgaagagggcaaagattttatacgtcagtgcctgcaacgtgatccatctagccgtccaacagcagtggatcttttgcaacattcatttatacgaagcgcattaccgcctggaaaatcagttgcctctactccgttggaacagttggatgatatatcttgcaaaccaagttctaaggtggttgggcatgtcagaaatatgtcttctttgggtttggaaggtcaatccatttaccagagaagagctgcaaaattttctttgacacacagtgatattcatatacggagcaatatttcttgcccagtttctccatgtggaagccctcttctgaggtcaagatccccgcaacaacaaaatggtacaatgtcaccatctccgatttctagccccagaactacttcgggtgcttccactcctctgacaggtggcaatggaaccatacctcctaaccatactagacaactagcttacagcaacaagggtgtcacaatcgcatcgagagttcttgatgaacactgggctagccggcctccagatccagttcttggtcatttagttagagctcaacaactctcgacaagcattcgggggagagtggtctctgaagctggcattcggggacctcagtttggaaagaggagacaacggaatttgcatgataggccattggcttccgagcatgcctctcagcatggctttggggataatttgaagctaaaaccttcagtggacatgacatctggtaatccacacctcatacgcaaccatggtcattgattctctagaaaggttgtgcaataggcattcagttggagcttgatgagatgctgacagttggcagttgatatggattgtccaacgccatttctatcatttcaagtaaagcatgagaattgccctatcaggaggggcatagactgccagactacctggtctgtaattgtatattagagcatctttatac

SEQ ID NO: 4282 - DNA, 1873 bp, Zea mays
gtcacctcccatcgtcattgcttgctccatgtggagtcactttattactgcattacactagctagctagctagccacagccagcttcatcttcacgtcgattcgatccatcggtgctgtgtgtaccgtacgccagcttgctgatccatcgccggccgacgatggaggtgagcacgtgggtgatgctggtggcggccgccgccgcgtacatggcgtggttctggcggctgtcgcgggggctcagcgggccgcgggtgtggccggtgctcggcagcctgccggggctggtgcagcacgccgaggacatgcacgagtggatcgtgggcaacctgcgccgcacgggaggcacctaccagacctgcatcttcgcggtgcccggggtggcgcgccgcggcgggctggtcacggtcacgtgcgaccctcgcaacctggagcacgtcctcaaggcgcgcttcgacaactaccccaagggccccttctggcacgccgtcttccgggacctgctcggcgacggcatcttcaactccgacggcgacacgtgggtggcgcagcgcaagacggccgcgctcgagttcaccacgcgcacgctccgcacggccatgtcccgctgggtgtcgcgctccatccacctcaggctgctgcccatcctggacgaggcggccaccgagaagacgcacgtcgacctccaggacctcctcctccgcctcaccttcgacaacatctgcggcctcgcgttcggcaaggaccccgagacgctcgcgccgggcctgccggagaacgcattcgccacggcgttcgaccgcgccacggaggcgacgctcaaccggttcatattccccgagtgcctgtggcggtgcaagaagtggctgggcctcggcatggagagcacgctggcccgcagcgtcgcgcacgtggaccagtacctcgccgccgtcatcaaggcgcgcaagcttgagctcgccggcaacggcaagtgcgacgcgccggcgcacgacgacctgctgtctcggttcatgcgcaagggctcctattcggacgagtcgctgcagcacgtggcgctcaacttcatcctcgccggccgcgacacctcctccgtggcgctctcctggttcttctggctcgtgtccacgcacccggacgtggagcgccagatcgtactcgagctgtgcgccgcgctcgccgcgtcccgcggctcccacgacccggcattgtggctggcgtcgccactcacgttcgaggagctggaccgcctggtctacctcaaggcggcgctctcggagaccctgcgcctgtacccgtccgttcccgaggactccaagcacgtcgtggccgacgactacctccccgacggcacgttcgtcccggcggggtcgtcggtgacctactccatctactcggccgggcgcatgaagacggtgtggggggaggactgcctcgagttccgccccgagcggtggttgtccgccgacggcacccggttcgagccgcacgactcgtaccggttcgtggcgttcaacgccgggccgaggatctgcctcggtaaggacctcgcgtacctgcagatgaagaacatcgccggcagcgtgctcctgcgccaccgcctggccgtcgcgcggggccaccgcgtggagcagaagatgtcactgacgctgttcatgaagcacgggctccggatggaggtgcacccgcgcgacctggccccggtcatcgatgagctccgtggcgcgggcgcggcaaggccggccatggcgccatgctgcgcgtagaagatcccccctccgtgctgcgggggagacgctgggaattcaatgtgtagataagcgtacaagtacaagacaggagtaaagtaaaaattaaatgggtttggtgagacc

SEQ ID NO: 4283 - DNA, 2332 bp, Triticum aestivum
gcccagcccagcccagccagcaccttaactcgccgatccaccccttggatccactctacccagctcgctagccagcggggtatatacacgcgcgtacgtacacttgcagagcttgcttcagggaggccggcaatggaggtggggacgtgggcggtggtggcgtcggcggtggccgcgtacatggcgtggttctggcggatgtcgcgcgggctgcgcgggccgcgggtgtggcccgtgctcggcagcctgcccggcctggtgcagcacgccgaggacatgcacgagtggatcgccggcaacctgcgccgcgcgggcggcacctaccagacctgcatcttcgcggtgcccggggtggcgcgccgcggcgggctggtcaccgtcacctgcgacccgcgcaacctggagcacgtcctcaaggcgcgcttcgacaactaccccaagggccccttctggcacggcgtcttccgggacctgctcggcgacggcatcttcaactccgacggcgacacctggctcgcgcagcgcaagacggccgcgctcgagttcaccacccgcacgctccggacggccatgtcccgctgggtctcgcgctccatccacggccgcctcctgcccatcctggccgacgcggccaagggcaaggcgcaggtggatctccaggacctcctcctccgcctcaccttcgacaacatctgcggcctggcgttcggcaaggacccggagacgctcgcccagggcctgccggagaacgagttcgcctccgcgttcgaccgcgccaccgaggccacgctcaaccgcttcatcttcccggagtgcctgtggcgctgcaagaagtggctgggcctcggcatggagaccacgctgaccagcagcatggcccacgtcgaccagtacctcgccgccgtcatcaagaagcgcaagctcgagctcgccgccggcaacggcaaatgcgacacggcggcgacgcacgacgacctgctctcccggttcatgcggaagggttcctactcggacgagtcgctccagcacgtggcgctcaacttcatcctcgccggccgcgacacctcctccgtggcgctctcctggttcttctggctcgtgtccacccaccctgcggtggagcgcaagatcgtgcgcgagctctgctccgttctcgccgcgtcacggggcgcccatgacccggcattgtggctggcggagcccttcaccttcgaggagctcgaccgcctggtctacctcaaggcggcgctgtcggagaccctccgcctctacccctccgtccccgaggactccaagcacgtcgtcgcggacgactacctccccgacggcaccttcgtgccggccgggtcgtcggtcacctactccatatactcggcggggcgcatgaagggggtgtggggggaggactgcctcgagttccggccggagcgatggctgtcggccgacggcaccaagttcgagcagcacgactcgtacaagttcgtggcgttcaacgccgggccgagggtgtgcctgggcaaggacctagcctacctgcagatgaagaacatcgccgggagcgtgctgctccggcaccgcctgaccgtggcgccgggccaccgcgtggagcagaagatgtcgctcacgctcttcatgaagggcgggctacggatggaggtacgtccgcgcgacctcgcccccgtcctcgacgagccctgcggcctggacgccggcgccgccaccgccgccgcagcaagtgccacagcgccgtgcgcgtagaagacctggcaccggcacgcgccatgcatgattcgtgcgtgctagctgttgaagggacgccggacattgaatgtgtagatagggcagcagtgcaagaccgtaagtaaaattgatgatgggtttggtgacaacattgaagccactcctttccagaatttacgacccggataggagaaacagggaaactttgcagatcacaacacaagatctagccagccggggatctgatcgatttgcgtctgctcagagcacgggtgcatgggagaccaaggaggaaaacaaaaaataacagaaacagagtgagcaatatttgtgattgtagccacgggaaagagagaggagtaattagtaattcagatttgtttgcagtagctcggtgttggtgaccagatcatagccaactaggctattctattctattctatttttggagatgatttttcaaagccgtgtacccttattctgttcttagagagttcatatcttgtccaagaaacttgtaagtagacgtagtacgtactcaaggttgtttgcttctttgacatcatgttcatccatgacaagtttcttcttt

SEQ ID NO: 4284 - DNA, 1788 bp, Zea mays
ggtcttgacccttccaccagaacgaacggcgccaactacaaatgtcatcaaatcaagacaccggtgtgagcatgagcatgcacagcacgaccgaaaaaggatgcacgatgaatgcaaaaagggcaagagagcaacgcagccaacacgctacaggatgatgcctcgaccgcttgcacatgaagaagtgatgcgtctcccccgcagcacggaggggggatcttctacgcgcagcatggcgccatggccggccttgccgcgcccgcgccacggagctcatcgatgaccggggccaggtcgcgcgggtgcacctccatccggagcccgtgcttcatgaacagcgtcagtgacatcttctgctccacgcggtggccccgcgcgacggccaggcggtggcgcaggagcacgctgccggcgatgttcttcatctgcaggtacgcgaggtccttaccgaggcagatcctcggcccggcgttgaacgccacgaaccggtacgagtcgtgcggctcgaaccgggtgccgtcggcggacaaccaccgctcggggcggaactcgaggcagtcctccccccacaccgtcttcatgcgcccggccgagtagatggagtaggtcaccgacgaccccgccgggacgaacgtgccgtcggggaggtagtcgtcggccacgacgtgcttggagtcctcgggaacggacgggtacaggcgcagggtctccgagagcgccgccttgaggtagaccaggcggtccagctcctcgaacgtgagtggcgacgccagccacaatgccgggtcgtgggagccgcgggacgcggcgagcgcggcgcacagctcgagtacgatctggcgctccacgtccgggtgcgtggacacgagccagaagaaccaggagagcgccacggaggaggtgtcgcggccggcgaggatgaagttgagcgccacgtgctgcagcgactcgtccgaataggagcccttgcgcatgaaccgagacagcaggtcgtcgtgcgccggcgcgtcgcacttgccgttgccggcgagctcaagcttgcgcgccttgatgacggcggcgaggtactggtccacgtgcgcgacgctgcgggccagcgtgctctccatgccgaggcccagccacttcttgcaccgccacaggcactcggggaatatgaaccggttgagcgtcgcctccgtggcgcggtcgaacgccgtggcgaatgcgttctccggcaggcccggcgcgagcgtctcggggtccttgccgaacgcgaggccgcagatgttgtcgaaggtgaggcggaggaggaggtcctggaggtcgacgtgcgtcttctcggtggccgcctcgtccaggatgggcagcagcctgaggtggatggagcgcgacacccagcgggacatggccgtgcggagcgtgcgcgtggtgaactcgagcgcggccgtcttgcgctgcgccacccacgtgtcgccgtcggagttgaagatgccgtcgccgagcaggtcccggaagacggcgtgccagaaggggcccttggggtagttgtcgaagcgcgccttgaggacgtgctccaggttgcgagggtcgcacgtgaccgtgaccagcccgccgcggcgcgccaccccgggcaccgcgaagatgcaggtctggtaggtgcctcccgtgcggcgcaggttgcccacgatccactcgtgcatgtcctcggcgtgctgcaccagccccggcaggctgccgagcaccggccacacccgcggcccgctgagcccccgcgacagccgccagaaccacgccatgtacgcggcg

SEQ ID NO: 4285 - DNA, 2250 bp, Triticum aestivum
gcccagcccagcccagccagcaccttaactcgccgatccaccccttggatccactctacccagctcgctagccagcggggtatatacacgcgcgtacgtacacttgcagagcttgcttcagggaggtcagccggcaatggaggtggggacgtgggcggtggtggcgtcggcggtggccgcgtacatggcgtggttctggcggatgtcgcgcgggctgcgcgggccgcgggtgtggcccgtgctcggcagcctgcccggcctggtgcagcacgccgaggacatgcacgagtggatcgccggcaacctgcgccgcgcgggcggcacctaccagacctgcatcttcgccgtgcccggggtggcgcgccgcggcgggctggtcaccgtcacctgcgacccgcgcaacctggagcacgtcctgaaggcgcgcttcgacaactaccccaagggccccttctggcacggcgtcttccgggacctgctcggcgacggcatcttcaattccgacggcgacacctggctcgcgcagcgcaagacggccgcgctcgagttcaccacccgcacgctccggacggccatgtcccgctgggtctcgcgctccatccacggccgcctcctgcccatcctggccgacgcggccaagggcaaggcgcaggtggatctccaggacctcctcctccgcctcaccttcgacaacatctgcggcctggccttcggcaaggacccggagacgctcgcccagggcctgccggagaacgagttcgcctccgcgttcgaccgcgccaccgaggccacgctcaaccgcttcatcttcccggagttcctgtggcgctgcaaaaagtggctgggcctcggcatggagaccacgctgaccagcagcatggcccacgtcgaccagtacctcgccgccgtcatcaagaagcgcaagctcgagctcgccgccggcaacggcaaatgcgacacggcggcgacgcacgacgacctgctctcccggttcatgcggaagggttcctactcggacgagtcgctccagcacgtggcgctcaacttcatcctcgccggccgcgacacctcctccgtggcgctctcctggttcttctggctcgtgtccacccaccctgcggtggagcgcaagatcgtgcgcgagctctgctccgttctcgccgcgtcacggggcgcccatgacccggcattgtggctggcggagcccttcaccttcgaggagctcgaccgcctggtctacctcaaggcggcgctgtcggagaccctccgcctctacccctccgtccccgaggactccaagcacgtcgtcgcggacgactacctccccgacggcaccttcgtgccggccgggtcgtcggtcacctactccatatactcggcggggcgcatgaaggcggtgtggggggaggactgcctcgagttccggccggagcgatggctgtcggccgacggcaccaagttcgagcagcacgactcgtacaagttcgtggcgttcaacgccgggccgagggtgtgcctgggcaaggacctagcctacctgcagatgaagaacatcgccgggagcgtgctgctccggcaccgcctgaccgtggcgccgggccaccgcgtggagcagaagatgtcgctcacgctcttcatgaaggacgggctacggatggaggtacgtccgcgcgacctcgcccccgtcctcgacgagccctgcggcctggacgccggcgccgccaccgccgccgcagcaagtgccacagcgccgtgcgcgtagaagacctggcaccggcacgcgccatgcatgattcgtgcgtgctagctgttgaagggacgccggacattgaatgtgtagatagggcagcagtgcaagaccgtaagtaaaattgatgatgggtttggtgacaacattgaagtcactcctttccagaatttacgacccggataggagaaacagggaaactttgcagatcacaacacaagatctagccagccggggatctgatcgatttgcgtctgctcagagcacgggtgcatgggagaccaaggaggaaaacaaaaaataacagaaacagagtgagcaatatttgtgattgtagccacgggaaagagagaggagtaattagtaattcagatttgtttgcagtagctcggtgttggtgaccagatcatagccaactaggctattctattctattctattctattcttggagatgatttttcaaagccgtgtacccttattctattcttagagagttcatat

SEQ ID NO: 4286 - DNA, 2494 bp, Hordeum vulgare
caataaattcccagccatctcaaccaactgtgcgctgctcccatcgataacccatcacttctataaaaccctagcctccccctgccatcctcctcgcttgctccatgtggagtcacttattacggccagcccagccagcaccttaactgactcgtcgatccaccccttggatccattctacctagctcactagccaccagtggagtgcatacacgcacgtacacttgcagagcctgagcttgcttgggaaggtcggtcagtcgctggcaatggaggcggggacgtgggcggtggtggtgtcggcggtggccgcgtacatggcgtggttctggcggatgtcgcgcgggctacgcgggccgcgggtgtggcccgtgctcggcagcctgcctggcctcgtgcagcacgcagaggacatgcacgagtggatcgccggcaacctgcgccgcgcgggcggcacctaccagacctgcatcttcgccgtgcccggggtggcgcgccgcggcgggctggtcaccgtcacctgcgacccgcgcaacctggagcacgtcctcaagtcccgcttcgacaactaccccaagggccccttctggcacggcgtcttccaagacctgctcggcgacggcatcttcaactccgacggcgacacctggctcgcgcagcgcaagacggccgcgctcgagttcaccacgcgcacgctccgcacggccatgtcccggtgggtctcccgctccatccacggccgcctgctgcccatcctggccgaagcggccgcgggcaaggcgcacgtcgacctccaggacctgctactccgcctcaccttcgacaacatctgcggcctggcgttcggcaaggaccccgagacgctcgcccagggcctgccggagaacgagtttgcctccgcgttcgaccgtgccaccgaggccacgctcaaccgcttcatcttcccggagtgcctgtggcgctgcaagaagtggctgggcctcggcatggagaccacgctgaccagcagcatggcgcacgtcgaccagtacctcgccgccgtcatcaagacgcgcaagctcgagctcgcggccggcaacggcaagtgcgacacggtggcgacgcacgacgacctgctctcccggttcatgcggaagggatcttactcggacgagtcgctgcagcacgtagcgctcaacttcatcctcgccggccgcgacacctcctccgtggcgctctcctggttcttctggctcgtgtccacccatcctgcggtggagcgcaaggtcgtgcgcgagctctgctccgttcttgccgcgtcacgtggcgcacacgacccggcattgtggctggcggagcccttcaccttcgaggagctcgaccgcctggtctacctcaaggcggcgctctcagagaccctccgcctctacccctccgttcccgaggactccaagcacgtcgtcgcggacgactacctccccgacggcacgttcgttcctgccggctcgtcggtgacctactccatatactcggcggggcgcatgaaggcggtgtggggggaggactgcctcgagttccggccggagcgatggctgtcggccgacggcagcaagttcgagcagcacgactcgtacaagttcgtggcgttcaacgccgggccaagggtatgccttggcaaggacctggcctacctgcagatgaagaacatcgccgggagcgtgctcctccggcaccgcctgaccgtggcgccgggacactgcgtggagcagaagatgtcgctcacgctcttcatgaaggacgggctacggatggaggtatgtccacgcgacctcgccccagtcctcgacgagcactgcggcctggacgccgccgccgccgccgccactgccaccgccgccgcagcaagtgccacagcgccatgcgcgtagaagacttcgcatgcatgattcgtgctagctgttggtgggatgccggacattgaatgtgtagatagagcagcagtacagggccgtaagtaaattgatggcgggtttggtgacaacattcaagtcactcctttccagaatttacggcccggataggagaaacaaggaaactttgcagatcgcaagatctagccggatctgatttgcgtctcgattggagaacgggtgcatgggagaccaacaaggaaaacagctcaaaaacaacagaaacggagtgagcaataatttgtgattgattgtagccacggtgaagaaggaaaggagtaatcagtaattcagatttgtttacagtagctcggtgttggtgaccagatcatagccaactaggctattctattcttttctattctatttttggagatgatttttcaaagcgatgtagtagtattattctattatattcttagggagttcatatcttgtccaggaaacttgtaagtagacgtacgtactcaaggttgtttgcttctttgccaccatgttcatccatgacaagtttcttctttagtggtctgattcgctgccgtgcg

SEQ ID NO: 4287 - DNA, 1128 bp, Zea mays
gccccgttgccacacatacggatccaacaaaatctcccgcaaagacaacggcgagccaaccaccaccagcgtcccgcgctagctgcggcaccgcatggctgccgtgaccagcaccgcctccatctgcccggccgcagccggcgccctctcttcgctgccgtccttcatcacgcgcaagcccaccagcggcagcaggaggttgcagcaggcagcagcgacgacagtctgccactgccgctctgctcgggtagaggaggggctgctgggccggagggacgccttattgctcggcatcgtcttctccgccgcgacgccgccgctgctcgcccctgccggcgctctggcggacgaggccaccgccgagtcgcaggagggcttcactacgtacgaggatgaggccaacaagttcagcattcaagttccgcaaggctggctggtcggcgccggcgaggccagcggcatcaagtctgtcacggcgttctaccccgagcaggccgccaccgactccaatgtcagcgtcgccatcaccgggatcgggccggacttcaccagcctcaagtccttcggcgacgtcgatgccttcgccgagggtctggtgaacggcctggacaggagctggcagaggccgccggggctcgccgccaagctcatcgactccagggcggcaaacggcctgtactacctggagtacacgctgcagaaccccggcgagcgacggcgccacatcgtctcggccatcgggatggccttcaacggctggtacaaccgcctctacactgtgacgggccagtacatcgacgacgatgactcggagaagtacaggcctcagatagagaaggctgttggatcgttcaggctgacatgaaagatgcgatgtcatccagcaccagcagcagcagccgcccacggtacataaaccctaaatatgtatgcggagaggtccagcaacatgttgtgcccgaaaattgacaccttgccatttcgatgagacaagacaaggcatgtgcctattgccctattccaattcttgagcactgtaacactgccaatatgcagagtatatgttttctgcctgttgaggtggatacaaatgcatgctttttttttattaataactcatgtgtaaca

SEQ ID NO: 4288 - DNA, 1365 bp, Setaria italica
atgacggttcatgtggatgtgcgggttttcgtgcgtttcctgtacttcgggcagtttctggacgagcgtgcaagctgctacaacgaccggagcgcccaaagtgggttcccgtcgaacgaacggtgcctaccaaaacacacggctggaacaaaatatcccccacgaaaacaaacggcgagccaaccgcaaccaccactcggcaccggctggcctgcggcgcgcgccatggctgccgtgaccagcaccgccttcctctgcccggccgccggcggcctctccccctcgccgcccttcaggcgcaatcccggcagcagcagcagccgcaggaggctgcagctgcaggtctgccactgccgccctgctcgggtagaggggctggaccggagggaggccttgctcggcgtcgccctctccgccgccgcgccggcgctcttcgcccccgcggctgctctggcggccgaggccaccgagttgcaggagggcttcaccacgtacgaggatgaggccaacaagttcagcattgtggttccacaaggctggctgatcggcgccggcgagtccagcggcatcaagtccgtcacggcgttctaccccgagcaggccgccgactccaacgtcagcgtcgcgatcaccggcatcgggccggacttcaccagcctcaagtccttcggcgatgtcgacgccttcgccgagggcctggtgaacggcctggacaggagctggcagaggccgccggggctcgccgcgaagctcatcgattccaaggcggcaaacggtctgtactacgtggagtacacgctgcagaaccccggcgagcggcggcggcacatcctctctgcaatcgggatggcgttcaacggctggtacaaccgcctctacacggtgacaggccagtacatcgacgacgaggagtcggagaagttcaggcctcagattgagaaggcggttcgatcgttcaggctgacatgagagtgcttcgcactgtgtagcattcagagatgcacggtatgcaggtggacgcctgtaaattgaccaactcgtcttccacattattaagtttttttttaagcaagtctcacggtatgttggaaagtacattgctacacctcaacaatcccatagatcgtctcatgtaatgccacatataatttttgctggtgtggaggaaggagggtgatgagagaaaaagaggtcgttgtttcgcgaaacaactgcgaaacaaccgtctcataggctagattttaggactacgagatgattactctacaattgtacgagttgtggttgcatgcaactcataatattttttttctatgcacaaattaaggaaatagaattactatgagacaactttaaaaaataacc

SEQ ID NO: 4289 - DNA, 786 bp, Saccharum officinarum
  misc_feature (633)..(633): n is a, c, g, or t
  misc_feature (637)..(637): n is a, c, g, or t
  misc_feature (672)..(672): n is a, c, g, or t
  misc_feature (710)..(710): n is a, c, g, or t
  misc_feature (721)..(721): n is a, c, g, or t
gccccgttgccacacatacggctgcaacaaaatatcccgcgaaaacaacggcgagccagccagccaaccaccgccaccggctgcatcccgtgcgtgcgtccttcgcttcagcctgcaccatggctgccgtgaccagcaccgcctccctctgcccggccgccgccggcggcctctcttcgtcgtcgtcgtttacgcgcaagcccagcagcaggaggctgcagcagggagcatcaacggtctgccactgccgccctgcacgggtggaagggctggaccggagggacgccttgctgggcatcgtcctctccgccgcggtggcgccgctgctcgcccctgccggtgctctggcggacgaggccaccaccgagtcgcaggagggcttcactacgtacgaggatgaggccaacaagttcaccattcaagtaccacaaggctggctggtcggcgccggcgaggccagcggcatcaagtccgtcacggcgttctaccccgagcaggccgccgccgattccaacgtcagcgtagccatcaccgggatcgggccggacttcaccagtctcaagtccttcggcgacgtcgactccttcgccgagggcctggtgaacggcctggacaggagctggcagaagccgncggngctcgccgccaagctcatcgactccagggcggcanacggtctgtactacctggagtacacgctgcagaacccncgcgagcggcngcggcacatcgtctcggccatcgggatggcgtcaacggctggtacaaccgctctacacgtgacag

SEQ ID NO: 4290 - DNA, 2655 bp, Zea mays
cgatggccgtggagctagctgcctgggaatgggataggatattttcccgtggcgggataaagcccaacgagcccgcgttacggatatcttcgccatccgttgcctcgcgagctcgccgccatggcattggctctccccctcgcccgcctcgtccccgcctgccagtgccagccttggccccacctgcgctttcggaagcgccacgtctccttcgccgctcacgccagttctcgcgccgccttcgctgcctgcgcggcggcccctgccctccaggtccaggcgccggaggcggaggcggaggcggagacggtcgagcaagtgggcccgaagacacgcctcgtcgcgcagaacatcccgtgggactgcacggccgacgaaatgcgcgcgctcttcgagagccacggctccgtcgtcggcgtcgagctttcaatgtacagcgccaataaaaacagagggttggcgtttgtaaccatgggttcagaagaggaggctcttgcagctctcacccatctcaattcaactattttaaatgataggaaaattaaggtggacttcgcaaggcctagaaagaagcaacctaagcaacctgctgtggtatcggatgacacggaaaagtatgttgtgtttgtcgggaatttgacatggagggtaagaaatcgtcaccttcgggaattatttgcctctgccccaggtgtggtatcagctgaagttatcttccataccaccactccgagacgatctgctggctacgcgtttgtttctttttcttcgaaagagagcgcaggggccgccatatctgctttcaacggaaagatattgatgggacggcccattaacgtgatgttcaaagatgaaaatggtgaaaagaatgaaccttcttctgtcccaaagaaggccgaggtggaaccatctgatgaccagagtgataagctaagcatgaactgttaacgaaacaaataggtcatatctgtcattacacacacatatatattctgacccatggtatttccttttcagaaatagttatgtcccttgttttattgatttgccaatctggtgtatgttcgtcgtgaggcaaacgtgagcgctgtgagggcgtcaaatcctcccgcgcgcgttgcaagggtcctaaatataaacttaattaggtttaataaatttgtctcgtctttttaattttatagtttctatatttaatactcgtaattactatttaaacattcggtgtgacataaattaaattttagttaggtggaaccaaacagagaattgaggggggttgcagtgaattaggagaggattttgacatatagggcatttgtagatttaagacaaacgaacatgagtcatgggcagccaatgaacatgattccatacgtattgttggccgacgaaaggaaaataagtatactcggacgtatttgcgtaggagcatagcagttggactggacatgccgtgtaatgcaccacgacgcggttaactcgggacggaagcaacgcaactcggcacgaagaaggaaaagccaccaccggttcctccgccgtccccgcggtttcagttccttgcttgcttgcttgctcttgctctccctctctcgtggaagccagccacacaaggcagaaagagagagtgacgttgtgttccatcccgttccgctgaagcaaccgctctcctacaccaaaccacccacaccactctaggtctctagccgatgcgatggatgtggatccagcagcggaccagcggaggaagaacaagggcgggctggagtcggagctggagcgccactacgacgacctgcagcgggagatgatgctgatggccgccgatcggccgcacaagcaactgcaacagcatcgacgtcacgggcaccgccccgatctgctccagaactgcgacctgcccccaccggccaagctcttcggccccgtacccaccctgcagaggctggagaccgctgctgccaaggaccacaaggccgacgacggcctgctgcgggcgctgcgcctgtcgcagtcgcgcgcgcgggaggcggaggacaagctggcggccgcgggcgccaccaacgtcgacctcgcggcgctgctcgtgcgggactccgtcgcgctctccgcccaccgccgctgggtcatgatgctggaggccgagaattccctgctccgaggaccacgacgagatgcggatggtccggaaccggaccacggagccggcggggtggccgcgtggtgggtcgcgctcgccgtctgcgtcggcgtcgccggcgtcggcctcgcgctcggcaggttcctctgctgaacaactgtgatggatcattctccttccttcctgctgctgtagaaagtgtaaatctacttcgagacgacgatcgatcgatcaatcaatcagtcaaaaaaaaaactgtaaatactgctacagtagtacggagtaggattggtctccaagttaaagtacccattcctgcacgctttctgctttagcttgtggaaacaatctgttgagaatttgatgcctgccgtgaggttccgtgtcactttccattgctcacagtcacagcacagaaattgtcgcgcattcatgtacgacgacaaggacttttccctgtagttgtaatccattttttttgaaaaaaacaattaattgattttacctgtaaa

SEQ ID NO: 4291 - DNA, 1155 bp, Setaria italica
ggatattttgccgtggcggataaaacccagcgaggccgcccgcgccacggatatcttcgccgcccgctgcgtcgcgagctcgccatggctctccccctcgcccgcctcctcctccccgcgctcccggcatgccagtgccagccaccgctccgcctgcgcttccccgagcgccacgtcgctcctgccgccgcacgttcccgcggccaccgcggcgccttcgctgcccgtgcggccgctagtgcccctgcggccccggcccccgcggcgccggaggcggaggagcaagtggggccaaggacacggctcgtcgcgcagaacatcccgtgggactacacgggcgacgacatgcgcgcgctcttcgagaagcacggctccgtcgtcggcgtggagctttcaatgtacaatgccagtaaaaacagagggttggcgtttgtaaccatgggttcagaagaggaggctcttgcagctctcaacaatctcaattcaactactttagatgatagaaagatcaaggtggactttgcgagacctagaaagaagcaacctaagcaagttaagcaacctgttgtggtatcagatagcacggaaaagtatattctgtttgtcggaaatttgacatggagagtcagaaatcgtcaccttcgcgaactatttgcctcggccccaggtgtcctatcagctgaagttatctttcataccactacgccaaggcgatctgctggttatgcatttgtttctttttcttcaaaagaggctgcagaggctgccatatcttctttaaatggacagaaattgatgggacgacccattaatgtgatgttcaaagaagaaagtgctaaaaagaatgaatcttctgtcccaaaggaagaggaggccgaggaggaatcatctgagcagagtgatagctaaacactaacttttcagagaatcaagaaaagtgaaatgaattgatctgtggttacatatattctgacccatggacatggtatttctttttcagcagtagttatatcttttgttttatttatctctatttattccatgtacatattggtttaccaagattggaagttgttttccatgtgagaaatgaaacagcctccttaacatgttattgttgattacatgtctgtttatttatgccgaacctacaac

SEQ ID NO: 4292 - DNA, 3003 bp, Zea mays
tcttcctcggctcctccaccccggtcctctcctgccgcgtcgcgttcgcccctcgcagcgggcaactcccaccgccgccgcttcgcatccgcccatctgcttccatcgtctcacggaggtcgctcacttcgccgccgcccgccccgcctctcccggtgccacggggccctcggccgcgccgtggcgcttaaaccctagatctgtgcctccgcgctggccgcggccgcgtcccgacgccggcacgccgccgatcgccgcacgtcgctcgatcccaggttttgccgctcgagtttagataagttccttcaatgcatcgtgttgggagtgctggtaacacagctggctcgactcgaccgagaaaagagaagcgcttcacatatgtactcaatgatgctgatgataaaaagcattgtgcggggatcaattgcttggcttatctagatggttccatatttagtacaagtgatcatctttttagcgggagccgtgatggtaccttgaaaagatgggaattaaataatggggatgcaagcttctcaggaactttcgagtctcatgttgattgggttaatgatgccattatagttggagacaagcttgtttcctgctcctcagacactacaataaaggtgtggaattgcttctctgatggtgcctgtaccaggactctccgccggcattctgattacgtgatttgtcttgctgctgctgagaataatagcaatattgtagcctctggtggtcttggtggtgaggttttcatttgggaccttgatgctgctcttgctcctgtagccaaatctgtggatgcaaaagaggatgaggttcctaatggaaactccgggcctgctttgacaacactgtgcagcataaattctagtagcaatattgcttcctctaatggtcaatcacatgggtacagtccaatagctgccaaaggtcacaaagattcagtttacgcactggcgatgaatgatacaggaacccttcttctctctggtggcactgagaaggttgtccgagtgtgggatccgaggacaggatcgaaaaacatgaaattgagagggcacactgacaatatcagagccttgcttgttgattctacagggaggtattgcctatcgggatcatctgattcaatgataagactatgggatctaggacagcagcgttgtgttcattcttatgctgtgcatactgattctgtttgggcacttgcaagcactcctgcatttggtcatgtctacagtggtggaagagatcaatctgtatacctaacagatttgtccacaagagagagtcttttactctgcacaaatgaataccctgttctacagttgtctctgcaagatgacacaatatgggtggcaacaactgattcttctgtttatggatggccagctgaagggcgcacaccccaaaaagtcttcgaaaagggtgcctcattcttagctgggaatttgtcattctcaagggcaagagcatctttagaaggatcggcacctgtccctgtatacaaagagccatcttttgttatcccaggagttccagcaataattcaacatgaaataatgaataatagaagacatgtactgacaaaggataccactggttcagtcaaattgtgggagatcactcggggtgctgttattgaagattttggcaaggtttctttcgaagacaagaaaaaagagttgtttgagatggtaagcatacctgcttggttcaccatggatgctcgattagggtgcttgtctgtccacctggatactccacaatgcttttctgcagaaatatatgcggttgacctaaatgttgctggagcacaagaagatctcaagattaatttggctcaagagacccttcgtggtttgctaattcattggagtaaaagaaagcagaaatctagttcacacagcttgtgtaatggtgatagttcaatagggaaagatgttccgtcgaaagactcgccccggtcaagacctgaggtcgacgatgccactcaaaaccatgcaactcatgtgcttccatcatttgagttttctacagtttcacctccatcaattatcacggaaggttctagtggagggccatggagaaagagaattaccgatttggatgtaactgagggtgatcttccatggtggtgtgtggactgcattactctcaatcgatatccaaaggagaatacaaaatgcgggttttatttacaccctgctgaaggctcgcctgcaccaaacataactcaagggaagcttagtgctccacggatattgcgaattcacaaggtagctaactatgtggttgagaaactcgttcttgacaaaccattggatggaggctctgatgcgtttgttatgggattgagttctgctcaatcacagctctcagttctagatagttcttcgcggcttggactaaagccatggcaaaaaacaaagccatgtattgagatattgtgcaataaccaggttctatcaccagagatgagtttggctactgtgcgaacatatatatggaaaaagccagaagatttgattcttcattacagagtggtccaaccgagatgatcacggcttcagatcacatggttctcagcatgcctgcaccataaacggtgtggttgaagacacccttggcttagcgaggaaaccgtcagaaatattttgctcttgggctccggtagcctttctcctagaatcccgacttcgtttgcttctttgtaaagttccttcctgatcttgccctggtagtaagatgtatcatagcacaggtataaggccctctgcttgtacatgtagaagatttgggtgcttaataaaggtcaaatggatttttttcgtttttctttgataaagtttgtaagaaaacgggctggttctcggctcagaccgtgacgttccgacgtcgattattggatttaaccctgtcgcatcctcttggttctgttagcgtaagaggtggacgggatgtcgggagcaataaagctgtttttttatatat

SEQ ID NO: 4293 - DNA, 2657 bp, Zea mays
gtactgacgccggcacgctgccgatctccatacgtcgctcgatcccaggtttagctgcttcgaatttagataagtttcttccatgcatcgtgttggaagtgctggtaacacggctggctcgactcgaccgagaaaggagaagcgcttcacatatgtgctcaatgatgctgatgataaaaagcattgtgcaggaatcaattgcatggcttatctaaatggttctacatttagtacaagtgattacctttttagcgggagtcgtgatggtaccttgaaaagatgggaattaaataatggggatgcaagtttctcagcaacttttgagtctcatgttgattgggttaatgatgccattatagttggagaaaagcttgtttcctgttcctcagacaccacaataaaggtctggaattgcttctccgatggtgcttgtaccaggactttccgccagcattctgattatgtgatttgtcttgctgctgctgagaagaatagcaatattgtagcctctggtggtcttggtggtgaggtttttgtttgggaccttgatgctgctcttgctcctgtagccaaatctgtggacgcaaaagaagacgaggttcctaatggaaactcagggcctcctttgacaacattgtgcagtgtaaattctagtagcaatattgcttcctctaatagtcaatcacatgggtacagtccaattgctgccaaaggtcacaaagattcagtttacgcattggctatgaatgatacaggaactcttcttctctctggtggcactgaaaaggttgtccgggtgtgggatccgaggacaggttcaaaaaacatgaaattgagggggcacactgacaatatcagggccttacttgttgattctacagggaggtattgcctatcaggatcatctgattcgatgataagactatgggatctaggacaacagcgttgtgttcattcttatgctgtgcatactgattcagtttgggcgcttgcaaccactcattcgtttggtcatgtctacagtggtggaagagaccaatctgtatacctaacagacttatccacaagagagagtgttttactttgcacaaatgaatgccctattctacagttgtctctgcaagatgacacaatatgggtggcaacaactgattcttctgtatatggatggccagctgaagggctcacaccccaaaaggttttccaaaagggtggctcattcttagctgggaatttgtcattctcaagggcaagagcttctttagaaggatcagcacctgtccctgtatacaaagagccatcttttgtcgtcccaggggttccagcaatagttcaacatgaaataatgaataatagaaggcatgtactgacaaaggataccactggttcagtcaaattgtgggagatcacccggggtgctgttattgaagactttggcaaggtttcatttgaggataagaaaaaggagttgtttgagatggtaagcatacctgcttggttcaccatggatgctcgattaggatgcttgtctgtccacctggatactccacaatgcttttctgcagaaatatatgcagttgatctaaatgtttctggagcacaagaagatctcaagattaatttggctcatgataccctttgtggcttgctagttcattggagtaaaagaaagcagaaatctagttcgcatggcttgcctaatggtgatagttcaatagggaaagatgttccgtcaaaagactcgcaccgatcaagaactgaggtggatgacacaactgaaaaccacacaactcatgtgctcccatcatttgagttttctacagtttcacctccatcaattatcacagaaggttctagtggagggccttggagaaagagaattactgatttggatggaaccgaaggtgatctaccttggtggtgtgtggactgtgttactcacaatcgatatccaaaggaaaatacaaagtgtggcttttatttacatcctgctgaaggttcgcctgcgccaaacataactcaagggaagcttagtgctccacggatattacgaattcacaaggttgctaactatgtggttgagaaactcgttcttgacaaaccattggatggaggctctgatagtacgtttgttatgggattgagttctgctcaatcacagctctcacagctagatagttcttcgcggcttggactaaagccatggcaaaaaacaaagccatgtattgaggtattgtgcaataaccaggcaaatatgagtttggctacagtgcgaacatatatatggaagaagccggaagatttgattcttcattatagagtggtccaatcgagatgatcacggcttcagatgtacatgctcacatggttctccagatatgtcccagcatgtccgcacctttagatggtgtggttgaagatgcctttggcttagagaggaagcatcatcttcacagaggaaatattttgctcttgctccgccctccccccggtagctgttcccagaatcgacttgttcgcttctctgtaaagttcctgaccttgccctggtagtaagatgtatcatagcacaggtataaggctctctgctggctgccgagcttgtaaatgtagaagattaggtgcttaataaaagatcgaaaggatatgttttttct

SEQ ID NO: 4294 - DNA, 3055 bp, Setaria italica
cttcctcggctcctcctcctccccggtcatcctctgccccgtcgcgtccgcccctcgccgcggcaactcccaccgcgtctgccgccgctgcagccgcctcacttcaccaacctcacgcgcccgccggctttgctgccgtccactacgcctctcccgctgctttcctccgggcgccacggccgcgccgcggcgccttaaaccctagatctgcgccccccgctccacactggccgcggacgcatcccgacgccggcgcgccgccgatcgccgcccgtcgcccgatcccaggtttagttgcccctagtttggatagcttccttcaatgcatcgtgttgggagtgctggtaacacggccggctcgactcgaccgagaaaggagaagcgcttcacgtatgtgctaaatgatgctgatgctaaaaagcattgtgcagggattaactgcttggcttatctaaatggttctgcaaatagtacaagtgattatctttttagcgggagtcgagatggtaccttgaaacgatgggaattaaataatggggatgcaagtttctcagcaacttttgagtcacatgtcgattgggttaatgatgctatcatagttggtgagaagcttgtttcctgttcctcagacaccaccctgaaggtgtggaattgcttctctgatggtgcctgtaccaggactctccgccagcattctgattatgtgatttgtcttgctgctgctgagaagaatagtaacattgtcgcctctggtggtcttggtggtgaggtcttcatttgggaccttgatgctgctcttgctcctgtagccaaatctgcggatgcaaaagaggatgaagttcctaatggaaactccggacctgctttgacaactctgtgcaatgtaaattctagtagtaacattgcttcctctaatggacaatcacatgggtacagtccaattgccgccaaaggtcacaaagattcagtttatgcactggctatgaatgatacaggaacccttcttgtctctggtggcactgaaaaggttgttcgagtgtgggatcccaggacaggttcaaaaaagatgaaattgagggggcacacagacaatatcaggaccttgcttcttgattctacaggaaggtattgtctatcaggatcatctgattcgatgataagactatgggatctaggacagcagcgttgtgtccattcttatgctgtgcatactgattcagtttgggcacttgcaagcactccttcatttggtcatgtctacagtggtggaagagaccaatctgtatacctgacagatttgtcaacaagagagagtgtcttactctgcacaaatgaataccctattctacagctgtctctgcaagatgacacaatatgggttgcaacaaccgattcttctgtttatggatggccagctgaaggacacacaccccaaaaggtcttcgaaaagggtggctcattcttagctgggaatttgtcattctcaagggcaagagcttctttagagggatcagcacctgtgcctgtatacaaagaaccatctttggttatcccaggagttccagcaataattcagcatgagataatgaataataggaggcatgtactgacaaaggatactgctggttctgtcaagctgtgggagattacccggggagctgttattgaagactttggcaaggtttcttttgaagataagaaaaaagagttgtttgagatggtaagcatacctgcctggttcaccatggatgctcgattgggatgcttgtctgtacacctggatactccacaatgcttttctgcagaaatatatgcggttgacctaaatgtttctggagcacaagaagaccttaagattaatttggctcaggagacccttcgtggtttgctagttcattggagtaaaagaaaacagaagtctggttcacatagcttgtcgaatggtgatagttcatcagggaaggatcttccttcaaaagactcaccgcggtcaagatccgaggtggatgatgggaccgaaaaccatgcaactcatgtgcttccgtcatttgagttttccacggtttcgcctccgtcaattatcacggaaggttctagtggagggccctggagaaagagaattactgatttggatggaactgagggtgatctcccatggtggtgtgttgactgtgtcacgcacaatcgttatccaaaggagaatacaaaatgcggcttttatttgcatcctgctgagggatcaccagcaccgaacataactcaaggcaagctgagtgctccacggatattgcggattcacaaagtagctaattatgtggtcgagaaactcgttcttgaaaaaccattggacggaggctctgacagcacatttgctatgggattgagttctggtcaatcgcagctctcagcgctagatagttcttcgcggattggactaaaggcatggcaaaaactaaagccatgtgtagagatattgtgcaataaccaggttctatcgccagagatgagtttggctacagtgagaacatatatttggaagaagccggaagacttaattcttcattatagagtggtgcagtcgagatgatcgcagctccagatgtacatgctcactttgttctccagaagcgttcagcatgtttgcacagtgggtggtgttattttggtggtgttgaagatgcccatggcttagagaggaaactatcatcttacagaaatattatgccttagctgttcctgaaaacgtgacttctttgtaaagttcctgatcttgccctgctagtaagatgtatcatagcacaggtataaggttctctgctggccgccaagcttgtaaatgtagagactgggtgcttaataaagattaaatggatatggttttttagggttttttttacatatatggtttgtaagaaatgcggatgctcatctcagatggtgtggcgttttgccatcgattattggtttcaccctgttcattcctcttggacctatttggatcgaaccagggaaagaggtgaacaaagttcggtaacaataaaattgttttttcccc

SEQ ID NO: 4295 - DNA, 2496 bp, Pennisetum glaucum
gtgctaaatgatgctgatgcgaaaaagcattgtgcagggatcaactgcttggcttatctaaatggttctccatttagtacaagtgattatctttttagcgggagtcgggatggtaccttgaaaagatgggaattaaataatggagatgcaagcttctcagcaacttttgagtcacatgtcgattgggttaatgatgctatcatagttggtgagaagcttgtttcctgttcctcagacaccaccctgaaggtgtggaattgcttctctgatggtgcctgtaccaggactctccgccagcattccgattatgtgatctgtcttgctgctgctgaaaagaatagtaacattgtcgcctctggtggtcttggcggtgaggtttttatttgggatcttgatgctgcccttgctcctgttgccaaatctgtggatgcaaaagaggatgaagttcctaatggaaactccgggcctgctttgacaactctgtgcaatgtaaattctagtagtaccattgcttcctctaatggacaatcacatgggtacagtccaattgccgccaaaggtcacaaagattcagtttatgcactgactatgaatgatacgggaacccttcttgtctctggtggcactgaaaaggttgttcgagtgtgggatcccaggacaggttcaaaaaagatgaaattgagggggcacacagacaatatcaggaccttgcttcttgattctacaggaaggtattgtctatcaggatcatctgattcgatgataagactatgggatctaggacagcagcgttgtgttcattcttatgctgtgcatactgattcagtttgggcgcttgccagcactccttcatttggtcatgtctacagtggtggaagagaccaatctgtatacctgacagatttgtcaacaagagagagtgtcttactctgcacaaatgaataccctattctacagttgtctctgcaggatgacacaatatgggttgcaacaactgattcttctgtttatggatggccagctgaaggacgcacaccccaaaaggtctttgaaaagggtggctcatttttagctgggaatttgtcgttctcaagggcaagagcttctttagagggatcagcacctgtgcctgtatacaaagaaccatctttggttatcccaggagttccagcaataattcagcatgagataatgaataataggaggcatgtactgacaaaggatactgctggttctgtcaagctgtgggagattacccggggagctgttattgaagattttggcaaggtttctttcgaagataagaaaaaagagttgtttgagatggtaagcatacctgcctggttcaccatggatgctcgattggggtgcttgtctgtacacctggatactccgcaatgcttttctgcagaaatatatgcggttgacctaaatgtttctggagcacaagaagaccttaagattaatttggctcaggagacccttcgtggtttgctagttcattggagtaaaagaaaacagaagtctagttcgcatagcttgtcgaatggtgatagttcatcagggaaggatcttccatcaaaagactcaccgcggtcaagatccgaggtggacgatggaaccgaaaaccatgcaactcaggtgcttccgtcatttgagttttccacggtttcacctccttcaattatcacggaaggttctagtggagggccttggagaaagagaattactgatttggatggaaccgagggtgatctcccatggtggtgtgttgactgcgtcatgcacaatcgttattcaaaggagaatacaaaatgcggcttttatctgcatcctgctgagggatcaccagcaccgaacataactcaaggcaagctgagtgctccacggatattgcggattcacaaagtagctaattatgtggtcgagaaactagttcttgaaaaaccattggacggcggctctgagagcacatttgctatgggattaagttctggtcaaccgctctcagtgctagatagttcttcacggattggactaaaggcatggcaaaaactaaagccatctattgagatattgtgcaataaccaggttctatcaccagagatgagtttggctacagtgagaacatatatttggaagaagccggaagacttgattcttcattacagagtggtccaatcgagatgatcgcagctcgagatgtagatgcaaaatgctcactttgttctccagaagcgttgagcatgtctgcaccgtgggtgttgttgttttggtggtgttgaagatacccatggcttagagaggaaactatcatcttacagagatatttttgccttagccgttcccggaaactgtgacttgtctgtaaagttgctgatcttgccctcctagtaagatgtaccatagcacaggtataaggttccctgctggccaccgagcttgtaaatgtagagactgggtgcttaataatgattaaatggatgtgtttttttt

SEQ ID NO: 4296 - DNA, 2698 bp, Triticum aestivum
tttttgatacatatccacctttcaatgcatcgtgtcgggagtgctggaaacacggccggttcaagtcgaccgagaaaggagaagcgcttcacatatgtgctcaatgatgctgataataaaaagcattgtgctggaatcaactgcttgtcgtacctgaatgcttctgcttctggtacaagtgattatctttttactgggagtcgcgatggtaccttgaagagatgggaataccaaaatggggatgcaaacttttcagcaacctttgagtcacatgttgattgggttaacgatgccattattgttggccaaaatcttgtttcctgttcctcagacaccacattaaaggtgtggaattgcttagcagatggtgcttgtaccaagactctccgccagcattctgattatgtgatatgtcttgctgcggctgaaaagaatagcaatattgtagcctctggtggccttggtggtgaggtcttcatatgggatcttgatgctgctattgcacctatagccaaatctgtagatgcaaaagaggatgaggttcctaacggaaactctggacctgctttgtcaaccttgtgcaatgtaaattctagtggcaacattgtttctaccaacggaaaatcacatgggtacagtccaattgctgccaaaggtcataaggattcagtttatgcattggatatgaatgatacagggacattgcttgtctctggtggtactgaaaaggttgttcgtgtttgggatcccaggacaggttctaagaacatgaaattgagagggcacactgacaatatcagggctttgcttattgattccactggaaggtattgtctatcaggctcgtctgactcaatgataagactatgggatctaggacagcaacgctgtgtgcattcttatgccgttcacactgattcggtttgggcgctcgcaagcaccccttcatttggtcatgtttatagtggtggaagagatcagtccgtgtacctgacagacctctccacacgagagagtgtcttactatgcacaaatgaacacccaatcctacagttgtccttgcaagatgatacaatatgggttgcaacaactgattcttctgtttatggatggccagctgaagggcaaaccccacaaaaggtttttcaaaagggaggctcattcttagctgggaatttgtcattctcaagagcaagagcttctttagaaggatcagcacctgtgcctgtatacaaagagccatctttcactattcctggagttccagctatagttcaacatgagatcatgaataatagaaggcatgtcctgacaaaggatactgttggttctgtcaaattatgggagattactcgaggagctgttatcgaagattttggcaaggtttcgtttgatgataagaaaaaggagttatttgagatggttagcatacctgcatggttcaccatggacgctcgattggggtgcctgtctgttcacctggatactccacaatgcttttctgcagaaatatatgcggttgatttgaatgttactggagcacaggaagatcttaagattaatttggctcatgagactcttcgtggtttgttagttcattggagtaaacgaaggccgaaaccaggcccacacagcttgtccaatggtgattcttcaatagggaaagatgtatcattgaaaaacttaccacatccaagatccgacgtcgacgatggaagcgaaaaccatgcaaataatgtgcttccctcgtttgagttctccacggtttcgcctccatcaattatcacggaaagttctagtggagggccttggagaaagagaattaccgatttggatggaaccgaggatgatttgccatggtggtgtgtggactgtgctgagaacggccgatttccaaaagagaacacaaagtgtggcttttatttgcatccggccgaaggctcacctgcaccaaacataacgcaagggaaactcagcgctccacggatattgcgagttctcaaagttgctaactatgttgttgagaagcttgttcttgagaaaccattggatggaagtccggacagcacatttgccatgggtttgacctctggcacatcagccctagatagttcttcacggcttggactaaagccatggcaaaaactgaaaccttctgttgagatattgtgcaacaaccaggttctgtcacctgagatgagtttggcgacggtgaggacatatatttggaagaagccggaggatttgattcttaattacagagtggtccaatcaagatgattgcaacctaaaatacatccgctcgtttggttcaccataggtgctgagcatatctgcattggagacggcatcgttgaagataaccatatgacctataggatgcaagtgttccactcttgtgctgctctttggtgccgttcccagaactacagcaacttaattcctctgtaaagtttttctgtgaatcttgtatctccaggcttctagtgagattgtatcatagcacaggtgtaatgatctgctggctaccaggcttgtatatctagagatttggatttctcaataaagcttctaaatgggataaaagaaattatttcttccccctccacgtacaaaatgatttgattgtaagaaaacatttttttccgctcctggacttaaccctgtttccatcgtcttgggatgaggtgtaagagaa

SEQ ID NO: 4297 - DNA, 3297 bp, Hordeum vulgare
aaaacagaggcacacgacacctctattgacccacctgccccctcgtcctcgccctcctcctcgctccgccccccgtcgggccctcacctcgccgcgacaaccgctaccgccgccgcgcaaaaccccgcccactcctcagcgccgcaatccatatccaccccaaccagatcgatcggcggcaccttctgctccaaatcccgcggcatcgcccctgagtctcccaccgctgaaacccacacccgagttcctcctcctcctcctaatctgccgctgccgtctcctcccgctcaaggacgcatgctacgaggctcggttctcgtgtgatctttctccgctgatctcgtctgctgcccttggactggcgcgggcatccggaagggacgcgatcccttttgctggctactccaatttttgatacatatccacctttcaatgcatcgtgtcgggagtgctggaaacacggccggttcaagtcgaccgagaaaggagaaacgcttcacatatgtgctcaatgatgctgataataaaaagcattgtgctggaatcaactgcttgtcatacctgaatgcttctgcttctggtacaagtgattatctttttactgggagtcgtgatggtaccttgaagagatgggaataccaaaacggggatgcaaacttttcagcaacctttgagtcacatgttgattggattaacgatgccattattgttggccaaaatcttgtttcctgttcctcagacaccacattaaaggtgtggaattgcttagcagatggtgcttgtaccaagactcttcgtcagcactctgattatgtgatatgtcttgctgctgctgaaaagaatagcaatattgtagcctccggtggccttggtggtgaggtcttcatatgggatcttgatgctgctattgctcctatagccaaatctgtagatgcaaaagaggatgaggttcctaaaggaaactctggacctgctttgtcaaccttgtgcaatgtaagttctagtggcaacattgtttctaccaacggaaaatcacatgggtacagtcctattgctgccaaaggtcacaaggattcagtttatgcattggatatgaatgatacagggacgttgcttgtgtctggtggtactgaaaaggttgttcgtgtttgggatcccaggacaggttctaagaacatgaaattgagagggcacactgacaatatcagggctttgcttattgattctactggaaggtattgtctatcaggctcatctgactcaatgataagactatgggatctaggacagcagcgctgtgtgcattcttatgccgttcacactgattcggtttgggcgcttgcaagcaccccttcatttggtcatgtttatagcggtggaagagatcagtccgtgtacctgacagacctctccacacgagagagtgtcttactatgcacaaatgaacacccaattctacagttgtccttgcaagatgatacaatatgggttgcaacaactgattcttctgtttatggatggccagctgaagggcaatccccacaaaaggtttttcaaaagggtggctcattcttagctgggaatttgtcattctcaagagcaagagcttctttagaaggatcagcacctgtgcctgtatacaaagagccatctttcactattcctggagttccagctatagttcaacatgagatcatgaataatagaaggcatgtcctgacaaaggatactgttggttctgtcaaattatgggagattactcgaggagctgttattgaagattttggcaaggtttcgtttgatgataagaaaaaggagttgtttgagatggttagcatacctgcatggttcaccatggacgctcgattggggtgcctgtctgttcacctggatactccacaatgcttttctgcagaaatatatgcggttgatttgaatgttactggagcacaggaagatcttaagattaatttggctcatgagactcttcgtggtttgttagttcattggagtaaacgaaggccaaaaccaggcccacacagcttgtccaatggtgattcttcaatagggaaagatgtatcattgaaaaatttaccccatccaagatccgacgttgatgatggaagcgaaaaccatgcaaataatgtacttccgtcgtttgagttctccacggtttcacctccatcaattatcacggaaagttctagtggagggccttggagaaagagaattaccgatttggatggaaccgaggatgatttgccatggtggtgtgtagactgtgctgagaacggtcgatttccaaaagagaacacaaagtgtggcttttatttgcatccggccgaaggctcacctgcaccaaatataacacaagggaaactcagtgctccacggatattgcgagttctcaaagttgctaactatgtggttgagaagcttgttcttgagaaaccattggatgggagtccggacagcgcatttgccatgggcttgacctctggcacatcagctctagatagttcttcacggcttggactaaagccatggcaaaagctgaaaccttcagttgagatattgtgcaacaaccaggttctgtcacctgagatgagtttggcaacggtgcggacatatatttggaagaagccggaggatttgattcttaattacagagtggtccaatcaagataattgcaacctaaaatacatctgctcgtttggttcaccataggtgctgagcatttctgcattgcagacggcagctttgaagataaccatatgacctataggatgcaagtgttccactcttgtgctgctctttggtgccgttcccagaactacagcaacttaattcctcctctgtaaagtttttctatgaatcttgtatctccaggcttctagtgagattgtatcatagcacaggtgtaatgctcagctggctaccaggcttgtatatctagagatttggatttctcaataaagcaaatgggataaaagaaattatttctcccgtctccacatacgaaatgatttgattgtaaaaacattttcccctgatcctggacttaaccctgtttccatcctcttggaatgaggtgtaagagaataaaattactcccaagggaactattttgcaatgtggacgtgaaagtctgcattgctgtgtgatagggctcaaagtattcagggctagagtgttgcgttgtgtttggcattgggacagattattatgttaattgagtatggttgaatcattttaggccctctttccttcaaataaattatatcggaatcaggatt

SEQ ID NO: 4298 - DNA, 2795 bp, Brachypodium distachyon
aagctaccccaatttttggctacatacccaaccttcgatgcatcgtgtcgggagtgctggcaacacgggcggttcaagtcgaccgagaaaggagaagcgtttcacatatgtgctcaatgatgctgataataagaagcattgtgccgggatcaactgtttgtcctacctgaatgcttctgcttctggtacaagtgattatctttttactgggagtcgagatggcaccttgaagagatgggagttccaaaatgggaatgcaaacttttcagcaactttcgagtcacatgttgattgggttaacgatgccattattgttggccaaaatctcgtttcctgttcctcagacacaactataaaggtgtggaataacttatcagatggtgcttgtaccaagactctccgccagcattctgattacgtgatctgtcttgctgcagctgaaaagaatagcaatattgtagcctctggtggccttggtggtgaggtcttcatatgggatcttgatgctgcgcttgctcctgtagccaaatctgtagatgcaaaagaggatgatattcctaatggaaaccccggacctgctttgtcaacattgtgcaatgtaaattctagtggcaacatttcttccaccaatggaaaatcacatgggtacagtccaattgctgccaaaggtcacaaggattcagtttatgcactggctatgaatgatacaggaagcttgcttgtctctggtggtactgaaaaggttgttcgtgtttgggatcccaggacaggtacaaaaacctcaaaattgagagggcacactgacaatatcaggactttgcttcttgattctactggaaggtattgtctatcaggttcatctgattccatgataagactatgggatctaggacagcaacgttgtgtgcattcttatgctgttcatactgattcagtttgggcgcttgcaagcaccccttcatttgcacatgtttatagtggtggaagagatcagtccgtgtacttgacagatctggcaacacgagagagtgtcttactctgcacaaatgaacacccaatcctacagttgtccttgcaagatgatacaatatgggttgcaactactgattcttctgtgcatggatggccagctgaagagtgcacaccccaaaaagttttccaaaagggtagctcatttttagctgggaatttgtcattctcaagggcaagagcttctttagaaggatcagcacctgtacccgtatataaagagccatcattgactattcctggagttccagcgataattcagcatgagatcatgaataatagaaggcatgtcctgacaaaggatactgctggttctgtcaaattatgggaaattactcgtggagctgttattgaagacttcggcaaggtttcttttgacgataagaaaaaggagttatttgagatggttagcatacctgcgtggtttaccatggatgctcgattgggatgtctgtctgtccatctagatactccgcaatgcttttctgctgaaatatatgcggttgacttgaatgtttctggagcacaggaagatcttaagattaatctggctcacgagactcttcgtggtttgttagttcattggagcaaaagaagacctaaacctgggtcacacagcttgtcgaatggtgatggttcaatagggaaagatgtatcattgaaaaatttaccgcatccaagatccgatgttgatgatggaaccgaaaaccatgcaagcaatgtgcttccctcatttgagttctctacggtttcacctccatcagtcattacagaaagttctagtggagggccttggagaaagagaattactgatttggatggaactgaggacgatctcccatggtggtgtgtggactgcgcagagaacaaccgatttccaaaagagaacacaaagtgtggcttttatttgcatcctgctgaaggctcacctgcaccgaacataacacaagggaaactcagtgctccacggatattgcggattctcaaagttgctaattatgtggttgagaagcttgttcttgagaaaccactggatggaagtcctgacagcacatttgctatgggattgacttctggccaatcacaactctcagctctagatagttcttccagacttggactaaagccatggcaaaagctaaaaccctctgttgagatattgtgcaacaaccaggttttgtcccctgagatgagtttggcaacggttcgaacatatatttggaagaagccagaggatctgattcttaattacagagtggttcagtcgagataatttcaacttcagatacaggtgctcacccgcttcgcccatagtagttcagcgtatctgcatcagagacggcgtgattgaagataaccgtttgatgacctagagcgagaaccattagatgcaaaatgttccatttgtgctgccttgtggtgccgtcccctgaaccacacaacaacctatttgcttcttgtaaagttttcttgtgaatcttgtacctccaggcctctagtgagattgtatcatagcacatgtgtaatgatctgctggctataccaagcttgtatatctagtgattgagtgcttacgtaataaagcttataaatgggatagaagaaattcattttatcccccccccccccccccctcacatatgtgattttgctgtaacaaacgtaaccaaacagtgcaccattttgctctgtgttgcgctttaacccgttcgcatcacccagagtatctccggagtccggatggtgtgcaagagaataaaattgtt

SEQ ID NO: 4299 - DNA, 3864 bp, Brachypodium distachyon
atggacctgggcctggacctcgccgtgcagcttcgcgagaccatccccggcgccgacttcgccttcaccaccgccgacacccgcgccgccttcctcctcctcgcccacctccccgggtacagcaaggatgagatcgaggtgcgggcgggcgagggcgggcgggagatctccatcgtggtgggcgcgaggaaggatgatggtggggtcgcggtggaggcgtcggccggaggacggcgggtgcgggtggcgcaccggcggcgcgtggaggggttccggcgggatttcgccgtgccggacggcgtcgaggtcggccgcatctccgtcgcgttcgaggaggacgacgcgctgctcgtcgtcgtcttgcccaagctgctcccgcccacgccggcggcggtcgacgatgaaggcctcgacgtgacggcggtggaggtcgaggaggagccgccggtgatggtggatatcgagtgcgacgtggtgttcgaggtgccgacggtgtacagggagctagccgtggagacgcccatcgaagtgctcgagccgcccccgccgccggtggctgacatcccgggcccgccgcctgtcgatatcccatgcgacgtcgtgttcgagccccctccgccgcccgtggtcgaggagcccaagccgccgcctgcagtcgaggggttggtgagggagccggagctgccgcctgtggaaccacccgagccggtgccggagcctcctccgccgccggtcgacccaccgccggtaccagggcctcctccgccggtggacccacctgcaccggtgccggagcctccgccgtctccgccgccggtacccgagcctcctctgcccgtggaaccacccgtgccggtgcccgagcctcctcctccgccggtacccgctcctcctccgcccgtggacccacccgcaccggtgccggagcctccgccgccgccgcccctggacccaccgccaccgccagttcaggagccgccgcagattgatccaccaacggagaaaccgaaccgagagcagagcggtgaatcaggtggcagcgatgaatcggatggcggcggaggcggcggcgggggaagggggaggcgacgcggcggcgggagagggcgtcgggggcgcaggcggcgcggcaggttctcgatgggcatggtagtcgcccccgccttggtcctgctcggtctcgcgctcattgcagccaggcggcggcggcaacagcgagggggctaccccaatttttggctacatacccaaccttcgatgcatcgtgtcgggagtgctggcaacacgggcggttcaagtcgaccgagaaaggagaagcgtttcacatatgtgctcaatgatgctgataataagaagcattgtgccgggatcaactgtttgtcctacctgaatgcttctgcttctggtacaagtgattatctttttactgggagtcgagatggcaccttgaagagatgggagttccaaaatgggaatgcaaacttttcagcaactttcgagtcacatgttgattgggttaacgatgccattattgttggccaaaatctcgtttcctgttcctcagacacaactataaaggtgtggaataacttatcagatggtgcttgtaccaagactctccgccagcattctgattacgtgatctgtcttgctgcagctgaaaagaatagcaatattgtagcctctggtggccttggtggtgaggtcttcatatgggatcttgatgctgcgcttgctcctgtagccaaatctgtagatgcaaaagaggatgatattcctaatggaaaccccggacctgctttgtcaacattgtgcaatgtaaattctagtggcaacatttcttccaccaatggaaaatcacatgggtacagtccaattgctgccaaaggtcacaaggattcagtttatgcactggctatgaatgatacaggaagcttgcttgtctctggtggtactgaaaaggttgttcgtgtttgggatcccaggacaggtacaaaaacctcaaaattgagagggcacactgacaatatcaggactttgcttcttgattctactggaaggtattgtctatcaggttcatctgattccatgataagactatgggatctaggacagcaacgttgtgtgcattcttatgctgttcatactgattcagtttgggcgcttgcaagcaccccttcatttgcacatgtttatagtggtggaagagatcagtccgtgtacttgacagatctggcaacacgagagagtgtcttactctgcacaaatgaacacccaatcctacagttgtccttgcaagatgatacaatatgggttgcaactactgattcttctgtgcatggatggccagctgaagagtgcacaccccaaaaagttttccaaaagggtagctcatttttagctgggaatttgtcattctcaagggcaagagcttctttagaaggatcagcacctgtacccgtatataaagagccatcattgactattcctggagttccagcgataattcagcatgagatcatgaataatagaaggcatgtcctgacaaaggatactgctggttctgtcaaattatgggaaattactcgtggagctgttattgaagacttcggcaaggtttcttttgacgataagaaaaaggagttatttgagatggttagcatacctgcgtggtttaccatggatgctcgattgggatgtctgtctgtccatctagatactccgcaatgcttttctgctgaaatatatgcggttgacttgaatgtttctggagcacaggaagatcttaagattaatctggctcacgagactcttcgtggtttgttagttcattggagcaaaagaagacctaaacctgggtcacacagcttgtcgaatggtgatggttcaatagggaaagatgtatcattgaaaaatttaccgcatccaagatccgatgttgatgatggaaccgaaaaccatgcaagcaatgtgcttccctcatttgagttctctacggtttcacctccatcagtcattacagaaagttctagtggagggccttggagaaagagaattactgatttggatggaactgaggacgatctcccatggtggtgtgtggactgcgcagagaacaaccgatttccaaaagagaacacaaagtgtggcttttatttgcatcctgctgaaggctcacctgcaccgaacataacacaagggaaactcagtgctccacggatattgcggattctcaaagttgctaattatgtggttgagaagcttgttcttgagaaaccactggatggaagtcctgacagcacatttgctatgggattgacttctggccaatcacaactctcagctctagatagttcttccagacttggactaaagccatggcaaaagctaaaaccctctgttgagatattgtgcaacaaccaggttttgtcccctgagatgagtttggcaacggttcgaacatatatttggaagaagccagaggatctgattcttaattacagagtggttcagtcgagataatttcaacttcagatacaggtgctcacccgcttcgcccatagtagttcagcgtatctgcatcagagacggcgtgattgaagataaccgtttgatgacctagagcgagaaccattagatgcaaaatgttccatttgtgctgccttgtggtgccgtcccctgaaccacacaacaacctatttgcttcttgtaaagttttcttgtgaatcttgtacctccaggcctctagtgagattgtatcatagcacatgtgtaatgatctgctggctataccaagcttgtatatctagtgattgagtgcttacgtaataaagcttataaatgggatagaagaaattcatttta

SEQ ID NO: 4300 - DNA, 2997 bp, Oryza sativa
agcacgttcactgtaaatttatcgtgcgcatataaccacacccctcagccctctctctcgtctcgtcagttcgtcttcctcccctcaagcctcaaccccttcccctaccaggcgcggctgccggcgattgcttgatccctccgcctccctgcctcgccgccgcgcgccacctcgccgtcgaatcgaaggctataagctgctccggttttagataaattaggcatctttcaatgcatcgtgttggaagtgctggtaacacggcaggttcaagtcgaccgagaaaggagaagcgctttacatatgtgctgaatgacgctgataacaaaaagcattgtgctgggatcaactgcttgtcatacctaaatgcctctacttctggtacgagtgattatctttttaccgggagtcgggatggtaccttgaagaggtgggaaccaaaaaatggagtcgcaagcttctcagcaacttttgagtcacatgttgattgggttaatgatgccattattgttggccaaaatcttgtttcctgttcctcagataccactctaaaggtgtggaattgtttatcagatggtgcttgtaccaggactctccgccagcattccgattatgtgatttgtcttgctgcatctgaaaaaaatagcaatattgttgcctctggtggccttggcggtgaggtctttatatgggaccttgattcttctcttgctcctgtggccaaatctgtagatgcaaaagaggatgaagctcctaatggaaactctgggcctgctttgacaaccttgtgcaatgtaaattctagcagcaaccttgcttccaccaatgggcaatcacatgggtacagtccaatcactgccaaaggtcacaaagattcagtttatgcattggccatgagtgacacaggaaacacacttgtctctggtggtactgaaaaggttgttcgcgtttgggatcccaggactggttcaaagaaaatgaaattgagagggcacactgacaatatcagggctttacttcttgatcctactggcaggtattgtctttcaggctcatctgattcaatgataagattatgggatctgggacagcagcgatgtattcattcttatgctgtgcatactgattcagtctgggcgcttgcaagcactccttcgtttagtcatgtttatagtggtggaagagatcagtcggtgtacttgacagatttaagcaatcgagagagtgtcttgctctgcacaaacgagcacccgattctacaattgtccttgcaggatgatatgatttgggttgcaacaactgattcttctgtgaatggatggaaagctgaagcgcatgaacccctaaagcttttccaaaaaggttcttcattcttagctggcaatttgtcattctccagggcaagggcttctttagaaggatcagcacctgtccctatacacaaagaaccatcttcaattattcctggagttccagcaataactcagcatgagatcctgaataatagaagacatgtattgacgaaggatactgctggttctgtcaaattgtgggagattactcgaggagctgttattgaagactttggcaaggtttcttttgaggataagaaaaaagagttgtttgagatggttagcatacctgcctggtttaccatggatgctcgattgggatgcctgtctgtccacctggatacacctcaatgcttttctgcagaaatatatgcagttgacttaaacgttgcaggagcacaggaagatcttaagattaatttggctcaggagactctccgtggtttgttagttcattggagtaaaaaaaagcagagatctggctcacacggcttgtcaaatggtgacacttcaacaggaaaagatgtatccttgaaaaatttgccccatccaagatctgaggttgatgatggggctgaaaatcatgcaagtcagatgcttccctcatttgagttttccacagtttcgcctccatcaatcatcacagaaggttcaagtggagggccttggagaaagagaattacagatttagatggaaccgagagcgatatcccatggtggattgtggactgtgttgagcataatcgatttccaaaagagaatacaaagtgtggattctacttgcatcctgctgaagggtcacctgcaccgaacataacacaagggaaacttagtgctccacggatattgcggattcacaaagtagctaactatgtggtcgagaaacttgatagaccactggatggcaatgctgacagcacatttggaatgggattgacttctggccaatcacaattttcagcgctagatagttcttcacggcttggactaaaaccatggcaaaaattgaaaccttctgtagagatattgtgtaacagccaggttttggcacccgaaatgagcttggccacagtgcgggcttatgtctggaagaagccagaggatttgattcttaactacaaagtggtccagtcaagatgattgcaacttgaaacgaatgttcaccctaggagctgaggaaatcagtgcggagcaggtcttgttgaagataaccatacgacctagagagaaaactatcatcacgctagagacagaagcgtttcgcccttgtgtgcctccttagcgaaaccgcaaaaattctacctctgtaaagttctctgtgaatgttgaactaccaccaggccctctagtgaggtgtcccatagcacaggtgtaatgatctcttctggctaccaagcttgtaaatttagggatttggggtgcttaaataaactttaaatgggatataatttccccttctctttttttgtgtttacacatataagatttgtaaggaaggtatcaaaccgtgcagcgatttgctgtttgatcctgatcttggactgttacttgctgttttgcattgttttgggagtcccctaaatccttattgacccatgccttgcaagaagtgaaagcttaaaataaaggaatggttctagaatgatta

SEQ ID NO: 4301 - DNA, 1961 bp, Panicum virgatum
  misc_feature (58)..(58): n is a, c, g, or t
  misc_feature (70)..(70): n is a, c, g, or t
  misc_feature (75)..(75): n is a, c, g, or t
  misc_feature (93)..(93): n is a, c, g, or t
  misc_feature (105)..(105): n is a, c, g, or t
  misc_feature (111)..(111): n is a, c, g, or t
  misc_feature (120)..(120): n is a, c, g, or t
  misc_feature (123)..(123): n is a, c, g, or t
  misc_feature (133)..(133): n is a, c, g, or t
  misc_feature (159)..(159): n is a, c, g, or t
  misc_feature (364)..(364): n is a, c, g, or t
  misc_feature (389)..(389): n is a, c, g, or t
  misc_feature (413)..(413): n is a, c, g, or t
  misc_feature (440)..(440): n is a, c, g, or t
  misc_feature (454)..(454): n is a, c, g, or t
  misc_feature (464)..(464): n is a, c, g, or t
  misc_feature (776)..(776): n is a, c, g, or t
  misc_feature (872)..(872): n is a, c, g, or t
  misc_feature (896)..(896): n is a, c, g, or t
  misc_feature (934)..(934): n is a, c, g, or t
  misc_feature (1260)..(1260): n is a, c, g, or t
  misc_feature (1290)..(1290): n is a, c, g, or t
  misc_feature (1332)..(1332): n is a, c, g, or t
  misc_feature (1336)..(1336): n is a, c, g, or t
  misc_feature (1404)..(1404): n is a, c, g, or t
  misc_feature (1431)..(1431): n is a, c, g, or t
  misc_feature (1462)..(1462): n is a, c, g, or t
  misc_feature (1524)..(1524): n is a, c, g, or t
  misc_feature (1765)..(1765): n is a, c, g, or t
caacaacccatctccaagaaaccacctcccctcgcccccaatcccaatccaaatcctncgccacgaaccnacccngcccaatccgatcagagnccccacgcattntcgtgntccatctcntcncgccgatcangatccgatccgagtgtccggcggctnattcgccggagttggggatgaagctcgacagggagatggagatgctgctcaacgagatccccctcctccaccacggcggcctcctcggcggcggcgacgcgggcggcgccgacgacgacgccgacctctcgttcctcatccacgagcttgccgccatgggcgtcgtcgacggcgacgacgagccgccggcgccgcccgccgccgncggcctcggcttctccggcttcatntaccccacgaaaggcgatagtccngtggcctcgcacccgttctccatcgcnaattactgcgcgcncatgccgtcnctgttcgatcccgtccccttcgacgccgccggcgccgccgccgacggctgggacatccggtgctccccgccgccttccgcgccgcccgcggccacgccgagggcccggtgcaagagcgccaggaggaagaacggcggctgcggcgcgatggcggcgagccccaagaagtgcggggccgcagcggcggcggccaagccgcacggcgagagcctggccggcctgcgcgggttcatgtaccacgtcgcgcgggaccagcacgggtgccggttcctgcagcagcggctcgacgacggcaaacgcgaggtcgacctnatcttcgccggcgtgtcgcgccacgccgcgcagctcatggtggacccgttcggcaactacctcatgcagaagctgctcgccgtctgcgacgccggncagaggatggcgctcgtgctcacnctcaccgccgaccccttcgtgctcgtcagatatccctnaacgtccatgggacacgggcagtgcagaagctgattgagagcctcagacgagggaagagattagtctcgtcgtcgacgctctgcgccctgggttcttggagctcatcaaggaccccaatggcaaccatgtcgtgcaaaagtgcttgcagtcatttgagtccgatgataacaaggcgatctttgatgctgcttctgttcactgtctcgacattggaatgcaatgccacggttgctgcgtcctgcagcgctgcattgcacgttcacgaggtgagcacagagagaagctggttgctgccatcgcttgcaatggatttgaactcgcgcangatgcctatgggaactatgttgtccagtangtgatggacctgaagatcccaaatgcgaattcaagtcttgcncagnagtttgaaggcaagtacatccatctttccatgcagaagttcagtagcaatgtggttgagaaatgcctnaaagtcttcaaggaggctgacaaggcnaagatcatactcgaactcctcgccatgccanacttggagcagttgcttcagcacccatatgcaaactatgtcatatactctgctcttcagaantccaaggggtcactccattctgcactcaccaacgcaatccgacctcatgtggaattacttaggaccagtccatactgcaagaggatatactctcgagctttgctgaagaagtgatgaactgatgacagtttgtcagcctgtaacaagaacgattgctgtcttgcgctgttttccagtttcagaaggcataaagatgatcacaagatagatctgtataaattagtattcttttgtcatgtanttctacgtgtacctgtacttgatgcactgcttgtgcctggcgttgcataagccatctgcgatggaataagttcaattgaacaagccctcgccgcaaactatctcttctctaatgttttgttgtcgacatacgggaagatattgatattgctgttgatttaattcacatttgttttaaatccattgacagcttttgg

SEQ ID NO: 4302 - DNA, 1954 bp, Setaria italica
cctcccctgcatgcctcaacaacccgtctccaagaagccacctcccgtcgccctcatcccaatccaacaaatccttcgccaggaaccaatccaacctgatccgatcagtgcccacgcattttcccatcttatttcttccatctgagatttatccttttctttgccgatcatcaagatttgatcggagcccggcggccaattcgccggagttggggatgaagctcgacagggagatggagatgctgctcaacgagatccccctcctccaccacggcggcctcctcggcgtcggcgatgcgggcgccgacgccgacgccgacgccgacctctcctacctcatccacgaactcgccgccatgggcgtcgtcgacggcgacgacgacccgccggcgccggccgccgctgattccctcggcctccccagcttcatttaccacaagaaaggcgataatctcgtgccctcgcacccgttcgccatcgccaattaccgcgcgcacatgccgtctcttttcgatcccgtctccttcgacgccaccgccgccaccgacgtctgggacatctggtgctccccgccgccttccacgccgccggcggccacgccgagggcccggtgcaagaacggcaggaggaagaacgcgatggcggcgagccccaagaagtgcggcgccgccgcggcggcggcggcggccaagccgcgcggcgagagcctggtcggcctgcgcgggttcatgtaccacgtcgcccgggaccagcacggctgccggttcctgcagcagcggctcgacgacggcaagcgcgaggtcgacctcatcttcgccggcgtgtcgcgccacgccgcgcagctgatggtggacccgttcggcaactacctcatgcagaagctgctcgccgcctgcgacgccgggcagaggatggagctcgtgctcaccctcaccgccgaccccttcgtcctcgtcaggatatccctgaatgtccatgggacacgagcagtgcagaagctgattgagagcctcaggacaagggaagagattaatctcgtcatcgacgctctgcgtcccgggttcttggagctcatcaaggatcccaatggcaaccatgtcgtgcaaaagtgcctgcagtcgttcgaggccgacgataacaaggctatctttgaagccgcttctgttcattgtcttgacattggaatgcaatgccatggttgctgcgtcctgcagcgctgcattgcacgttcacgaggtgagcacagagagaagctggttgcggcgatcgctcgcaatggatttgaactcgcgcaagatgcctatgggaactatgttgtccagtatgtaatagacttgaagatcccaaatgcaaattcaagtcttgcacagcagtttgaaggcaggtacatccacttgtccatgcagaagttcagtagcaatgtggttgagaaatgcctgaaagtgttcaaggaggctgacaaggcgaagatcatactcgaactccttgccatgccacaattggagcagttgcttcagcacccatacgcaaactatgtcatatactctgctcttcagaattctaaggggtcactccattctgcactgaccaacgcaatccgacctcatgtggaactacttaggaccagtccatactgcaagaggatatactctcgagctttgctaaagaagtgacgaactgatgatagtttgtcagcatgtaacaagagcaatttgctgtcttgtgttatttttgggtttcaaaaggcataaagatgatcacaaaatagatctgtataaattagtattctttggtcatgtacttctacttgtacctgtacttcacacactgcttgtgcctggtgttgcataagcccatctgtggtggaataagttcaattgaacaagcctttgccacaaactatcttatctctgatgttttgttctctacacatgggaagatgttgctgttggtt

SEQ ID NO: 4303 - DNA, 2088 bp, Zea mays
ctcagttataagacttcttgttggatatgctattaggatagttaaattgtaaaatttgtagatatgtcaaaataaaaaaaaagggttagagacaatgtccaaataaactcggtaataaagagcaggcactctccccacctcacctcagtcaccactactttcccgctctatccgtatataacacccaccaccaccgccactctccttcctcctctgcatgtctcaacaacccgtctccaagaaaccaccttcccccctcgctccaatcccaatccttctccgcggaccaatagaacccaatccgatcactccccacgcagtttccccatatcgaaagatccgatcggagtccggcagctaattcaccggggaaagatgaaggtcgacagggagatggagattctgctgaacgagatccccctcctccaccacgtcggcctcctcggcggcagcgaggccggcgcggacgacgacgccgacctctccttcctcatccacgagctcgccgcgatgggcctcgtcgacggcgacgacgagctgccggcgccgggcgctgccaccggctacggcttccccacgaaaggcgagaaccttgtcgccatgcactcgttctccatggccagccactacgcgcacatgcgctctctgtttgttcccgtcaccttcgacgacgccgccgcggccgacggctgggacatccggtgctccccgccgccttatgtgcctctgccttctcccgccacgccgagggcccggtgcaagagcgtgaggaggaagaacggctcggtgatgacgacgagccccaagaagtgcggagccgccgcggcggccaagtggcacggcgagagcctggccggcctgcgcggggtcatgtaccacatggcgcgcgaccagcacgggtgccgcctgctgcagcagaggctcgacgacggcaagcgcgaggtcgactatatcttcgccggcgtctcgcgccacgccgcgcagctgatggtggacccgttcgggaactacctcatgcagaagctgctcgccgtctgcgacgacgggcagaggatgacgcttgtgctcaccctcaccgccgaccccttcgcgctcgtcaggatatccctcaacgtccatggaacacgggcggtgcagaagctgatcgagagactcagtgcaagggaagagattggtcttgtcatggatgctctgcgccctggcttcttggagctcatcaaggataccaatggcaaccatgtcgtgcaaaagtgtttgcattcgtttgcttcaaacgataataaggcgatctttgctgctgctgcactccactgcgtcgatatcgggatgcaaatccacggttgctgtgtcctacagcggtgcattgcgcggtcgcgtggtgagcacagggacaagctggttgccgccattgctcacaatgggtttaagcttgccgaagatgcatatgggaactacgttgtccaggttgtactggacttgaagataccaactgcgaattcaagccttgcgcaacagtttggaggcaagtatatccacctgtccatgcagaagttcagcagcaatgttgtggagaaatgcctgaaagtgttcaaggaggttgacaaggccaagatcatactggaactccttgccacgccacacctggagcaactgcttccgcactgctatgcaaactatgtcgtctactctgctctcaagaattcaaagggctcacttcattccgcactgataaatgcaatcctaccacatgaggaactacttaggaccagtccgtactgcaagaggatatactcgaaattttttctgaagaattgatggcaggtttgcagcttgtaacaagaactgctgcgctcttgtgctattttttttcagtttcaaaaggcataaagatgatcatgaaatagatctgtataaattagtattctttggtcatgtactcctagctgtacctgtaattgatgcacggcttgtgcctggtgctgcataatcatctgggacggaataagttcaattgaaagtatcatacaaattatttgtatgttacgttgttgtcttgttgatgcatgcaaggatattgttgttgttacc

SEQ ID NO: 4304 - DNA, 1038 bp, Saccharum officinarum
cctctccacccggagtcccggaccctcctggaagttctcgccatcagcgccgaattccggcacgacgtcgccgcaggccaaaacgcgatgggattcccagatgaaagagtacaagtagatgcactggagagacacttactaactggtttatcttcaaacgactataatggaagttttgaggatgaggtcctctatgacgcatcatttgcagaaatggaagataattttgtcaagtatcaaattgctcagtggactttattatctctattactaatcgtagcttggggagtaggactgctcatgctactttacatacctattcgggtatatgtatgtcgaagcgactttcgctcgaggaagctatacttgacaccacatgctgttatttacaaggtaaacaagccttttgcttttccttgttttggggttttcaagaaggagaaatattgtatcctcccttcaatttctgatgttgttgttgagcaaaattctctccagtcatttttcggggtatattcgatcaggattgagaatatcagtgtcagaaagcctcgtagttatgatgtaaaaattactggggttgctcatccacatgatttcaggaaggctgttctagtccatcttttgaacactaggaagctgaagttcagtcaaaaagcttcatcggatgaccaacagagcacaagtttgagttctacagctagttcttcggtatgtcttcaggaggctcctcttgaagatttgatgttagagaagcttgatgaagtcgtaatctctgtaaagaaaatgcaagcactgctagagggggctgaaacttcgaagattaagaccacatccagttgactcaatgtatgttgacatttcacaggattgaacaagatgtgactggtgctgttgataggatggtcactggtgctgttttatattttaaggatcgaccccctttggtggcgtatcaccaatcattgggcggggggttcttgttggataaccagtttcgggttcggtgcaaaacaatttttcggcagatgggcctgg

SEQ ID NO: 4305 - DNA, 1354 bp, Zea mays
tacgcgagaaaattgaatatttatactacccgtacacagcacgaacgggtatagtcgggccgttttcacccctagtgccatccctccctccggggtgcggaccttcctggagttctttccatcagccgaccaccggttccgaattccgacacgacatcgccaaattcctggaggccaaaacgcgatggaactcccagatgaaagagtacaagtagatgcactggagagacacttactagctggtttatcttcaaacgactatgatggaagttttgaggatgaggtcctctatgatgcatcatttgcagaaatggaagataattttgtcaagtatcaaattgctcagtggactttattatctctattactaatcgtagcttggggagtaggtgtgctcatgctactttacttacctattggggtatatgtatgtcgaagagactttcgctcgaggaagctgtacttgacaccgcatgctgttatttacaaggtaaacaagccttttgcttttccttgttttggagtttccaaaaaggagaaatattggatcctcccttcaatttccgatgttgttgttgagcaagattatctccaatccatttttggtgtatattcgatcaggattgagaatattagtgtcagaaagcctcctagttgtgatgtaaaaattactggggttgctcatccacatgatttcaggaaggccgttgtagtccatcttttgaacactaggaatcaaaaaacatcatcggatgaccaacagagcacaaatttgaattatgcagctagttcttcggaggcttctcttggagatttgatgctagagaagcttgatgaagttgaaatctctgtaaagaaaatgcaagcactgctacaggggcctgaaatttccaagtttaagaccacatcaggttgactccatgtatgttgacattttcacaggtgattgaagttgaaattgtttgactccttgggaaatgagaattgcgttctttttggaagtactagggagtacataccaaaattttgggcatgttcagctattggctgcggcagcagctgtacagccattcagcaactgtagcacatgcagcatccaatcagcagctggcacctcagcaaacagccgcttatacgcacagggaacaggcctttactgcagaagtcgcatttgtgcaggagtcatcaggttatgaaatgtaatgactatgtgtttttgtttctaataaataacgacgcaactgtaactaccaaaaaaaaagttctgttaaagaatgcagtaaccagcacataccctcctcttgttcagtaaatatcagccaaagtgccaaatccaaactaaagttatcaagac

SEQ ID NO: 4306 - DNA, 1204 bp, Setaria italica
tcgaaaccttctcgccctcgctcgccaaaattccccggcggcctcgccccgcgcgcgctctcttccgcttccgtcgcggttccagctccgatgggatcgccagatgaaagagtgcaagtagatgcattagaaagacttttattggctggttcatcttcaaatgactataacataagtattgaggatgaggtcctccatgatgcatcatttgcagaaatggaagataatttcgtcaagtatcaaattgctcagtggattcttttatctgttttactagtcttagcttggggagtaggagtgctcatgctactttacttacctattcggatatatgtatgtcggagggacttccgctcaaggaaattatatttgacaccacatgccattgtttataaggtaaacaagcctgttgcttttccttgttttggggttttcaagaaggagaaatatgttatcctcccttcaatttctgatgttgttgttgagcaaggttatcttgaatccttttttgggatatattctatcagaattgagaatgttggtgttagaaagcctgctagtgatgatgtaaaaataactggggtttctcatccacatgatttcaggaaggctgttctagtccatcttttgaacacaaggaacctgaatttcagcaggaaagctccatctgatggccaacagagcacaagtttgaatcctatagctagtgcttgggagcctccacttggggatttgatactagagaagcttgatgaagtcgaaatctctgtaaagaaaatgcaagcaatggtacaagggattgaaacttccaagacgaagaccagatccagttgattcaatgtatatttgacacttgacaggattggtgaagatatgacttggtgccgattgatccctttggtggctatcagcatcgtcctcgtggttgctgtcgatagtagtgggatcatgcgagcattttcccggtggctatatgtatagctcaggatacttgtaactatgttattgtcttatgtttcgcctcgtccaataatagatggtgatggcttgctattttttgccgctttctataatcaaacctggaattccactttctgcgcacaaaagacatatagttgaaaaggaaatcattcgatattgcaactagaaaaggatctgcttggttatcagctataataactgaaaccaagtcactaccttgcaa

SEQ ID NO: 4307 - DNA, 1624 bp, Sorghum bicolor
tctgtagggcatttacatctctaagctcaaagaggaaggattatgaaaatggcgcacttgatcactaactgtagtttcagtacatctcctgctgttcagacattctccagttctcctaattactgccgcagtgttggccaattacagaactcaaaatcttcaaatttatccctcaaatcttgttccaggagacaaaagaagtcatatgtttcctgtgctagtgcagccgtacaaggacagacacaaacacctcttactggtagccagcaagcttatgagcattcatcctccaaacctaaaaaggtaatggttattggtggagatggatactgtgggtgggcaacagctcttcatctctcaaacaaaggttatgaggttgctattgttgataatcttgttcgccgtctttttgatcaccaacttggtcttgattcccttacccccataacttcaatccaaaatcgtgtccgtagatggaagtctctcactggtaagacaattcagctctttatcggtgacatatgtgattttgaattcctctcggaagctttcaagtcttttgagccggatgctgctgttcactttggtgagcaaagatccgcaccatactctatgattgatcgttcgcgggcagtctacacgcagcataacaatgtcattgggacacttaatgtcttgtttgccataaaggaatacagtgacgagtgccatttggttaagctaggaactatgggtgagtatggaacaccaaacattgacattgaagaggggtttatcactattactcacaatggaagaacagacaccttgccttatccaaaacaagcgagttctttctaccatctaagcaaagtgcatgactcccacaacatagcatttacctgcaaggcttggggtataagggccacagatcttaaccaaggtgtggtctatggggtcagaacagatgaaactgcactgcatgaagagctatctaacagatttgactatgatggcgtctttgggacagcactaaataggttctgcgttcaggctgctgtagggcatccacttacagtttatggaaaaggtggtcaggtatgtccggggatatctggacatcagagacactgtacagtgcgttgagctagcaatagccaacccagccaaacctggcgagttcagagtcttcaaccagttcactgagcaattctctgtcaatgagctagccaaactggtgacagccgcaggagcgaagcttggtctagaagtgcagaccaaatcggtgcccaacccacgagtcgaggctgaggagcactattacaacgccaagcacacgaagctcattgagctcggcctggtgccccacctgctctcagactccctgcttgactcgcttctcaactttgccatccaatacaaggatcgggtcgacacagcacagatcatgccaagcgtgtcatggaagaagatgggtgccaagccacggacagtctctgtttagagggtgattcaacttcccctggcttatagtgtcaaccaacattgacattattgacatatgtaatgtaataattatgcacattagtatgatgtgctaggtagtgaggtgtttattacgatattaaatttcatttttgttgcc

SEQ ID NO: 4308 - DNA, 1896 bp, Panicum virgatum
cccgttccattccattccctccctctcccgctccgccccctcttcgtcctctcgctgcggccggcctcgttcccccgagggttggcgcggagcggagagccgcccgggcgccgagttctactctgggcaggcatctacatttttgaactgaaagagaggattatgaaaatggcacatttggtcactcactgtagtttcagtgcatctcctgctgttaagacgttctccagatctcctggttattgctgcaatgttagccaattacagaactcgaaatcttcaaatctgtccctcaaatcttctctcaagagacaaaagaagtcatatgttacttgtgctagtgctgctgtacaaggacagacacaaacacctctaactggtagtcaggaagcttctgggcattcatcctccaagcctaaaaaagtaatggttattggtggagatggatactgtgggtgggcgacagctcttcatctctccaacaaaggttatgaggttgctatagttgataaccttgttcgacgtctttttgatcaccagcttggtcttgagtcccttacccccataacttccatccaaaatcgtgtccgtagatggaagtctctcactggcaagacaatccagctctttattggtgacatatgtgattttgacttcctctcagaagccttcaagtcttttgagccagatgttgctgtccactttggtgagcaaagatctgcaccatactctatgattgatcgttcaagggcagtctacacgcagcataacaatgttattggaacacttaatgtcttatttgccattaaggagtacagtgaagagtgccatctggttaagctcggaactatgggtgagtatggaacaccaaacattgacattgaagaggggtttatcactataactcacaatggaagaactgacaccttgcctttacccgaagcaagcaagttccttctaccatctaagcaaagtgcatgactcccacaacatagcatttacttgcagggcttggggtataagggccacagatcttaaccaaggtgtagtctatggagtcagaacagatgaaactgcattgcatgaagagctatccaacaggtttgactatgatggtgtctttgggacagcactaaataggttctgtgtccaggctgctgtagggcatccacttacagtttacggaaaaggtggtcagacccgtggatatctggacatcagggacactgtacagtgcgttgagctagcaatagccaacccagccaaacccggcgagttcagagtcttcaatcagtttactgagcagttctccgtcaacgatctggccaagctcgtgactgccgcgggagccaagctcggtctggacgtgcagtccaagtcagtccctaacccccgggtcgaggccgaggagcactactacaatgccaagcacacgaagctgattgagctcggcctggtgccccacctgctctcggactccctgctcgactcactgctcaacttcgctgtccagtacaaggacagggtcgacacggcccagatcatgcctagcgtgtcgtggaagaagatgggcgccaagccaaggacagtctctgtttagagcagagggaacgttcccctggcgtataatgtcaaccatgacattgacattattgacatacgtaatgtaataattacgcacattagtgtgatgtgctagttagtgaggtgttttatttacgatattagatttaatttttgctgccccacgactggaaccggcgatctaagactgactccaatagtgagaggcaaatccatttttgcatctccatttgcactgtgcatcataaaatcagtctcgaacagaagaggcaaatgagtaggcattttgcaatgtgaagagagatgtgaggt

SEQ ID NO: 4309 - DNA, 2032 bp, Setaria italica
tcctcctctccccctccgcctctcctcgcagtcgtcgccctcgtcctcccggggattggcgcggtgtggataggcaccaggacgcgggtcgatccctccttttggtggtaactgggtatctacaaatttgaactgaaagagagaggattatgaaaatggcacatttgataactaactgtactttcagtgcatctcctgctgttaagacgctctccggatctcctagttattgctgcaatgttggccgattacagaactcaaaatcttcaaatctgtccctcaaatcttcttccaagagacaaaagaagtcatatgttacttgtgctagtgctgctgtacaaggacatacacaaacacctcttgctggtagtcaggaagcttcatcctccaagcctaaaaaagtaatggttattggtggagatggatactgtgggtgggcgacagctcttcatctctccaacaaaggttatgaggtcgctattgtcgataatcttgttcgacgtctttttgatcaccaacttggtcttgattcccttacccccataacttccatccaaaatcgtgtccgtagatggaagtctctcactggcaagacaattcagctctttattggtgacatatgtgattttgaattcctctcagaagccttcaagtcttttgagccagatgctgctgtccactttggtgagcagagatccgcaccatactctatgattgatcgttcaagggcagtctacacacagcataacaatgttattggaacacttaatgtcttgtttgccattaaggagtacagtgaagagtgccatctggttaagctgggaactatgggtgagtatggaacaccaaacattgacattgaagaggggtttatcactattactcataatggaagaactgacaccttgccttacccaaaacaagcaagctccttctaccatctaagcaaagtgcatgactcccacaacatagcatttacttgcaaggcttggggtataagggccacagatcttaaccaaggtgttgtctatggagtcagaacagatgaaactgcaatgcatgaggagctatctaacaggtttgactatgatggtgtctttgggacagcactaaataggttctgtgtccaggctgctgtagggcatccacttacagtatacggaaaaggtggtcagacccgtggatatctggacatcagggacactgtgcagtgcgttgagctagcaatagccaacccagccaaacccggcgagttcagagtcttcaatcagttcacagagcagttctccgtcaacgaactggccaagctcgtgactgctgcaggagccaagctcggtctggacgtgcagaccaagtcggtccccaacccacgggtcgaggctgaggagcactactacaatgccaagcacacgaagctgattgagctgggcctggagccccacctgctctcggattccctgctcgactcgctgctcaactttgccgtccagtacaaggacagggtcgacattgcccagatcatgcccagcgtttcgtggaagaagatgggcgccaagccacggacagtctccgtttagaggaaaggggacgttcccctggcgtataatgtcaaccatgacattgacattattgacatacgtaatgtaataattatgcgcattagtatgatgtgctagttagtgaggtgttttattacggtattaggtttcatttttgctgccccacgactggaacctgcgatcgaagggcacatgtgtatttgattctgttcgctcgagctcttgatctgcttcaatgtggactgatgactaaaatcccacgtgtcaccgcttcactagcaaggaggggtctgtcccatcccgaggcttgccctttgtgtgaccaagctgaggagactagtcaccatctgttggtcggctgtgtcttcacactctgggctttgatctttcaacagctgggcctcattatcttgacaccggatccttcagcatctcgtttttctaagggcatgtttggatacatcctcataaac

SEQ ID NO: 4310 - DNA, 1565 bp, Pennisetum glaucum
ctccccctccgcctctcctcgcagtcgtcgccctggtcctcccggggatttggcgccaggacgccggtggtcgatcccctcctcttggtggtaactgggcatcttcaaatttgaaccgaaagagagaggattatgaaaatggcacatttgataactaactgtactttcagtgcatcccctgctgttaagacgttctccatatctcctagttattgctgcaatgttggccaatcacagaactcaaaatcttcaaatctgtccctcaaatattcttccaagagacaaaagaagtcatatgttacttgtgctagtgctgctgtacaaggacagaagacacaaacacctcttactggtagtcaggaagcttcatcctccaagcctaaaaaagtaatgattattggtggagatggatactgtgggtgggcgacagctcttcatctctccaacaaaggttatgaggtcgctattgtcgataaccttgttcgacgtctttttgatcaccaacttggtcttgattcccttacccccataacttccatccaaaatcgtgtccgtagatggaagtctctcactggcaagacaattcagctctttattggcgacatatgtgattttgaattcctctcagaagccttcaagtcttttgagccagatgctgctgtccactttggcgagcaaagatctgcaccatactctatgattgatcgttcaagggcagtctacacacagcataacaatgttattggaacacttaatgttttgtttgccattaaggagtacagtgaagagtgccatctggttaagctgggaactatgggtgagtatggaacaccaaacattgacattgaagaggggtttatcactatcactcataatggaagaactgacaccttgccttacccaaaacaagcaagctccttctaccatctaagcaaagtgcatgactcccacaacatagcatttacttgcaaggcttggggtataagggccacagatcttaaccaaggtgttgtctatggagtcagaacagatgaaactgcaatgcatgaggagctatctaacaggtttgactatgatggtgtctttgggacagcactaaataggttctgtgtccaggctgctgtagggcatccacttacagtatacggaaaaggtggtcagacccgtggatatctggacatcagggacactgtgcagtgtgttgagctagcaatagccaacccagccaaacctggcgagttcagagttttcaatcagttcacagagcagttctccgtaaacgagctggccaagctagtgactgctgcaggagccaagctcggtctggacgtgcagaccaagtcggtccccaacccacgggtggaggccgaggagcactactacaatgccaagcacacgaagctgattgagctgggcctggagccccacctgctctcggactccctgctcgattccctgctcaacttcgctgtccagtacaaggacagggttgacactgcccagatcatgcccagcgtttcgtggaagaagatgagtgccaagccacggacagtctccgtttagag

SEQ ID NO: 4311 - DNA, 1607 bp, Oryza sativa
tggaagataaaggacatgaaaatggcacatatggtaactaactgtagtttcagcccttcgcctgcagttaagacgtactcgaaatctcctggttattgctgcaatgtgacccaattccagagctcaaaatgttccaatctagtgctcaaatcatgtactgcgacaagaccgaacaggccatttgtcgctcgtgctagcgctgctgtacaaggacagacacaaacaccccttactggaagtcagcaagcatctgggcactcatcctctaaacccaaaaaggtcatggttatcggcggagatggctactgcggctgggcaaccgcacttcatctctccaataaaggatacgaggttgccattgttgacaatcttgtgcggcgcctttttgatcaccaacttggcctggattccctcacacccatagcctccatccagaatcgcatccgtcggtggaaggctctaaccggaaagacgattcagctctatgttggtgatatatgtgactttgatttcctttcagaagccttcaagtctttcgagccggattctgctgtccactttggtgagcagagatcagcgccatattctatgattgatcgttcccgtgcggtattcactcagcataacaatgttatcggaactcttaatgtattatttgccattaaggagttcagtgaagaatgccatctggtcaaactaggaaccatgggtgagtatggaactccaaatattgacattgaagaagggttcatcactattacccacaatggaagaactgataccttgccttacccaaagcaagcgagctccttctaccatctaagcaaagtgcatgactcgcacaatatagcatttacatgcaaggcttggggtataagggccacggatcttaaccaaggtgttgtatatggagtgagaacagatgaaactgcaatgcatgaagaactatccaacaggtttgattatgatggcgtctttgggacagcactgaataggttctgtgttcaggctgctgtaggtcatccacttacagtttatggaaaaggtggtcaggtatgtccgtggatatctggacatcagggatacagtgcaatgcgtagagctcgcaatcgccaacccagccaaaccaggtgagttcagggtcttcaaccagttcaccgagcagttctcggtcaacgagctggcaaagctggttacggccgccggtgcaaagcttgggctggaggtgcagaccaagtcggtgcccaacccgcgggtggaagcggaggaacactactacaacgccaagcacaccaagctcatggagctcggcctggagccccacctgctgtcggactcgctcctcgactcgctgctcaacttcgccgtccagtacaaggacagggtcgacacggcgcagatcatgcccagcgtgtcgtggaagaagatgggggcgaagccgaagacggtgtccgtctaagaggaggctggttttgccatggcggggtataatgtcaaccgtgacattgacattataaatttggtgtgtagtaatgcaataattatgtgcgtttagtataatgcacgttgtagtgggtgtggttacggtgttagatttcttttttgtt

SEQ ID NO: 4312 - DNA, 2316 bp, Oryza sativa
cgcgctgccgccgcttcaactccgtatcctctcgcgagctagcgttaggtagggagccaagctagctgctccattctttcctctactctctgctcctgtcttgcacagccgcgagcccctgaaaccgggaggatagagcagtgctcatcgatggatgaacggttaagatggaatcaaccgggggccatcgcaggttgatccggatccctccgcggctccgccgaatatccgccgcgctgctgcctgctgcctgctgttgctgctatccatcctctcctctccacctcgcttccgctcgttcgttcctcttccccctcacccacctggtcgccaccccccaaccccaccggcgtccgagcccgctccgctccggcctcctcctgcgaggccatcgatatagctaaccgtagtggaagataaaggacatgaaaatggcacatatggtaactaactgtagtttcagcccttcgcctgcagttaagacgtactcgaaatctcctggttattgctgcaatgtgacccaattccagagctcaaaatgttccaatctagtgctcaaatcatgtactgcgacaagaccgaacaggccatttgtcgctcgtgctagcgctgctgtacaaggacagacacaaacaccccttactggaagtcagcaagcatctgggcactcatcctctaaacccaaaaaggtcatggttatcggcggagatggctactgcggctgggcaaccgcacttcatctctccaataaaggatacgaggttgccattgttgacaatcttgtgcggcgcctttttgatcaccaacttggcctggattccctcacacccatagcctccatccagaatcgcatccgtcggtggaaggctctaaccggaaagacgattcagctctatgttggtgatatatgtgactttgatttcctttcagaagccttcaagtctttcgagccggattctgctgtccactttggtgagcagagatcagcgccatattctatgattgatcgttcccgtgcggtattcactcagcataacaatgttatcggaactcttaatgtattatttgccattaaggagttcagtgaagaatgccatctggtcaaactaggaaccatgggtgagtatggaactccaaatattgacattgaagaagggttcatcactattacccacaatggaagaactgataccttgccttacccaaagcaagcgagctccttctaccatctaagcaaagtgcatgactcgcacaatatagcatttacatgcaaggcttggggtataagggccacggatcttaaccaaggtgttgtatatggagtgagaacagatgaaactgcaatgcatgaagaactatccaacaggtttgattatgatggcgtctttgggacagcactgaataggttctgtgttcaggctgctgtaggtcatccacttacagtttatggaaaaggtggtcagacccgtggatatctggacatcagggatacagtgcaatgcgtagagctcgcaatcgccaacccagccaaaccaggtgagttcagggtcttcaaccagttcaccgagcagttctcggtcaacgagctggcaaagctggttacggccgccggtgcaaagcttgggctggaggtgcagaccaagtcggtgcccaacccgcgggtggaagcggaggaacactactacaacgccaagcacaccaagctcatggagctcggcctggagccccacctgctgtcggactcgctcctcgactcgctgctcaacttcgccgtccagtacaaggacagggtcgacacggcgcagatcatgcccagcgtgtcgtggaagaagatgggggcgaagccgaagacggtgtccgtctaagaggaggctggttttgccatggcggggtataatgtcaaccgtgacattgacattataaatttggtgtgtagtaatgcaataattatgtgcgtttagtataatgcacgttgtagtgggtgtggttacggtgttagatttcttttttgttcttcctcacgaatagatgctgcaatctgatcgaaggggattccttctgtatttctgttgtaaacttttatccagctcttgatcagcaaatgggtatccaggatgcaggggggtatttgagccttttttttttttttgagtgtttccgaactgaagatggtgtaataataccatacataccactaatttcttttattgttaattgaacttataaaatagtaatatcgcgaaaacattttccaactgacagttctaccataggaataaagcggtggtagaaattcacatctgattggatactgta

SEQ ID NO: 4313 - DNA, 2134 bp, Brachypodium distachyon
cggcagccgatccgaatcccttcgcccgaatatccccgctcccacgcacactgcacactaccctcccgccgctattgctatccaatccctccccctctcccaccctttgttttcttcgcctccctctccggagctcctccacggctggacctcgccctcctccggtcgtctctagcgctgcacggttgaaggacctgccccctcgccctcctcccgtcgcttgtcttcgtcttcgaccgagcgccgccacccctcccttcccatcccgctgccgagcagcgccccagtctctcgtcttcctcctcgtgcgagcgcctccaccgcagcttttttagggtatctgcattattatagtggacgagaaacgattatgagaatggcacatttggtcactaactgtagtttcagcccatctcctgctgttaagacacaccccaaatcaccaaattgtggccacaatagcatccgattccaaaattcaaaatcttcaagttcaagtctgattgccaaatcatgttccaagagatcaaagaagttgtatgttacacgtgctagtgcttctgtacaagcacctgcagataaaacacaaacacctcttactggtagtcagcaagaatctgcacattcatcctctaaacctaaaaaagttatggttattggaggagatggatactgtggctgggcaactgctcttcatctctcgaacaaaggttacgaggttgctattgttgataatcttgttagacgcctttttgaccatcaacttggccttgattcacttactcccatagcttccatccaaaatcgcatccgcagatggaaatctcttactggcaagacaattcagctcttcattggtgatatatgtgactttgaattcctttcagaggccttcaagtcttttgagcctgattctgctgtccactttggtgaacaaagatcagcaccatattctatgattgatcgttcacgagcagtattcacacagcacaacaatgttattggaacacttaacgtcttgtttgccatgaaggagtttagtcaagaatgtcatttggtcaaactaggaactatgggtgagtatggaactccaaatattgacattgaagagggatttatcactattactcacaatggaagaactgacaccttaccatacccaaagcaagcaagctccttctatcatctaagtaaagtgcatgactctcacaacatagcatttacttgcaaggcttggggtataagggccacagatcttaaccaaggtgtcgtctatggagtcagaacagatgaaactgccatgcatgaagagctatccaataggttggactatgatggaatctttgggacagcactaaataggttctgtgttcaggctgctgtaggtcacccgcttacagtttacggaaaaggtggccaaacccgtggatacctggacatcagggataccgtgcaatgcgttgagctcgccattgccaacccagcaaaaccaggtgagttcagggtcttcaaccagttcacagagcagttttccgtcaacgagctagccaagctggtaacagcggccggagcaaagctcgggctggaggtgcagaccaagtcggttcccaacccgcgcgtcgaagcggaggagcactactacaatgccaagcactccaagctctccgagcttgggctggtgccccacctgctctcggactcgctgcttgactcgctgctcaacttcgctgtccagtacaaggacagggtcgacacggcgcagatcatgcccagcgtgtcgtggaagaagatgggcgcgaaaacgaagaccctctctgtctagtctagagagcgggcagcttccctgttgtatagcgtatggtgtcagctatgacattgacattatatgtaatgtagcaataataatgtgcgttagtttaaagcacgctgtagtggagatgtgagaattgctgttacgatgtaagatttcattttgcccctcgggtgagaactgcaattcaagagcatttgttcttttttcattcttttttgtgtgggaaaagagcattctgtttagtttctgcttccgggaaaattactctaaccagtttggagattcgggtctctttgtggaaacggtaaatttttctgcttt

SEQ ID NO: 4314 - DNA, 1916 bp, Secale cereale
cttgctgctatccaatcccgctctttgtttccttcgccactctctcccctgctctctacctcaccctccgtcctcctccccgtctcacggcacgggcagaggaggctgctcgctcgggtctaggcgcctcagcctcgggccgccggcggttgtgtcccaacgacgcggcagattcagcagttttgcttttgtagggtatctccattatagaaaggatagcaagaatggcaaatttggtcaccaactgtggtttcagtccatctcctgctgttaaggcacactgcaactcaccaagttatggccacaatttcatccgattacaaaattcgaaatcttcaacttcaagtctgaatctcaaatcatcttccaagaggtcaaataagttatatgttacttgtgctagtactgctgtacaaggacagacacaaacacctcttactggtagtcagcaagcatctgggcaatcatcctctaaacccaaaaaagttatggttattggtggagatgggtactgtggctgggcaactgctcttcatctgtccaacaaaggttatgaggttgctattgttgataatcttgttcgacgtctttttgaccatcaacttggccttgattcacttactcccatagcttccatccaaaatcgcattcgccgatggaaatctcttactgggaagacaattcagctcttcattggtgatatatgtgactttgaattcctttcagaagccttcaagtcttttgagccagattctgctgtccactttggtgaacaaagatcagcaccattttctatgattgatcgctcacgagcagtatatacacaaaacaacaatgttattggaacacttaatgtattgtttgccatgaaggagtttagtgaagagtgtcatttggttaaactaggaactatgggtgaatacggaactccaaatattgacattgaagagggattcctcactattactcacaatggaagaactgataccttgccttacccaaagcaagcaagctccttctatcatctaagtaaagtgcatgactctcacaacatagcatttacttgcaaggcttggggtataagggccacagatcttaaccaaggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggcggtcagacccgtggatacctggacatcagggacaccgtgcaatgtgtggagctagcaatcgcaaacccagccaaaccaggcgagttcagagtgttcaaccaattcaccgagcagttctccgtgaacgagctggccaagctggtgaccgccgcgggagcgaagctcgggctggacgtgcagaccaagtcggtgcccaacccgcgcgtggaggcggaggagcactactacaacgccaagcactcgaagctgtcggagctggggctggtgccccacctgctgtcggactcgctcctcgactcgctgctcaacttcgcggtccagtacaaggaccgggtggacacggcgcagatcatgcccagcgtgtcgtggaagaagatgggggccaagccgaagacggtctctgtatagagcgagcgagggaggggaggggaggggaggggaaggggtttcccctttgttgtgtggcgtatgatgtcaaccatgacattgacattgtatcttgttgtgtgtaatgtagcggtaataatgtagcgataatagtttgatgcacgctgtagtgaggtgtggaagttgctgattatgctgttagatttcatttttgcccccacggacgggaactgcaattgaacagcatctgtgtagtatgttgttatttctgactag

SEQ ID NO: 4315 - DNA, 1766 bp, Brachypodium distachyon
cccttcccatcccgctgccgagcagcgccccagtctctcgtcttcctcctcgtgcgagcgcctccaccgcagcttttttagggtatctgcattattatagtggacgagaaacgattatgagaatggcacatttggtcactaactgtagtttcagcccatctcctgctgttaagacacaccccaaatcaccaaattgtggccacaatagcatccgattccaaaattcaaaatcttcaagttcaagtctgattgccaaatcatgttccaagagatcaaagaagttgtatgttacacgtgctagtgcttctgtacaagcacctgcagataaaacacaaacacctcttactggtagtcagcaagaatctgcacattcatcctctaaacctaaaaaagttatggttattggaggagatggatactgtggctgggcaactgctcttcatctctcgaacaaaggttacgaggttgctattgttgataatcttgttagacgcctttttgaccatcaacttggccttgattcacttactcccatagcttccatccaaaatcgcatccgcagatggaaatctcttactggcaagacaattcagctcttcattggtgatatatgtgactttgaattcctttcagaggccttcaagtcttttgagcctgattctgctgtccactttggtgaacaaagatcagcaccatattctatgattgatcgttcacgagcagtattcacacagcacaacaatgttattggaacacttaacgtcttgtttgccatgaaggagtttagtcaagaatgtcatttggtcaaactaggaactatgggtgagtatggaactccaaatattgacattgaagagggatttatcactattactcacaatggaagaactgacaccttaccatacccaaagcaagcaagctccttctatcatctaagtaaagtgcatgactctcacaacatagcatttacttgcaaggcttggggtataagggccacagatcttaaccaaggtgtcgtctatggagtcagaacagatgaaactgccatgcatgaagagctatccaataggttggactatgatggaatctttgggacagcactaaataggttctgtgttcaggctgctgtaggtcacccgcttacagtttacggaaaaggtggccaaacccgtggatacctggacatcagggataccgtgcaatgcgttgagctcgccattgccaacccagcaaaaccaggtgagttcagggtcttcaaccagttcacagagcagttttccgtcaacgagctagccaagctggtaacagcggccggagcaaagctcgggctggaggtgcagaccaagtcggttcccaacccgcgcgtcgaagcggaggagcactactacaatgccaagcactccaagctctccgagcttgggctggtgccccacctgctctcggactcgctgcttgactcgctgctcaacttcgctgtccagtacaaggacagggtcgacacggcgcagatcatgcccagcgtgtcgtggaagaagatgggcgcgaaaacgaagaccctctctgtctagtctagagagcgggcagcttccctgttgtatagcgtatggtgtcagctatgacattgacattatatgtaatgtagcaataataatgtgcgttagtttaaagcacgctgtagtggagatgtgagaattgctgttacgatgtaagatttcattttgcccctcgggtgagaactgcaattcaagagcatttgttcttttttc

SEQ ID NO: 4316 - DNA, 1889 bp, Triticum aestivum
tccaatcccgctcgttgtttccttcgccactctctctcccccgctctctctacctcaccctccgtcctcctccccgtctcgcggcacggccagaggaggccgctcgctcgggtctagcgcctcagcctcgggccgccggcggttgtgtcccagcgacgcggcagattcctcgagcagttttgcttttgtagggtatctccattatagaaaggatagtgagaatggcaaatttggtcaccaactgtggtttcagtccatctcctgctgttaaggcacactgcaactcaccaagttatggccacaatttcatccgattacaaaattcgaaatcttcaacttcaagtctgaacctcaaatcatcttccaagaggtcaaataagttatatgttacttgtgctagtactgctgtacaaggacagacacaaacacctcttactggtagtcagcaagcatctgggcaatcatcctctaaacccaaaaaagttatggttattggtggagatgggtactgtggctgggcaactgcacttcatctgtccaacaaaggttatgaggttgctattgttgataatcttgttcgacgcctttttgaccatcaacttggccttgattcacttactcccatagcttccattcaaaatcgcattcgccgatggaaatctcttacggggaagacaattcagctcttcattggtgatatatgtgactttgaattcctttcagaagctttcaagtcttttgagccagattctgctgtccactttggtgaacaaagatcagcaccattttctatgattgatcgttcacgagcagtatatacacaaaacaacaatgttattggaacacttaacgtattgtttgccatgaaggagtttagtgaagagtgtcatttggttaaactaggaactatgggtgaatacggaactccaaatattgacattgaagagggattcctcactattactcataatggaagaactgataccttaccttacccaaagcaagcaagctccttctatcatctaagtaaagtgcacgactctcacaacatagcatttacttgcaaggcttggggtataagggccacagatcttaaccaaggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggcggtcagacccgtggatacctggacatcagggacactgtgcaatgcgtggagctagcaatcgcaaacccagccaaaccaggcgagttcagagtcttcaaccagttcacggagcagttctcggtcaacgagctagccaagctggtgaccgccgcgggagcgaagctggggctggacgtgcagaccaagtcggtgcccaacccgcgcgtggaggcggaggagcactactacaacgccaagcactcgaagctgtcggagctcgggctggtgccccacctgctgtcggactcgctcctcgactcgctgctcaacttcgccgtccagtacaaggaccgggtagacacggcgcagatcatgcccagcgtgtcatggaagaagatgggggccaagccaaagacggtctctgtatagagcgagggagggagggaggggagggagcttccttcccctttgttgtgtggcgtatgatgtcaacaatggcattgacattgtatcctgttgctgtgtgtaatgtagcagtaataatgtagcgatagtagtttgatgcacgctgtagtgaggtgtggaagttgttagattttatttttgtcctacacggacggtaactgcaattgaacagcagctgtgcagtatattacactt

SEQ ID NO: 4317 - DNA, 1634 bp, Brachypodium distachyon
tggacgagaaacgattatgagaatggcacatttggtcactaactgtagtttcagcccatctcctgctgttaagacacaccccaaatcaccaaattgtggccacaatagcatccgattccaaaattcaaaatcttcaagttcaagtctgattgccaaatcatgttccaagagatcaaagaagttgtatgttacacgtgctagtgcttctgtacaagcacctgcagataaaacacaaacacctcttactggtagtcagcaagaatctgcacattcatcctctaaacctaaaaaagttatggttattggaggagatggatactgtggctgggcaactgctcttcatctctcgaacaaaggttacgaggttgctattgttgataatcttgttagacgcctttttgaccatcaacttggccttgattcacttactcccatagcttccatccaaaatcgcatccgcagatggaaatctcttactggcaagacaattcagctcttcattggtgatatatgtgactttgaattcctttcagaggccttcaagtcttttgagcctgattctgctgtccactttggtgaacaaagatcagcaccatattctatgattgatcgttcacgagcagtattcacacagcacaacaatgttattggaacacttaacgtcttgtttgccatgaaggagtttagtcaagaatgtcatttggtcaaactaggaactatgggtgagtatggaactccaaatattgacattgaagagggatttatcactattactcacaatggaagaactgacaccttaccatacccaaagcaagcaagctccttctatcatctaagtaaagtgcatgactctcacaacatagcatttacttgcaaggcttggggtataagggccacagatcttaaccaaggtgtcgtctatggagtcagaacagatgaaactgccatgcatgaagagctatccaataggttggactatgatggaatctttgggacagcactaaataggttctgtgttcaggctgctgtaggtcacccgcttacagtttacggaaaaggtggccaagtatgtccgtggatacctggacatcagggataccgtgcaatgcgttgagctcgccattgccaacccagcaaaaccaggtgagttcagggtcttcaaccagttcacagagcagttttccgtcaacgagctagccaagctggtaacagcggccggagcaaagctcgggctggaggtgcagaccaagtcggttcccaacccgcgcgtcgaagcggaggagcactactacaatgccaagcactccaagctctccgagcttgggctggtgccccacctgctctcggactcgctgcttgactcgctgctcaacttcgctgtccagtacaaggacagggtcgacacggcgcagatcatgcccagcgtgtcgtggaagaagatgggcgcgaaaacgaagaccctctctgtctagtctagagagcgggcagcttccctgttgtatagcgtatggtgtcagctatgacattgacattatatgtaatgtagcaataataatgtgcgttagtttaaagcacgctgtagtggagatgtgagaattgctgttacgatgtaagatttcattttgcccctcggg

SEQ ID NO: 4318 - DNA, 2087 bp, Hordeum vulgare
gcctctctcccgctgcttgccattgctatccaatcccgctctttgtttccttcgccactctctctctccccctctctctgcctcgccctccttcctcctccccgtctaacggcacgggcagaggcggctgctcgctcgggtgtcggcgcctcagccccggagcagggccgggcgacacggccgcagcggcagattcctcgagcagtctgggtatctcaattattacagtggacaataaaggattgtgagaatggcaaatttggtcaccaactgcggtttcagtccatctcctgctgttaaggcacactgcaactcaccaagttatggccacaatttcatccgattacaaaattcaaaatcttcaacttcaagtctgaacctcaaatcatcttccaagaggtcaaataagttatatgttacttgtgctagtacttctgtacaaggacagacacaaacacctcttactggtagtcagcaagcatctgggcattcatcctctaaacctaaaaaagttatggttattggtggagatggatactgtggctgggcaactgctcttcatctgtccaacaaaggttacgaggttgctattgttgataatcttgttcgacgcctttttgaccatcaacttggccttgattcgcttacgcccatagcttctatccaaaatcgcattcgccgatggaaatctcttacagggaagacgattcagctcttcattggtgatatatgtgactttgaattcctttcagaagcttttaagtcttttgagccagattctgctgtccactttggtgaacaaagatcagcaccattttctatgattgatcgttcacgggcagtatacacacagaacaacaatgttattggaacacttaacgtattgtttgccatgaaggagtttagtgaagagtgtcatttggttaaactaggaactatgggtgaatacggaactccaaatattgacattgaagagggattcctcactattacccacaatggaagaactgataccttaccttacccaaaacaagcaagctccttctatcatctaagtaaagtgcatgactctcacaacatagcatttacttgcaaggcttggggtataagggccacagatcttaaccaaggcgtcgtctatggaatcagaacagatgaaactgctatgcatgaagagctttccaataggttggactatgacggaatctttggaacagcactaaataggttctgtgttcaggcagctgtaggtcacccgcttacagtttatggaaaaggtggtcagacccgtggatacctggacatcagggataccgtgcagtgcgtggagctagcaatcgcaaacccagccaaacctggcgagttcagggtcttcaaccaattcaccgagcagttctccgtgaacgagctagccaagctggtgaccgccgcgggagcgaagctcgggctggacgtgcagaccaagtcggtgcccaacccgcgcgtcgaggcggaggagcactactacaacgccaagcactcgaagctctcggagctcgggctggtgccccacctgctgtcggactcgctcctcgactcgctgctcaacttcgccgtccagtacaaggacagggtcgacacagcgcagatcatgcccagcgtgtcgtggaagaagatgggggccaagccgaagacgatctctgtatagagggagggacggagctccccctctgttatgtggcgtatgatgtcaaccatgccattgacattatatcttgttgtgtgtaatgtagcggtaataatgcgcgctagttttggtgtacacgctgtagttgaggcgtgggagttgctggtttacgctgttatagtagatttcatttttgccccacggatgggaactgcaattagagagcatatgtgtggtatgttgttaattctgactagcaaatttagctacagtgggtgttactagaggtttcgggctacattatagcactggttaatggttatattgttgccctaggtgacaaagagtgtaataatcatgtcgggtaatgaagcttacacaattatttctagaagaattttttggagaaagctcacttaag

SEQ ID NO: 4319 - DNA, 2058 bp, Triticum aestivum
ccctgtcgtgcccttgagagacgccgaccacgcagtaccgttttgctatccaatcccgctctttgtttccttcgccactctctctcctcaccctccgtcctcctccccgtctcacggcacgggcagcggaggctgctcgctcgggccgtctaggcgcctcagcctcggcggttgtggcccaacgacgcggcagattcctcgagcagttttgggtatctatattatagaaaggatagtgagaatggcaaatttggtcaccaactgtggtttcagtccatctcctgctgttaaggcacactgcaactcaccaagttatggccacaatttcatccgattacaaaattcgaaatcttcaacttcaagtctgaacctcaaatcatcttgcaagaggtcaaataagttatatgttacttgtgctagtactgctgtacaaggacagacacaaacacctcttactggtagtcaacaagcatctgggcaatcatcctctaaacccaaaaaagttatggttattggtggagatgggtactgtggctgggcaactgctcttcatctgtccaacaaaggttatgaggttgctattgttgataatcttgttcgacgcctttttgaccatcaacttggccttgattcacttactcccatagcttccatccaaaatcgcattcgccgatggaaatctcttactgggaagacaattcagctcttcattggtgatatatgtgactttgaattcctttctgaagccttcaagtcttttgagccagattctgctgtccactttggtgaacaaagatcagcaccattttctatgattgatcgttcacgggcagtatatacacaaaacaacaatgttattggaacgcttaacgtattgtttgccatgaaggagtttagtgaagagtgtcatttggttaaactaggaactatgggtgaatacggaactccaaatattgacattgaagagggattcctcactattactcacaatggaagaactgataccttaccttatccaaagcaagcaagctccttctatcatctaagtaaagtgcacgactctcacaacatagcatttacttgcaaggcttggggtataagggccacagatcttaaccaaggcgtcgtctatggaatcagaacagatgaaactgctatgcatgaagagctgtccaataggttggactatgacggaatctttggaacagcactaaataggttctgtgttcaggcagctgtcggtcacccgcttacagtttatggaaaaggcggtcagacccgtggatacctggacatcagggacaccgtgcaatgcgtggagctagcgatcgcaaacccagccaagccaggcgagttcagagtcttcaaccagttcaccgagcagttctctgtgaacgagctggccaagctggtgaccgccgcgggagcgaagctggggctggacgtgcagaccaagtcggtgcccaacccgcgcgtcgaggcggaggagcactactacaacgccaagcactcgaagctgtcggagctggggctggtgccccacctgctgtcagactcgctcctcgactcgctgctcaacttcgccgtccagtacaaggaccgggtggacacggcgcagatcatgcccagcgtgtcgtggaagaagatgggggccaagccgaagacggtctctgtatagagcgagggagggaagggggcttcccctttgttgtgtggcgtatgatgtcaaccatgacattgacattatgtcctgttgtgtgtaatgtagcagtaataatgtagcgataatagtttggtgcacgctgtagtgaggtgtggaagttgctggttacgctgatagattttatttttgccccacgggtgggaactgcaatcgaggagcatttgtgtagtctgttgttaattctgactagcaaatttagctacactgggtgttactgcagatttccggctacgttataggagccctggttagagcaagtacaatagtgaccttatatctaagacggattttgagaatatggggcaacggagcactttattttgaactgcttcaaa

SEQ ID NO: 4320 - DNA, 1918 bp, Triticum aestivum
gctgtccaatcccgctcgttgtttccttcgccactctctctcccccgctctctctacctcaccctccgtcctcctccccgtctcgcggcacggccagaggaggccgctcgctcgggtctagcgcctcagcctcgggccgccggcggttgtgtcccagcgacgcggcagattcctcgagcagttttgcttttgtagggtatctccattatagaaaggatagtgagaatggcaaatttggtcaccaactgtggtttcagtccatctcctgctgttaaggcacactgcaactcaccaagttatggccacaatttcatccgattacaaaattcgaaatcttcaacttcaagtctgaacctcaaatcatcttccaagaggtcaaataagttatatgttacttgtgctagtactgctgtacaaggacagacacaaacacctcttactggtagtcagcaagcatctgggcaatcatcctctaaacccaaaaaagttatggttattggtggagatgggtactgtggctgggcaactgcacttcatctgtccaacaaaggttatgaggttgctattgttgataatcttgttcgacgcctttttgaccatcaacttggccttgattcacttactcccatagcttccattcaaaatcgcattcgccgatggaaatctcttacggggaagacaattcagctcttcattggtgatatatgtgactttgaattcctttcagaagctttcaagtcttttgagccagattctgctgtccactttggtgaacaaagatcagcaccattttctatgattgatcgttcacgagcagtatatacacaaaacaacaatgttattggaacacttaacgtattgtttgccatgaaggagtttagtgaagagtgtcattttgttaaactaggaactatgggtgaatacggaactccaaatattgacattgaagagggattcctcactattactcacaatggaagaactgataccttaccttatccaaagcaagcaagctccttctatcatctaagtaaagtgcacgactctcacaacatagcatttacttgcaaggcttggggtataagggccacagatcttaaccaaggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggcggtcagacccgtggatacctggacatcagggacactgtgcaatgcgtggagctagcaatcgcaaacccagccaaaccaggcgagttcagagtcttcaaccagttcacggagcagttctcggtcaacgagctagccaagctggtgaccgccgcgggagcgaagctggggctggacgtgcagaccaagtcggtgcccaacccgcgcgtggaggcggaggagcactactacaacgccaagcactcgaagctgtcggagctcgggctggtgccccacctgctgtcggactcgctcctcgactcgctgctcaacttcgccgtccagtacaaggaccgggtagacacggcgcagatcatgcccagcgtgtcatggaagaagatgggggccaagccaaagacggtctctgtatagagcgagggagggagggaggggagggagcttccttcccctttgttgtgtggcgtatgatgtcaacaatggcattgacattgtatcctgttgctgtgtgtaatgtagcagtaataatgtagcgatagtagtttgatgcacgctgtagtgaggtgtggaagttgttagattttatttttgtcctacacggacggtaactgcaattgaacagcagctgtgcagtatattacacttacagtttgtctattcacatttagat

SEQ ID NO: 4321 - DNA, 2005 bp, Brachypodium distachyon
gaatatcccccgcttccacgcacacggcacacagcacactaccctcccgctgctattgctatccaatccctccccctctcccagtgccactctttgttttctttgcctccctctcctcctccacggaccacggctgggtctgccgctcgccctcttctctagcagcgttgcacggttgaacgcggctgttcgctcgctggtataggcgttgcgagcaggagcagagggcggcggctgtgccgagcaggaccgaacaaggcggcggcgggcgattcctcgagcaatttagcttttgtagggtatctgcattattatagtggacgagaaacgattatgagaatggcacatttggtcactgactgtagtttcagcccatctcctgctgttaagacacaccccaaatcaccaaattacggccacaatggcatccgattccaaaattcaaaatcttcaagttcaagtctgatttccaaatcatgttccaagagatcaaagaagttatttgttactcatgctagtgcttctgtacaagcacctgcagataaaacacaaacacctcttactggtagtcagcaagcatctgcacattcatcctctaaacctaaaaaagttatggttattggtggagatggatactgtggctgggcaactgctcttcatctctcgaacaaaggttacgtggttgctattgttgataatcttgttcgacgcctttttgaccatcaacttggccttgattcacttactcccatagcttccatccaaaatcgcatccgcagatggaaatctcttactggcaagacaattcagctcttcattggtgatatatgtgactttgaattcctttcagaagccttcaagtcttttgagcctgattctgctgtccactttggtgaacaaagatcagcaccatattctatgattgatcgttcacgagcagtattcacgcagcacaacaatgttattggaacacttaacgtcttgtttgccatgaaggagtttagtgaagaatgtcatctggtcaaactaggaactatgggtgagtatggaactccaaatattgacattgaagagggattcatcactattactcacaatggaagaactgacaccttaccgtacccaaagcaagccagctccttctatcatctaagtaaagtgcatgactctcacaacattgcatttacttgcaaggcttggggtataagggccacagatcttaaccaaggcgtcgtctatggagtcagaacagatgaaactgctatgcatgaagagctatccaataggttggactatgatgcaatctttgggacagcgctaaataggttctgtgttcaggctgctgtaggtcacccgcttacagtttacggaaaaggtggtcagacccgtggatacttggacatcagagatactgtgcaatgcgttgagctcgccattgccaacccagcaaaaccaggtgagttcagagtcttcaaccagttcacagagcagttctccgtcaacgagctagccaagctggttacagccgctggagcaaagctcgggctggaggtgcagaccaagtcggttcccaacccgcgtgtcgaagcggaggagcactactacaacgccaagcactccaggctctccgagcttgggctggtgccccacctgctgtcggactcgctgctcgactcgttgctcaacttcgctgtccagtacaaggacagggtcgacacagcgcagatcatgcccagtgtgtcatggaagaagatgggtgcaaaaccgaagaccctctctgtctagtctagagagtgggcagcttccctgttgtatagcgtatggtgtcaactatgacattgacattatatgtaatgtagcaataataatgtgcgttagtttaaagcacgccgtagtggaggtgtgagaattgctgttaccatgtaagatttcatttttgcccctcgggtgagaactgcaattcaagagcatttgttcttttttcattctttttttgtgttggaaa

SEQ ID NO: 4322 - DNA, 1899 bp, Brachypodium distachyon
gccactctttgttttctttgcctccctctcctcctccacggaccacggctgggtctgccgctcgccctcttctctagcagcgttgcacggttgaacgcggctgttcgctcgctggtataggcgttgcgagcaggagcagagggcggcggctgtgccgagcaggaccgaacaaggcggcggcgggcgattcctcgagcaatttagcttttgtagggtatctgcattattatagtggacgagaaacgattatgagaatggcacatttggtcactgactgtagtttcagcccatctcctgctgttaagacacaccccaaatcaccaaattacggccacaatggcatccgattccaaaattcaaaatcttcaagttcaagtctgatttccaaatcatgttccaagagatcaaagaagttatttgttactcatgctagtgcttctgtacaagcacctgcagataaaacacaaacacctcttactggtagtcagcaagcatctgcacattcatcctctaaacctaaaaaagttatggttattggtggagatggatactgtggctgggcaactgctcttcatctctcgaacaaaggttacgtggttgctattgttgataatcttgttcgacgcctttttgaccatcaacttggccttgattcacttactcccatagcttccatccaaaatcgcatccgcagatggaaatctcttactggcaagacaattcagctcttcattggtgatatatgtgactttgaattcctttcagaagccttcaagtcttttgagcctgattctgctgtccactttggtgaacaaagatcagcaccatattctatgattgatcgttcacgagcagtattcacgcagcacaacaatgttattggaacacttaacgtcttgtttgccatgaaggagtttagtgaagaatgtcatctggtcaaactaggaactatgggtgagtatggaactccaaatattgacattgaagagggattcatcactattactcacaatggaagaactgacaccttaccgtacccaaagcaagccagctccttctatcatctaagtaaagtgcatgactctcacaacattgcatttacttgcaaggcttggggtataagggccacagatcttaaccaaggcgtcgtctatggagtcagaacagatgaaactgctatgcatgaagagctatccaataggttggactatgatgcaatctttgggacagcgctaaataggttctgtgttcaggctgctgtaggtcacccgcttacagtttacggaaaaggtggtcagacccgtggatacttggacatcagagatactgtgcaatgcgttgagctcgccattgccaacccagcaaaaccaggtgagttcagagtcttcaaccagttcacagagcagttctccgtcaacgagctagccaagctggttacagccgctggagcaaagctcgggctggaggtgcagaccaagtcggttcccaacccgcgtgtcgaagcggaggagcactactacaacgccaagcactccaggctctccgagcttgggctggtgccccacctgctgtcggactcgctgctcgactcgttgctcaacttcgctgtccagtacaaggacagggtcgacacagcgcagatcatgcccagtgtgtcatggaagaagatgggtgcaaaaccgaagaccctctctgtctagtctagagagtgggcagcttccctgttgtatagcgtatggtgtcaactatgacattgacattatatgtaatgtagcaataataatgtgcgttagtttaaagcacgccgtagtggaggtgtgagaattgctgttaccatgtaagatttcatttttgcccctcgggtgagaactgcaattcaagagcatttgttcttttttc

SEQ ID NO: 4323 - DNA, 1961 bp, Triticum aestivum
tccaatcccgctctttgtttccttcgccactctctctcccccgctctctacctcaccctccttcctcctccccgtctcacggcacggccagaggaggctgctcgctcgggtccaggcgcctcagcctcgggccgccggtggttgcgtcccagcgacgcggcagattcctcgagcagttttgcttttgtagggtatctctattactgcagtggacgagaaaggatcgtgagaatggcaaatttggtcactaattgtggtttcagtccatctcctgctgttaaagcacactgcaactcaccaagttatggccacaatttcatccgattacaaaattcgaaatcttcaacttcaagtctgaacctcaagtcatcttccaagaggtcaaataagttatatgttacttgtgctagtactgctgtacaaggacagacacaaacacctcttactggtagtcagcaagcatctgggcattcatcctctaaacccaaaaaagttatggttattggtggagatgggtactgtggctgggcaactgctcttcatctgtccaacaaaggttatgaggttgctattgttgataatcttgttcgacgcctttttgaccatcaacttggccttgattcacttactcccatagcttccatccaaaatcgcattcgccgatggaaatctcttacgggaaagacaattcagctcttcattggtgatatatgtgactttgatttcctttcagaagccttcaagtcttttgagccagattctgctgtccactttggtgaacaaagatcagcaccattttctatgattgatcgttcacgagcagtatatacacaaaacaacaatgttattggaacacttaacgtattgtttgccatgaaggagtttagtgaagagtgtcatttggttaaactaggaactatgggtgaatacggaactccaaatattgacattgaagagggattcctcactattactcacaatggaagaactgataccttaccttacccaaagcaagcaagctccttctatcatctaagtaaagtgcacgactctcacaacatagcatttacttgcaaggcttggggtataagggccacagatcttaaccagggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggcggtcagacccgtggatacctggacatcagggacaccgtgcaatgcgtggagctagcaatcgcaaacccagccaaaccaggcgagttcagagtcttcaaccaattcaccgagcagttctccgtgaacgagctggccaagctggtgaccgccgcgggagcgaagctggggctggacgtgcagaccaagtcggtgcccaacccgcgcgtcgaggcggaggagcactactacaacgccaagcactcgaagctgtcggagctcgggctggcgccccacctgctgtcggactcgctcctcgactcactgctcaacttcgccgtccagtacaaggaccgggtcgacatggcgcagatcatgcccagcgtgtcctggaagaagatgggggccaagccaaagacggtctctgtatagagcgagggagggagggaggggagggggcttcccctttgttgtgtggcgtatgatgtcaaccgtgacattgacattatatcttgttgtgtgtaatgtagcagtaataatgtagcgataatagtttgatgcacgatgtagtgaggtgtggaagttgccgattacgctgttagattttatttttgcgccaccacgggcgggaactgcaattgaacagcatctgtgtagtatgttgttatttctgactagcgaatttagctacagtgggtgttagtgcaaaaaaaaaaaaaaaacga

SEQ ID NO: 4324 - DNA, 2038 bp, Triticum aestivum
ggctgcttgctattgctatccaatcccgctctttgtttccttcgccactctctctcccccgctctctacctcaccctccttcctcctccccgtctcacggcacggccagaggaggctgctcgctcgggtccaggcgcctcagcctcgggccgccggtggttgcgtcccagcgacgcggcagattcctcgagcagttttgcttttgtagggtatctctattactgcagtggacgagaaaggatcgtgagaatggcaaatttggtcactaattgtggtttcagtccatctcctgctgttaaagcacactgcaactcaccaagttatggccacaatttcatccgattacaaaattcgaaatcttcaacttcaagtctgaacctcaagtcatcttccaagaggtcaaataagttatatgttacttgtgctagtactgctgtacaaggacagacacaaacacctcttactggtagtcagcaagcatctgggcattcatcctctaaacccaaaaaagttatggttattggtggagatgggtactgtggctgggcaactgctcttcatctgtccaacaaaggttatgaggttgctattgttgataatcttgttcgacgcctttttgaccatcaacttggccttgattcacttactcccatagcttccatccaaaatcgcattcgccgatggaaatctcttacgggaaagacaattcagctcttcattggtgatatatgtgactttgatttcctttcagaagccttcaagtcttttgagccagattctgctgtccactttggtgaacaaagatcagcaccattttctatgattgatcgttcacgagcagtatatacacaaaacaacaatgttattggaacacttaatgtattgtttgccatgaaggagtttagtgaagagtgtcatttggttaaactaggaactatgggtgaatacggaactccaaatattgacattgaagagggattcctcactattactcacaatggaagaactgataccttaccttacccaaagcaagcaagctccttctatcatctaagtaaagtgcacgactctcacaacatagcatttacttgcaaggcttggggtataagggccacagatcttaaccagggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggcggtcagacccgtggatacctggacatcagggacaccgtgcaatgcgtggagctagcaatcgcaaacccagccaaaccaggcgagttcagagtcttcaaccaattcaccgagcagttctccgtgaacgagctggccaagctggtgaccgccgcgggagcgaagctggggctggacgtgcagaccaagtcggtgcccaacccgcgcgtcgaggcggaggagcactactacaacgccaagcactcgaagctgtcggagctcgggctggcgccccacctgctgtcggactcgctcctcgactcactgctcaacttcgccgtccagtacaaggaccgggtcgacatggcgcagatcatgcccagcgtgtcctggaagaagatgggggccaagccaaagacggtctctgtatagagcgagggagggagggaggggagggggcttcccctttgttgtgtggcgtatgatgtcaaccgtgacattgacattatatcttgttgtgtgtaatgtagcagtaataatgtagcgataatagtttgatgcacgatgtagtgaggtgtggaagttgccgattacgctgttagattttatttttgcgccaccacgggcgggaactgcaattgaacagcatctgtgtagtatgttgttatttctgactagcgaatttagctacagtgggtgttagtgcagatttccggctacgtatgccctggttatgcacttatactgcaaagctcctttttggctcggcgaagatgaagcttac

SEQ ID NO: 4325 - DNA, 1596 bp, Secale cereale
gggtatctccattatagaaaggatagtgagaatggcaaatttggtcaccaactgtggttttagtccatctcctgctgttaaggcacactgcaactcaccaagttatggccacaatttcatccgattacaaaattcgaaatcttcaatttcaagtctgaacctcaaatcatctcccaagaggtcaaataagttatatgttacttgtgctagtactgctgtacaaggacagacacaaacacctcttactggtagtcagcaagcatctgggcaatcgtcctctaacccaaaaaagttatggttattggtggagatgggtactgtggctgggcaactgctcttcatctgtccaacaaaggttatgaggttgctattgttgataatcttgttcgacgcctttttgaccatcaacttggccttgattcacttacccccatagcttccatccaaaatcgcattcgccgatggaaatctcttactgggaagacaattcagctcttcattggtgatatatgtgactttgaattcctttcagaagccttcaagtcttttgagccagattctgctgtccactttggtgaacaaagatcagcaccattttctatgattgatcgttcacgagcagtgtatacacaaaacaacaatgttattggaacacttaatgtattgtttgccatgaaggagtttagtgaagagtgtcatttggttaagctaggaactatgggtgaatacggaactccaaatattgacattgaagagggattcctcactattactcacaatggaagaactgataccttaccttacccaaagcaagcgagctccttctatcatctaagtaaagtgcacgactctcacaacatagcatttacgtgcaaggcttggggtataagggccacagatcttaaccaaggcgtcgtctatggaatcagaacagatgaaactgctatgcatgaagagctgtccaataggttggactatgatggaatctttggaacagcactaaataggttctgtgttcaggcagctgtaggtcacccgcttacagtttatggaaaaggtggccagacccgtggatacctggacatcagggacaccgtgcaatgcgtggagctagcaatcgcgaacccagccaaaccaggcgagttcagagtgttcaaccaattcaccgagcagttctctgtcaacgagctggccaagctggtgaccgcggcaggagcgaagctcgggctggacgtgcagaccaagtctgtgcccaacccgcgcgtggaggcggaggagcactactacaacgccaagcactcgaagctgtcggagctggggctggtgccccacctgctgtcggactcgctcctcgactcgctgctcaacttcgccgtccagtacaaggaccgcgtggacacggcgcagatcatgcccagcgtgtcgtggaagaagatgggggccaagccgaagacggtctctgtatagagcgagcgagggagggaggggagggggcttccccgtttgttgtgtggcgtatgatgtcaaccatgacattgacattatatatcttgttgtgtgtaatgtagcggtaataatgtagcgataatagtttga

SEQ ID NO: 4326 - DNA, 2035 bp, Secale cereale
cggagcgcgctggtcgcagccgatccgaatccctccgcccgaatatcccagcccttccccccccatcccctttgcctccctcccgctgcttgctattgctatccaatcccgctctttgtttccttcgccactctctctcccccggtctctgcctcaccctccttcctcctccccgtctcacggcacgggcagaggaggctgctcgctcgggtctaggcgcctcagcctcgggccgccggcggttctgtcccaacgacgcggcagattcctcgagcagttttgggtatctccattatagaaaggatagtgagaatggcaaatttggtcaccaactgtggttttagtccatctcctgctgttaaggcacactgcaactcaccaagttatggccacaatttcatccgattacaaaattcgaaatcttcaatttcaagtctgaacctcaaatcatctcccaagaggtcaaataagttatatgttacttgtgctagtactgctgtacaaggacagacacaaacacctcttactggtagtcagcaagcatctgggcaatcgtcctctaaacccaaaaaagttatggttattggtggagatgggtactgtggctgggcaactgctcttcatctgtccaacaaaggttatgaggttgctattgttgataatcttgttcgacgcctttttgaccatcaacttggccttgattcacttactcccatagcttccatccaaaatcgcattcgccgatggaaatctcttactgggaagacaattcagctcttcattggtgatatatgtgactttgaattcctttcagaagccttcaagtcttttgagccagattctgctgtccactttggtgaacaaagatcagcaccattttctatgattgatcgctcacgagcagtatatacacaaaacaacaatgttattggaacacttaatgtattgtttgccatgaaggagtttagtgaagagtgtcatttggttaaactaggaactatgggtgaatacggaactccaaatattgacattgaagagggattcctcactattactcacaatggaagaactgataccttaccttacccaaagcaagcaagctccttctatcacctaagtaaagtgcatgactctcacaacatagcatttacttgcaaggcttggggtataagggccacagatcttaaccaaggcgtcgtctatggaatcagaacagatgaaactgctatgcatgaggagctgtccaataggttggactatgacggaatctttggaacggcactaaataggttctgtgttcaggcagctgtaggtcacccgcttacagtttatggaaaaggcggtcagacccgtggatacctggacatcagggacaccgtgcaatgcgtggagctagcaatcgcgaacccagccaaaccaggtgagttcagagtcttcaaccaattcaccgagcagttctcggtcaacgagctagccaagctggtgaccgccgcgggagcgaagctggggctggacgtgcagaccaagtcggtgcccaaccgcgcgtggaggcggaggagcactactacaacgccaagcactcgaagctgtcggagctggggctggtgccccacctgctgtcggactcgctcctcgactcgctgctcaacttcgcggtccagtacaaggaccgggtcgacacggcgcagatcatgcccagcgtgtcgtggaagaagatgggggccaagccgaagacggtctctgtatagagcgagcgaggtaggggaggggaaggggcttccccttttgttatgtggcgtatgatgtcaaccatgacattgacattgtatcttgttgtgtgtaatgtagcggtaataatgtagcgataatagtttgatgcacgctgtagtgaggtgtggaagttgctgattacgctgttagatttcatttttgcccccacggacgggaattgcaattgaacagcatctgtgtagtatgttgttatttctgactagcgaatttaactagtgggtatatacacgctgcggcaaactga

SEQ ID NO: 4327 - DNA, 1650 bp, Brachypodium distachyon
tgtagggtatctgcattattatagtggacgagaaacgattatgagaatggcacatttggtcactgactgtagtttcagcccatctcctgctgttaagacacaccccaaatcaccaaattacggccacaatggcatccgattccaaaattcaaaatcttcaagttcaagtctgatttccaaatcatgttccaagagatcaaagaagttatttgttactcatgctagtgcttctgtacaagcacctgcagataaaacacaaacacctcttactggtagtcagcaagcatctgcacattcatcctctaaacctaaaaaagttatggttattggtggagatggatactgtggctgggcaactgctcttcatctctcgaacaaaggttacgtggttgctattgttgataatcttgttcgacgcctttttgaccatcaacttggccttgattcacttactcccatagcttccatccaaaatcgcatccgcagatggaaatctcttactggcaagacaattcagctcttcattggtgatatatgtgactttgaattcctttcagaagccttcaagtcttttgagcctgattctgctgtccactttggtgaacaaagatcagcaccatattctatgattgatcgttcacgagcagtattcacgcagcacaacaatgttattggaacacttaacgtcttgtttgccatgaaggagtttagtgaagaatgtcatctggtcaaactaggaactatgggtgagtatggaactccaaatattgacattgaagagggattcatcactattactcacaatggaagaactgacaccttaccgtacccaaagcaagccagctccttctatcatctaagtaaagtgcatgactctcacaacattgcatttacttgcaaggcttggggtataagggccacagatcttaaccaaggcgtcgtctatggagtcagaacagatgaaactgctatgcatgaagagctatccaataggttggactatgatgcaatctttgggacagcgctaaataggttctgtgttcaggctgctgtaggtcacccgcttacagtttacggaaaaggtggtcaggtatgtccgtggatacttggacatcagagatactgtgcaatgcgttgagctcgccattgccaacccagcaaaaccaggtgagttcagagtcttcaaccagttcacagagcagttctccgtcaacgagctagccaagctggttacagccgctggagcaaagctcgggctggaggtgcagaccaagtcggttcccaacccgcgtgtcgaagcggaggagcactactacaacgccaagcactccaggctctccgagcttgggctggtgccccacctgctgtcggactcgctgctcgactcgttgctcaacttcgctgtccagtacaaggacagggtcgacacagcgcagatcatgcccagtgtgtcatggaagaagatgggtgcaaaaccgaagaccctctctgtctagtctagagagtgggcagcttccctgttgtatagcgtatggtgtcaactatgacattgacattatatgtaatgtagcaataataatgtgcgttagtttaaagcacgccgtagtggaggtgtgagaattgctgttaccatgtaagatttcatttttg

SEQ ID NO: 4328 - DNA, 1638 bp, Hordeum vulgare
tggacaataaaggattgtgagaatggcaaatttggtcaccaactgcggtttcagtccatctcctgctgttaaggcacactgcaactcaccaagttatggccacaatttcatccgattacaaaattcaaaatcttcaacttcaagtctgaacctcaaatcatcttccaagaggtcaaataagttatatgttacttgtgctagtacttctgtacaaggacagacacaaacacctcttactggtagtcagcaagcatctgggcattcatcctctaaacctaaaaaagttatggttattggtggagatggatactgtggctgggcaactgctcttcatctgtccaacaaaggttacgaggttgctattgttgataatcttgttcgacgcctttttgaccatcaacttggccttgattcgcttacgcccatagcttctatccaaaatcgcattcgccgatggaaatctcttacagggaagacgattcagctcttcattggtgatatatgtgactttgaattcctttcagaagcttttaagtcttttgagccagattctgctgtccactttggtgaacaaagatcagcaccattttctatgattgatcgttcacgggcagtatacacacagaacaacaatgttattggaacacttaacgtattgtttgccatgaaggagtttagtgaagagtgtcatttggttaaactaggaactatgggtgaatacggaactccaaatattgacattgaagagggattcctcactattacccacaatggaagaactgataccttaccttacccaaaacaagcaagctccttctatcatctaagtaaagtgcatgactctcacaacatagcatttacttgcaaggcttggggtataagggccacagatcttaaccaaggcgtcgtctatggaatcagaacagatgaaactgctatgcatgaagagctttccaataggttggactatgacggaatctttggaacagcactaaataggttctgtgttcaggcagctgtaggtcacccgcttacagtttatggaaaaggtggtcaggtatgtccgtggatacctggacatcagggataccgtgcagtgcgtggagctagcaatcgcaaacccagccaaacctggcgagttcagggtcttcaaccaattcaccgagcagttctccgtgaacgagctagccaagctggtgaccgccgcgggagcgaagctcgggctggacgtgcagaccaagtcggtgcccaacccgcgcgtcgaggcggaggagcactactacaacgccaagcactcgaagctctcggagctcgggctggtgccccacctgctgtcggactcgctcctcgactcgctgctcaacttcgccgtccagtacaaggacagggtcgacacagcgcagatcatgcccagcgtgtcgtggaagaagatgggggccaagccgaagacgatctctgtatagagggagggacggagctccccctctgttatgtggcgtatgatgtcaaccatgccattgacattatatcttgttgtgtgtaatgtagcggtaataatgcgcgctagttttggtgtacacgctgtagttgaggcgtgggagttgctggtttacgctgttatagtagatttcatttttg

SEQ ID NO: 4329 - DNA, 1929 bp, Avena sativa
ggccggccgactctcgcacgtctcacgggcagagcgaggcgggttctccctttggtgtaggcctcgggcaggcggcggcagggctcagagacgcggctgcggcggccaactccctggagcagctttgggtaccccacaattagcatagtggaagagaaaggattatgagaatggcgaatctggttgctaactgtggtttctgcctatctcctgctgttaagacgcactgcagctcacaaagtcatggccacaacaatgtcatccggttccaaaattcaaaatcttcggcctcgagtctgaacctcagatcatgttccaagagatcaaacaagttatttgttactcgtgctagtgctgccgtacaaggacagacaaatgtaacgcaaacacctcttactggtggtcagcaagcgtctgggcagtcgtcatcgagacccaagaaggttatggttatcggtggagatggatactgcggctgggcaactgctcttcatctctccaacaaaggttacgaggttgctattgtcgataatcttgttcggcgcctttttgaccatcagcttggccttgattcgcttacccccatagcttccattcaaaaccgcattcgccgatggaaagcccttactggcaaaacaattcagctcttcattggtgatatatgtgactttgaattcctttcagaagctttcaagtcttttgagccagattctgctgtccactttggcgaacaaagatcagcaccatattctatgattgatcgttcaagggcagtatacacacagcacaacaatgttattggcacgcttaacgtcttgtttgccatgaaggagtatagtgaagagtgccacttggttaaactaggaactatgggcgagtatggaacaccaaatattgacatagaagagggattcctcactattactcacaatggaagaactgacaccttaccttacccaaagcaagcaagctccttctatcatctaagtaaagtgcatgactctcacaacatagcatttacttgcaaagcttggggcataagggccacagatctcaaccaaggcgtcgtctatggagtcagaacagatgaaactgctatgcatgaagagctatccaatagattggactatgatggagtctttggcacagcactaaataggttctgtgttcaggctgctgtaggccacccgcttacagtttacggaaaaggtggtcagacccgtggatacctggacatcagagacaccgtgcaatgcgtcgagctagcgatcgcgaacccggccaaaccaggcgagttcagagtcttcaaccaattcaccgagcagttctcagtcaatgaactagccaggctggtgacggccgctggagcgaagcttgggctggaggtgcagaccaagtcggtgcccaacccacgcgtggaagcggaggagcactactacaacgcgaagcactcaaagctctcggagcttggcttggtgccccacctgctgtccgactcgctccttgactcgctgctcaacttcgccgtccagtacaaggacagggtcgacacggcgcagataatgcccagtgtgtcatggaagaagatgggtgcgaagccgaagacggtctctgtttagaggggagctagctcggggagctttcctttgttatagggcagcgtgcctatgtatgatgtcaaccttgacattgacattgtatcttgttgtgtaatgtagctataataataatgcacgttagttcgatgtatgccgtggcgagatgtgaaaattgctggctacgtcgttaggtatcaatttttgccagcggtgggaactgttaattctcctccaaggctcttgatctgcaaatgaagattgaggatgatgggactctttcagtcatggtattttagttgattcagatatattgtgtcaattatttccaaaa

SEQ ID NO: 4330 - DNA, 1432 bp, Setaria italica
cctgcagtccagccgcggccgccccaagccccgcccgggcgccgcaattcgtcgaacagttgccgcgcgcgcttcctctcccgtggccaccacccaccagcccaccaggcaccatggcgtccgccgcgcgcgctctgggcgcgctcctccacagggcctcgtctctgtcctcctccgcctccgctctccggagagcctcgctcctccacgggattgaacctattggcaacgctggcctgttccggaggcatgccgcgaggcggaggatttcgacgttccagccgctctgcatggggcgacgctcctgcaagatcgccggaaggaaggatgcccagaatttgaaaaagatgaagcgcaacagcaaaattggaaaagaaattgtttctgccatcaagaagggtggcccaagcccttcatccaacacagctttagcagcaatattggagaaagctagggaacttgatatccccaaagaaattttggagcgtaacatcaaaagggcatcagaaaaggaccaagatacttacacagaaaaggtttatgaggtctatggttttggtggagtaggtatgatcgtggaggtccttactgacaaaattacaagatcggttgctgacattagaaatgtggtaaaagactgtggagcaaaattggctgatcctgggtctgttacctttagattcagacaagctcgagtggtgaatataaaagttactgatgctggtaaggaccaactgctctccattgcgttagatgctggtgctgacgatgtccttgaaccaaattttgatgatgatgatgactctgaagaagaaatagaaaggttctacaagatagttactacatcagacaactatccagttgtgctatcgaagctacaggaggaaggactaaagtttgaaactgataatggctacgaacttcttcctctgaacccaatcgaggtggatgacgaggccatggaactaaataaggagcttgtatcaaaattgctagagcttgatgatgtcgatgcagtctatacagaccagaagtgagtgaattcatgagctacagatttcaattcaagacacttgatgaccatatgcgtaatccaattcaagagcgtcttcacttctcatcattgagaattactagttttacagttccaaaaattggagcagatgatacagcattgtttcgatacctcggcatgctagcattatctcaaacactttatctttgccttggatttttgcccatcccttctttttctgaaaatttcttcgttgttcagattgcagatttgagagatcattgtaaaataatacgataacactgactcacttattggtcgtgagcatatagtaatgaaaaggccttggcagactgaaacgaacggcaatgtgctctggtctgcggagaatctagaaacgtatagcatacccgaatt

SEQ ID NO: 4331 - DNA, 1281 bp, Panicum virgatum
cgtcgaacagttgccgcgcgcgcttcctcccccgcggccaccagggcaccatggcgtccgccgcgcgggctctgggggcgcttctccacagggcctcgtctctgtcctcctccgcgtccgctctccggagagcctctgtcctccgcgggaatgaagctatgggcaacgccggcctgttccggaggcatgaggcgaggcgaaggatttcgacgttccagccgctctgcatgggacgacgctcctgcaagatcgccggacggaaggatgcccagaatttgaaaaagatgaagcgcaacagcaaaattggaaaagaaattgttgctgccattaagaagggtggcccaagcccttcatccaacacagctttagcagcaatattggagaaagctagggaacttgatatccccagagaaattttggagcgtaacatcaaaagggcatcagaaaaggaccaagatacttacacggaaaaggtttatgaggtctatggttttggtggagtaggtatgattgtcgaggtcctaactgacaaaattacaagatcagttgctgacattagaaatgtggtaaaagactgcggagcaaaattggctgatcccgggtctgttaccttcagattcaaacaagctcgagtggtcaacataaaagttactgatgctgataaggaccaactgctctccgttgcgttagatgctggtgctgatgatgtccttgaaccaaattttgatgatgatgatgatggttctgaagaagaaatagaaaggttctacaagatagttactacatcagaaaactatccagttgtgctatcaaagctacaagaggaaggagtgaagtttgaaactgataatggctacgaacttcttcctctcaacccaattgaggtggatgacgaggccatggaattaaacaaggagcttgtatcaaaattgctagagcttgatgatgttgatgctgtctatacagaccaaaagtgagtgaattgatgagctttcaatttacgggataaatattgatagttgacctcatgatgcttggcaattgagcattaccaattttacagttcctgaaaactggacttgatgatacaacatattttaatacgtcagcatactagcgtaatctcaaaccttggatttttgcccatccattccgttttctggaaatttctttgttcagatagcagatctgagaagtcattgtaaaataatagcattacactgacccacttgtggtcgtgatgagcactataatgaaaatgcaaaatgctttggcacactg

SEQ ID NO: 4332 - DNA, 1490 bp, Zea mays
cacacccaggctcctcacctcaccaccgcggccgcctgcccaaagcagcccaccactcgggcgcagcaattcgtcgagcatccgccgcgctcgacggccaccggcccaccagggcaccatggcgtccgccacgcgtgctctgggggcgctcctccacagggcctcgtctctgtcttcctccgctcccgctctccggggagcctcgctcctccgcggggacgggcctattggaagcgccggactgttccggaggcatgcggcgaggcggcggatttcgtcgttccagccgctctgcatgggaagacgctcctgcaaaatcgctggaaggaaggatgcccagaacttgaagaagatgaagcgcaacagcaaaattggaaaagaaattgttgcggcgtaggtgttgctggacactgtgaacttgcactatcattttaacagcttgcatcaagaagggtggcccaaacccttcatccaacacaactttatcagctatactagagaaagcaagggaacttgatgtccctagagaaattttggagcgcaacatcaaaagggcatcagaaaagggacaagatacttacacagaaaaggtttatgaggtctatggttttggtggagtgggtatggtcgttgaagttctaactgacaaaattacaagatcagttgctgacattagaaacgtggtgaaagactgcggagcaaaattggctgatcctggatctgttacctttagattcagacaagctcgagtggtgaacataaaagttactgatgcagataaggaccaactgctcaccgttgcgttagatgctggtgctgatgacgtccttgaaccaaattttgatgatgatgactctgaagaagaagcagaaaggttctacaagatagttactacatcagaaaactacccagttttgctatcgaagcttcaagaagaaggattgaagtttgaaactgataatggctacgaacttgttcctctgaacccaattgaggtggacgacgaggccgtggaactaaacaaggaacttgtttcaaatttgctagagcttgatgacgttgatgccgtctatacagaccaaaaatgagtgaattcatgagctacagctctcaattcaagacgcgctcggccaatggactttgttcgagtatattcacttttcattgatgggaaaaaaatgttaggtctttttatgaagcctggttgagcaccatcggctctacccaaaaacttaacctagttatccagcatctttttgatactttggcatttcgcaagctcatgtctataccttggtttcttcccagcccatcgtgttgggatggtttgatacatgttcagaaagcagatgtgagaaaccatagtaaaataatacgttgatgctgatccatttttgggtcttgttaaattgcaatggaaatgctatgattttggtaagcattgaaatgaaaatgctttggctctctgaataaatgaatgtgctcttcgc

SEQ ID NO: 4333 - DNA, 1546 bp, Triticum aestivum
gagcacaagtccttcccacccagccgctgcccggggcggcaatccgtcgagcaccagccgcgcgcgctccactccgctgctcctgcagccgccgccgtccatggcgtccgccgcgcgggctttgggtgcgttaatccacagggcctcgtcgctgtcctcctccgcctccgccctcaggagcgcctcccttgtacacaggaatggcccaactggtggcgccagcttgttccaggggcacgtggctaggcggaggatttcgacgttccagccgctctgtatggggcggcgctcctgcaagatcgccgggaggaagggtgctcagaatttgaaaaagatgaagcgcaacagcaaaatcggaaaggaaatcgttgctgccatcaagaagggtggtccaagtccttcgtccaacacagctttagcagcgatactagagaaagtaagagagcttgatgtccccaaggaagttgttgagcgtaacatcaaaagagcttcagaaaagggtcaggatacttacacagaaaagatttatgaggtctatggttttggtggagtaggtatggtcgttgaggtccttacagacaaaattacaagatctattgcggatattagaaatgttgtaaaagactgtggagcaaaattggctgatcctgggtctgttacattcagattcagacaagctcgagtggttaacataaaagttacagatgccgataaggaccaactactctctgttgctttggatgctggcgccgatgatgttattgaaccaaattttgatgatgaagatgactctgaagaggttctagagaggttttacaagatagttactacatctgaaaactatcctgttgtgctatcaaagctacaagaggaagggctgaaatttgaaacggataacggttatgaactgctgcctctcaatccgattgaggtggatgacgaggccatggaacttaacaaggaccttgtattgaagttgcttgaattggatgatgttgatgctgtctacacagaccagaagtgagccaatttggaacccacaggctctctcagctctcaagacgctgctcgatgactccatttgggtagggcttgttttcaacttcgtgtccattaaggatttcttatcagcactgtttgcgccgattacgaagcctgcacacataacatcagcttcaagtgtccaaaatgaaaattggtgaacgcagcagtttccttttgggagtacttttccccacattctgccgtctcatactcagagttttttaccttacgtttgttgtccctgatctcttcaccttgtccgtgtctcagtgagctgctagacgctgctcatataacgaatgttgtagctgcatcttttcatgtgattgtaagcaatacaagtaaaactgacctatgcatggactttggagtctgtttttttcttcctatattttgtgtgtgttggtgttggttgtgtgcatcgtaatcatacagagacgggttatgtactcatgatgtttgtatttccttttttttacaaggatgatgtttgtaatgcctt

SEQ ID NO: 4334 - DNA, 1529 bp, Triticum aestivum
caaatctcaaccgtgcctttccaatcccccggatccagtctcgctcccagcacaagtcctcccacccagccgctgcccggggcggcaatccgtcgagcaccagccgcgcgcgctccactccgctgctcctgcagccgccgccgtccatggcgtccgccgcgcgggctttgggtgcgttaatccacagggcctcgtcgctgtcctcctccgcctccgccctcaggagcgcctcccttgtacacaggaatagcccaactggtggcgccagcttgttccaggggcacgtggctaggcggaggatttggacgttccagccgctctgtatggggcggcgctcctgcaagatcgccgggaggaagggtgctcagaatttgaaaaagatgaagcgcaacagcaaaatcggaaaagaaatcgttgctgccatcaagaagggtggtccaagtccttcgtccaacacagctttagcagcgatactagagaaagtaagagagcttgatgtccccaaggaagttgttgagcgtaacatcaaaagagcttcagaaaagggtcaggatacttacacagaaaagatttatgaggtctatggttttggtggagtaggtatggtcgttgaggtccttacagacaaaattacaagatctattgcggatattagaaatgttgtaaaagactgtggagcaaaattggctgatcctggatctgttacattcagattcagacaagctcgagtggttaacataaaagttacagatgccgataaggaccaactactctctgttgctttggatgctggcgccgatgatgttattgaaccaaattttgatgatgaagatgactctgaagaagaggttctagagaggttttacaagatagttactacatctgaaaactatcctgttgtgctatcaaagctacaagaggaagggctgaaatttgaaacggataacggttatgaactgctgcctctcaatccgattgaggtggatgacgaggccatggaacttaacaaggaccttgtattgaagttgcttgaattggatgatgttgatgctgtctacacagaccagaagtgagccaatttggaacccacaggctctctcagctctcaagacgctactcgatgactccatttgggtagggcttgtttgcaacttcgtgtccattaaggatttcttatcagcactgtttgcgccgattacgaagcctgcacacataaacatcagcttcaagtgtccaaaatgaaaattggtgaacacagcagtttccttttgggggtacttttccccgcattctgccgtctcatactcagggtttttaccttacgtttgttgtccctgatctcttcaccttgtcagtgtctcagtgagctgctagacgctgctcatataacgaatgttgtaactgcatcttttcatgtgattgtaagcaatacaagtaaaactgacctatgcatggactttggagtctgtttttttcttcctatattttgtgtgtgttggtgttggttgtgtgcatcctagctatgcaga

SEQ ID NO: 4335 - DNA, 1406 bp, Secale cereale
ggggtcgagcacctgccgcgcgcgctccactctgctgctcctgcggccgccgccatctatggcgtccgccgcgcgggctctgggcgcgctcctccacagggcctcgtcgctttcgtcctccgcctctgctctcaggagcgcctcccttgtacacaggaatggcccaactggtggtgctagcttgttccaggggcacgtggctaggcggaggatttggacgttccagccgctctgtatggggcggcgctcctgcaagatcgccgggaggaagggtgctcagaatttgaaaaagatgaagcgcaacagcaaaatcggaaaagaaatcgttgctgccatcaagaagggtggtccaagtccttcgtccaacacagctttagcagcgatactagagaaagtaagagagctagatgtccccaaggaagttgttgagcgtaacatcaaaagagcttcagaaaagggtcaggatacttacacagaaaagatttatgaggtctatggttttggtggagtaggtatggtcgttgaggtccttacagacaaaatcacaagatctattgcggatattagaaatgttgtaaaagattgtggagcaaaattggctgatcctgggtctgttacattcagattcagacaagctcgagtggttaacataaaagttacagatgccgataaggaccaactactctctgttgctttggatgctggcgccgatgatgttattgaaccaaattttgatgatgaagatgactctgaagaagacgttctagagaggttttacaagatagttactacatctgaaaactatcctgttgtgctatcaaagctacaagaggaagggctgaaatttgaaacggataatggttatgaactgctgcctctcaatccgattgaggtggatgacgaggccgtggaacttaacaaggaccttgtatgtaagttgcttgaactggatgatgttgatgctgtctacacagaccaaaagtgagccaatttggaacccacaggcctctctcagctctcaagacgctactcgatgactccatttgggtagggcttatcagagctgtttgcgccgattacaaagcctacaaactaaaacatcatcagcttcagttgtccaaaatgaaaattggtgaacacagcattttcctttagggggtagtacttttccccgcattctgccgtctcatactcagagttttttaccttacgtttggtgtcccttgatatcttcaccctgtcagcgtctcagtgagctgctagacgctgctcttataatgaatgttgtaaccgcgtgttttaatgtgattgtaagcaacacaagtaaaactgacctatgcatggactttggaggtcgcttttgtctttcctattattttgtgtgtgtacgttgggtgttgattgtg

SEQ ID NO: 4336 - DNA, 4097 bp, Oryza sativa
gactcctctcctcctccgccagcccgcgccgccggaagcgggcaattcgtcgagcacctggtgcgcgcgctccgccgccatggcgtccgccgcgcgggctctgggcgcgctcgtccacaaggcctcgtcgctgtcctcctccgccgccgctctcaggagcgccgccgtcctccatgggagaggctctgctggcggcagcgccagattgttccagaggcacgcggcgaggcggaggatttcgacgttccagccgctttgcatgggacggcgctcctgcaagatcgccggaaggaaggatgctcagaatttgaaaaagatgaagcgcaacagtaaaattgggaaagaaatcgttgctgccattaagaaaggtggcccaagtccttcatcaaacacaactttagcagcaatattggagaaagcaagggaacttgatatccccaaagaaatcttggagcgcaacataaaaagggcttcagaaaagggccaagatacttacacagaaaaggtttacgaggtgtatggttttggtggagtaggtatggttgttgaggtccttacagataaaattacaagatctattgcggatataagaaatgttgtaaaggactgtggagcaaaattggctgatcctggatctgttacattcagattcagacaagctcgagtggtgaacatcaaagtaactgatgctgataaggaccaactgctcactgttgctttggatgctggcgccgatgatgtcattgaaccaaattttgatgatgatgatgatgacgacgacgactacgatgacgactcctctgaagatgtttcagaaaggttttacaagatagttactacatcagagaactatcctgttgtgctatcgaagctacaagaggaaggactaaaatttgaaactgataatggctatgaattgctgcctctgaacccgattgaggtagatgacgaggccatggaactaaacaaggtcctagtgtctaagttgcttgagcttgatgacgttgatgctgtctatactgaccaaaggtgactctgaattcatgatccaagacactcgatgccgacggttcttgggttacactgtggattggcagtggattggcagaaagctggtggatggagctgccaatggagcctgtttacttgcagccagttatattttgccaaaattgagttgataatacggcattttttgtgtaactactttgcacactcgcatctcaaacaaagagttctaaaaattttcccttccaagtctcatcccatcttcgcctgtaaaacgattagcccattttttcacttcgtctcaccccatcttcgctttgtaaaacgataggaccgaccatgctatggtgttggatcttgacgagcgttctaataaaaagttttgccagtttgaaacggctgaagatttgttcctttgactggcagaaactgttggcaaatttcttcagctcatactgtacatcctaaaaacagcggtaactctccctatgtgtaactgtatagaaaaaataaacaataaatagccacgttctcatttttctaaataaacttccattgtacgtccgcctaaacatcttcagtgcaaaaggagtataaaagacactaaaccgcgtgttgcaaacaatggggccaaaaagcttagagcagtctatcaaaaatttcttcagcactcctgctggtcccaaaaacatattaggggtgtcaaatactgagtgcaataacgcagcaatctctaatcctaggcctgtggttttctagttcttttgagcttagttgcagttgagctagcaaaagcaaattccaagcagccacgtcgcttttcgcatttactcatttttattgccatgggttcttctttcggcccgccgcattcgttgagctagctttggagccctgcggataagcaagcgaaaaaaggttaaatgtgttcaaacttcaaagttatcagaataggggtgtgaaaattaaaaatttgccagacttacagatttcaacttcttcaacttgccccgaaccctattcttttgaggtttcagtttatatatacggaccatccagtggtgggttgtgaaaacctttatgatttaaaagaacgataggaaaacgccaagcaaacgattgagttagaaaaagatgaaaataaaacgactaattggaaagaggagtaacatcgcattacctcctcaaaatgtgttagtttgaaatgcttctttcctatttcatatcctcttactctatcaaaacctttgccatcggtctcaacgaacctggaggaaacaaggaaaacagccaaatgtaaaaaaaaaaatattgatgacaactaaacgttatctattgaattctgtttgtcaaacctgtaatagcaaagcttgtacatgaggcaattcagcatagttggggtgccttgagcatcaacacgatagttaccatccctctggcaacaaaataacatgagaaatcagaatagtgaatcaagctcatatatttgtttcactatttctattcttccttatgcccaccaaaatgatgtgtaaggcaccatccctaaaaagattcacaactcacaagataatcaggttccttgatgtgagggaatacaccacctcctatgcgaaccatccaaaggaacttgttaatatcatcgctagggtagccaacaagacctgtaaagtaaacacccaacgtcagggatctggggccactagttattgatttgttctaaagaagtccacaaagcatcaacctccaaatacaacaaggacatatttgacatctaaagaattgaagatctcccaagctgctttttctggagatgacatcgctgttccaactgttgctatgtgggtattattccaagtattattgtctacaattacagtcctgttggccattgcagttgtttgataaccataatcccaccaggacgcaacctgcagtggaccgtcttactgtcagaaaaacacagagcacttagaaatagagggcaagggatgagcgtaccttgtcatcaacatctgtgttatggctgagccatgcataggcttcacggaaatcatcaaaaacatgcaatccatcacgcgaacgagaagtcaacacaattgaaggagctgagtacgcctcagctgctgcccacacacaatggacctacaaaaatgcatctcctaagatacatccagacatcacttatggtatgactgttctttctgtaagactaagaatatttaacttaccacatagaaaccacctaacacgatcagcaacaaaatgcccaaaacagatgcctccataggaagtaccaaaagcttcttttcctttttaggctttacaggaacactttcagccacttccttttccttcttccggtttttctttgatggtttttcctttggggctgtttcagttttttcaggtctagtctcattttttgctgaatttgtggagacagtactagcgctagaactctctgcactactatcccctgacttaagtttcagaagaaataagttgtcaataagtttgttaaggatgaagccaggtaattattaacagagtaaagaaaaacaatgaagaaagcaaccgtacagcagcagggctgtcatcaaataattttgatagctgatatttaacggatcttgtgaggacgtcgaaagcctcagaaagagcgattccagataaaatgcacgcagcaggagcaaggacaagcataagccgcacctaaaagagaatatatgtaaagaaaagttaataaataaatactagataaacattgctttatagatgcttttacattacacatattcttaccattactccagaaaaatatactgcggtgaccaagtacaagaccacgaaggagcttgcatcagataaaggcaagaagcatgactgttgacaatgtcaatattaactagtaagaacaaatacttatgctaattcaattcggattgaaaatgtagactgcttacaatgatcccagcaggaatcaagaaggccaacacgttgatatccatgaaataggagggccaggtagggggttgatgttcgctgacactagcaataatagggatgtacttgcttgcataggttct

SEQ ID NO: 4337 - DNA, 1390 bp, Brachypodium distachyon
gcgctccgccgccaccatccatggcgtctgcggcgcgggctctgggcgcgctcctccagagggcctcgtcgctttcctcctccgcctcggctctcaggagctcctcccttctccacaggagtggctctactcaggaggggagtttgtaccagtggcacctgggtaggcggaggatttggacgtttcagccgctctgtatggggcggcgctcctgcaagatcgccggaaggaaggatgcccagaatttgaaaaagatgaagcgcaacagcaaaattggaaaagaaatcgttgccgccatcaataaaggcggccctaatccttcatccaacacagccttagcagcaatactggagaaagtaagggagcttgatgttcccaaggaagttgtggagcgtaacatgaaaagagcttcagaaaagggccaggatacttacacggaaaaggtttatgaggtctatggttttggtggagtaggtatggtcgttgaggtccttacagacaaaattacaagatctattgcggatattagaaatgtggtaaaggactgtgcagcgaaattggctgatcctgggtccgttacgtttagattcagacaagttcgcgtagtgaacataaaagttacagatgctgataaggacgaactactctctgttgctttggatgctggtgctgatgatgtaattgaaccaaattttgattatgatgatgactctgaagaagttacagaaaggttttacaagatagttactacatcagaaaactatcctgttgtgctatcgaagctacaagaggaaggaataaaatttgaaacggataatggctatgaactgctgcctctcaacccgattgaggtagatgacgaggccatggaactaaacaaggaccttgtatctaagctgcttgaactcgatgatgtcgatgctgtctacacagaccagaagtgaaagtgccagttctgaacctacagtctcaactctcgagacgctgcccaacgaccctctggttgcaccacgcgtgtggggtggacgtgtttacaaatttgcttccatgtaggacttcagaccagcactggtggggttgcatatgaagcctgcttacttcgagcatcatcaatttgaaatgtccaaaatgaaagctggtgatgctgcaaaaaaaaattctcagtatttactctggcctctcatacgcggagcttcactttgcattcagctccccttgttcacctcactctgtcaatgaactgctagatcctgggattcgcacagagggcatgagctgatagaggtgtgatacgtgattgtaagcaatataaaataacactgacctagacatcggtactaatactgattctgataataattttttggcgcatttgatattaagtggacag

SEQ ID NO: 4338 - DNA, 1178 bp, Pennisetum glaucum
aagcatgccgcgaggcggaggatttcgacgttccagccgctctgcatgggacgacgctcctgcaagatcgccggaaggaaggatgcccaaaatttgaaaaagatgaagcgcaacagcaaaattggaaaagaaattgttgctgccatcaagaagggtggctcaagcccttcatccaacacagctttagcggcaatattggagaaagctagggaacttgatatccccaaagaaattttggagcgtaacatcaagagggcatcagaaaaggaccaagatacgtacacagaaaaggtttatgaggtctatggtttcggtggagtaggtatgatcgtcgaggtccttactgacaaaattacaagatcagttgctgacattagaaatgtggtaaaagactctggagcaaaattggctgatcctgggtctgttacctttagattcagacaagcacgagtagtgaacataaaagttactgatgccgataaggacaaactgctctccattgcgttagatgctggtgctgatgatgtccttgaaccaaatttcgatgatgatgatgatgactctgaagaagaaatagaaaggttctacaagatagttactacatcagaaaactatccagttgtgctatcaaagctacaggaggaaggactaaagtttgaaactgataatggctacgaacttcttcctctgaacccgattgaggtggatgatgaggccatggaactaaacaaggagcttgtatcaaaattgctagagcttgatgacgttgatgcagtttatacagatcagaagtgagtgaattcaggagctacagatttcaattcaagacactagatggccctttgtagagcatcttcacttctcatagttgagaattaccaagttactgttccaaatattggagctgacaacagcattgttttgatgccttgtcgtaattgcattatctcaaactctttatcttttcctctgatttttgtccattccttctttttctggaaatttctttgctgttcagattgcagattttgagaaatcgttgtaaaataatatgatatcactgacccatttgttggtcttgatgagcacagcagtgaaaatgcctgcagactgaaacgaacggcaaagtgctctggtctgcggagaatcaaacaacttgtagcatactcaaattccgt

SEQ ID NO: 4339 - DNA, 784 bp, Saccharum officinarum
caaacaggccccatgaaacaggagtctgtgtaaggctgtggaagccacaagcaccacgggcgtagaattcccctcgtgtcctctcttcagctctcagaaggcaaagacgatgctgccgctgaggtccgccgccgccgcgccgtgctcggttgcaggactgctgctccaccgattctcatcctgctcgtcctcttctgtctattcggtccgccaccacgcctcgcctgctgtctcctcccagcccaccacctgctccaccactacctggtccccttccccccattccagcagccccaggatccgggggtttgcggcctgggcatcggcgccggggcaggcggggtctgcggattcccccgctacaaaggcgctagaggctaagatcaaggagcagctggaggcggacacagtcacggttgtggatacctctggggatggccgtcatgtctgcatagacgtggtttccaaggtatttgagggaaaatctgctgtaaataggcagagaatggtttacaaggctatatgggaggagcttcagagcactgtgcatgctgtggaccaaatgactaccaaaacgcctgatgaagctggtgccaacaagtaatcgatagctgcataatacctgtggagacacagattgtctgtgctttgaagatcaggcctttgcgtcgaccaaaatttttctcttgtgtactattaatttgcgtgtcaactgaatgatcaataatttggagtatgattagcgtggcttcaaaacgaaatataatttttaattagcttttgc

SEQ ID NO: 4340 - DNA, 829 bp, Panicum virgatum
ctcccttctcaactccggtaagaccgatgctgccgatgaggtccgccgccgccgcgccgtgctcgctggcagcgctgctgctccgccgcctctcctcccactcgtcctcttctgtctattccgtcagccgccacgccccctctgccttatcctctcagccctccgccacctacctcaccaccagccccccttgccccctttccagcagccgcaggaccaggggattcgcggcctgggcctcggcgccggggccggcggggcccgccgaatcccccgccacgaaggcgctagaggccaagatcaaggagcagctggaagccgacgcggtcacggtcgtcgatacctccggggacggccgccacgtctgcatagatgtggtttccaaggcattcgagggaaaatctgcagtaaataggcagagaatggtttacaaggctatatgggaggagcttcagagcactgtgcatgccgtggaccaaatgactaccaagacgccagacgaagctgctgcgaacaagtaattcaatatcatgcctgtggaggcagttatgctctcctttgaagatcaggcccctgccttcaccaagtttctgtttttttttcctgaatgatcaataattcgcgatgtgattagtgtgtattcaaaaagaaatatatgtcattcaatttgcctccacaaacaaattgtatgctatgtgcaagcgtctgtggctgctaattagctgtgtaaagggctaaatataagtcatgctgagtataaagtgggtagacaggtgtaaactccagcacgccgatgcatcaaaaaagaaaacttgcgtttttggcctac

SEQ ID NO: 4341 - DNA, 1652 bp, Zea mays
cagaaggcaacaaacaaccacactgattgaggcagttcgtgaacaagccgtcacacccactcgctgctgaaccaggagttccatccatcgccgctcactcccacgatcagcgtcgtcgcttatccgcaaatatctctcttcctctttgcagtcggcaccatgggttccgacttcaaatcgatccccttgatcgatatcggcccgcttgtcgaaaagattgatgatccaagcatggccaacgataaggatttactgcaggttgtccggttactggatgatgcttgcaaggaggccggattcttctatgtgaaaggccatggtattgatgagtcactgatgagggaagtcaggaatgtaacccgtgaattctttcagcttccttatgaggaaaaattaaaaattaagatgacacctcaaagtggatatagagggtatcaaaggataggggaaaatattaccaagggtaagcctgatatgcatgaagcaatcgattgttatactcctattagacctggcaaatatggagatctcgctaaaccaatggaaggatctaacttatggccaaaatacccatcaaattttgaagtactgctggaaaattatatcaaattatgtagagacatttcaagaaagataatgcgaggtatagccttggctttgggaggggcaattgatgcttttgaaggggatacagctggagatcctttctgggtgttaaggttgattggttatcccgtagatattccagaagagcagcgcactgatactggctgtggagctcatacagattatggacttctaacactggttaaccaggatgatgacatatgtgcccttgaggtgcaaaatcgttctggtgagtggatatatgcaacgccgattcccggaacctttgtttgtaacatcggtgacatgctgaaggtttggacaaatggaatatatcagcccacccttcacagagttgtcaacaattcccagcattaccgtgtatctgttgcattcttctacgagtccaacttcgatgctgcagtagagcctgttgagttctgccgggagaaaaccggcggtgctgctaagtacgaaaaggttgtgtacggggagcatttggttcagaaagtattgacgaacttcgtcatgtaaatttgctaagtacgacaaataaatctgcattgcagcatcagaactccagacctatttggtgtgtagtgctgtaccagaaaggtagtaacggactaaagcatgcgcccgtctctgaaatttgaccttaacaagagtcgcagacttgcagtgcaggtgatatcacaaggaaatcggggggagatttgttctctctgctgcacggagttgtcgacaaccctgtcgctgaaatctgaatttagcatcagacaactggagatgctacgagtccgtctctgaaatctgaatttagcatcaggcgcgaaattgcctccatttcttcgccaaaccatctaatgatggaagctttgtagctggcaaggccatctcgtgtgacgccgcagccagacgatgccagcgtagcaagttacctaccattagcactggttaactagctagccatactagtgaattactctattccgatcaaatgttggagaattcttttctcatagatactttgatgaaaagaattg

SEQ ID NO: 4342 - DNA, 1285 bp, Panicum virgatum
gccgcaaacaatcagcatcgtttatccccagcacttcgagctccctcgtccctccctctgcgctccatggcttccgacttcaaggcgatccccctgatcgatgttggcccgcttgtcgaaaagatcgatgatccgaatatggccaacgacgcggatttgctggaggttgtgcggatgctggacgacgcttgtaaggaggccggattcttctatgtgaaaggccatggtattgctgagtcgctaatgaaggaagtcagggatgtgacacgcaaattctttcaccttccttatgaggagaaattaaagattaagatgacacctgagagtggatatagagggtatcaaaggataggggagaatgttaccaagggtaaacctgatatgcacgaagcaattgattgctacactcctattagacctggcaaatatggagatcttgctaaaccaatggagggatctaatttatggccagaaaatccatcaaattttgaagcactgctggagaactacatcaatctatgcagagatctttcaagaaagatcatgcgtggtatagccttggcattgggaggggcaattgatgcgtttgaaggagaaacagctggagatcctttctgggtgctaaggttgattggttatccagtagacattccagaagagcagcgcactgatactggatgtggagctcatacagattacggacttctgacactggttaaccaggatgatgacatatgtgcccttgaggtgcaaaaccgctctggtgagtggatatatgcaactccaattccaggaacctttgtttgtaacattggtgacatgctgaaggtatggtccaatggaatatatcagcccacacttcacagagttgtcaacaactcccctcgttaccgcgtatctgttgctttcttctatgagtccaactttgacgctgccatagagcctgttgagttctgccgggagaaaaccggcggtgctgccaagtacgaaaaggttgtgtacggggaacatttggtaaagaaagtgctgacgaactttgtcatgtaaatttgctgggctgcagatgtggaaggaaaaaaaactgtatcgaaatattcatcaataaacatgtctgtccattcgtgtcattgcagtgaatttattgtctttcagttttgttctgtaaagttttttctttcagtctctataccttgtatgtttagtcttgttttctcttctgttgtgtaaataccctttctttcaataaaatttcaacagcgggggcctccctcgctgttttcggtcc

SEQ ID NO: 4343 - DNA, 1223 bp, Cenchrus ciliaris
  misc_feature (576)..(576): n is a, c, g, or t
tgactctgccgtcacgctgtttgtcctcgcccattggcttctagtatcatgtaactaacagactggcccagagtgccaaagccatcgccgcaagctccaacgatcagcgtcgcttatccccaaacctcgagctcccctccctctctgcagtctgcaccatgggctccgacttcaaggcgatccccctgatcgatattggcccgctcgtcgaaaaaatcgatgatccgaggatggcgaatgacgcggatttgctggaggttgtgaggatgctggacgacgcttgcaggaaggccggattcttctatgtgaaaggccacggtattactgagtcgctaatgaaggaagtcagggatgtgacgcgcaaattctttcaacttccttatgaggagaaattaaagattaagatgacacctcagagtggatatagaggatatcaaaggataggggagaatattaccaaaggtaaacctgatatgcacgaagcaattgattgctacactcctatcagacctggcaaatatggagatcttgctaaaccaatggagggatcgaacttatggccagaaaacccatcanattttgaagcactgctggaaaactatatcaacctatgcagagatctttcaagaaagatcatgcgtggtatagccttggcattgggaggggcaattgatgcatttgaaggggaaacagctggagatcctttctgggtgctaaggttgataggttatccagtagacattccagaagaccagcgcactgacactggatgtggagctcacacagattatggacttctgacactggttaaccaggatgatgacatatgtgcccttgaggtgcaaaatcgctgtggtgaatggatatatgcaacaccaattccaggaacttttgtttgcaatattggtgacatgctgaaggtttggtcgaatggaatttatcaatcaacgcttcatagagttgtcaacaactcgcctcgttaccgggtatccgttgcatttttttacgagtccaacttggatgctgccatagagcctgttgagttctgccgggagaaaacgggcggtgccgcgaagtatgaaaaggttgtgtatggggagcatttggtaaagaaagtcctgacgaactttgtcatgtaaatttccggggggaatatgtggtggaaaaaatgtaactgaatattgatttgggatatttcatcaataaaacatgcctttccaaca

SEQ ID NO: 4344 - DNA, 1232 bp, Pennisetum glaucum
ggaatccggttgggggcacatgggtgttatccgatgtttggtttcagtgtgaatctactcggatgctgctgaacgacacacgtcacacacatgccatcgccgcaacctccaacgatcagagtcgcttatccccaaagctcgagttccctcactctacggtctctgcgccatgggctccgacttcaaggcgattcccctgatcgatattggcccgctcgtcgaaaagattgatgatccgagtatggccaacgacgcggatttgatggaggttgtgaggatgctggacgatgcttgtaaggaggccggattcttctatgtgaaaggccacggtattactgagtcgctaatgaaggaagtcagggatgtgacacgcaagttctttcagcttccttatgaggagaaattaaagattaagatgacacctcacagtggatacagaggatatcaaatgataggggagaatattaccaaaggtaaacctgatatgcacgaagcaattgattgctacactcctatcaaacctggcagatatggagatcttgctaaaccaatggagggatcaaacttatggccagaaaacccatcaaattttgaagcactactggaaaattatatcaacctatgcagagatctttcaagaaagatcatgcgtggtatagccttggcattgggaggggcaattgatgcgtttgaaggggaaacagctggagatcctttctgggtgctaaggttgattggttatccagtagacattccagaagatcagcgcactgatactggatgtggagctcacacagattacggacttctgacactggttaaccaggatgatgacatatgtgcccttgaggtgcaaaaccgctctggtgagtggatatatgcgacaccaattccaggaacctttgtttgcaacattggagacatgctgaaggtttggtcgaatggaatttatcaatccacgcttcatagagttgtcaacaactcgcctcgttaccgcatatccgttgcattcttctacgagtcaaactttgatgctgccatagagcctgttcagttctgccgggagaaaactggcggtgctgcgaagtatgaaaaggtggtgtacggggagcatttggtaaagaaagtcctgacaaacttcgtcatgtaaatttcctaggtgcagatgcggtgggaataatgttactgaaatattggatttgtgatatttcatcaataaaacatgtctgtcc

SEQ ID NO: 4345 - DNA, 1334 bp, Setaria italica
aggggctcgtgaatctgccgtcacgctgtttgtcctcgtccatcggcttctatcattcaactaaccgactggccgagagtgccaagccatcgccgcaagctccaacgatcttatccccaaacctcgagctccctccctctctctacgttcaccatgggttccgacttcaaggcgatccccctgatcgatattggcccgctcgtcgaaaagattgatgatccgaggatggccaacgacgcggatttgctggaggttgtgcggatgctggacgacgcttgcaaggaggccgggttcttctatgtgaaaggccatggtattactgagtcgctattgaaggaagtccgggacgtgacacgcaaattctttcagcttccttgtgaggagaaattaaagattaagatgtcacctcagagtggatatagagggtatcaaaggataggggagaatattaccaagggtaaacctgatatgcacgaagcaattgattgctacactcctattaaacctggcaaatatggagatcttgctaaaccaatggagggatctaacttatggccagaaaacccatcaaattttgaagcactgctggagaactatatcaacctatgcagagatctttcaagaaagatcatgcgtggtatagctttggcattgggaggggcaattgatgcatttgaaggggaaacagctggagatcctttctgggttttaaggttgattggttatccagtagaaattccagaagagcagcgcactgatactggatgtggagcccatacagattatggactactaacactggttaaccaggatgatgacatatgtgcccttgaggtgcaaaaccgctctggtgagtggatatatgcaacaccgattccaggaacctttgtttgtaacattggagacatgctgaaggtttggtcgaatggaatttatgaatccacgcttcatagagttgtcaacaactcgcctcgttaccgcatatccgtcgcattcttctacgagtccaactttgatgctgccatagagcctgttcagttctgccgggagaaaactggcggtgctgcgaagtatgaaaaggtcgtgtacggggagcatttggtaaagaaagtcctgacgaacttcgtcatgtaaatttcctgggtgcagatgtggtggaaaacatgttactgaaatattggttttgcgatatttcatcaataaaacatgtctgtccatttgtgtcattgcagtgattttacaaatgccttatttgttgtgtacttctcctgtctaatgataacgactagttacagcaggtcagggagcatcgatggtgcaaaattaacatgagc

SEQ ID NO: 4346 - DNA, 1599 bp, Oryza sativa
gtaaacatagtggcattgtggcgatggcaatggcaaaatctcggatttctcgccgtatggtatggtacggcagacagagtacatgaaaagtggttttgctttgcttggtcgtctccaaattgaccatggcaatccaatcctattcttactcgggtcgggggtcagagcgcaccgcatatcgcatcatttttttcgggcaatccaatcgtataggtttccactacatactttcccatttttttcttacactttggttctataaaacgccgcacatgacgtcgaaagtcaccccgctatcgcagcaatccaaaatccccaacccaacccaacccaacccaaccgcactatcacgccactcttcgcccgcccgcccgccgccggaatcgccatcgcccgaccgccgccgcgttcgtgtccccacaggcggcttctctccctgcatcaccatgggttctgacttcaaggcaatccccttgatcgacattagtccccttgtcggaaagattgatgatccgagcatggtcaatgacgaggatttgctgcaagttgtgcaaatgttggacgatgcctgcagggaggctggattcttttatgtgaaaggccatgggattgctgactcgctaatgaagcaagttagggatgtgacacagaagttctttcagcttccttatgaggaaaaactcaagattaaaatgacacctcagagtggatacagagggtaccaaagagttggtgaaaatattaccaagggtaaacctgacatgcatgaagcaattgattgctacacgcctattgaacctggtaaatatggagaccttgctaaaccaatggtaggatctaatttgtggcccaaatatccatcaaattttgatgtactgctggaaaactatatcagccttctaagagatctttcaagaaagatcatgcgaggtatagccttggcgttgggtgcgccagttgatgcttttgaaggtacaaccgcaggagatcctttttgggtttgcaggctgatcggttatcctgtatcaactgatattccagaagagcagcgcactgatactgggtgtggagctcacacagactatggtcttctgacattggttaatcaggatgatgacatatgcgcccttgaggtcagaaaccaatcaggtgaatggatatatgccaaaccaatcccaggaaccttcgtctgcaacatcggtgacatgctgaaggtttggtcaaacggaatatatcagccaacacttcatcgagttgttaacaactcccctcgctaccgtgtatctgttgcattcttctatgagtcaaacttcgatgctgccgtagagcctgttgagttctgccgggagagaacaggtggtgttgccaagtatgaaaaggttgtgtacggagaacacttggttcagaaagtcttgacaaacttcgtcatgtaaaatttgtggaaaagaacatgcattgtactccaatgtctgatcgcaacattcgtcactaaaataaaatcatttgtaaatttgtcatagcacagtagaacagtcatattgaagaatggaatgcatccttaattgaaatcacaagcgatgtgaataatcttttcgtgca

SEQ ID NO: 4347 - DNA, 1313 bp, Secale cereale
aaacaaggaaaaggtgctctgcaccgcatcgcaataccgaacgcatggatggatgcatgattgctgatcctgccgtcacgccactcacctcatctcacctcacctgccatcgatatcgctcccttatcccaaatccctctcctccagtctcgagtctctctctgtctctctcgcctcgccgaacaacatgggttccgacttcaaggccatccctctgatcgatatcggcccgctcgtcgagaagatcgatgaccctgccatggccggcgacgagggtttgctggacgtcgtccggatgctggacgacgcttgcagggaggccgggttcttctatgtgaaaggccatggaatttcggagtccctaatgacggaggtcagggatgtcacccgcaagttctttcagctccctcgcgaggaaaaactgaagattaaaatgacacctcagagtggatatagagggtatcagagagtgggagaaaatgttaccaagggtaaacctgatatgcatgaagcaattgattgctacacgcctatcgaaccgggcaaatatggagatcttgccaaaccgatggagggatctaatttgtggccagattatccatcaaattttgacgcgctgctggagaactatataagacttctacgagatctttcaaggaagatcatgcgcggcatagccttggcgctgggtgcaccgttggatgctttcgaaggcggggtggcgggagatgctttctgggttctcaggttaattggctatccagtctcagatgacatcccacaagaggaacgcactgatattggatgtggagctcatacagattatggtcttctgacattggtgaatcaggatgatgatatctgtgctcttgaggtcagaaaccagtccggtgagtggatatacgccaagccggtcccgggaacctttgtttgcaacatcggggacatgctgaaggtttggtcgaatgggatataccagcccacgctccacagagtcatcaacaactcccctcgctaccgtgtatctgtcgccttcttctacgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaacagttcgaggaacaaatttctgtagctgtactgaaaatgatccatcaataaaacccttcgacaaatcagcctcctttctgacagcacatgaggatttcctatcatctggctttctccctttgcttgcgttctgcggatc

SEQ ID NO: 4348 - DNA, 1249 bp, Secale cereale
ccacaaccaaaaccaaacaggaaaaggtgctctgcaccgcatcgcaataccgaacgcatggatggatgcatgattgctgatcctgccgtcacgccactcacctcatctcacctgccatcgccctccttatcccaaaccccaaatccctctcctccagtctcgggtctctctctgtctctctcgcctcgccgaacatcatgggttccgacttcaaggccatccctctgatcgatatcggcccgctcgtcgagaagatcgatgaccctgccatggccggcgacgagggtttgctggacgtcgtccggatgctggacgacgcttgcagggaggccgggttcttctatgtgaaaggccatggaatttcggagtccctaatgacggaggtcagggatgtcacccgcaagttctttcagctccctcgcgaggaaaaactgaagattaaaatgacacctcagagtggatatagagggtatcagagagtgggagaaaatgttaccaagggtaaacctgatatgcatgaagcaattgattgctacacgcctatcgaaccgggcaaatatggagatcttgccaaaccgatggagggatctaatttgtggccagattatccatcaaattttgacgcgctgctggaaaactatataagccttctacgagatctttcaaggaagatcatgagaggcatagccttggcactgggtgcgccgttggatgctttcgaaggcggagtggcgggagatgctttctgggttctcaggttaattggctatccagtctcagatgacatcccacaagaggaacgaactgatattggatgtggagctcatacagattatggtcttctgacattggtgaatcaggatgatgatatctgtgctcttgaggtcagaaaccagtccggtgagtggatatacgccaagccggtcccgggaaccttcgtttgcaacatcggtgacatgctgaaggtttggtcgaatgggatataccagcccacgctccacagagtcgtcaacaactcccctcgctaccgtgtatctgtcgccttcttctacgagtcgaacttcgacgctgcggtggaacctgcagagttctgccgggagaagacgggcggcgttgccaagtatgagaaggtggtgtatggggagcacctagtgcagaaagtcctcaccaacttcgtcatgtaacagttcgaggaacaaatttctgtaactgtactgaaaatgatccatcaataaaacccttcgacaaa

SEQ ID NO: 4349 - DNA, 1306 bp, Triticum aestivum
ctcgccgaacaacatgggctccgacttcaaggccatccctctgatcgatatcagcccgctcgtcgagaagatcgatgaccctgccatggccggcgacgagggtctgctcgacgtcgtccggatgctggacgacgcttgcagggaggccgggttcttctatgtgaaaggccatgggatttcggagtcgctaatgacggaagtcagggatgtcacacgcaagttctttcagctccctcgcgaggaaaaactgaagatcaaaatgacacctcagagtggatatagaggatatcagagagtgggagaaaatgttaccaagggtaaacctgatatgcatgaagcaattgattgctacacgcctatcgaaccaggcagatatggagatcttgctaaaccaatggaaggatctaatttgtggccagattatccatcaaattttgatgcgctgctggaaaactatataagccttctacgagatctttcaaggaagatcatgagaggcatagccttggcactgggtgcgccgttggattctttcgaaggcggagtggcgggagatgctttctgggttctcaggttaattggctatccagtctcagatgacatcccacaagaggaacgcactgatattggatgtggagctcatacagattatggtcttctgacattggtgaatcaggatgatgatatatgtgctcttgaggtcagaaaccagtccggtgagtggatatacgccaagccggtccctggaaccttcgtttgcaacatcggcgacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaaaacgggcggcgttgccaagtatgagaaggtggtgtatggggagcacctagtgcagaaagtcctcaccaacttcgtcatgtaacagtttgggggaggggaggtgaaagcctgaaagggaacaaatttctgtagctgtactgaaaatgatccatcaataaaacccttcgacaaatcagcctcctttctggtcggacaaagtaactgtcccggtgtatcgtgaccaggcaaggcagcacatgaggatttcctctcatctggctttctcgctttgcttgcgttctgcggatcgaaccctcacaactggttcacaatccgttgtaatttcgtgacgacaatgtaaatgcaaccaccaatatgtcttgttgttactccacttccactctgctac

SEQ ID NO: 4350 - DNA, 1656 bp, Triticum aestivum
gaaacgggttccgttcccaagggtaccgaaagggaccgggaccccgaaggccgaagtacgggtaagtcaacgacacgagtaacgcggggaaaccggaaaaggtagctctgcaccgcatcgcaataccgaacgccatggatgcatgattgctgatcctgccgtcacgccactcacctcacctcatctcacctgccatcgatatcgctcccttatcccgaaccccaaatccccctctccggtccggcgcctccgtctctctcgccgaacaccatgggctccgacttcaaggccatccctctgatcgatatcagcccgctcgtcgagaagatcgacgaccctgccatggccggcgacgagggtctcctcgacgtcgtccggatgctggacgacgcttgcagggaggccgggttcttctatgtgaaaggccatgggatttcggagtcgctaatgacggaagtcagggatgtcacacgcaagttctttcagctccctcgcgaggaaaaactgaagatcaaaatgacacctcagagtggatatagaggatatcagagagtgggagaaaatgttaccaagggtaaacctgatatgcatgaagcaattgattgctacacgcctatcgaaccaggcagatatggagatcttgctaaaccaatggaaggatctaatttgtggccagattatccatcaaattttgatgcgctgctggaaaactatataagccttctacgagatctttcaaggaagatcatgagaggcatagccttggcactgggtgcgccgttggattctttcgaaggcggagtggcgggagatgctttctgggttctcaggttaattggctatccagtctcagatgacatcccacaagaggaacgcactgatattggatgtggagctcatacagattatggtcttctgacattggtgaatcaggatgatgatatatgtgctcttgaggtcagaaaccagtccggtgagtggatatacgccaagccggtccctggaaccttcgtttgcaacatcggcgacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaaaacgggcggcgttgccaagtatgagaaggtggtgtatggggagcacctagtgcagaaagtcctcaccaacttcgtcatgtaacagtttgggggaggggaggtgaaagcctgaaagggaacaaatttctgtagctgtactgaaaatgatccatcaataaaacccttcgacaaatcagcctcctttctggtcggacaaagtaactgtcccggtgtatcgtgaccaggcaaggcagcacatgaggatttcctctcatctggctttctcgctttgcttgcgttctgcggatcgaaccctcacaactggttcacaatccgttgtaatttcgtgacgacaatgtaaatgcaaccaccaatatgtcttgttgttactccacttccactctgctcatcctgaaacgctttcaacctctgagttatgatttgagttcagaaacaaagtttagaactgatatgaccaactttaataatgttcgtactgaca

SEQ ID NO: 4351 - DNA, 1461 bp, Triticum aestivum
acgacacaccagaaccaaaaaccagacaggaaaaggtgctctgcaccgcatcgcaataactaacgccatggatgcatgattgctgatcctgccgtcacgccactcacctcacctcacctgccatcggtatcgctcccttatcccgaacaccaatttcccctctccggtccggcgcctctgtctctctcgccggacaacatgggctccgacttcaaggccatccctctgatcgatattggcccgctcgtcgagaagatcgatgaccctgccatggccgacgacaaggctttgctggacgtcgtccaaatgctggacgacgcttgcagggaggccggattcttctatgtgaaaggccatggaatttctgagtcgctaatgacggaagtcagggatgtcacacgcaagttctttcagctccctcgcgaggaaaaactgaagattaaaatgacacctcagagtggatatagagggtatcagagagtgggagaaaatgttaccaagggtaaacctgatatgcatgaagcaattgattgctacacgcctatcgaaccgggcaaatatggagatcttgctaaaccaatggaaggatctaatttgtggccagattatccatcgaattttgacgcgctgctggagaactatataagccttctacgagatctttcaaggaagatcatgagaggcatagccttggcactgggtgcgccattggatgctttcgaaggcggagtggcaggagatgctttctgggttctcaggttaattggctatccagtctcagatgacatcccacaagaggaacgcactgatattggatgtggagctcatacagattatggtcttctgacattggtgaatcaggatgatgatatctgtgctcttgaggtcagaaaccagtccggtgagtggatatacgccaagccggtcccgggaaccttcgtttgcaacatcggggacatgctgaaggtttggtcgaatgggatataccagcccacgctccacagagtcgtcaacaactcccctcgctaccgtgtatctgtcgccttcttctacgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaaacagtttggggaaaaaaattctgtagctgtactgaaaatgatccatcaataaaacccatcgacaaatcagcctcctttctggtcggacaaactaactgtcccggtgtatcgtgaccaggcaaggcagcgcatgagtatttcctctcatctggctttctccctttgcttgcgttctgcggatcgaaccctcacaagtggttcacaatccgtaagcacacaatcctccgtgtaattttgtgacgacaatggaaatgcaaccaccaatatgtcttgttg

SEQ ID NO: 4352 - DNA, 1401 bp, Triticum aestivum
atggatgcatgattgctgatcctgccgtcacgccactcacctcatctcacctgccatcgccctccttatcccgaaccccaaatccctctccggtctcgggtctacctctcgcctcgccgaacatcatgggctccgacttcaaggccatccctctgatcgacatcagcccgctcgtcgaaaagatcgacgaccctgccatggccggcgacgagggtctgctcgacgtcgtccggatgctggacgacgcttgcagggaggccggattcttctatgtgaaaggccatgggatttcagagccgctaatgacggaagtcagggatgtcacacgcaagttctttcagctccctcgcgaggaaaaactgaagatcaaaatgacacctcagagtggatatagaggatatcagagagtgggagaaaatgttaccaagggtaaacctgatatgcatgaagcaattgactgctacacgcctatcgaaccggggagatatggtgatctagctaaaccaatggaaggatctaatttgtggccagattatccatcgaattttaacgcgctgctggaaaactatataagccttctacgagatctttcaaggaagatcatgagaggcatagccttggcactgggtgcgccgttggatgctttcgaaggcggagtggcgggagatgctttttgggttctcaggttaattggctatccagtctcagatgacatcccacaagaggaacgcactgatattggatgtggagctcatacagattatggtcttctgacattggtgaatcaggatgatgaaatctgtgctcttgaggtcagaaaccagtccggtgagtggatatacgccaagccggtcccgggaaccttcgtttgcaacatcggggacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaacagtttggggaacaaatttctgtagctgtactgaaaatgatccatcaataaaacccttcgaagccctcaaaaaataaaacccttcgacaaatcagcctccttttctggtcggacaaagtaactgtcctggtgtatcgtgaccaggcaaggcagcgcatgatgatttcctctcatctggctttctccctttgctcgcgttctgcggatcgaacccgcacaactggttcacaaatccataagcacacaatccttcgtgtaattttgtgacgacaatgaaaatgcaaccacc

SEQ ID NO: 4353 - DNA, 1472 bp, Triticum aestivum
ctctgcaccgcatctcaataccgaacgccatggatgcatgattgctgatcctgccgtcacgccactcacctcacctcatctcacctgccatcgatatcgctcccttatcccgaaccccaaatccccctctccggtccggcgcctccgtctctctcgccgaacaccatgggctccgacttcaaggccatccctctgatcgatatcagcccgctcgtcgagaagatcgacgaccctgccatggccggcgacgagggtctcctcgacgtcgtctggatgctggacgacgcttgcagggaggccgggttcttctatgtgaaaggccatgggatttcggagtcgctaatgacggaagtcagggatgtcacacgcaagttctttcagctccctcgcgaggaaaaactgaagatcaaaatgacacctcagagtggatatagaggatatcagagagtgggagaaaatgttaccaagggtaaacctgatatgcatgaagcaattgattgctacacgcctatcgaaccaggcagatatggagatcttgctaaaccaatggaaggatctaatttgtggccagattatccatcaaattttgatgcgctgctggaaaactatataagccttctacgagatctttcaaggaagatcatgagaggcatagccttggcactgggtgcgccgttggattctttcgaaggcggagtggcgggagatgctttctgggttctcaggttaattggctatccagtctcagatgacatcccacaagaggaacgcactgatattggatgtggagctcatacagattatggtcttctgacattggtgaatcaggatgatgatatatgtgctcttgaggtcagaaaccagtccggtgagtggatatacgccaagccggtccctggaaccttcgtttgcaacatcggcgacatgctgaaggtttggtcgaatgggatataccagcccacgctccacagagtcgtcaataactcccctcgctaccgtgtatctgtcgccttcttctacgagtcgaacttcgacgctgcggtggaacctgtagagttctgccgggagaaaacgggcggcgttgccaagtatgagaaggtggtgtatggggagcacctagtgcagaaagtcctcaccaacttcgtcatgtaacagtttgggggaggggaggtgaaagcctgaaagggaacaaatttctgtagctgtactgaaaatgatccatcaataaaacccttcgacaaatcagcctcctttctggtcggacaaagtaactgtcccggtgtatcgtgaccaggcaaggcagcacatgaggatttcctctcatctggctttctcgctttgcttgcgttctgcggatcgaaccctcacaactggttcacaatccgttgtaatttcgtgacgacaatgtaaatgcaaccaccaatatgtcttgttgttactccacttccactctgctcatcctgaaacgcttc

SEQ ID NO: 4354 - DNA, 1414 bp, Triticum aestivum
atggatgcatgattgctgatcctgccgtcacgccactcacctcatctcacctgccatcgccctccttatcccgaaccccaaatccctctccggtctcgggtctacctctcgcctcgccgaacatcatgggctccgacttcaaggccatccctctgatcgacatcagcccgctcgtcgaaaagatcgacgaccctgccatggccggcgacgagggtctgctcgacgtcgtccggatgctggacgacgcttgcagggaggccggattcttctatgtgaaaggccatgggatttcagagccgctaatgacggaagtcagggatgtcacacgcaagttctttcagctccctcgcgaggaaaaactgaagatcaaaatgacacctcagagtggatatagaggatatcagagagtgggagaaaatgttaccaagggtaaacctgatatgcatgaagcaattgactgctacacgcctatcgaaccggggagatatggagatctagctaaaccaatggaaggatctaatttgtggccagattatccatcgaattttgacgcgctgctggaaaactatataagccttctacgagatctttcaaggaagatcatgagaggcatagccttggcactgggtgcgccgttggatgctttcgaaggcggagtggcgggagatgctttctgggttctcaggttaattggctatccagtctcagatgacatcccacaagaggaacgcactgatattggatgtggagctcatacagattatggtcttctgacattggtgaatcaggatgatgaaatctgtgctcttgaggtcagaaaccagtccggtgagtggatatacgccaagccggtcccgggaaccttcgtttgcaacatcggggacatgctgaaggtttggtcgaatgggatataccagcccacgctccacagagtcgtcaacaactcccctcgctaccgtgtatctgtcgccttcttctatgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaaacagtttggggaaaaaaattctgtagctgtactgaaaatgatccatcaataaaacccatcgacaaatcagcctcctttctggtgggacaaactaactgtcccggtgtatcgtgaccaggcaaggcagcgcatgaggatttcctctcatctggctttctccctttgcttgcgttctgcggatcgaaccctcacaagtggttcacaatccgtaagcacacaatcctccgtgtaattttgtgacgacaatggaaatgcaaccaccaatatgtcttgttgttaaaaacctcggccgcgaccacgct

SEQ ID NO: 4355 - DNA, 1537 bp, Avena sativa
caatctgcccgccctgcactacacgacacgagccccagcatcgcatcgcactgacgtgacgtgacgcacggttggttgctgatcctgccgtcaacgccacactctcatcccacctcacctcgcctcacctgccatcatcgcttatcccaaaatcccaaaattccccccgaccctctctgtccctcgcctcgcctcgccagcatgggttccgacttcaaggccatccctctgatcgacatcggcccgctcgtcgagaagatcgatgaccccggcatggccggcgacgagggtctgctgggcgtcatccggatgctggacgacgcttgtaaggatgccgggttcttctacgtgaaaggccatgggattcccgagtcgctactgacggaagttagggacgtcacgcgcaagttcttccatcttcctcacgaggaaaaactgaagatcaagatgacgcctcagagtggctacagagggtatcagagagttggggagaatgttaccaagggtaaacctgatatgcacgaagcgattgattgctacacgcctatcgaaccggggaaatatggagctcttgctaaaccaatggaaggatctaacttgtggccggatcacccaccaaattttgacgcgctcctggagaactatataagtcttctacgagatctttcaagaaagatcatgcgaggtatagccttggcattgggtgcgccgttggatgcttttgaagggggaacggcaggagatcctttctgggttctcaggctgattgggtatccagtctcagctgacatcccgcaagagcaacgcactgatactggatgcggagctcacacagattatggccttttgacactggttaaccaggatgatgacgtatgtgcgcttgaggtcagaaacatgtctggcgagtggatatacgccaaaccggtccctggaacctttgtttgcaacattggtgacatgctgaaggtttggtcgaacgggatatatcagcccacgctccaccgagtcgtcaacaactcccctcgctaccgtgtatctgtcgccttcttctacgagtcgaacttcgatgctgccgtggagccagtggagttctgccgggagaaaacgggcggcgtcgccaagtacgagaaggtggtctacggggagcatctggtgcagaaagtcctgacgaacttcgtcatgtaaactgggtgaaaaaaggtagaaatctgttgtagcattccatcaataaaatcgtgtttgggtcactcgcgatgtgcgttgcagctgccgttcatggatgccgccgcgggcgttgatcagatcagtgcatatatatcgttgtaaagaaaaggcagtagtttctgacagcaatagatttgccgtctatgtgatgcacgaaatcgaaaagaattgttcagaatggacaaaacgagactccggccaagtttcctcccgagattctatggtagatagcacaaggccggtgcgttgctacgcattttgtacaaaactaaagttccatatttattaagaatatgattgccacttgttg

SEQ ID NO: 4356 - DNA, 1161 bp, Pseudoroegneria spicata
  misc_feature (9)..(12): n is a, c, g, or t
  misc_feature (1070)..(1072): n is a, c, g, or t
gaacaacannnngttccgacttcaaggccatccctctcatcgatgttagcccgctagtcgagaagatcgatgaccctgacatggccaaggacgagggtctgctggacgtcgtccgaatgctggacgacgcttgcagggaggccgggttcttctatgtgaaaggccatgggatttcggagtcgctaatgacggacgtcagggatgtcacacgcaaattctttcaactccctcacgaggaaaaactgaagatcaaaatgacacctcagagtggttatagagggtatcagagagtgggagaaaatgttaccaagggtaaacctgatatgcatgaagcaattgattgctacacgcctatcaaaccaggcagatatggtgatcttgctaaaccaatggaaggatccaatttgtggccagattatccatcaaattttgacgcgctgctggaaaactatataagccttctacgagatctttcaaggaagatcatgcgaggcatagccttggcactgggtgcgccgttggatgctttcgaaggcggaacggcaggggatcctttctgggttctcaggttgattgggtatccagtctcagctgacatcccacaagagcaacgcactgatattgggtgtggagctcacacagattatggccttctgacactagtgaatcaggatgatgatatctgtgctcttgaggtcagaaaccagtctggtgagtggatatacgccaagcccgtccccgggaccttcgtttgcaacatcggagacatgctgaaggtttggtcgaatgggatataccagcccacgctccacagagtcgtcaacaactccccccgctaccgtgtatctgtcgccttcttctacgagtcgaactttgacgccacggtggagcctgtggagttctgccgggagaaaacgggcggcgttgccaagtatgagaaggtggtgtacggggagcacctggtgcagaaagttctcaccaacttcgtcatgtaacagtttctgtagcatgtactgaaaacgttggggatcggtcacggtgctccatcaataaaacatgtgacaaaccannngtcttttctggacggacaaactgtcccggtgtgttgtgaccaggcaaaaggggtccatgggatgcaactacatgcctacttcaacctta

SEQ ID NO: 4357 - DNA, 1559 bp, Brachypodium distachyon
aaacagcacagccgcactgtctcacctgccattttgattgctgatcctgccgtcactctccttgtccggcctcatcgctcgcttatccccaaatcccaaccccccctctctctctctctctcatgggttccgacttcaaggccatccctctgatcgacatcggcccgcttgtcgagaagatcgacgatccagacatggtcggcgacgagggtttgctgggcgtcgtccggaagttggacgatgcctgcagggaggctggattcttttatgtgaaaggacacgggatagcggagtcactaatgacggaagttcgggatgtcacgcgcaagttctttcaacttcccgatgaggaaaagttaaagatcaaaatgacacctcagagtgggtatagagggtatcaaagagtaggtgaaaatgttaccaagggtaaacctgatatgcatgaagcaattgattgctacacgcctatcgaaccgggtaaatatggagatcttgctaaaccaatggaaggatctaatttgtggcccgattacccatcaaatttcaaagtactcctggaagagtatttaagcctcgtacgagatctttcaaggaaaatcatgcgaggtatcgccttggcattgggtgcgccgttggatgctttcgaaggcgggatggcaggagatgctttctgggttttcaggttgattgggtatccagtctcagctgacattccacaagagcaacgcactgatattggatgtggagctcacacagattatggccttctgacgctggttaaccaggatgatgacatctgtgctcttgaggtgagaaaccagtctggtgagtggatatacgccaagccagtccctggcacctttgtttgcaacatcggtgacatgctcaaggtttggtcgaacgggatatatcagcccacgctccacagagtggtcaacaactcccctcgttaccgtgtctccgttgcgttcttctacgagtccaacttcgacactacggtggagcctgtggagttttgccgggagaaaacagggggcgtcgccaagtatgagaaggtcgtgtatggggagcatcttgtccagaaagtcctcacgaacttcgtcatgtaaggattggggggaggggtacaaaaggaataaatctgaagcactccttcgggtactgaaaatgttggtgcaggccgagcacggcgttccattagttaataaaatccgcgtgatgcaaaagatgtgccgaatgtgccaatgccatgtgagagatactattacatgtacttaggcacggcgtgtcgtggcattgttgcgcaaagaaaaatgaaccgatctgtgcgtgatcgattgcctccaaggactggccactttgtggatgaactcatcttctcgatgccacctcctcgctatctttcttctcgagggcacctccttgctcaagtttcacagtatctaaagcccacaccattcccatatggttagaataattgtgtatatcaataaataatgttgtgttcctcttggagtataagtagaattgttttcagtatctgcccaaaactttcttta

SEQ ID NO: 4358 - DNA, 1322 bp, Triticum aestivum
atcccgaaccccaaatccctctctgttctcgggtctctctcgcctcgccgaacaacatgggctccgacttcaaggccatccctctgatcgatatcagcccgctcgtcgagaagatccatgaccctgccatggccggcgacgagggtctgctcgacgtcgtccggatgctggacgacgcttgcagggaggccgggttcttctatgtgaaaggccatgggatttcagagtcgctaatgacggaagtcagggatatcacacgcaaattctttcacctccctcgtgaggaaaaactgaagatcaaaatgacacctcagagtggatatagagggtatcagagagtgggagaaaatgttaccaagggtaaacctgatatgcatgaagcaattgattgctacacgcctatcgaaccgggcagatatggagatcttgctaaaccaatggaaggatctaatttgtggccagattacccatcaaattttgacgcgctgctggaaaactatataagccttctacgagatctttcaaggaagatcatgagaggcatagccttggcactgggtgcgccgttggatgccttcgaaggcggagtggcgggcgatgctttctgggttctcaggttaattggctatccaatctcagatgacatcccacaagaggagcgcactgatattggatgtggagctcatacagattatggtcttctgacattagtgaatcaggatgatgatatctgtgctcttgaggtcagaaaccagtccggtgagtggatatacgccaagccggtcccgggaaccttcgtttgcaacatcggggacatgctgaaggtttggtcgaatgggatataccagcccacgctccacagagtcgtcaacaactcccctcgctaccgtgtatctgtcgccttcttctatgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaaacagtttgggggaaaaaattctgtagctgtactgaaaatgatccatcaataaaacccatcgacaaatcagcctcctttctggtgggacaaactaactgtcccggtgtatcgtgaccaggcaaggcagcgcatgaggatttcctctcatctggctttctccctttgcttgcgttctgcggatcgaaccctcacaagtggttcacaatccgtaagcacacaatcctccgtgtaattttgtgacgacaatggaaatgcaaccaccaatatgtcttgttgtta

SEQ ID NO: 4359 - DNA, 1303 bp, Triticum aestivum
caaacaggaaaaggtgctctgcaccgcatcgcaataccgaacgcatggatgcatgattgctgatcctgccgtcacgccactcacctcacctcatctcacctgccatcgccctccttatcccgaaccccaaatccctctctgttctcgggtctctctcgcctcgccgaacaacatgggctccgacttcaaggccatccctctgatcgatatcagcccgctcgtcgagaagatccatgaccctgccatggccggcgacgagggtctgctcgacgtcgtccggatgctggacgacgcttgcagggaggccgggttcttctatgtgaaaggccatgggatttcagagtcgctaatgacggaagtcagggatatcacacgcaaattctttcacctccctcgtgaggaaaaactgaagatcaaaatgacacctcagagtggatatagagggtatcagagagtgggagaaaatgttaccaagggtaaacctgatatgcatgaagcaattgattgctacacgcctatcgaaccgggcagatatggagatcttgctaaaccaatggaaggatctaatttgtggccagattacccatcaaattttgacgcgctgctggaaaactatataagccttctacgagatctttcaaggaagatcatgagaggcatagccttggcactgggtgcgccgttggatgccttcgaaggcggagtggcgggcgatgctttctgggttctcaggttaattggctatccaatctcagatgacatcccacaagaggagcgcactgatattggatgtggagctcatacagattatggtcttctgacattagtgaatcaggatgatgatatctgtgctcttgaggtcagaaaccagtccggtgagtggatatacgccaagccggtcccgggaaccttcgtttgcaacatcggggacatgctgaaggtttggtcgaatgggatataccagcccacgctccacagagtcgtcaacaactcccctcgctaccgtgtatctgtcgccttcttctacgagtcgaacttcgacgctgcggtggaacctgtagagttctgccgggagaagacgggcggcgttgccaagtatgagaaggtggtgtatggggagcacctagtgcagaaagtcctcaccaacttcgtcatgtaacagtttggggaaaaaatctgtagctgtactgaaatgatccatcaataaaccatcgacaatcagcctcctttctgtcagacactaactgtcgggcatcaagacaggcaaggcagcgcatgagaatttccccctccatatttggcc

SEQ ID NO: 4360 - DNA, 1441 bp, Hordeum vulgare
gtgctctgcaccgcatcgcaataacgaacgccatgatatgatatggatggatgattgctgatcctgccgtcacgccactcacctcacctcatctcatctcatctcatctcatctcacccgaaatccctcgggtgtctctcgccttctgccaacatgggttccgacttcaaggccatccccctgatcgatatcggcccgctcgtcgagaagatcgatgaccctgccatggccggcgacgagggtgttctcggcgtcgtccggatgctggacgccgcttgcagggaggccgggttcttctatgtgaaaggccatgggatttcggaatcgctaatgaccgaagtcagggatgtcacgcgcaagtttttccagctccctcaccaagaaaaactgaagatcaaaatgacacctcagagtggttatagagggtatcagagagtgggagaaaatgttaccaagggtaaacctgatatgcatgaagcaattgattgctacacgcctatcgaaccgggcaggtatggtgatcttgctaaaccaatggaaggatctaatttgtggcccgattacccatcaaattttgacgcgctgctggaaaactatataagccttctacgagatctttcaaggaagatcatgagaggcatagccttagcattgggtgcgccgttggatgctttcgaagggggagtggcgggagatgctttctgggttctcaggttaattggctatccagtctcagatgacatcccacaagaggaacgcactgatataggatgtggagctcatacagattatggccttctgacattggtgaatcaggatgatgatatttgtgctcttgaggtcagaaaccagtccggtgagtggatatacgccaagccggtcccgggaaccttcgtttgcaacattggggacatgttgaaggtctggtcgaatgggatataccagcccacgctgcacagagtcgtcaacaactcccctcgctaccgtgtatctgtcgcctttttctatgagtcgaacttcgacgctgcggtggagccggtggagttctgccgggagaaaacgggcggcgttgccaagtacgagaaggtggtgtatggagagcacctggtgcagaaagtactcaccaattttgtcatgtaacagttgggggaggggaggtgaaatcctgaaagggaacaaatttctgtagctgtactgaaaatgatccatcaataaaatccttcgacaaaaaaaaaaaaaaaaaacctcgtgccgaattcggcacgaggtatatgagcacctacttgtaaaatccccataagcttcagattcagcaaaaatttcttcacgtgccacgtaaattgtgaatgctaaccagccctcttcttttctcttgtgtggagtgcagccatgtaattcttgggtttattgggtgagagcgtgtatatctatcctatcactg

SEQ ID NO: 4361 - DNA, 1328 bp, Brachypodium distachyon
actgtctcacctgccattttgattgctgatcctgccgtcactctccttgtccggcctcatcgctcgcttatccccaaatcccaaccccccctctctctctctctctcatgggttccgacttcaaggccatccctctgatcgacatcggcccgcttgtcgagaagatcgacgatccagacatggtcggcgacgagggtttgctgggcgtcgtccggaagttggacgatgcctgcagggaggctggattcttttatgtgaaaggacacgggatagcggagtcactaatgacggaagttcgggatgtcacgcgcaagttctttcaacttcccgatgaggaaaagttaaagatcaaaatgacacctcagagtgggtatagagggtatcaaagagtaggtgaaaatgttaccaagggtaaacctgatatgcatgaagcaattgattgctacacgcctatcgaaccgggtaaatatggagatcttgctaaaccaatggaaggatctaatttgtggcccgattacccatcaaatttcaaagtactcctggaagagtatttaagcctcgtacgagatctttcaaggaaaatcatgcgaggtatcgccttggcattgggtgcgccgttggatgctttcgaaggcgggatggcaggagatgctttctgggttttcaggttgattgggtatccagtctcagctgacattccacaagagcaacgcactgatattggatgtggagctcacacagattatggccttctgacgctggttaaccaggatgatgacatctgtgctcttgaggtgagaaaccagtctggtgagtggatatacgccaagccagtccctggcacctttgtttgcaacatcggtgacatgctcaaggtttggtcgaacgggatatatcagcccacgctccacagagtggtcaacaactcccctcgttaccgtgtctccgttgcgttcttctacgagtccaacttcgacactacggtggagcctgtggagttttgccgggagaaaacagggggcgtcgccaagtatgagaaggtcgtgtatggggagcatcttgtccagaaagtcctcacgaacttcgtcatgtaaggattggggggaggggtacaaaaggaataaatctgaagcactccttcgggtactgaaaatgttggtgcaggccgagcacggcgttccattagttaataaaatccgcgtgatgcaaaagatgtgccgaatgtgccaatgccatgtgagagatactattacatgtacttaggcacggcgtgtcgtggcattgttgcgcaaagaaaaatgaaccgatctgtgcgtgatcgattgcct

SEQ ID NO: 4362 - DNA, 3174 bp, Oryza sativa
ggccgatccgatccattgtatcatgcgaccaccctccctcctccccaaccagatcgaccattatatccgtctctccctccaacctcctcgctagaccagagccttccgtcgtgtcagtgtgccacccaaactcaccatggcttctgacttcaaggcaatccccttgatcgacattagcccacttgttgaaaagatcgatgatccaaatatggccaatgacaaggatttgctgcaagttgtccgattgttggacgatgcatgtagggaggctggattcttttatgtgaaaggccatgggattgctgagtcgctaatgaaggaagttagggacgtcacacacaagttcttccaacttccttatgaagaaaaactaaagattaaaatgacacctcagaatggatatagaggataccaaagactgggcgaaaatattaccaacggtaaacctgacatgcaggaagcaattgattattatgcgcctattgaacctggtaaatatggagatcttgccaaaccaatggaaggaactaatttgtggccaaaatatccatcaaattttgatgcactactaaaaaactatatcagccttctaagagatctttccagaaagatcatgcaaggtatagccttggcattgggtgggccagttgatgcttttgaaggtagaaccgcaggagatcctttttgggtttgcaggttgattggttatcctgtatcaaccgatattctagaagagcatcgcactgacactggctgtggagctcacacagactatggccttctgacattggttaaccaagatgatgacatatgtgcccttgaggtcaaaaaccaatcaggtgagtggatttatgccaaaccaatcccgggaaccttcgtctgcaacattggtgacatgctgaaggtttggtcaaatggaatatatcaaccaacacttcatcgagttgttaacaattcccctcgttaccgtgtatctgttgcctttttctatgagtcaaacttcgatgctgccatagagcctgttgagttctgccgggagagaacaggtggtgtcgccaagtatgaaaaggttgtatacggggagcatttaattaaaaaagtcttgaataatttcatcaaataaatttgcggaacagaaaaaacaaacgtgtatgcactccaagatcatatcacatcatttatcaataatactgtttgtgaaattttattgtagcacttgttgcatttctataatttgctacattttaggggctatcttaacactaaagatagagttcctttatggttcaccgtactatgctatagtagtgggttgtactagtgatccaacgattcgttggcataataagcctggcctaaggtcatgcctgtaactcgcctggcatctgtttggttgctaccctgaggattctagcctgataaatcttgcctgagtgtactcgcctgagtcaggcgtacaaaatgggtggcctgagcatttcgctccacctgcctgagtaaaatcaccgctcttctatacagtagtgaaaacgagaccacttcttcctcctcctcactgctagcctagggttcttgcggagaccagttcccatcgattcttccatggctccagcagcggtgaccaaggaacttgcagatctggtggccagttgtttctttttccagtaaaagtcctgcatttggtgatctgttagagcgtagctctgaccgtgagagctagcagattgccaagcccccacaatctttgccacgattttctgcagcaagttcataacatggatataggaggaagcaacaaacatggcaagggaaaaagtaaggcacgcaaaggagttgggggatcaggtgtgaggtcaaaacccataaattggccaccagcattctctgaatttcttcttgactggtacattgaaaagaagttagagctgccaccaaagggagtgatcaagaagatgcatcacactgcttgcacatcagctattaatgcaaagtatggcagtacttacaatgttgatcaggttcaacgacactataggtgccataaagagacttgggcacttgtagctcgccatctaaatgagagtggtggtggctgggatgagacaaacaaaatgttgtctctctcccaatctaccttggatagcctatcgattaatgaccgtggaattctttcaaagcctattcagttcttcgataagctgcaagagttgtttagtggttcctcggctgatggagcgtttatggaagatccttcaagtgttgctgattttgatgatgaagctgatgaacttgataatttcaatgatatgtcaacctatgctgaaacaaaatatccacaaggggaagactcggacaaattagaggcagacagtgatgattgcaaggaggtggcagcccttaatgcagcaactgcagcccttaatgcagcaactagtcaagtttcatcttctcataccagtggtctgaagccaaacaagaagagtttcaaaaagtgtgggaagccaaagaccttgcctcaatcacataatgataagggtaagcttaaggcaaagtcatcatctggattgcatgatgatgatgatattgatgtgctgatcactagtaccttggttggaatcaaagataaccttgccaaaccaatacagactgcagcccctcaagatccaaatgcccctctatgggacatgctcaagaagattgccttagaacctgaagataaaatgagagttggactacacctttgcaagccagaatttcaagctcatcgcagttttcttattagcatgggtcaagaatatcttgaacgttgggtttacaagttcttatctggtgatgatacaggcctctagtgagctataggtgcatattggttgcaaaagctaatcgtggttgatgagggtctatattttgctgcacccttttggtcatgcaattgccgcactatatatgtgtttagacaattgctaaatattaacatagatactatgatgatgcatgctgtgacatgctaatctgctagtagtgttgctttctaacttttggacaagttgataaccctagctttgtggcccttttcttttgtcttgtttaactcgtggcattactggctagaactgatctgtatgatggctgaaacttgatgttaaatatattcactatttccctgttgccatt

SEQ ID NO: 4363 - DNA, 1053 bp, Cynodon dactylon
gccggggagaagatatcggtagctctgcccagccatccgccaacctaaacaacaatcggtctcacttatcccctcaagagcgctctctctctctctctctctccgccatgggttccgacttccaagcgatccccctgatcgatatttgcccacttgtcgaaaagattgatgatccaagtacggcaaacgataaggatttgctggaagttgtgcggatgttagacgaagcttgtaaggaggctgggttcttttatgtgacagggcatggtattagtgagtcactactgagggaagtcagggatgtaacacgcaagttctttcagcttccttacgaggaaaaaatgaagatcaagatgacgcctcagagtggatatagggggtatcagagagtaggggagaacgttacaaagggtaaacccgatatgcacgaagcaattgattgctatactcctgttaaacctggtaaatatggtgatcttggtaaaccaatggaaggatctaatttatggcctgaatacccatcaaattttgaggggctcttggaaaattatgtcaacctatgccgagatctttcaagaaagatcatgcgaggtatagctttggcattgggagggaaagttgatgcttttgaaggagaaacagcaggagatccgttctgggttttaagattgattggttatccggtggatattccagcagagcagcgcactgacactggatgtggagctcatacagattatggtcttctgacactggtcaaccaagatgacgacatatgtgcacttgaggttcaaaatcgttctggtgactggatatatgccaagccgattcccgggacctttgtttgcaacattggtgacatgctgaaggtttggtcaaatggaatatacctatccacacttcacagagttgtcaacaattcccctcgttaccgtgtatctgttgctttcttctatgagtcaaatttcgatgctgctatagaacctgttgacttctgccgcgaggaagaccggtggtgtcccaaagtacgaaaaggttgtgtatgggaagcat

SEQ ID NO: 4364 - DNA, 1026 bp, Avena sativa
cctcgcctcgcctcgccagcatgggttccgacttcaaggccatccctctgatcgacatcggcccgctcgtcgagaagatcgatgaccccgccatggccggcgacgagggtctgctgggagtcatccggatgctggacgacgcttgtaaggatgccgggttcttctatgtgaaaggccatgggattcccgagtcgctactgacggaagtcagggacgtcacgcgcaagttcttccatcttcctcacgaggaaaaactgaagatcaaaatgacgcctcagagtggttatagagggtatcagagagttggggagaatgttaccaagggtaaacctgatatgcacgaagcgattgattgctacacgcctatcgaaccgggaaaatatggagctgttgctaaaccaatggaaggatctaacttgtggccagatcacccaccaaattttgacgcgcttctggagaactatataagtcttctacgagatctttcaagaaagatcatgcgaggtatagccttggcattgggtgcgccgttggatgctttcgaaggcggaacggcaggagatcctttctgggttctcaggctgattgggtatcccgtctcagctgacatcccgcaagagcaacgcactgatactggatgtggagctcacacagattatggccttctgacactggttaaccaggatgatgacatatgtgctcttgaggtcaggaacctgtccggcgagtggatatacgcaaaaccggtccctggaacctttgtttgcaacattggtgacatgctgaaggtttggtcgaacgggatatatcagcccacgctccaccgagtcgtcaacaactcccctcgctaccgtgtatctgtcgccttcttctacgagtcgaacttcgatgctgccgtggagccagtggagttctgccgggagaagacgggcggcgtcgccagtacgagaaggtggtctacggggagcatctggtgcagaaagtcctgacgaacttcgtcatgtaaactgggtggaaaaaggtaga

SEQ ID NO: 4365 - DNA, 602 bp, Saccharum officinarum
gcatccagctcactcacagagctcgcgaccagcgagagagcaagcaagaaaggaagcaagcggagcaatggagtactggtacccctgcaacggcggcagcggctgcagcaaggagaagaggccgccgctcaagaggggccagctcaagctgcagatcgccaagaccctgctcggcagcctcgcggcgccggtcgccaagaaccgggatcgcggcttcgggaaataagcagtgctagcaggcgtagagtagctagctgaggacatgcgtcgtgcggtggactgtgcaaactgatgagcttttcttttcctcttttaaaacacagggtgtgttgtgttggtgtcaagttttgccctgttctttctccttccgctcttgctcaccttcagcctcttggttgactcctgctagaacagaacactgaacaccaagcttaagagccctgttcttgaatgaagcaatgtacgtagagcgagaggtctacagttccttgctcttcctcttgtgtacaactaccaagttctaacagtctacagctgttctgctatagcatggttttgtatggtatttggtgcttaacttcagaactgcactacacttgagc

SEQ ID NO: 4366 - DNA, 976 bp, Zea mays
gagaagcaacggagagaggggccagctcaagaggaaggaagcaagcaagaaggaaacaaggaaggaagcaagcaagcaatcggagcgatggagcacgggtacccctgcaacggctgcggcaaggagaagcggccgccgctcaagaggggccagctcaagctgcagatcgccaggaccctgctcggcagcctcgcggcgccggtcgccaagaaccgggaccgtgccttcgggagataggccgcccgtgccgtggtagcaggagtagagtagtagctagctgaggacatgcgtcggtcgagtggcggactgtgccgtctgtgcttttgttcttcctcttcttcttttaagaaagagcgtgttgccgtcaggttttgctctgttctttctccttccgcaggcctcttgctcaccttcttcagccgcctctcttggttggctggctcgtactagaacggaaacgccaggcagcttaagagccctgttcctcctgaatgaagcaacgcacgcacgtagagcgagaaagcaacacaaccgtccggaaacatcttgtgtttttctatgtagtatcctcttgaacaaaaggagacgccaccagagcattcgattcctgccctggggcgacatttacgcctttatttggcatgacaatttggcctgatttctatttgccatgagggcataagctaggctaatccctccccaactaacactgatgcttcgagtgacccctcccccaactaactctggacaggtgcgcgggtggtgatgagtgtcgcgagtgcgagaagacaagtgacgcaggtcccactacccagcccactagcaacaacagagagatgagagaaccacatgcatggctcaaaacaagtccgcagcttaatttattccccgaccgtaggaaccacatgcatgacccaattccctcccatcaacacgcattcagatgaaaacgaacgtgcccaaaggatggagagaa

SEQ ID NO: 4367 - DNA, 497 bp, Panicum virgatum
agctctcgcagtctcgccttctccactccaccagcaagcagcggcgcaggacatcaggagctaaagaggaaggtggaagagctagcaatggagtacgggtacccctacaacggctgcggcggcaacaaggagaagaggccgccgctcaagcgtgggcagctcaagctgcagatcgccaggaccctgctgggcagccttgtggcgccgggcgccaagaacagggaccgcagcttcgggagataagcaaagctggagcgctggagcagtgcttgcagtgtcagcttccggaggatatgcatcctgtgctgcttgagataggaattgtgcagactgaagagttttttttctttaatagtttaattaggtatccgttggtgctaagttttgcccccttctgctcaccttcaggtttttagctgctggaacgcagcttagaactctcctcatagtgattaagcaatgcaaagagagaggttactgttccttgttcttgtgct

SEQ ID NO: 4368 - DNA, 1922 bp, Zea mays
atcactgcctctcctcgtctcgctttaaattctccctgcctctcctccatctcgcttcagtaatcagtgctcagtgctcactagcccaagtcgccctaaacctagcccgggcacccgccagaccagccagcccaacaacgcaaaacgcgacgcggccaccgccttgtccatgggctcctcggcgcagctcaggcggctgaagcctctgtaccagctggtggtgaacaacatcctgaccatcgtggccgtgccgctcgccgccgcggtcctgctcaaggcggcggagctggggcccgaggagatcctggcccgggcccgcgcgctccggccggcgcacatgctcctggcggggttcctgccggccgtggcgacggtgctgtacctgacgctccggccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctgctggagcggtcggggctgggggaggagacgtgcctgccgtacgcgcagcactacatcccgccgtcgcgcgacctggagtcctcccgcgccgaggccgagctcgtcatcttctcggccatcgacgacctgctcgccaagacgggcgtgtccccgcaggacatcgacatcctggtggtgaactgcagcctgttcgcgccgacgccgtcgttcgcggacatggtcatgcgccggtacgggctccgcggggacgtgcgcagcgtgcacctcgccgggatgggctgcagcgcggggctcatctccgtggagctggcccggaacctgctgcaggtggcgccgcggggcgcgcgcgcgctggtggtgtccacggagaccatcacgcccaactactacatgggcaaggagcgcgcgatgctgctccccaactgcctgttccgcatgggcggcgccgcggcgctgctgtccaccgacggcgccggcgcgcggttccggctggcgcgcgtggtgcgcacgctgcgcggcgcctcggacgccgcgtaccgctgcgtgtaccaggaggaggacgagcgcggcaacgtgggcatcaacctgtccaaggacctgatgagcatcgcgggcgacgcgctgaaggcgaacatcacggcgatggggcccctggtgctgccggcgtcggagcagctgctgttcgcgctgtccttcatcgcgcgcaaggtgctgaacgaccgggtgaagccctacatcccggacttccgcacggcgttcgagcacttctgcatccacgcgggcgggcgcgccgtgatcgacgagctccagcgaagcctgacgctgtcggacgagcaggtggaggcgtcgcggatgacgctgcaccggttcggcaacacctccagcagctccctctggtacgagctcgcctacatcgaggccaagggccgcatgcgcaggggcgaccgcgtctggatgatcggattcggctccggcttcaagtgcaacagcgccgcctgggagtgcatccgccccgccgccaacgccgacgacgggccgtgggccaactgcatccaccgctaccccgtccacattcccgacgtgctcaagcactgacccgactacaagcctgcgtaccgtaccgtacgtacgtccacattcccgacgtgctccagcggctcccgtacatgtgcgcccggggaacgggtgtgttgtggtccggagcgttgtatacacgtacactcgtttcgtcttgtgtccagatttctttatctatcatgtaatatgtttttcccatttctttaaaatccatgtacactttctatgtaatacagctacaagtctcacgtaccggttaaaacggttttcaagtttttaataaatattattcatatttattgctttaaatcaa

SEQ ID NO: 4369 - DNA, 2025 bp, Zea mays
cacttcagtaatcagtgctcgctagcccaccacgccctgaacctagcccggacacccgccaggacaggccagcccaacgcgatgcgaccgccgcctcagggtccgcgcaccaccatgtccatgggctccccggtgcagctcaggcggctgaagcctctgtaccagctggtggtgaacaacatcctggccatcgtggccgtgccgctcgccgccgcggtcctgctcaaggcgtcgtcgctcgggcccgaggagatcctggcgctccggccggcgcacatgttcctggccgcgttcctgcctgccgcggccacggtgctatacctgatgctccggccgcgcgctgtgtacctggtggactacgcgtgcttccgcaccagccccaactgccgcgtcccgttcgcgacgttcctggagcactcccgcgtgtggccgggcttcgacgagcgcagcgtccggttcatgacgcgcctgctggagcggtcggggctcggggaggagacgtgcctgccgtacgcgcagcactacatcccgccgtcgcgcgacctggagtcctcccgcgccgaggccgagctcgtcatcttctcggccatcgacgacctgctcgccaagaccggggtctccccgcgggacatcgacatcctggtggtgaactgcagcctgttcgcgccgacgccgtccttcgcggacatggtcgcgcaccggtacaggctccgcggcgacgtgcgcaacgtgcacctcgccgggatggggtgcagcgcggggctcgtctccgtggagctggcccggaacctgctgcaggtggcgccgcggggcgcgcgcgcgctggtggtgtccacggagaccatcacccccaactactacatgggcgaggagcgcgcgatgctgctgcccaactgcctgttccgcatgggcggcgcggcggcgctgctgtccaccgacggcgccggcgcgcggttccgcctggcgcgcgtggtgcgcacgctgcgcggcgcgtcggacggcgcgtaccgctgcgtgtaccaggaggaggacgagcgcggcaacgtgggcatcaacctgtccaaggacctgatgagcatcgcgggcgacgcgctgaaggcgaacatcacggcgatggggcccctggtgctgccggcgtcggagcagctgctgttcgcgctgtccttcatcgcgcgcaaggtgctgaacaaccggatcaggccctacatcccggacttccgcacggcgttcgagcacttctgcatccacgcgggcgggcgcgccgtgatcgacgagctccagcgcagcctgacgctgtcggacgagcaggtggaggcgtcgcggatgacgctgcaccggttcggcaacacctccagcagctccctctggtacgagctcgcctacgtcgaggccaagggccgcatgcgcaggggcgaccgcgtctggatgatcggcttcggctccggcttcaagtgcaacagcgccgcctgggagtgcatccgccccgccgccaacgccgacgggccgtgggccaactgcatccaccggtaccccgtgcacattcccgacgtgctcaagcactgagcccggcgccagctccagtttcgtgccgtgccttgcctttcccttttcctcctcgcccggttgccattgcacctgctgctacatttggtttgtggacatcaaaacgaaccgctggaacagcgattggccgtggtcgtgaactaggttggtggaatatgtgatggagagtgacagagtacttgtcgtgtcgtatcaacgggggctcaaggcggcggggtggtcgtcataaaggaggcgaggtcgggccaggctgccgtacatgggcgcccggggaacggacgtgtgttgtgcttgtccggggcgttgttgtattatctaccatttactatttcttacaattcattcctgcagtataccatgaaaagagatatgacatgagctactagtagacgacaagacgagcaaaagctttgatgtatgtgtgcacctactctttatacaatcaagtgttctcatttaagt

SEQ ID NO: 4370 - DNA, 2002 bp, Setaria italica
cgctttaaattctcgctgcctctcctctcgtctcgcttcagacttcagtaatcacagtactgatccacgccctgagcctggcccggacagccggcagctagcttagtccagtcccgcgctgcaacccaactcgacgggggtgtgggcgccgcctcggggttcgctcaccatggtctcctcggcgcagctcaggcggctcaagcccctgtaccagctggaggtgaacaacatcctggccatcgtcacggagccgttcgccgccgctgccgtgctcaaggcggcggagctgggtcccggcgagatcctggaacgcctccgcgcgctccggcccgcgcacatgttcctcgccgcgttcctgcgggcggcggcggcggcgctgtacctcaggctccgcccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcggctgctggagcgctcggggctgggtgaggagacgtgcctgccgtacgcgcagcactacatcccgccgtcccgggacctcgagtcctcccgcgccgaggccgagctcgtcatcttctccgccatcgacgacctcctcgccaagaccgggctgtccccgcaggacatcgacatcctcgtcgtcaactgcagcctcttcgcgccgacgccgtccttcaccgacatgatcatgcgccggtacaagctccgcgaggacgtgcgcgctgtgcacctcgccgggatggggtgcagcgcggggctcatctccgtggagctcgcccggaacctgctccaggtggcgccccggggcgcgcacgcgctggtggtgtccacggagaccatcacccccaactactacatggggcaggagcgcgcgatgctgctccccaactgcctcttccgcatgggcggcgcggcggcgctgctctccaccaacggcgccaacgcgcggttccggctggcgcgcgtggtgcgcacgctccgcggcgcctcggacagcgcctaccggtgcgtgtaccaggaggaggacgaccggggcaacgtcgggatcaacctgtccaaggacctgatgaacatcgccggcgacgcgctgaaggcgaacatcacggcgatgggtcccctggtgctgccggcgtcggagcagctgctgttcgcgctgtccttcatcgcgcggaaggtgctcaacaaccggatcaagccctacatcccggacttccgcacggcgttcgagcacttctgcatccacgcggggggccgcgccgtgatcgacgagctgcagcgcagcctgacgctgtcggacgagcaggtggaggcgtcgaggatgacgctgcaccggttcgggaacacctccagcagctcgctctggtacgagctcgcctacatcgaggccaagggccggatgcgcaggggcgaccgcgtctggatgatcggcttcggctccgggttcaagtgcaacagcgccgcctgggagtgcattcgccccgccgccaacgccgacgggccatgggcaaactgcatccaccggtaccccgtccacatccccgacgtgctcaagcactgaccgccccgtccgtacagccgccgttcctgcagccctctccgtccggtgtcgcgcatctcccagtacatctccattactactcttctgtgttgtgttccctaaaccgttggcaacagcgaccggggccggccatgaactcgaaattcgggggtcgaggacttgtcgtgtcagcgagcagcggcggcggcggcgggctggtcgtcataaaggcggcgggtcgggtcaggctctggtgcatgtgcgccgggagggcaaaacgtgatcacgtcgtcctcttccaggagggcggctgccggctttacacgtacactcgttggatgtgactcgtgtcgtgtcgtgttcccacttccttttctcgatgtgtgttttttgtgtttc

SEQ ID NO: 4371 - DNA, 2177 bp, Panicum virgatum
gactagttccacactacagctccacgacgccctgagcctggcccggacacccggcggctaggtagctagcccagcagcaccgcgaccgcacaacgccacgggagcgccgcctcggggttcgggcaccatgggctcctcggcgcagctcaagcggctcaagcccctgtaccagctggtggtgaacaacatcctcgccatcgtcgcggtgccgctcgccgccgcggtggtgctcaaggcggcggagttgggccccgcggagatcctggcgcggctgcgcgcgctccggcccgcgcacatgttcctggccgcgttcctgccggcggcggccgcggtgctgtacctctggctccggccgcgcgcggtgtacttggtggactacgcgtgcttccgcaccaaccccaactgccgcgtcccgttcgcgacgttcctggagcactcccgcgtgtggcccggcttcgacgagcgcagcgtccggttcatgacgcggctgctggagcgctcggggctcggggaggagacctgcctgccgtacgcgcagcactacatcccgccgtcgcgggacctcgagtcctcccgcgccgaggccgagctcgtcatcttctccgccatcgacgacctgctcgccaagaccgggatgtcgccgcaggacatcgacatcctggtcgtcaactgcagcctcttcgcgccgacgccgtccttcaccgacatgatcatgcgccggtacaagctccgcgaggacgtgcgcaacgtgcacctcgccgggatggggtgcagcgcggggctcatctccgtggagctcgcccggaacctgctgcaggtggctccccgcggcgcgcacgcgctggtggtgtcgacggagaccatcacccccaactactacatggggcaggagcgcgcgatgctgctccccaactgcctgttccgaatgggcggcgcggcggcgctgctgtccaccagcggcgcccaacgcgcggttccggctggcgcgcgtggtgcgcacgctccgcggcgccgcggacagcgcgtatcggtgcgtgtaccaggaggaggacgagcggggcaacgtcgggatcaacctgtccaaggatctgatgaacatcgctggcgacgcgctgagggcaaacatcacggcgatggggccgctggtgctgccggcgtcggagcagctgctgttcgcgctgtccttcatggcgcgcaaggtgctcaacaagcggatcaggccctacatcccggacttccggacggcgttcgagcacttctgcatccacgccggcgggcgcgccgtcatcgacgagctgcagaagaacctgcagctgtcggcgcggcacgtggaggcgtcgcgcatgacgctgcaccgcttcggcaacacctccagcagctcgctctggtacgagctcgcctacatcgaggccaagggccgcatgcgccgcggcgaccgcgtctggatgatcggtttcggctccgggttcaagtgcaacagcgcagcctgggagtgcatccgccccgccgccaacgccgacgggccctgggccaactgcatccaccggtaccccgtccacatccccgacgtgctcaagcactgaccgcgccgccggcgacgacctcccgtacgtgccgccattattcctgcctcccgtccagtgtcctcctctatccccctccacatcttcctttactcttctatctatctctctctctccggccgccggttccgttgccattgccacatatggttcgtggaaatcaaaccgctgggacagtgatgaactcggagtttggggtcgagggctttgtcgtgtcggcctgtcagggtggtcgtcataaaggcggcgggtcaggtgaggctcttggtgcatgtgcgcccccagggcgggcgggtgtgttgtggtcgaggtggcggtgtggttgtaatcgcgtcggccttttccaggagggcgggtactatacacgtacgtacactcgttggctgtgacttgttcgcgtcgtatcgtgttcccatttctttttttctgtatgttttttttgcgtatttttttttaacacattcatccagtataaggagagaaacaagagctagacaagcaagaagaagagcttgatgtatttgtgtacctaccaaaactctgtgtacctactctatcaatcgattgttcactgttgcatgaggcaagagaacc

SEQ ID NO: 4372 - DNA, 2441 bp, Oryza sativa
gtattattcagctgcttgagatgcgccgatgcctaattgcctattggctcgttctggttaaattcatcgtttcatcgcacggtacgagcacatgacacggacggactggctcacttgactggcttcgttaatggactcgccacctcacctactcaccaggcttactttcatcaatctcactggcttctctgcagcctctgaaccggggaacagaagccggggcctgggcctgggcctgggctctcgcttctttaaattctcccactccttcactcgcttcgtacacgagagccaagctgcgacgccactcgagggcacgacacaagctgacgtttcccttaacccaaacggcggcgcgaggaagcagccaatcaatttcctcgtagaggcatgacgagctcgtcggggcagctcaagaggctgaagccgctgtaccagctggcggtgaacaacatcctcgccgtcgtcgccgtgccgctcgcggcggcggtggtgttgaaggcggcggagctcgggcacgaggagatcctcgccagggcgcgcgcgctcccgccggcgcacctgttcttggccgcgttcgtcccggccgcggcggcggttgtctacctcatgctccgcccccgcgcggtgtacatggtggactacgcgtgcttccgcaccagccccaactgccgcgtcccgttcgcgacgttcctggagcactcccgcgtgtggccgggcttcgaagagcggagcgtccggttcatgacgcgcctgctcgagcgatcgggcctcggcgaggagacctgcctgccctacgcgcagcactacatcccgccgtcgcgcgacctcgagtcatcccgcgccgaggccgagctcatcatcttctccgccatcgacgacctgctcgccaagaccggcatctccccccaggacatcgacatcctcgtcgtcaactgcagcctcttcgccccgacgccgtccttcaccgacatgatcatcaaccggtacaagctccgcaaggacgtgcgcaacgtgcacctctccgggatgggctgcagcgcggggctcatctcggtgggtctcgccaggaacctgctccaggtcgcgcccaagggcgcgcacgcgctggtggtgtccacggagaccatcacgccaaactactacatgggccaggagcgtgccatgctgctgcccaactgcctgttccgcatgggcggcgccgccgtgctcctctccaccaacggtgccaaggcgcggttccggctggcgcgcgtggtgcggactctgaccggcgcccaggacggtgcgtaccactgcgtgtaccaggaggaggacggccgcggcaacgttgggatcaacctctccaaggacctgatgagcatcgccggcgacgcgctcaaggccaacatcacgaccatgggcccgctggtgctcccggcgtcggagcagctcctcttcgcgctctccttcatggcgcgcaaggtgctgagcgggcggatcaagccctacatccccgacttccgcacggcgttcgagcacttctgcatccacgccggcggccgcgccgtgatcgacgagctgcagcgcagcctcaccctgtcggacgagcaggtggaggcgtcccgcatgacgctccaccggttcggcaacacgtcgagcagctcgctctggtacgagctcgcctacgtcgaggccaagggccgcatgcgcaagggcgaccgcgtgtggatgatcggcttcggctccggcttcaagtgcaacagcgccgcgtgggagtgcatccgccccgccgccaacgccgacgggccatgggccacctgcatccaccgctaccccgtcgacatccccgacgtgctcaagcactaaccgagtcactcacaactccagcatcctctctgtgttcgtgcccgatcacaatcgattcgtgcaaaaataattatcactaacagtttgagagacaccgagggctgacgtgtgtagttgccgcggtgatcgtcgtgtcaagacaggtcatggtacgtctgcggcgcggcgcggttcaggctggtgcgtctgcggcgcggcgcggcgcgacgcggggggggggggggggggggggggtttaattggttcgatcgctttaccactcgcttcagctgaagtactccatatattgatacacaagtttggtgttacccgtgatgtacttagtagtggtcccatgtgtctcgcttttattttctttttctcttcatttatctcttccttgatgtactgatactgtttatcacagggaaaagggcaccatcgatcactctatccaaaagcatgtaactttgacagaaatgaaacttccagcggtacaaagttgctcctatactgtaaagcagacctatagttgcatacattcatgaagaatctagtaaggtctggcatgttcctgaatgttgaaaacctgcttccctgtgttaattcggtga

SEQ ID NO: 4373 - DNA, 1899 bp, Brachypodium distachyon
ccggggcctcctcgtcctggcttccttccatcccaccgcgaggtagcagcaaaacactccactgaaacgcagacgcgaaggacagagaacgcaccgcacggttagcatgatgagctcgtcggcgcagcttctcaggcgtctcaagccgctgtaccagcttgtggtgagcaacatcctggccatcgtgtcagtgccgttggccgccctggccgcgctcaaggccgccgagctcgggcccgacgaggccctggcgcgtctgcgcgcgctccggccggcgcacatgttcctggccgcgttcgtgccagcggcggccgcggcgctgtaccttcgtctccggcccagggcggtgtacatggtggactacgcgtgcttccgcaccagccccaactgccgcgtcccgttcgccaccttccaggagcacgcccgcgtgtggcctggcttcgacgagcgcagcgtccgcttcatgacgcgcctcctggaacgctcggggctcggggaagagacgtgcctcccttacgcgcagcactacatcccgccgtcccgcgacctggagccctcccgcgcggaagcggagctcatcgtgttctccgccatcgacgacttgctcgccaagaccggcgtgtcccctgccgacatcgacatcctggtcgtcaactgcagcctgttcgcgccgacgccgtccttcgcggacatggtggtgaaccggtacaggctgcgcaaggacgtgcgcaacgtgcacctggccggcatgggctgcagcgcggggctcatcgccgtcggcctggccaggaacctgctgcaggtggcgccgccaggcgccaaggcgctggtggtgtcgacggagaccatcacgccaaactactacatggggaaagagcgcgccatgctgctcccaaactgcctcttccgcatgggcggcgccgccgtgctcctgtccacgagcccccgcaacgcgcggttccggctgtcccgcgtggtgcgcacgctgacgggcggcgccaaggacggcgcgtaccggtgcgtgtaccaggaagaagacgaccggggcaacgtggggatcaacctgtccaaggacctgatgagcatcgccggggacgcgctcaaggccaacatcacggccatgggtcccctggtgctcccggcgtcggagcagctgctgttcgcgctgtccttcatcgcgcgcaaggtggtgagcggcaggatcaagccgtacatcccggacttccgcacggcgttcgagcacttctgcatccacgccgggggacgggcggtgatcgacgagctgcagcggagcctgacgctgtcggacgagcaggtggaggcgtccaggatgacgctgcacaggttcgggaacacgtccagcagctccctgtggtacgagctcgcctacatcgaggccaaaggccggatgcgcaagggcgaccgcgtctggatgatcgggttcggctccgggttcaagtgcaacagcgccgcctgggagtgcgtccggccgccgccgcccgaggccgtccgggacgggccctgggcggcctccgtgcaccggtaccccgtcgacatccccgacgtggtcaagcattagaaactttggcacccataaataagatcgtcctcgtacgtacactacacacagtcacactggcacgcagacactagtagctactagctaccgcctcctctttgtacgtacaagtgttattattcaattgttgcatgtcttcatccggttcatctctccggccgctgcacattgcattgatggctccttctgttttccactcacggagtatcctactggaccgccctaagtatagtgcctattgctacatgatattgcttttgccaatcaatcgatcgatcgatcgattgaacagttaaaagtgacgaacggtactacacgga

SEQ ID NO: 4374 - DNA, 1759 bp, Brachypodium distachyon
catgatgagctcgtcggcgcagcttctcaggcgtctcaagccgctgtaccagcttgtggtgagcaacatcctggccatcgtgtcagtgccgttggccgccctggccgcgctcaaggccgccgagctcgggcccgacgaggccctggcgcgtctgcgcgcgctccggccggcgcacatgttcctggccgcgttcgtgccagcggcggccgcggcgctgtaccttcgtctccggcccagggcggtgtacatggtggactacgcgtgcttccgcaccagccccaactgccgcgtcccgttcgccaccttccaggagcacgcccgcgtgtggcctggcttcgacgagcgcagcgtccgcttcatgacgcgcctcctggaacgctcggggctcggggaagagacgtgcctcccttacgcgcagcactacatcccgccgtcccgcgacctggagccctcccgcgcggaagcggagctcatcgtgttctccgccatcgacgacttgctcgccaagaccggcgtgtcccctgccgacatcgacatcctggtcgtcaactgcagcctgttcgcgccgacgccgtccttcgcggacatggtggtgaaccggtacaggctgcgcaaggacgtgcgcaacgtgcacctggccggcatgggctgcagcgcggggctcatcgccgtcggcctggccaggaacctgctgcaggtggcgccgccaggcgccaaggcgctggtggtgtcgacggagaccatcacgccaaactactacatggggaaagagcgcgccatgctgctcccaaactgcctcttccgcatgggcggcgccgccgtgctcctgtccacgagcccccgcaacgcgcggttccggctgtcccgcgtggtgcgcacgctgacgggcggcgccaaggacggcgcgtaccggtgcgtgtaccaggaagaagacgaccggggcaacgtggggatcaacctgtccaaggacctgatgagcatcgccggggacgcgctcaaggccaacatcacggccatgggtcccctggtgctcccggcgtcggagcagctgctgttcgcgctgtccttcatcgcgcgcaaggtggtgagcggcaggatcaagccgtacatcccggacttccgcacggcgttcgagcacttctgcatccacgccgggggacgggcggtgatcgacgagctgcagcggagcctgacgctgtcggacgagcaggtggaggcgtccaggatgacgctgcacaggttcgggaacacgtccagcagctccctgtggtacgagctcgcctacatcgaggccaaaggccggatgcgcaagggcgaccgcgtctggatgatcgggttcggctccgggttcaagtgcaacagcgccgcctgggagtgcgtccggccgccgccgcccgaggccgtccgggacgggccctgggcggcctccgtgcaccggtaccccgtcgacatccccgacgtggtcaagcattagaaactttggcacccataaataagatcgtcctcgtacgtacactacacacagtcacactggcacgcagacactagtagctactagctaccgcctcctctttgtacgtacaagtgttattattcaattgttgcatgtcttcatccggttcatctctccggccgctgcacattgcattgatggctccttctgttttccactcacggagtatcctactggaccgccctaagtatagtgcctattgctacatgatattgcttttgccaatcaatcgatcgatcgatcgat

SEQ ID NO: 4375 - DNA, 1923 bp, Triticum aestivum
ggagtagccacctactcacacagccgactcatcaagtcaggatcgtgagtcctctgcctgcttctgtagtgtgatctcttctcggggcgacaggctcgggctccacctgcggggtccggcaccccgagttccgcttctttaaattctccctcccggctttctcctcgcctcccaccgcgagccaggcgacacccccacgaggccacaaagccaaagctgctcccaacgcagacgcaagcgatacagagcgcgccgttagcatgagctcgtcggtgcagctcaagcggctgtaccagctggcggtgagcaacatcgtggccatcgcggccgtgcccttcgccgcctccgccctgctcaaggcggcggagctagggcccgaggagctgctcgcccggctgcgcgcgctccggcccgtgcacatgttcctggccgccttcgtcccggccgcggcggccgccgtctacctcaagctccgcccgcgcgcggtgtacatggtggactacgcgtgcttccgcaccagccccagctgccgcgtcccgttcgccgcgttccaggagcacgcccgcgtgtggccgggctttgacgagcgcagcgtccggttcatgtcgcgcctgctggagcgctccgggctcggggaggagacctgcctcccctacgcgcagcactacatcccgccgtcccgcgacctcgagtcctcccgcgccgaggtcgagctcatcgtcttctccgccatcgacgacctgctcgccaagaccaaggtcgccccggaggacatcgacatcctcgtcgtcaactgcagcctcttcgccccgacgccgtccttcgccgacatgatcgtcaaccgctacaacctccgcaaggacgtccgcaacgtgcacctcgccgggatgggctgcagcgcggggctcatctccgtggggctcgcaaggaacctgctccaggtcgcgcccagggggtcgaacgcgcttgtggtgtccacggagaccatcacgccaaactactacatgggcaaggagcgcgccatgctcctgcccaactgcctcttccgcatgggcggcgccgccgtgctcctctccaccaacggcgccaacgcgcggttccggctggcgcgcgtggtgcggacgctgacgggcgcccaggacggcgcgtaccgctgcgtgtaccaggaggaggacgaccggggcaacgtgggcatcaacctgtccaaggacctgatgagcgtcgccggcgaggcgctgaaggcgaacatcacggccatggggcccctggtgctcccggcgtcggagcagctgctgttcgcgctgtccttcatcgcgcgcaaggtggtgaaccgcgggatcaagccgtacatcccggacttccgcacggcgttcgagcacttctgcatccacgcgggcgggcgcgcggtgatcgacgagctgcagcgcagcctgacgctgtcggacgagcaggtggaggcgtcgcggatgacgctgcaccggttcggcaacacgtccagcagctcgctgtggtacgagctggcctacgtggaggccaaggggcgcatgcgcaagggcgaccgcgtgtggatgatcggcttcggctccgggttcaagtgcaacagcgccgcctgggagtgcatacacccggcgcccgtggcggccgacgggccctgggccgcctgcgtccaccggtaccccgtcgacatccccgacgtgctcaagcattagcctagccaacccaacccaacccagcccggcagctcgtctggtgcacattcgtacacacacgttggctcgtacacagaaaagtccacacactccagtagccaccactaggtggtagcactagctaatactctaccaacgatcgacccgtgctctgtacgtaaaactagtcattgctgcatgcatccagtgagctcatctcatctctctctctcca

SEQ ID NO: 4376 - DNA, 1352 bp, Saccharum officinarum
tccacctctctctctctctcctcccactgctcgccctctctcttacgcgcgcgtgacaacctccctccacgggcgcgcggcgcgggagcagcagcggcagcacccaccgactgatcgccggtggggcggggcgggggcgatctgatgccggcgcggcggtgatggcagcgccgtccggcggtgggggcggcggtgcgggggagggctcctcctcggccgccgcagctgcgacgatcggggcccacggggtggaccaagaggcgatgtggcagatgaatttaggagaaaccatggcccccatggaactggggccatacccagagcgtgttggtgagccagactgtagctattacatgaggactggcatgtgcaggtttgggatgacctgtaaatttaatcacccagcagacagaaagctggctgttgctgctgcaagaatgaagggagaatatcctcaaagaattgggcagcctgaatgtcaatactatctgaagactggcacgtgcaagtttggagcaacttgcaagtttcaccatccccgagaaaaggctgcaatggcaactcgagttcagttgaatgaattgggctacccactccgcccgaatgaaaaggagtgtgcttattatttaagaacagggcagtgcaagtttggaagcacatgtaagtttcaccatccacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagttatgcacaagtgatggttcctcctgggcttgtcaggtcccaggatggagtccttatactgcacagattggttcttcatcctcggatgaccaacaacggacacccggagctgcccaatactatactggctcacgccagagtggaacagctggcataagcgatcaaggaatgttttcatcctaccaagcaagttctgttcccgttggactttatgcagtacagagggagaatgtatttccagagaaacctgaccaacctgaatgtcagttctatatgaagaccggagactgtaagtttggtgctgtatgcaagttccatcatcccagggagcgaataattcctactcccaattgtgcactgagtccattaggcctacctttgcgcccgggagagccaatatgcagtttctataatcgctatgtcatgtgcaagtttggtccaaattgcaaattcgatcatccaatgggaagtgctatgtatggccatgcttcatcaccaactagtgaggccccaa

SEQ ID NO: 4377 - DNA, 2169 bp, Zea mays
gcgcggccgcgcggtgaaaagaagcgggccgcgaggggaggaggaacaaaacgactggctgtccgaacggggacgtctggttcctctcattccccttccacctcgctctctctctctctcctcccactgctcgccctctctctcttacgcgcgcgtgacaacctccctccctccactgcgcgcggcgcgggagcagcagcggcagcacccaccgactgatcgccggtgggcggggcgggggcgatctgatgcgggcgcggcggtgatggcagcgccatccggcggtgggggcggcggtgcgggggagggctcctcctcggccgccgcagctgcgacgatcggggtccacggggtggaccaagttgcagaggcgatgtggcagatgaatttggaagaagccatggaactggggccatacccagagcgtgttggtgagccagactgtagctattacatgaggactggcatgtgcaggtttgggatgacctgtaaatttaatcacccagcagaccgaaagctggctgttgctgctgcaagaatgaagggagaatatcctcaaagaattgggcagcctgaatgtcaatactatctgaagactggcacgtgcaagtttggagcaacttgcaagtttcatcatccccgagaaaaggctgcaatggcaactcgagttcagttgaatgaactgggctacccactccgcccgaatgaaaaagagtgtgcttattatttaagaacagggcagtgcaagtttggaagcacatgtaagtttcaccattcacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagttatgcacaagtgattgttcctcccgggcttgttcaggtcccagggtggagtccttatactgcgcaaattggttcttcatcctcggaggaccaacaacggacacctggagctgctcaatactatactggctcacgccaaagtggtactagtataggcgatcaaggaatgttttcatcctaccaagcaggttctgttcctgttggactttatgcagtacagagggagaatttatttccagagagacctgaccaacctgaatgtcagttctatatgaagaccggagactgtaagtttggtgctgtatgcaagttccatcatcccagggagcgaataattcctactcccaattgtgcactgagtccattaggcctacctttgcgcccgggagagccaatatgcagtttctacaatcgctacggcatgtgcaagttcggtccaaattgcaaattcgatcacccaatgggaaatgccatgtacggccaggctccatcgccagctagcgaggccccagctcctcggcgcatgctggcacatgtaccgccgtcgcacccagaagcatcgcctgatggtggttccggaaggtctaggaggattgcccactctgattcccagcaaataccctctggtgaaaggagcgctgagagagaggcgtcctaggccatcctcggtgtcttcgttccccattcttgactggagtaaccatctgcaaccaacaacattcgaggatccgaagctgtacaggtcttttgccccacctctgagctttacataccggagcttgcttcaacgtgtattgcattcaggcaggaaaaagttcttgcctgttcgggatgctcatttgctcccccactgaaacgggaacaaacctaccttatttaaaacatatgtatggatggaacctactcacctctggacattcaaacccattcgagtcatgtgcactggtcccggtgctgtagttatagagctgtctttgcatggacaaagctgttgcgaaactgactggggatgcgcaagcataacctcttttgttaattattgtctcgtttttttttctcggcatttatctctttttcataagggcagccccgcactctgaaagtgtgcgttttgaagattgggaaaataataggttgccatcgtatgctctgtattacccaccatgctttaaactcagttatttgagagtcgtttttatcttggtggtcctgacagggactgtttatttt

SEQ ID NO: 4378 - DNA, 2906 bp, Oryza sativa
agttgactgggttggttggcgcggccgcgcggcggtgaaaaaaagcggggaagggaggagaggaacaaaaacgactggctgtccgaacggggacgcctcgttcctctcattccccttccttcctccctcttccgcctccgcctcctcctcctccgcccttacccccgcgcgcgtgcacgcgacggcgcggcgatctgatgctgccgccgctgctgctgcaggcgccgcggtgatggcggcggcgccgtccgccggcggcgttggggagggctcttcctcctccgccgccgccgccgctgctgctgctgccgcgacgatcgggccccacgtggtcgacgaagaggcaatgtggcagatgaatctaggagaagctatggaagctgggccatacccagagcgtattggagaaccagattgtagttattacatgaggactggcttgtgcaggtttgggatgacctgtaaatttaatcacccagcagatcgtaagatggctgttgctgctgcaaggatgaagggggaatatcctcaaagaattggtcaacctgaatgtcaatattatttgaagactggaacatgcaaatttggagcaacatgcaagtttcaccacccccgagaaaaagctgcaattgcaacccgagtacagctgaatgctttaggctacccattgcggccgaatgagaaggaatgcgcttattatttaagaaccggacagtgcaaatttgggagcacatgtaagtttcatcatccacagccatctaatacgatggttgctgtacgtggctctgtttattcacctggacagtcagttacttctcctagtcagcatacttacccaggggctgtaacaaactggcccttgtcaagatctgcttcgtttattgcaagtccaaggtggccaggccattctagctatgcacaagtgattgttcctccagggctcgttcaagttccagggtggaatccttatgcagcacaaattggttcttcatcctcagacgatcaacagaggacagctggaggtgcacaatactatactggctcacgtcacagtgaaacacctaacatgggtgaccagggaatgttttcatcataccaagctggttctgttcctcttgggctatatacagtacagagggagagcatatttccagagcgacctgaccaaccagaatgccagttctatatgaagactggggactgtaagtttggtgctgtatgcaagttccatcatcccaaggagagaattatccctactccaaactgtgcgttgagctcattaggtcttccactgcgtccgggagagcccatatgcacattctattctcgctatggcatctgcaagtttggtccgaattgcaaatttgatcatccaatgggaactgtgatgtatggtctcgcaacatcaccaactggtgatgtgtctgcccgacgtatgctggcacctgtaccagcacattcagaagtatcgcctgacaatgtctcagggaggtctcggaggatcacccattcagattcccagcaaataccctctggtgaaagaggcaccgagagagaggcgtcctaagccatcctcggtgcaaatgtttcatgctgcttcctgttcttgactctctgagtaaattacccgcaacaaaacttgaggagccgaagctgtacaggtctcgcccttttgcctcacatttgagctttacataccggagcttgcttcaagacttccaacatgtatcgcattcaggcaggaaaaagttcttgcttgttagggatgctcttttgccccgtgtaaacgggacaaccgaccttatttaaacatctatatatggaacaaactcacctctggacattcgatttcgagtgatgtgccttgatccctttgttgtagttatacaggtgccttgcaatggacaaagcttttgccaaacgggggatatgtgcaaatcgctctcctctctgtttctttcttttttttgccttccctctaatttagcagtttcataaggggcaacccccgcttctggaattgtgcatgttgaggatgcggaaataataggcaattgtataatcatctacatatttataccctgtcacttgttcccataagagagcagaaaattcaccttgatggtgccggctttagtttgtcatttcatcttgcaaaattttgttctgctactgaaccttttatcaattgtgcatcatttttttgccattatatgtgcacgggaaggatggttactaaagaacaagtaacaagaggtagggttagactggttgagacaggtccggttcctaattctgttacagcaatctatcatttgcacagctatcaaggttgccaaacacctctatccggtgttacgcctcctaaatcctgatgaacggagcagctgcgtcaacacctatgtcctgataaacggagcagctgcatcaggattctggagtgtcaggtaggtgaaggtataatgtggagcaaaaggagttccagatgactcctaatcctataatcatccgatacgagtaggttcgccacatgcggatgaaatgtagtggatggtttctaaactacaaatgtagtggatggtttcttataaataggattatcagatcatcagcccttcaaaactatgggcctggttggcacagctctagctcccgctccacccctcctggagctggagctcagccaaacagttttagctccaccaaaaatgggagtggagttgggtagagctctctcacagaatgtactggagttgtagagctgggtttaggcagctccacaactccacttcagactcaactcctaaagttatatttaggagttagagttgtactaaacaggccttacaaatagaacactacttatatgtccacattataagtttgcctaagagggtatcattttc

SEQ ID NO: 4379 - DNA, 2074 bp, Setaria italica
ctctctctctctctctctctctctctctctctctctctcacgcgcgcgtgacacctccacgggcgcgcgagagcagcagccaccgactgatcaacggcgggggcgggggcgatctgatgctggcgtggcggtgatggctgcgccgtccgccggcgccgggggtgggggcggcgccgcgggggagggctcctcctcctcggccgccgcggctgcagcagctgcgacgatcggggcccacggggtcgaccaagttgcagaagcgatgtggcagatgaacttaggagaagctgtggaactggggccatacccagagcgtgttggtgagccagactgtagttattacatgaggactggcatgtgcaggtttgggatgacctgtaaatttaatcatccagcagataggaagctggctgttgctgctgcaagaatgaagggagaatatcctcaaagaagtggccagcctgaatgtcaatactatctgaagactggcacatgcaagtttggagcaacttgcaagtttcaccacccccgagaaaaggctgcaatggcaactcgagttcagttgaacgaattggggtatccattccgcccgaatgaaaaggaatgtgcttattatttaagaacagggcagtgcaagtttggaagcacatgtaagtttcaccatccacaaccatctaccatgatggttgcagtacgtggctctggttattcacctggacagtctgcaacttctcctggccaacatgcttaccaaggggctgtaacaagctggcctttgtcaagatctgcttctttcattgcaagcccaaggtggccaggtcattcaagctatgcacaagtgattgttcctccagggcttgttcaggtcccagggtggagtccttacactgcgcagattggttcttcatcctcagatgaccaacaacagacacccggagctgcccaatactatactggttcacgccagagtggaacacctggcatgggtgatcaaggaatgttttcatcataccaagctggttcagttcctgttggactttatgcagtacagagggagaatgtgtttccagagagacctgaccaacctgaatgccagttctatatgaagactggagactgtaagtttggtgctgtatgcaagttccatcatcccagggagcgaataattcctactcccaattgtgcgctgagttcattgggcctacccctgcgcccgggagagcccatttgcagtttctattctcgctatggcatgtgcaagttcggtccaaattgcaaattcgatcatccattaggaaccgtcatgttcggccatgcttcatcaccaactggcgaggtcccaacttctcggcgtatgctggcacatgtaccatcgcatccagaagtatcacctgacagcggctcgggaaggtcgcggaggatttcccattcagattcccagcaaatacccccaggtgaaaggagcactgagagagaggcgtcctaagccatcctcggtgccgtgttcatgctgcctcccattcttgactggagtaattacctgcaacaaacatttgaggagctgtacaggtcttttgcgctttttacctcaccttcgagctttacataccggagcttgcttcaacgtgtattgcattcaggcaggaaaaagttcttgcctgttcgggatgcccattcgcccaatggaaacgggaacaaaccttggctatttaaaacatatatgtatggaatcaactcacctctggacattcggaccgattcgagtgatggtgttgttgtagctatagaggtgcattgcaatggacaagcttttgcgaaacatgattggggatgcgcaagcataacctctttttcgttaatttctttcagcatttccataagagcaacctcacatgagtgtttatcacacacattagttttttccccctatggcggactcacacgcaagcacaaaataacacaagtagcttttggtggatgtggccatccttacccaacatatatgtagctggtaccttcccatgttatgttcctatttaatgcagtcaatacctatatgatctgcatatttttt

SEQ ID NO: 4380 - DNA, 1887 bp, Panicum virgatum
ctcgctctctctctctctctcttcgcactgccctctctctctcttacgcgcgcgtgacacctccacgggcgcgccgcgcgcgagagcagccgccaccgactgatcaccggcgggcgcgggggctggggcgatctgatgctggcgcggcggtgatggctgcgccgtccgccggcgcagggggcgggggcggcggcgcgggggagggctcctcctcctcggccgccgcggctgccgcagccgcgacgatcggggcccacggtgtcgaccaagttgcagaagcgatgtggcagatgaacttaggagaagctgtggaactggggccttacccagagcgtgttggtgagccagattgtagttattacatgaggactggcatgtgtaggtttgggatgacctgtaaatttaaccatccagcagataggaagctggctgttgctgctgcaagaatgaagggagaatatcctcaaagaaatggccagcctgaatgtcaatactatctgaagaccggcacatgcaagtttggagcaacttgcaagtttcaccacccccgagaaaaggctgcaatggcaactcgagtgcagttgaatgaattgggctacccattccgcccgagtgaaaaggaatgtgcctattatttaagaacagggcagtgcaagtttggaagcacatgtaaatttcaccatccacaaccatctaccatgatggttgcagtacgtggttctggttattcacctggacagtctgcaacttctcctggccagcatgcgtaccaaggggctgtaacaagctggcccttgtcaagatctgcatctttcattgcaagtccaaggtggccaggtcattcaagctatgcgcaagtgcttgttcctccaggtcttgttcaggtcccagggtggaatccttacactgcgcagattggttcatcatcctcagaggaccaacaacggacacctggagctgcccaatactatactggctcacgccaaagtggaacacctggcattggagatcaaggaatgttttcatcataccaagctggttcagttcctgttggactttatgcagtacagagggaaaatgtgtttccagagagacctgaccaacctgaatgtcagttctatatgaaaactggagactgtaaatttggtgctgtatgcaagttccatcatcccagggagcgaataattcctgctcccaattgtgcactgagttcattgggccttcccctgcgtccgggagaacccatttgcagtttctattctcgctatggcatgtgcaagttcggtccaaattgcaaattcgatcatccaataggaacagtcatgtatggccatgtttcatcaccaactagtgaggtcccaacttctcgacgaatgctggcacatgtaccatctcatccagaagtatcgcctgacaatggctcgggaaggtcacggaggattacccattcagattcccagcaaataccctcaggtgaaaggagcactgagagagaggcgtcctaagccatcctcggttccatgttcatgctgcctcccattcttgactggagtaattatctgcaacaacatttgaggagctgtacaggtcttttgcgcttttacctcaccttcgagctttacataccggagcttgcttcaacatgtattgcattcaggctggaaaaagttcctagcctgttcgggatgcccatttgcccaatggaaacaggaacaaaccttaccttatttaaaacatatgtatggaaccaactcacctttggacattcgaaccgactcgagtgatgtgtgccgtgacggtgttgttgtagctatagaggtgcattgaaatggacaagcttttgcgaaacttgactggggatgcgcaagcataacctctttggtttat

SEQ ID NO: 4381 - DNA, 2139 bp, Brachypodium distachyon
tagatactggttgggtgaggagaggtgagcgagcggggcaggcagcacggtgaaaaagggcgggcgggggcagtgggaggaacaaaacgactggctgtctgaccggggatgcctcgttcctctcgttccccttcctgctactctgtatctctcgcgcgcccgtggctccttcacgagcacgcgcgagcgaaccagcggccgatcgccgacagggggcggggcgatctgatgccggtgaggcgctgatggcggcgctgtccgccggtggtccgggcggcgtcgtggctggggagggttccacctcctctgccgccgctgctgccgcgacgatcgggtcccacagggtcgacggagaggcaatgtggcatatgagtttaggcgaatccatggaagctggtctgtatccagagcgtgttggagagccggattgtagttactacatgaggactggactgtgcaggtttggaatgacctgtaaatttaatcacccagcagatcgaaagatggctgttgctgctgcaagaatgaagggagaatatcctcaaagaattggtcaaccagaatgtcaatactatctaaaaactgggatgtgcaaatttggagcaacgtgcaagtttcaccatccccgagaaaaggctgcaatggcaacccgagtacagctgaatgttttaggctacccattacggccgaatgagaaggaatgttcttattacttaagaacagggcagtgcaaatttggaagcacatgcaagttcaatcacccacaaccatctaatacgatggttgcactacgtggctctgttttttcgcctggacagtccgcaacttctcctagtcagcatacttattctgggagtgtaacgaactggcccttgtcaagatctgcttcatttattgcaagtcctaggtggccaggccattcaagctatgcacaagtgattgttccaccaggccttgttcaagttccagggtggagtccttatgctgcacaacttggttcgtcgtcatcagatgaccaaggacggtcttctggtgctgcccagtactatactggctcacgtcagagtgaaacacaaggcatgagtgatcatggaatgatatcatcatatcaacatggttctgttcctgctggactctatgcagtacagagggagtacatatttccagatagacctgatcaacctgaatgtcagttctatatgaagacaggagactgcaagtttggtgctgtatgcaagtttcatcatcccaaggagcgaataattccttctccaagctgtgcgctgagtccgctaggtctgccactacgctcgggagagccaatatgcactttctattcccgttatggcatctgcaagtttgggcctaattgcaaatttgatcacccaatgggaaccgttatgtatggcctcgcaacgtcaccaacaggtgaggtcccaactggtcggcatatgttagcacctgtaccagcactttcagaagtaccaccaggcaatagctccggaaggtctcgaaggatgacccatgcagatacccagcaaacaccgtctactgaaagaagcaccgagagagaggcatcctaagccgtcctcagtgttatattcatgtggcttcccattctggactctcgacaaaatttcaggagctggtgctgtacatgtcttgcccaattgcctcgcctttgagctttacaagccggagcttgcttctacttggcattcaggcaggaaaaggtttttcttgttcaggatgctcatttggcctgtgtcaatgggacaaccttatttaaacatatggtcttacatgaacaaactcacctatgaacattcgattccctccgagtgatgtggcttgatccctgttgtaattaccggtgttttgcaatggacaaagcttttgccaaactggctaggggtgtgccatatcttatccttttctgtcgtttctccttttacaatttgtgtcgaaaatgccgacattataggctgcaatcataaggtactgtcaaatctggaaaatttagaactttagtttgctgccataagagcgcaattcaaccttcgtggtgctggcttagttggtgttctacttctacctggcaaattttatttccgcttctgctattgaatcatcattggt

SEQ ID NO: 4382 - DNA, 1921 bp, Brachypodium distachyon
tccccttcctgctactctgtatctctcgcgcgcccgtggctccttcacgagcacgcgcgagcgaaccagcggccgatcgccgacagggggcggggcgatctgatgccggtgaggcgctgatggcggcgctgtccgccggtggtccgggcggcgtcgtggctggggagggttccacctcctctgccgccgctgctgccgcgacgatcgggtcccacagggtcgacggagaggcaatgtggcatatgagtttaggcgaatccatggaagctggtctgtatccagagcgtgttggagagccggattgtagttactacatgaggactggactgtgcaggtttggaatgacctgtaaatttaatcacccagcagatcgaaagatggctgttgctgctgcaagaatgaagggagaatatcctcaaagaattggtcaaccagaatgtcaatactatctaaaaactgggatgtgcaaatttggagcaacgtgcaagtttcaccatccccgagaaaaggctgcaatggcaacccgagtacagctgaatgttttaggctacccattacggccgaatgagaaggaatgttcttattacttaagaacagggcagtgcaaatttggaagcacatgcaagttcaatcacccacaaccatctaatacgatggttgcactacgtggctctgttttttcgcctggacagtccgcaacttctcctagtcagcatacttattctgggagtgtaacgaactggcccttgtcaagatctgcttcatttattgcaagtcctaggtggccaggccattcaagctatgcacaagtgattgttccaccaggccttgttcaagttccagggtggagtccttatgctgcacaacttggttcgtcgtcatcagatgaccaaggacggtcttctggtgctgcccagtactatactggctcacgtcagagtgaaacacaaggcatgagtgatcatggaatgatatcatcatatcaacatggttctgttcctgctggactctatgcagtacagagggagtacatatttccagatagacctgatcaacctgaatgtcagttctatatgaagacaggagactgcaagtttggtgctgtatgcaagtttcatcatcccaaggagcgaataattccttctccaagctgtgcgctgagtccgctaggtctgccactacgctcgggagagccaatatgcactttctattcccgttatggcatctgcaagtttgggcctaattgcaaatttgatcacccaatgggaaccgttatgtatggcctcgcaacgtcaccaacaggtgaggtcccaactggtcggcatatgttagcacctgtaccagcactttcagaagtaccaccaggcaatagctccggaaggtctcgaaggatgacccatgcagatacccagcaaacaccgtctactgaaagaagcaccgagagagaggcatcctaagccgtcctcagtgttatattcatgtggcttcccattctggactctcgacaaaatttcaggagctggtgctgtacatgtcttgcccaattgcctcgcctttgagctttacaagccggagcttgcttctacttggcattcaggcaggaaaaggtttttcttgttcaggatgctcatttggcctgtgtcaatgggacaaccttatttaaacatatggtcttacatgaacaaactcacctatgaacattcgattccctccgagtgatgtggcttgatccctgttgtaattaccggtgttttgcaatggacaaagcttttgccaaactggctaggggtgtgccatatcttatccttttctgtcgtttctccttttacaatttgtgtcgaaaatgccgacattataggctgcaatcataaggtactgtcaaatctggaaaatttagaactttagtttgctgccataagag

SEQ ID NO: 4383 - DNA, 1463 bp, Saccharum officinarum
cttcatccaggcgccgctcaccgcgctgctcgagtactccggcatcctccgtcccgatcccggtggcggaacccaacagccggggaccggggctgggccgggcgaggtgtcgatccggattgtggcgcctggcgaggcggggacgtcctctgagagggccgaggaggcgatcgtagaggaggaggaagaggatggacacgcaacgaggacgcgaccggaggaaccgacacctgctgctggcggcggggagggcggcagggaatcctcgtcgtcgtaccagcggtacgacatacagcaggtggcaaggtgggtggagcagatactgcccttctcactgctgctgctcgtcgtcttcatcagacaacatctgcaaggtttcttcgtgacaatttggattgctgcagtgatgttcaagtccaatgatatcctgcgtaagcagactgctctgaagagggagagaaaaattccggttcttgtcgggattacaatattatttgttgttcatgtatctggattttattggtgttacaagaatggggaccttataagacctctcatgatgcttcctccaaaagaaataccaccattttggcatgcaatattcatcatcttggtgaatgatacaatggtgcgccaaactgctatggttgttaaatgtttgctgctgatgtactataagaacagtagaggccgtagctatcgtaggcagggtcaaatgttgacgattgtggaatattttctacttttgtaccgtgcattattgcctacacctgtgtggtaccgttttttcctgaacaaggagtatggaagcctattttcatctctaaccactggcttgtatctcactttcaagttgacatcagttgtggaaaaggttcaatcatttttgacggcattgagagcattatctcataaagacttccattatggttcatatgcaacaagtgagcaggtggttgctgctggagatttgtgtgcgatatgccaagaaaagatgcatgttcccatccttttgcgctgcaaacacatcttttgtgaagattgtgtatccgaatggtttgagagggagcgaacatgcccgctgtgcagggccttggtgaagccagcagacctccggtcgttcggtgacggttcaacaagcctcttcttccagctattctaatctaagagagccaaaagagcggcaagttggagcgctccactctatgcagatgttaggggtgtgtgtgtgcgtgtgttgctgctggcagcgcctgcgagcagtgcggccctgatgcggtgctgggagagtgtacaccaagctgaagctgaaggcgtacatgattgtgtattgtgactgcatatttccatcccctgtataggctctcgcgggatgcttgagcacctgaggatttacctgaccatatacggtagaaatcactacattaatagaaatggtgagtatatacaacggatttgaatgc

SEQ ID NO: 4384 - DNA, 1970 bp, Zea mays
cccggaagagagagagagaggatcatcaaaagggcaggccacaaaatatcctcaaagcctcccagaaaaattcctcccaccgcgcccgcgacagcgacgacgacggcgacgagcacggggcccctccaccgcctccgcctccgcctcgccgcgtgcggccaccgcgccgccccgacgtcgtcccctccgccctccccctcggccctcgacgcgccgccgcccgccctccgccgccgccgccgccgcggcgggctcggcctcctctggaagctcccctccgcccgcgcgccgccccgcccggctccgatggacgcgcgcgcgcccccgcctccgcagccccatccgccgcgcgccccgtcgccgcagcccccgcccgcgccgtccaggaggtacggcctgcacttctcggcgtccagcttcatccaggcgccgctcaccgcgctgctcgagtactccggcatcctccggcccgatcccggtggtggaatccaacagccagggaccggggccaggccgggcgaggtgtcgatccggattgtggcgcccggcgaggcgggcacgtcgtctgagagggccgaggaggtgatcgtcgaggaagaggaagaggatggacaggcaacgaggacgcgccccgaggacccatcacctgccgctggcggcggggagggcggcagggaatcctcgtcgtcgtaccagcggtacgacatacagcaggtggccaggtgggtggagcagatactgcccttctcactgttgctgctcgtcgtcttcatccgacaacatttgcaaggtttctttgtgacaatttggattgctgcggtgatgttcaagtccaacgatatcctgtgtaagcagactgctctgaagagggagagaaaaattccagttcttgtcgggattacaatattatttgttgttcatgtatctggattttactggtgttacaagaacggggatcttataagacctctcatgatgcttcctccaaaagaaataccaccattttggcacgcaatattcatcatcttggtgaacgatacaatggtgcgccaaactgctatggttgtcaaatgtttactgctgatgtactataagaacagcagagggcgtagctatcgtaggcagggtcaaatgttgacgattgtggaatattttctacttttgtatcgtgcattattgcctacacctgtgtggtaccgttttttcctgaacaaggagtatggaagcctattttcgtctctaaccactggcttgtatctcactttcaagttgacatctgttgtggaaaaggttcagtcttttttgacggcattgagagcattatctcataaagacttccattatggttcatatgcaacaagtgagcaggtagttgctgctggagacttgtgtgcgatatgccaagaaaagatgcatgttcccatccttttgcgctgcaaacatatcttctgtgaagattgtgtatccgaatggttcgagagggagcgaacgtgcccgctgtgcagggcattggtgaagccagcagacctccggtcgttcagcgacggttcaacaagcctcttcttccagctattctagtccgagacagccaaaagagcggcaagccggagcgctccacccgatgatgcagatgttagctgtgtgtgtgcgtgtgttgctgcttgcaacgcctgcgagcagtgcggccctgatgcggtgctgggagagtgtacaccaagctgaagctgaaggcgtacatgattgtgtattgtgactgcacatattttcatcatcccctgtataggctctcgcgttgatgcttgagcacctgaggattttacctgaccatatacggcacaaattattacataaatagaaatggtgagtatatacaacgataaatcaatatggtccttgtttatgctgtgctctgtgttgggatttagaactagtcgataaatccttgtgatccttgcttatgccgtgcgccc

SEQ ID NO: 4385 - DNA, 1439 bp, Pennisetum glaucum
ggccagacggggtgtctatccattccagactcagagcacaacgcgtgctctgagtctggaatggatagaattctggcgggggccgggccagacgaggtgtcgatccggattgtggcgcccggggaggcgggtacgtcgtccgagagggccgaggaggtgatcgtcgaggaggaagaggaggggcacgcaacgagggcgcgcgccgaggagccggcacccgcggcaggggccggggagggcggcagggaatcctcgtcgtcgtaccaacggtacgacatacaacaggtggcgaggtgggtggagcagatactgcccttctccctgctgctgctcgtcgtcttcatcagacaacatctgcaaggtttctttgtgacaatttggattgctgcggtgatgttcaagtccaacgatatcctgcgtaagcagactgctctgaagagggagagaaaaataccagtccttgccgggattacagtattatttgttgttcacgtatctggattttattggtattacaagaatggggaccttataagacctctcgtgatgcttcctcctaaagaaataccaccattttggcatgcaatattcatcatcttggtgaatgatacaatggtgcgtcaaactgctatgattgtcaaatgtttgctgctgatgtactacaagaacagcagaggccgaagctatcgtagacagggtcaaatgttgacaattgtggaatattttctacttttgtaccgtgcattattgcctacacctgtgtggtaccggtttttcttgaacaaggaatatggaagcctattttcgtctctaactactggcttgtatctcactttcaagttgacatctgttgtggaaaaggttcaatcgtttctaacagcattgagagcattatctcataaagacttccactatggttcatatgcaacgagtgagcaggtacttgctgctggagatatgtgcgcgatatgccaagagaagatgcatgtccccattcttttgcgctgcaaacacatcttttgtgaagactgtgtatctgaatggtttgagagggagcggacgtgcccgctgtgcagggctctggtgaagccagcagacctccggtcgttcggtgatggttcaacaagcctcttcttccagctattctaagaggggcaggttggagcgctccactctatgaggatgttagggtgtgtgcgtgtgttgctgcttgccgttgcgctgcgagcagagcggccctgatgcggtgctgaaaagagtgtacaagtgaagtcccctccggcagaagctgaagggcgtacatgagtgtgtgtattttggctgtgcatattgccatccccctgtataggctctcgcgggatgcttgagcaccacctgaccctatagtacgtacaaatttactaccaccaatagaaaatggtgattatatgctgtgctcc

SEQ ID NO: 4386 - DNA, 1868 bp, Panicum virgatum
accaaaagggcagaccacaaaatatcctttaagcctctcccagaaattcctccaacccacgacggcgacgagcacggggaccctccaccgcctccgcctccgcctcgccgcgtgcggcctcggcgccgccccgacgtcgtcccctccgccatccccctccgcccccggcgcggcgccgcccggcctccgccgccgccgccgcggcggaatcctcctctggaagctccacccctcccgcgcgccgtcccgcccgatggacgcgccgccgccgcaggcccagccgccgcgcgccccgtcccctccgcccccgccccaaccgcccgcgccgtcgaggaggtacggcgtgcacttctcggcctccagcttcatccaggcgccgctcaccgcgctgctcgagtactccggcatcctccgccccgatcccggcggcggggcgcaccaggcgggggcaggggctgggccaggcgaggtgtcgatccggattgtggcgcccggcgaggcggggacgtcgtctgagagggccgaggaggtgatcgtcgaggaggaggaagaggagggacacgcaacgagggcgcgtcccgaggaaccggtacccgcggctggcgtcggggagggcggcagggaatcctcgtcgtcgtaccagaggtacgacatacaacaggtggcgaggtgggtggagcagatactgcccttctccctgctgctgctcgtcgtcttcatcagacaacatttgcaaggtttctttgtgacaatttggattgctgcggtgatgttcaaatccaatgatatcctgcgtaagcagactgctcttaagagggagagaaaacttccagtccttgttgggattacagtattatttgttgttcacgtatctgggttttattggtgttacaagaatggggaccttataagacctcttgtgatgcttcctccgaaagaaataccacctttttggcatgcaatattcatcatcttggtgaatgatacaatggtgcgccaaactgctatgattgtgaaatgtttgctgctgatgtactacaagaacagcagaggccgaagctatcgtaggcagggtcaaatgttgacaattgtggaatattttctacttttgtatcgtgcattattgcctacaccggtgtggtaccgttttttcttgaacaaggagtatggaagcctattttcatctctaaccactggcttgtatctcactttcaagttgacatctgttgtggaaaaggttcaatcatttttgacagcattgagagcattatctcataaagacttccactatggttcctatgcaacgagtgagcaggtcattgctgctggagatatgtgcgcgatatgccaagagaagatgcatgtccccattcttttgcgctgcaaacatgtcttttgtgaagactgtgtatctgaatggtttgagagggagcggacgtgcccgctgtgcagggcactggtgaagccagcagacctccggtcgttcggtgacggttcaacaagccttttcttccagctattctaagacaggccgaaagagtggcaaggtttcagtgctctacttcatgcagatgataggggtgtgtgcgtgtgttgctgctcgcagtctctgtgcctgcgagtagagcggccctgatgcggtgctgaaagagtgtccaagtcccttgcagcagaagctgaaggcgtacatgagtgtgtattttggactgtgcatatcgtcatccccctgtataggctctcgcgggatgcttgagcacctgagggtcacctgaccatatacgtacaaattactactataaatagaaatggtgagtatatatatagtacagtttcatgccgggctccttaacctgggaaacaaaattatc

SEQ ID NO: 4387 - DNA, 1905 bp, Setaria italica
atgcaactatgccttgtccggatgggcagaccacaaaaatatcctataagcctcccaaaaattcctcccaccacgaccgcgacgacgacggcgacgagcacggggaccctccaccgcctccgcctccgcctcgccgcgtgcggcctccgcgcctccgcaccgacgtcgtcccctccgccgtccccctcctccgcccccgacgcggcgccgccagccctccgccaccgccgccgccgcggcggaatcctcctctggaagctccacccctcccgcgcgccgtcccgcccgatggacgcgccgccgccgccgcatcagcagcagcaggcgcacccgccgcgcgccccgtccccgccgcccccgccccagccgcccgcgccgtcgaggaggtacggtgtgcacttctcggcctccagcttcatacaggcgccgctcaccgcgctgctcgagtactccggtatcctccgccccgatcccggcggcggggcgcagcaggcgggggcgggggccgggccaggcgaggtgtcgatccggattgtggcgcccggagaggcggggacgtcgtctgagagggccgaggaggtgatcgtcgaggaggaggaagaggaggggcacgcaacgagggcgcgcgccgaggagccggcacccgcggctggggccggggagggcggcagggaatcctcgtcgtcgtaccagaggtacgacatacaacaggtggcgaggtgggtggagcagatactgcccttctccctgctgctgctcgtcgtcttcatcagacaacatttgcaaggtttctttgtgacaatttggattgctgcggtgatgttcaagtccaatgacatcttgcgtaagcagactgctctgaagagggagagaaaaattccagtccttgtcgggattacagtattatttgttgttcacgtatctggattttattggtgttacaagaatggggaccttataagacctctcctgatgcttcctcctaaagaaataccaccattttggcatgcgatattcatcatcttggtgaatgatacaatggtgcgccaaactgctatgattgtcaaatgtttgctgctgatgtactacaagaacagcagaggccgaagctatcgtaggcagggtcaaatgttgacaattgtggaatattttctacttttgtaccgtgcattattgcctacacctgtgtggtaccgttttttcttgaacaaggagtatggaagcctattttcgtctctaaccactggcttgtatctcactttcaagttgacatcagttgtggaaaaggttcaatcgtttttgacagcattgagagcattatctcataaagacttccactatggttcatatgcaacgagtgagcaggtacttgttgctggagatatgtgcgtgatatgccaagagaagatgcatgtccccattcttttgcgctgcaaacacatcttttgtgaagactgtgtatctgaatggtttgagagggagcggacgtgcccgctgtgcagggcactggtgaagccagcagacctccgatcgttcggcgacggttcaacaagcctcttcttccagctattctaaagagcggcaagttggagcgctccactctatgaagatgttagggtgtgtgcgtgtgttgctgctcgcagcgcgctgatgcggtgctcgctgcgagcagagcggccctgatgcggtgctgaaagagtgtacaagtcaaagtcccttccagcagaagctgaaggcgtacatgagtgtgtgtattttgaccgtgcatattgccacccccctgtataggctctcgcgggatgcttgagcacctgatgactacctctacctgaccgtatacgtacaagtttactagtactatataaatagaaatgttgagtttatacaaacgttacgctgtgctcc

SEQ ID NO: 4388 - DNA, 1847 bp, Zea mays
atcaaaaggacaggccacaaaatatcctcaaactctatgcctcccagaaaaattcctcccaccgcgacggcgacgagcacggggaccctccaccgcctccgcctccgcctctccgcgtgcggcctccgcaccgccccgacgtcgacccctccgccctccccctcggccaccgacgcggcgccgcccgccctccgccgccgccgccgccgcggcgggctcggtctcctctggaagctcccctacggccgcgcgccgtcccgcccgatggacgcgctgccgcctctgcagcgcgccacgtcgccgccgccccagccccggccccagccgcccgtgccgtccaggaggtacggcgtgcacttctcggcgtccagcttcatccaggcgccgctcaccacgctgctcgagtactccggcatcctccgccccgatccaggcggcggaacccagcaggatggggccggggctgggccgggcgaggtgtcgatccggattgtggcgcccggcgaggcggggacgtcgtctgagaggcccgaggaggtgatcgtggaggaggaggaagaggatggacacgcaacgagaacgcgcccggaggacccgtcacctgcggctggtggcggggagggcggcagggaatcctcctcatcgtaccagcggtacgacatacagcaggtggccaggtgggtggagcagatactgccattctcactgctgctgctcgtcgtcttcatccgacaacatttgcaaggtttctttgtgacaatttggattgctgcggtgatgttcaagtccaatgatatcctgcgtaagcagactgctctgaagagggagagaaaaattccagttcttgtcgggattacaatattatttgttgttcacgtatctgggttttattggtgttacaagaacggggaccttataagacctctcatgatgcttcctccaaaagaaataccaccattttggcacgcaatattcatcatcttggtgaatgatacaatggtgcgccaaactgctatggtcgtcaaatgtttgctgctgatgtactacaagaacagcagaggccgtagctatcgtaggcagggtcagatgctgacgattgtggaatattttctacttttgtaccgcgcattattgcctacacctgtgtggtaccgttttttcctgaacaaggagtatggaagcttattttcgtctctaaccactggcttgtatctcactttcaagttgacatcagtcgtggaaaaggttcaatcatttttgacggcattgagagcgttatctcataaagacttccattgtggctcatatgcaacaagcgagcaggtggctgttgctggagatttgtgcgcgatatgccaagagaagatgcacgttcccatccttttgcgctgcaaacatgtcttctgtgaagattgtgtgtccgaatggttcgagagggagcggacttgcccgctgtgcagggcactggtgaagccagcagacctccggtcgttcggtgacggttcaacaagcctcttcttccagctattctaatctgagagagccaaaagagctgggcaagctggggcgctccaccctgtgcagatgttaggtgtgtgtgtgtgtgtgagtgttgctgctggcaacgcgtgcgagcagtgcggccctgatgcggtgctgggagagtgtacaccgagctgaagctgaaggcgtacatggttttgtactgtgattgtgcatattttcatcccatgtataggcactcgcgggatgcttgagcacctgaggatttttacctgaccttatacgcacaaactactacgtaaatagaaatggtgagtatatacaatggttccggatgcgtcgat

SEQ ID NO: 4389 - DNA, 1737 bp, Brachypodium distachyon
cggcgctgcggcgggccccctcctccgcggccaccgccgcaggcgcctctggaagctgcctccgcagccgccgccgtcgtcccggcccagtcccggtaccaccaaccacaccccgatgacggagagcgcgccgccccggccgacgtcgccgcggcccccgctagtcctgcagccgccccagccccccgcggccgtggcgtccaggaggtacggcgtgcatttctccgcctccagcttcatccaggcgccgctgtccgcgctgcttgagtactccggcatcctccgcgtcgagccccaccatgcggggggtgaggggggcgaggtgtcgatccggattgtggggggcggcgaggcgggggagtcgtccgagagaggggaggatggcgtcgtcgaggagcaggaaggggacgccgggccgaccgcgagggcggcgcacccctccgtgcctgcgccggccggcggggaggccgggagggagtcctcgtcttcctaccagcggtacgacatacagcaggtcgcgaggtgtgtggagcagatactgcccttctccctgctgctgctcgtcgtcttcatcagacagcacttgcaaggcttctttgtgacgatctggattgctgcggtgatgttcaagtccaatgatatcctgcgcaagcagactgccttgaagggggagagaaaaatgctagttcttgttgggattacattattatttgtcgttcatgtatttggagtttattggttttacaagaatggtgatcttataagacctctggtgatgcttcctccaaaagaaataccaccattttggcatgcaatattcatcatcttggtgaatgatacattggtgcgccaaactgctatgatcgtcaagtgcatactgctaatgtactacaagaacaccagaggccgtagttaccgtaggcagggtcaaatgctaacaatcgtggaatattttctacttctataccgtgcattattgcctgctcctgtatggtaccgttttttcctgaacaaggagtatgggagcctgttttcttctctaaccactggactgtatcttactttcaagttgacatctgttgtggaaaaggttcaatcatttttgacagcactgagagcattgtctcataaagactttcattatggttcttacgcaacaactgagcagattgctgctgctggagatatgtgcgctatatgccaagagaagatgcatgcccccattcttttgcgctgcaaacatgttttctgcgaagattgtgtctctgaatggtttgagagggagcggacgtgcccactctgccgggcattggtgaaaccagcagacctccgttcatttggtgacggttcaacaagcctcttcttccagcttttctagatgaccgaagagcaagcgcgggagctgaattgctttgcgctgtgcggataataggtgtgcgtgcgtgtgtttgttcgcgttttgcgagcagagcagcccggtgaggtgctgaatgggatctccacgtccttcccagccgaaggagtacatacatgagtatggtttgtttctggagtgtgcatattattccctgtataggctataagagagctataagagattttacctgaccctatatatgatctacataaatagaaatgagtataatgagtatataccggaaaaccgttggcctgtgaaagtggtgaactggtgatctctttgcatcctgcttgagttgaggatgagttcatgagtcc

SEQ ID NO: 4390 - DNA, 1864 bp, Brachypodium distachyon
atggccacactaggactcgcgtcctgctgcacgccaggggctgtgccccctctccgttgtgtgtctgctgtggcagctcccgggaggatctccaccatctgctgttcacctgtccccggctgcgtggtctctatgctgcccttcggcgtgggcgtgaaccgtctgggcagtgcccctacgtttgcgtcgttctgcaccgctctccggacctccctgcgacgcttcccgacgccggtagctaactccttggtgctgctgatcctctgggtcatttggaagcgacggaacagaagttcacaaccattgtcgaccgtgttgcttacgaacttacgtgctttggttcgtctagctcgtggatggctcgtaattaacttcctgcagccgccccagccccccgcggccgtggcgtccaggaggtacggcgtgcatttctccgcctccagcttcatccaggcgccgctgtccgcgctgcttgagtactccggcatcctccgcgtcgagccccaccatgcggggggtgaggggggcgaggtgtcgatccggattgtggggggcggcgaggcgggggagtcgtccgagagaggggaggatggcgtcgtcgaggagcaggaaggggacgccgggccgaccgcgagggcggcgcacccctccgtgcctgcgccggccggcggggaggccgggagggagtcctcgtcttcctaccagcggtacgacatacagcaggtcgcgaggtgtgtggagcagatactgcccttctccctgctgctgctcgtcgtcttcatcagacagcacttgcaaggcttctttgtgacgatctggattgctgcggtgatgttcaagtccaatgatatcctgcgcaagcagactgccttgaagggggagagaaaaatgctagttcttgttgggattacattattatttgtcgttcatgtatttggagtttattggttttacaagaatggtgatcttataagacctctggtgatgcttcctccaaaagaaataccaccattttggcatgcaatattcatcatcttggtgaatgatacattggtgcgccaaactgctatgatcgtcaagtgcatactgctaatgtactacaagaacaccagaggccgtagttaccgtaggcagggtcaaatgctaacaatcgtggaatattttctacttctataccgtgcattattgcctgctcctgtatggtaccgttttttcctgaacaaggagtatgggagcctgttttcttctctaaccactggactgtatcttactttcaagttgacatctgttgtggaaaaggttcaatcatttttgacagcactgagagcattgtctcataaagactttcattatggttcttacgcaacaactgagcagattgctgctgctggagatatgtgcgctatatgccaagagaagatgcatgcccccattcttttgcgctgcaaacatgttttctgcgaagattgtgtctctgaatggtttgagagggagcggacgtgcccactctgccgggcattggtgaaaccagcagacctccgttcatttggtgacggttcaacaagcctcttcttccagcttttctagatgaccgaagagcaagcgcgggagctgaattgctttgcgctgtgcggataataggtgtgcgtgcgtgtgtttgttcgcgttttgcgagcagagcagcccggtgaggtgctgaatgggatctccacgtccttcccagccgaaggagtacatacatgagtatggtttgtttctggagtgtgcatattattccctgtataggctataagagagctataagagattttacctgaccctatatatgatctacataaatagaaatgagtataatgagtatata

SEQ ID NO: 4391 - DNA, 892 bp, Panicum virgatum
ccaaactgctatgattgtcaaatgtttgctgctgatgtactacaagaacagcagaggccgaagctatcgtaggcagggtcaaatgctgacaattgtggaatattttctacttttgtatcgtgcattattgcctacgccggtgtggtaccgttttttcttgaacaaggagtatggaagcctattttcatctctaaccactggcttgtatctcactttcaagttgacatctgttgtggaaaaggttcaatcatttttgacagcattgagagcattatctcataaagacttccactatggttcatatccaacgagtgagcaggtatttgctgctggagatacgtgcgcgatatgccaagagaagatgcatgtccccattcttttgcgctgcaaacatatcttttgtgaagactgtgtgtctgaatggtttgagagggagcggacgtgcccgctgtgcagggcactggtgaagccagcagacctccggtcgttcggtgacggttcaacaagcctcttcttccagctattctaagacgggccgaaagagttgcaaagtttcagtgctctactccatgcagacgataggggtgtgtgcgtgtgttgctgctcgcagtcgctgcgcctgcgagcagagcggccctgatgcggtgctgaaagagtgtcctagtcccttccagcaggagctgaaggcgtacatgagtgtgtattttggactgtgcatatcgccatccccctgtataggctcttgcgggatgcttgagcacttgagggtcacctgaccatatacgtacaaattactactataaatagaaatggtgagtatatatatagtacaatttcatgctgtgctccttaacctgggaaacaaaattatctaatgctctattgccagttt

SEQ ID NO: 4392 - DNA, 1150 bp, Avena sativa
ttcatcagacagcacctcgcaaggtttctttcgtcacgatctggattgccgcggtgatgttcaagtccaatgacatcctgcgcaagcagactgccctgaaggggagagaaaaatgttagttcttgttgggattacaatattatttgtcgttcacgtatttggggtttactggtgttacaagaatggtgaccttataagacctctggtgatgcttcctccaaaagagataccaccattttggcacgcgatattcatcatcttggtgaatgatacgatgacacgccaaactgctatggtcgtcaagtgcatactgctaatgtactacaagaacaccagagggcgtagctatcgtaggcagggtcaaatgttaacagttgttgaatatctcctgctcctgtaccgtgcattattgcctactcctgtgtggtaccggtttttcttgaacaaggagtacgggagcctattttcttctctaaccactggactatatcttactttcaagttgacatctgttgtggaaaaggttcaatcatttttgacagcactgagagcattatctcataaagaatttcactatggttcatatgcaacgactgagcaggttgctgcagctggagacatgtgtgctatatgccaagagaagatgcatgccccgattcttttgcgctgtaaacatgtcttctgtgaagattgtgtttctgaatggttcgagagggagcggacgtgcccgctgtgcagggcattggtgaaaccagcagacctccggtcatttggtgacggttcgacaagcctctttttccagcttttctagactattctgtgaagataagaagacagatagtaggtgtggtgcgtgcgtgtgtgtttgcgtttctacgagcagagcggcccggtcaggtgctgaaaacggatctccacgtcattcccagctgaaggagtacatgagtgttgtttccgagtgtgcatattagcatcccttgtataggctataagagagattttacatgaccctatatatgatttacataaatagaaatgagtattatatacaatgtacgtggattctgagcttgtggtgacagctacgacagaatgaactgtctggctcctgcttgagtcgatgatgagttcatttggattctatgctccg

SEQ ID NO: 4393 - DNA, 1802 bp, Hordeum vulgare
gcgccgacgacgacgacgccgccggcgtcgccgcggacgcagccacagccgcaggcacccgcggccgtgccgtcgaggcgctacggcgtgcatttctcggcctccagcttcatccaggcgccgctgtccgcgctgctcgagtactcgggcatcctccgcgccgagcccggcccgcaccgcccgcccgccggggcaggcgaggtgtccatccggatcgtcggcccggcgccgaccgacggggacgtgcaggaggagggggacgacgccgcgggatcctccgcgccccccgcgccggccgacccctcctcctcatcatcatcataccagaggtacgacgtacagcaggtggccaggtgggtggagcagatactcccattctccctcctgctgctcgtcgtcttcatcagacagcacctgcaaggtttctttgtgaccatctggattgcggccgtcatgttcaagtccaatgacatcttgcgcaagcagactgctctcaagggggagagaaaaatgttaattcttgttgggattacaatattatttatcgttcatgtatctggagtgtactggtgttacaagaatggtgatctcatcagacctctggtcatgcttcctccaaaggagataccaccattttggcatgcaatattcgtaatcctggtgaatgatacaatggtgcgccaaactgctatgatcgtgaagtgcatactgctaatgtactacaggaacaccaagggccgtagctatcgtaggcaggggcaaatgttaacactagtggaatactttctacttctgtaccgtgccttattgcctgctcctgtatggtaccgttttttcctgaacaaggagtatgggagcctattttcctctctaaccactggactgtatcttactttcaagctgacgtctgttgtggaaaagattcaatcatttttgacatcactgagagcattgtcccataaagacttccattatggctcatatgcaacgagtgaacaggttgctgccgctggagatatgtgtgctatatgccaagagaagatgcacgtccccattcttttgcgctgtaaacatgtcttctgcgaagattgtgtctctgaatggtttgagagggagcgcacctgcccgctgtgcagggcactggtgaagccagcagacctccggtcattcggcgacggttcgacaagcctctttttccagcttttctaggccgcaaacagcaagcgaggaacttggcttgcgcttgcttttacgctgtgcagataagaaagcaggtgttataggtgtgagtgcgtgcgttgtgtttgttcgtgtttcgcgagcagagcggcccggtgaggtgctgaaatgggtgcatttgttgccgagtgtgcatattatccggtgtataggctgtaagagattttacctgaccctactacatttacataaatagaaatgagtacatatatacaggtacctggattcggagctttgcacaggcgttacggcagattggtgaagtctctgaaccctggttgagttgaggatgatgagttcatttggatagctccagaaggtaaggcgtactgggagtcttggaacagctatctctgggcgtgccttgttttttctcgcagtgtaaatatggcagtatctgagcctctcagaaataaactctagtccctgcctagtgtatgtggtatgtgaatccctaacagatcgaccaacatgaacaccagtgacatattcctaggcttgttgtttcagttttcagcaaaatgtgcagatattttccccattatgtgaagttactttgaagc

SEQ ID NO: 4394 - DNA, 1243 bp, Aristolochia fimbriata
aggaaaatttctgttttggttggaatcacattactttttatgctacatgttgtgggagtatactggtggtacagaaatgatgatcttttataccctctggtcatgctgcctccaaaagaaataccaccattctggcatgcaatattcataatcatggtcaatgatactatggtgcggcaagcagcaatggtgttgaagtgtattttactgatgtattacaaaaacagtagaggacgtaactatcgtaagcagggtcaaatgctgacactggtggagtatctccttcttctataccgtgcattgttgcctacccctgtttggtatcggttcttcttgaacaaggaatatggaagcctattttcatctcttacaactggactatacctaactttcaagctgacttcagttgtggaaaaggtccaatcgttcttcactgcgctgaaagcattgtcccgtaaagaagtacactatgggtcatatgcaacaactgaacaggttgttgcagctggtgatctttgtgctatttgccaggaaaagatgcatgctcctatcctacttagatgcaaacatatcttctgtgaagattgtgtatctgaatggtttgagagagaaagaacatgcccattgtgccgggcgttggtaaagcctgcagacctgagatcatttggtgatgggtcgaccagtcttttcttccagttattctgaaaaaaccacctcctcgtgggaaaaacagtagatgctacaaattgtgctcgaaagaggaaagctgcatgatatagaaagtctttcctctaactctgatctcccattctgaatcacggacgcaagactgttttgagggtgcaagctccacaacttgccgactcctatctacagatgtgttctgaacttcaacgaagaatcggaggaaagggatttggctgctgtgttcatattgctgtaatcaaacgagtaacagcaccttggaagtggcaaatatgggaatattttttgtccttgttatactacaaattggtgggtgtcagttgatcatatggtcttctacggtatatatagaatacatgttacatagttgatgaaacagaagtgggttgttcggccgtggtggccttgttcttgccttcaccgctgctactgctctgtaagaacttaaaaattaagccaagttcagaggaaacccaatgtttcttgtaatcaaaagccacactgactgcaataaaaatatgcttctaaggtgcaattg

SEQ ID NO: 4395 - DNA, 1829 bp, Triticum aestivum
gagggactcctcgcgccgcgaccgcgacaaccgaccaacccgacgccaccacggcgacggcgagccccctccgccgcctccgcctccgcctcgccgcctgcctccgcgcctcccctcctccgcccccgccctgcgacgccgccgccgacccgcccgcgctcctccgccaccgccgcaggcgcctctggaagccgccgccccggcccgacgccccgatgatggacgcgccgccgccacggacgacgactacggcgactcccccgccgttgccgcggccgcccccgctccagccccaggcctccgcggccgtgccgtccaggcgctacggcgtgcatttctccgcctccagcttcatccaggcgccgctctccgcgctgctcgagtactcgggcgtcctccgcgccgaccccggcccgcaccacccgcccgccgggggaggcgaggtgtcgatccggatcgtggggccgccggcggccgacggggccgtgcaggaggagggggacgccgcgggaggggcgcaaccctccgcgcccgcgccggcggccggcgcggccggcgtcgactcctcctcctcctaccagaggtacgacatacagcaggtggcccggtgggtggagcagatactgcccttcaccctgctgctgctcgtcgtcttcatcagacagcacctgcaaggtttctttgtcaccatctggattgctgccgtgatgttcaagtccaatgacatcctgcgcaagcagactgctctcaagggggaaagaaaaatgttaattcttgttgggattacaatattgtttatcgttcatgtatctggagtgtactggtgttacaagaatggtgatcttatcagacctctggtcatgcttcctccaaaagagataccaccattttggcatgcaatattcgtaatcctggtgaatgatacaatggtgcgccaaactgctatgatcgtgaagtgcatactgctaatgtactacaggaacaccaaaggccgtagctatcgtaggcagggtcaaatgttaacactcgtggaatactttctacttctgtaccgtgccttattgcctgctcctgtatggtaccgttttttcctgaacaaggagtatgggagcctattttcttctctaaccaccggactgtatcttactttcaagttgacatctgttgtggaaaagatccaatcattttttacatcactgagagcattgtcccataaagacttccattatggctcatatgcaacgagtgagcaggttgctgctgctggtgatatgtgtgctatatgccaagagaagatgcatgtccccattcttttgcgctgtaaacatgtcttctgtgaagattgtgtctctgaatggtttgagagggagcgcacctgcccactgtgcagggcactggtgaagccagcagacctccggtcattcggcgacggttcgacaagcctctttttccagcttttctaggccgcaaacagcaagcagggaacctcgcttgctttgcgctgtgcagataagaaagcagatgttataggtgtgagtgagtgtgttgtgtttgtccgtgtttcgcgagcagagcggcccgatgaggtgctgaacgatcccaacgcccccttcccagctgaaggtggagggtgcatgagtgcgtttgttcccatgtgtgcatattatcccctgtataggctataagaagaaatctgaccctactacgatttacataaatagaaatgagtatatatagactattgttatatacagactcttgagattgtgacgggttgacagttacggcagattggtgaactctctgaaccctggctgagtgaagagttg

SEQ ID NO: 4396 - DNA, 1739 bp, Triticum aestivum
ccgcgaccgcgacaaccgaccaacccgacgccaccacggcgacggcgagccccctccgccgcctccgcctccgcctcgccgcctgcctccgcgcctcccctcctccgcccccgccctgcgacgccgccgccgacccgcccgcgctcctccgccaccgccgcaggcgcctctggaagccgccgccccggcccgacgccccgatgatggacgcgccgccgccacggacgacgactacggcgactcccccgccgttgccgcggccgcccccgctccagccccaggcctccgcggccgtgccgtccaggcgctacggcgtgcatttctccgcctccagcttcatccaggcgccgctctccgcgctgctcgagtactcgggcgtcctccgcgccgaccccggcccgcaccacccgcccgccgggggaggcgaggtgtcgatccggatcgtggggccgccggcggccgacggggccgtgcaggaggagggggacgccgcgggaggggcgcaaccctccgcgcccgcgccggcggccgcggccggcgccgacacctcctcctcctaccagaggtacgacatacagcaggtggccaggtgggtggagcagatactgcccttcaccctgctgctgctcgtcgtcttcatcagacagcacctgcaaggtttctttgtcaccatctggattgctgccgtgatgttcaagtccaatgacatcctgcgcaagcagactgctctcaagggggagagaaaaatgttaattcttgttgggattacaatattatttgtcgttcatgtatctggagtgtactggtgttacaagaatggtgatcttatcagacctctggtcatgcttcctccaaaagagataccaccattttggcatgcaatattcgtaatcctggtgaatgatacaatggtgcgccaaactgctatgatcgtgaagtgcatactgctaatgtactacaggaacaccaagggccgtagctatcgtaggcagggtcaaatgttaacactcgtggaatactttctacttctgtaccgtgccttattgcctgctcctgtatggtaccgttttttcctgaacaaggagtatgggagcctattttcctctctaaccactggactgtatcttactttcaagttgacatctgttgtggaaaagattcaatcattttttacatcactgagagcattgtcccataaagacttccattatggctcatatgcaacgagtgagcaggttgctgctgctggagatatgtgtgctatatgccaagagaagatgcatgtccccattcttttgcgctgtaaacatgtcttctgtgaagattgtgtctctgaatggtttgagagggagcgcacctgcccactgtgcagggcactggtgaagccagcagacctccggtcattcggcgacggttcgacaagcctctttttccagcttttctaggccgcaaacagcaagcagggaacctcgcttgctttgcgctgtgcagataagaaagcagatgttataggtgtgagtgtgtgtgttgtgtttgtccgtgtttcgcgagcagagcggcccgatgaggtgctgaacggatcccaacgcccccttcccagctgaaggtggagggtgcatgagtgcgtttgttcccatgtgtgcatattatcccctgtataggctataagaaatctgaccctactacgatttacataaatagaaatgagtatatatagactattgttatatacagactct

SEQ ID NO: 4397 - DNA, 1763 bp, Secale cereale
ccgcgaccgcgacaaccaacccgacgccaccacggcgagccccctccgccgcctccgcctccgcctcgccgcctgcctccgcgcgcccgttcccccgccccagccctgcgacgccgccgcggacccgcccgcgctcctccgccaccgccgcaggcgcctctggaagctgccgccccgccccggcgccccgatgatggacgcgccgcccccgacgacggcgcccaccacgccccctgcgtcgccgcggccccagccccaggcccccgcggccgtgccgtcgaggcgctacggcgtgcatttctccgcctccagcttcatccaggcgccgctctccgcgctgctcgagtactcgggcatcctccgcgccgagcccggcccgcaccacccgcccgccgggggaggcgaggtgtcgatccggatcgtcgggccggcgccgaccgacgacgtgcaggaggagggggacgccgcgggaggggcgcaaccctccgcgcccgcgccggcggccgcggccggcgccgacccctcctcctcctcctaccagaggtacgacatacagcaggtggcccggtgggtggagcagatactgcccttcaccctgctgctgctcgtcgtcttcatcagacagcacctacaaggtttctttgtcaccatctggattgctgccgtgatgttcaagtccaatgacatcctgcggaagcagactgctctcaagggggagagaaaaatgttaattcttgttgggattacaatattatttgtcgttcatgtatctggagtatactggtgttacaagaatggtgatcttatcagacctttggtcatgcttcctccaaaagagataccaccattttggcatgcaatattcgtaatcctagtgaatgatacaatggtgcgccaaactgctatgatcgtgaagtgcatactgctaatgtactacaggaacaccaagggccgtagctatcgtagacagggtcaaatgttaacagtggtggaatactttctacttctgtaccgcgccttattgcctgcccctgtatggtaccgcttttttctgaacaaggagtacgggagcctattttcctcgctaaccactgggctatatcttactttcaagttgacatctgttgtggaaaagattcaatcattttttacatcactgagagcattgtcccataaagacttccattatggctcatatgcaacgagtgagcaggttgctgttgctggagatatgtgtgctatatgccaagagaagatgcacgtccccattcttttgcgctgtaaacatgtcttctgcgaagattgtgtctctgaatggtttgagagggagcgcacctgcccactgtgcagggcactggtgaagccagcagacctccggtcattcggcgacggttcgacaagcctctttttccagcttttctaggccgcaaacagcaagcggggaacctcgcttgctctgcgctgtgcagataagaaagcagatgttatagttgtgcgtgcgtgcgttgtgtttgtttgtgttttgcgagcagagcggcccggtgaggtgctgaacggatccccacgcctccttcccagctgaaggaggagagtgcgtttgttgctgagtgtgcatattatcccctgtataggctataagaaacctgaccctactacgatttacataaatagaaatgagtatatatatagactatagctacatacaagtgcgtgaactctgagattgtgacaggcttgacagttacggcagattggtggaaatt

SEQ ID NO: 4398 - DNA, 2364 bp, Sesamum indicum
gagagagagagcaaacgcatattcaaccacacacatccgcagcctcaccgtcccccgccctcggacccaacaattacgccgccccctgcctccgtgccttcaatatttgtcaggctattctaatatgccctttctccctttgactttcgtcccccctccttcccctttttctgcttagggttctttctccaaaaatgattcccccgtcttccttttgaatcccaagccatcatccacggattttccatctcgaaggcttaggtttaggttcagggcatcctctcgaatggaagcgtccggtggaaattcggacgcttacagaagttcttcttcgaatacttctactcattcccgaagacacggattgcatatttctgcttctaacattcttcgatcgcctttgtccactttattagaatacaccggaattctcagaaccaggtccaatcattcagaatccgacgctttattgaacaatggatcccaaatcagctatcgagatcaccaccttcagccgcatctcaatgactctccacctccagcccctgcaaataggggtggcactgcaggagaggtctcaatcaggataattggtgccggcgaacatgagcatgacagggttgccactgtgttgcactcagtaccagtagttgggcagcttagtgcacagtctgagtcctttccgcagccaatttcgaggtcagggtctgcagtttctgtattgtcctcgttagagagccaggttgaattgaggagtgatcgagaggcaggagatggaggtgcacacacaacagattcaggtggtgatacagacgctgccgagggagctgctgccaataatagggattcatcctcttcgtatcagcgatatgacatacagcaggctgctcggtggatcgagcaggtccttcctttctcattgcttctgttggttgtatttatacgccaacacttgcaaggtttctgtgttaccatttggattgctgctttcatgtttaagtcgaatgatgttgtacggaagcagacagcactcaagggcgagaggagaatatttgtcctcatcggcattgttattcttttcacacttcatgttgttgggatatactggtggtatcgcaatgatgatctgttatatccattgctgatgctgccaccgagaaccataccgcctttctggcatgcgatattcattatcatggtgaatgacacactggttcgtcaggctgcaatggtcttcaagtgtgtgctattgatgtattataaaaacagcagaggtcgaaattatcgtcggcagggtcaattgctgactttagttgagtatctactgctgctttatcgtgcactgctccctgcccctgtttggtaccgtttctttttgaacaaagaatatgggagccttttctcgtcgctaatgactggactgtacttaacattcaagcttacatccgttgttgagaaggtccaatcattcattactgctttgagagcattgtcgaggaaagacatccattatggagcttatgctacatccgaacaggttgttgcggcaggagatttgtgtgccatttgccaggaaaagatgcacgctccagtccttctacgttgcaaacacatattttgtgaggactgtgtatccgagtggtttgagagagaacgaacttgccccttgtgccgggctttggtgaaacctgctgatcttagatcatttggtgatggatcaaccagcctattttttcagttattttaaatccaggaagttttctgctttgaagccttaatcctccagtcagagcagctctttcctgatcatttcatctgcatagaaaatttaactgtaattatattgtttattgccactgacatctagtctgcagtggctgatagaaatgttgtaatcagaaaatgtatgtgaaggtttccacatgcaggagttaccttcatgttcaatggtatatgcaacaaagttttttcttaatgaatgtactgcctcagtggggtagggttgtttaagctatgggttgcgctggtggatggattcataggatgatcatatgtattcataggtctttggtacctgctacattgtccaaataatattggatgatcgttggaaagtatcacttgatcaaccactcaggtggaaattgttggaagccaacggcactcgaaatatgcattactttacaggcactctcctgttcaacaaactaggaaagaagaaagcaaagcgcctgggaccttgtatgtgtttccacatgcgtgcatgctttttagttgactcagctgaatcacaagaccaaagtccagtgcaacatcttggatctttgctaagttaattgactctaggataactgattctgtgcg

SEQ ID NO: 4399 - DNA, 1830 bp, Mimulus guttatus
tctcgctcgcgctcttcccaaagccaaacgaagaggagagagagagagacaagggaaaaacgcgtattaccctgccgtgagtctcaccgtctgattctcctcccccgcggagccaatattattaccggcttggatatgtcttcctcccccttttccatttagggttctttccccaacaatgaatccgccttcttctttctgaatattaaacgatcatccacggattttcgatctccaaggaattcttcttcttccactaatcattcccgaagacatggaatgcatatttctgcctctaacattcttcgatcgccattgtcaactttattagagtatactggagttctcagaacgaggtcaaaccactcagaatcagacattttactgaatagtggagctaaccttggttatcgagatcaccacttgaatgactctgcaccttccccagttgcaaacagcagtgtcagtgctggagaggtttcaattaggatcattggttctggtgaacacgagaatgatagggttgccaccgtgttgcatccagttccgactgttgagcagctcagtagtcaggttgatttgaggagtgatcgcgaggcaggagagggagttacacatacggtgaatccaggcagtgatacagatgctgctgacggaggtggcgtcactaacagggactcatcatcttcttaccagagatatgatatacagcaggcggctcggtggattgagcaggtccttcctttctctttgcttctgttggttgtgttcatacgtcagcacttgcaagggttctgtgctaccatatggattgctgctttcatgtttaaatcgaatgatatagtacggaagcagacagcacttaagggtgagaggagaatatttcttctcactggcattgccattcttttcacacttcacgtggttgggatttactggtggtatcggaatgatgatctactatatccgttgctcatgctgccaccaagaactataccacctttctggcatgcaatatttattatcatggttaatgatacactggtccgtcaggcagcgatggtctttaagtgcatgctattgatgtattacaaaaacagtaggggtcaaaactatcgtaggcagggtcaaatgctaactttagttgagtacctgcttctgctttatcgtgcactactgcctgccccagtttggtatcgtttctttttgaacaaagaatatgggagccttttctcatcactaatgactggactgtacttaactttcaagcttacatctgttgttgagaaggtccaatcattcattactgctctgagagcattgtctaggaaagacatccattatggatgttatgctacatctgaacaggtcgttgcagcaggagatctttgtgccatttgccaagaaaaaatgcatgcacctgtccttctacggtgcaagcacatattttgtgaggactgtgtgtctgagtggtttgagagagaacggacttgccctctgtgccgggcattggtgaaaccggctgatcttagatcatttggtgatggatcaaccagtctattttttcagttattttaaatccagcaagttttgtgccccccaacattcagagaagctcggtcccgatcatcccaacatttgcatagcaaaatttaactgtaactattgtgtttattgtcactgacatatgtaaactgcagtggctgatagaaatgcaccattctgttcatacattgtaatcgaaaatgcctctcaagggttcctcttacaggagttttaccatagtggccaatggtatatgcaaaacaacttgtcatatataaaagcttc

SEQ ID NO: 4400 - DNA, 1798 bp, Amorphophallus konjac
ccgtatcgtcgtcttcgttgtccgtactttctttcgtccgtttgtatttttcgtacccttcggtgtgtagttccggtgtccgggattttggtcgtagttcggtttgggttcggcccgtcgggggtcggtttgtcttcgtttcgtttgttggtacgtttttgggtggaggggcggggaagtttgttggtcgttgttgacggctatggagacatccggcgggggggcagacccatacaggagcccgtccggcggcggggctgccgacggcggcaacggtggcgcatcgtcgaggaggtatgggttgcagttgtctgcttcgaatctgttgcaggctcccatttcggcgctgttagagtattctggtatcctgcgccctcgagcggggtatccggagaatgagagcttgattggtggaggtgggcttcctgctgggttgcgggatcatgtgccgagccggttggatgatgctgcggtctccagctccggtgatggggaagtttcgataaggattataggggcaggtgatcaggagagtataagggtgggaacgggtccgccgcagcagttggttgtgggtccaggaagggagaggaatgccggagagaatggtgtacagacggagcatgttcccacagtgtccgatcgccacagtggagacatcgggaatgagggtggtgtagcagaggcaccttcgtcgtctatgtcatcaccgatttcttctggaagcgctgcgggtacggaaggtgaggcagggagtggtgttggagggaacaacagggactcgccttaccagagatatgatatacagcaagctgcacggtggattgaacagattcttccgttctcattgcttctgttggtcgtgttcatccgtcagcatttgcaaggcttctttgttacaatctggattgctgcagtgatgtttaagtcaaatgacattctgaggaaacagacagccttaaagggagagagaaaattttctgtccttgttggtatcgcacttgttttcacactgcatgtggttgcagtctattggtggtaccgaaatgatgatgttctttatccactggtcatgcttccaccgaaagcaattccaccattttggcatgccatatttattataatggtgaatgatacaatggtgaggcaggcagcgatggttttcaagtgcatgttgctcatgtattacaagaatggcaggggacgtaattatcgtagacagggacaaatgctaactctggtggaatatctcttacttctgtatcgtgctttactgccgacacctgtctggtatcggttcttcttgaacaaggaatatggcagtctattttcatctctcactacagggctgtatctaaccttcaaactgacatcagtcgttgagaaggttcaatctttcttcactgcattgaaggcattatcacgcacagaagtccattatgggtcttatgcaacaacagaacaggtgattgcagctggtgatctgtgtgctatttgccaagagaagatgcatgctcctattctacttcgctgtaaacatatcttctgtgaagattgtgtatcagaatggttcgaacgggaacgaacatgccctttatgcagggccttggtaaagcctgcggatcttaggtcatttggtgatggctcaaccagcctattcttccagctattctaattcagtacccagtgaactagacaaccaagttcagatatggcactgccacctagaaggatgcatggaaatgatggcgacctgggcatgcccctccttccaggtgaagtgaattatatattatgc

SEQ ID NO: 4401 - DNA, 2435 bp, Chelidonium majus
gagaaagaggaaaaggtcagacattagagacgccttagaaaaaccgaagctttttttccttttgagagagagagagagagagaaatttcagcttgaaaccctagaaatctaacctgaatcataaatttcagcttcaaacaaaagaaaaaagaaaccctagatgtctaaccttattttgatgaagtctttcatcatttctataaatttaacacggatcaatctgttttgattcctgatattctacttttttttatctgtaattgattttagtttattgggaataaaattttgggtttgggtctggaaactggagttttgaatctgattgattgatcgtcagctggagtttcggcttgtgaagaaggtggtggataataggtgatttttgtgtgtgtgtgtgtgggaatcgtgttacttttgttctagggttagtgttttgttatagagaaatggaaacttcaagtagcaatcccgacccgtataggaattcatctggttctgggagtagtaattcaaggagatttgggatgcaattttctgctgcgaatttcatccaagcgcctttatcggctttgttggaatattctgggattctaagaacaaggtctagtcatcaagagacggaaagtttgattaatgggaacccgtcttctggttttcgtgaccgaattcagaatcggttggatgattctggtccagtcagcagtgatggggaggtctcaatacggataataggtgctgcggaacaagagagagaaggtcaaataggcgaaagtgtcgtctctgctgaacagattgctggaccatcagcagttgcagtgttggatcgtcagggaaatgggggtaatgaaagtggaacgagtgaggggaagttcattgtcatcttcagcttcaatagggacttctaattctagtaatgaaagcactgacggggagactggtaatggtgcgggtggtaatagggattcgtcataccagagatacgatattcagcaggttgctaggtggattgagcaggttttgccattctctttgcttctgttggtggtcttcattcggcagcatttacaaggtttctttgtcacaattttaattgccgctgtaatgttcaagtcaaatgatattctacggaagcagacagcgctaaagggagaaagaaaaatctcttttctcgttggcatcactatcctgtttatgcttcatgtggttggtgtttactggtggtatcgaaacgatgatcttctgtacccactggttatgcttcccccaaaagccataccaccattttggcatgctatattcatcatcatggtgaacgatacaatggtgcggcaagcagcaatggtcctcaagtgcatactgctgatgtattacaagaatagcagaggccgtaattatcgtaagcagggtcaaatgctaacccttattgaatacttgctgctgctataccgtgctctgttaccaactcctgtttggtatcgtttctttttgaacaaggaatatggaagcctcttttcatctctaactacaggattgtacctgaccttcaagctgacatcagttgttgagaaggtccaatctttcttcgctgcattgaaggcattgtcacgtaaagaggtccattatggatcttatgctacatccgaacaggttaatgcagcaggtgatttgtgtgctatttgccaggagaagatgcatgctcctatcttacttcgttgtaaacacatcttttgtgaagattgtgtctcagaatggttcgagagagaaaggacttgcccattgtgcagggccttggtcaaaccggcagacctaagatcgtttggtgatgggtcaaccagtctgttcttccagttattctaagggaggctacttttggtaaaatcctgggagccctacttgcttctaagtcgagaaccatttcacaaagtagaacccttaccatgatctttgcgtatcaaggggtacagcggatgtatcttgcatactgttctcacgtaattgtgtaacgcggaaaatatgtaggttggtgcctctggaaactgaaaagggcctggtctggtgtttatatgttatatgagggcttttcaaactacaaacaaatatttatacaagttaatctgcttacaaatgaaagatcatccttggaatacatatccttcaacatttcttgctactcttattgtttgaattcgaacattacaatgtaatattcggttctgaaaagaagctgtaaaggaaaacattgcatttttcagtcatacgaacactttacaccaaaaaagcttgcagaatttcgaaatgaatggcccctgaaagagaagtgcacagtaaatgagtggtatttaggagtcgatgactcggaagttttcttagcttttctttacgtgtttgtgtttaggcttcttgtttctgttaatgctccgatattgatacag

SEQ ID NO: 4402 - DNA, 1439 bp, Avena sativa
ggtacgacgtgcaccacgtcgctcggtggatcgagcagatactgccattctcgctgctcttgctcgtcgtcttcatacgccagcatctccaaggtttctttgtcacaatttggattgctgctgtaatgttcaagtcaaatgatatattgaagaagcaaactgctttgaagggtgagagaaagttgctatgcttgttggaatcactttaatcttcatgatccatgtgttcggcatatattggtggtataggaacgatgatcttcttagacctctgttcatgcttcctccaaaagatataccaccattctggcatgcaatttttatcatcatgatcaatgatacaatggtccgccaggcagcaatgaccgtcaagtgcattctacttatgtactataagaacagcagaggtcgtaactaccgtaggcagggtcaaatgctaacacttgtggagtaccttctgcttctgtatcgtgctttattgccgactcctgtttggtaccggttctttctgaacaaggaatatggaagtctgttctcatctttaaccactggtctttacctgactttcaagttgacttccgtagttgagaaggttcaatcattcttatctgcagtgaaggcattgtcacgtaaagatgtgcattatgggtcttatgccacatcagaacaggcaatcgctgccggtgatatgtgtgccatctgccaggagaagatgcatgttcctgttctacttcgctgtaaacacattttctgtgaggattgtgtctctgaatggtttgagcgagaacggacttgccccttgtgtagagcactggtaaagcctgctgacattcggtcatttggtgatggttctacaagtctgttcttccagttgttttagaactccaaatggaaaaccctaacatagaacgatcaatcacaagcaattggttataagagagttcaagtggaagtcctttgttccttagcttgcagaaccataatgtaacaatgttctcgaaaattatctgactgcgaccattatgttcatccatatgttcaagcgatagttagagatctgtcagttgcaacatcagcataagttcgcatcagaagggaatcctggtctggattgttgaaggaatctactcctgtgaaccatgaacctcctgcatcttgctgtggcttgtgcgatgtaaaattggtaattcttttaaagaagttaaagtgtcttgtataattggagcctgcaagttttgcttgctagcaagaagtatgtttgaggaagtggtaggaatttaacctgtaaagctgtgatacatgaaaatgttgaaaaccatataaattgtaatcatcacagacagtaaatattacaaagactacaatgttgacacaattttatgctttgcccttttttctttgctgctgatataatctgaatctgcaattgcttgtacgag

SEQ ID NO: 4403 - DNA, 2077 bp, Elaeis guineensis
gcaagagcaggagatcgcgattcttctctctctctcttaccttcttaaccccaagaaccactcgttcctggaaataaatttatcccctccgttccaactcctcctcccccgcctcctcttcttcataatctctcactccgacttggcgaaagaaacgattcccctctagggttagggtttccggacgattccttctcccatttttcgatcttgctccgcgtcgagttcttcttgccgatcaattgccgtcgtttgcggaggattttggggggtttcttggtcggatttgtgctccgatgatggaatcatccggcgggagctccgatccctacaggagccagagcggcggtggcagcggaggttcttcgaggcggtatggggttcacttctcggcctccaacttcatccaggcgccgctgtccgcgcttttggagtattctgggattttgcggccgagaccgagtcaccaggagaacgagagcttgatcagtggagcggccggcagtgccttgcgagaccatgtctccgggcggcttgatgattctgccgtcgccggcactggcggcgatggtgaggtgtcgataaggatcatcggcgtcggggatcaggagactttgaggatgggttccggccagccgcaagcgctggctgttggtcccggtagagaggggaattccggtggtaatggtgttggttctgagacgattccgactgtgtctgagaggcagggaggagatggagggactgatggtggggttggagaggtgacttcttcatcgtcctcttctcttccatcatcaatctctgcggttggtcctcagagtacggaaggtgaggcgaacgttacaggaggtaacaacagggattcttcataccagaggtacgacatgcagcagattgcaaaatggatcgagcagattttgccattctcgttgcttctgttggtggtgttcatcagacagcatttgcaaggtttctttgtcaccatttggattgctgctgtgatgttcaagtctaatgatatattacggaaacagactgctctaaagggagagagaaaaatctctgtgcttgttgggattacattagttttcatgattcatgtgtttggagtctattggtggtacaggaatgatgacattctgtacccactggtcatgcttcctccaaaggaaataccacctttttggcatgcaattttcatcattatgctgaacgatactatggtgcgccaggcagctatggttgttaagtgtgtgctgctgatctactacaaaaacagtaggggccgtaactatcgtaagcagggtcagatgctaacacttgtggagtatcttttacttttgtaccgtgctttgttgccaactcctgtttggtaccgattcttcctaaacaaagaatatggtagcctcttttcatctcttaccacagggctctatcttacgttcaagctgacttcagttgttgagaaggttcagtcattctttgtggcactgaaggcattgtcgcgcaaagaagtgcattatgggtcttatgcaacaacagaacaggttgttgcagctggtgatctgtgtgctatctgccaggagaagatgcacgctcccattttgcttcgctgtaaacacatattctgtgaagattgtgtttctgaatggtttgagagagaacgcacatgcccattgtgcagggcattggtgaaaccagcagatcttcgctcgtttggtgatggttccacgagcctgtttttccagttattctagaataccctggcagcaaactaaactgattacctctacgccaactctggtctgaaatgagtaggatgacctcatttccctgcgttgccattaggcccatgctctgatgtagccagatccacacccatgttcttgctggaggtcatgactggaattgctacaaaatttgttgagacagcttttttgtccatatttcctcaaccaatctatatatgcccttgttgggaaatttcaacagaacagatggagaagtacgatattatatataagtatataatttatattacattgtgaaaagttattaatatatgagcatcttt

SEQ ID NO: 4404 - DNA, 2099 bp, Papaver somniferum
ttcggtttaaattccgagttatttttttagggtatttatggaagggaaatagattcttcttcttctgtaataaaaatctgtaaagaaggttacgattattaatttgatgggatatttctgtgaatttttttttagggtttctcttgattgaagttttttttagaatataatttgtgaaaaataatctttagggttagtatatattttttgtggggttaatggaaacttcgaatagcagtacggattcgtataggaattcgtctagcagtagtagtaataattcgagaagatttgggatgcaattttctgctgcgaattttatacaagcacctttatcggcgttattggaatattctggagttttaagaactaggtcgagtcatcaagaatccgagagtttgattaatggaagtcctacatctgtttttcgtgagagaaatcagaatcgattagatgattctattggcccagttagtggggatggggaagtttcgattaggataattggtgaacaagatagagaaggtggtgaagatgccctatctgctgaccacattactggctcatcatcagctgttgtgctggaacggcaggggggtaatgtgggtaatgatggtggtggagttggtgaggggttggcatcttcagcttcaatagcgggtagtaattctagtaatgaaaccactgatggggaagctggtgctggtgttgggggtaataatagggactcgtcataccagagatatgatattcagcaggttgctaggtggattgagcaggttttgcccttctctttgcttctcttggtggtcttcattcgacaacacttgcaaggtttcttcgttacaattttgattgctgctgtaatgttcaagtcaaatgatattctacggaagcagacagcgctcaagggggagagaaaagttacttttcttgcaggaattagtgtagtcttcttacttcatgtagttggtgtttattggtggtttcgtaatgatgatcttctccatcctctggttatgcttcctccaaaagcaatacctcctttctggcatgctatattcatcatcatggtcaatgacacgatggtgcggcaggcagcaatgatcttgaagttggcactgctgatatattacaaaaatagccgaggtcgcaactaccgtaggcagggtcaaatgcttactttggtggagtatctattgctgctataccgtgccttgttaccaactcctgtttggtatcgcttctttttgaacaaggaatatggaagcctcttttcatccctaaccacaggcttataccttactttcaagctgacatcagttgttgagaaggtccagagtttctttgctgcactaaaggcattgtcacgtaaagaggttcattatgggtcttatgccacatctgaacaggttaatgcagcaggtgatctgtgtgctatatgccaggagaagatgcatgcaccgatcttacttcgttgtaaacacattttctgtgaagattgtgtatcagagtggttcgagagagaaagaacatgcccattatgcagagccttggttaaaccagcagatcttagatcatttggcgacggatcgaccagtctgttcttccaattattttgagggatggtctctgctactacttgccacggataaaattcaaagagcctttcttcttggttcttttgaatggggaaccgcttaacagagcagctacagaaccaacacttcttatgatgcatctgtttaccaacttgcgtaattgcaggtgtattttgcaagctctgctgttctctcacgtaattgtgtaacaccgggttatatgatgtagttaaggctagttccttcaaaaccgaaaaatgggactggccttatgtttatattatatgttataagagagggattttgaactacggacaaatatcatatacagacaaaaggcttacagaaaaatgaagaaaaattatcctcctcggattaacctcatctctgaaatatttcttgctactctttactacgagtatttaagttaagttgatgtttagttacactgctaacaattatgtatatttatgctggaaagttcattatcaaggaaaa

SEQ ID NO: 4405 - DNA, 2212 bp, Papaver somniferum
ccttattgtttaaatttccgaggtattcttttatttagggtattatggaagggaaatagattcttcttcttctgtaattattaacggaggaggtgtttttaggtgtaaagatggtacgatttattaatttgatgggatatttatgtgaaaactatctttagggtttctgattgaagtttttttaagaatataatttgtaaaaaataaatctttagggttgctagatatttttttggggtaatggaaacatcgagtagcagtacggattcgtataggaattcgtctagcagtggtaataattcgagaagatttgggatgcaattttctgctgccaattttatacaagcacctttatcggcgttattggaatattcaggagttttaagaactaggtcgagtcatcaagaatccgagagtttgattaatggaagtcctacatctgtttttcgtgagagaagtcagaatcgattagatgattctattggtccagttagtggggatggggaagtttcaattaggataattggtgaacaagatagagaaggtggtgacgacgccctagcggcggaccagattactggctcttcatcagctgctgtgctggaacggcagggggggaatgtgggtaatgatggtggtggagttggtgaggggttgccatcttcagcttcattagcgggtagtaattctagtaatgaaaccactgatggggaagctggtactggtgttgggggtaataatagggactcgtcgtaccagagatatgatattcagcaggttgctaggtggattgagcaggttttgcccttctctttgcttctcttggtggtcttcattcgacaacacctgcaaggtttcttcgttacgattttgattgctgctgtaatgttcaagtcaaatgatattctacggaagcagacagcgctcaagggggagagaaaggttacttttcttgcaggaattagtgtagtcttcatacttcatgtagttggtgtttattggtggtttcggaatgatgatcttctccatcctctggttatgcttcctccaaaagcaatacctcctttctggcatgctatattcatcatcatggtcaatgatacgatggtgcggcaggcagcaatgattttgaagttggcactgctgatatattacaaaaatagccgaggtcgtaattaccgtaggcagggtcaaatgcttactttggtggagtatctattgctactataccgtgccttgttaccaactcctgtttggtatcgcttctttttgaacaaggaatatggaagcctcttctcatccctaaccacaggcttataccttactttcaagttgacatcagttgttgagaaggtccagagtttctttgctgcattaaaggcattgtcacgtaaagaggttcattacgggtcttatgccacatctgaacaagttaatgcagcaggtgatctgtgtgctatatgccaggagaagatgcatgcaccgatcttacttcgttgtaaacacattttctgtgaagactgtgtatcagaatggtttgagagagaaagaacatgcccattgtgcagagccttggttaagccagcagatctcagatcatttggcgatggatcaaccagtctgttcttccagttattttgagggatggtctctgctactacttgccacggataaaactcaaagggcttttcttcttggttcttttgaatggagaaccgtttaacagagcagctacaaaaccaacacttcttatgatgcatctgtttaccaacttgcgtaattgcaggtgtattttgcaagctctgctgttctctcacgtaattgtgtaacaccgggttatatgacgtagttaaggctagttccttcgaaaccgaaaaatgggactggccttgtgtttatatgttataagagagggattttgaactacagacaaatatcatatacagacaaaggcttacagaaaatgaagaaaattatcctcctcggattaacctcatctctgaatatttcttgctactctttactacgagtatttaagttaagttgatgtttagttacactgctaacattatgtatatttatgctggaaagtacattattgaggaaaacactctttaagttcagttttctcattcacactggatttcaaactcccttaataaacggtcaagttcaagtgggaatgcattaataaaccacttgttcgtatagt

SEQ ID NO: 4406 - DNA, 2207 bp, Brachypodium distachyon
ccgcgacgaaaagccaaaaggcaaaaacaaactaaaaatacgaggcaaaccaacccaagcaaagggggaatctcccgaatctcccattccaggggtctccgcctgcgcgtgcgccccgtcggcctccggctttcaagggtttcgccgctggcgatggacccaccggcgggaggctctaccgatcgccggggagccgtgtccggcgcctccgccggtgccgcgtcgtccggcctccgccggtacggcctcaacttctccgcatccagccttctccaggctccgctcgccgcgctgctcgagtactcaggcgtcgttccttccgggccgccatcgcagacggtacaccaggcggtcccttcgtcgtcgtctgaggccgacgggctactttccgccgctgcggccgggaacggggaggtctcaattcggatccagggcggccccaacgactcggatgcggcgggcgcggcgtctaccggggcctccccgggggactcgatcgaggcgaccgctgccaccgatgttgacccggcctccgcggctgggaggggtgctggtgccgacgcggaggcgggcggcggtggcagtggcggggcgacggggaatggggccggggaccgcgcctatcaacggtatgacgtgcaccatgtcgcgcgttggatcgagcagatactaccattctcgctgctcctgctcgtcgtcttcatacggcagcatcttcaaggtttctttgtcacaatttggattgctgctgtaatgttcaagtcaaatgatatattgaagaagcaaacagcgttgaagagcgagagaaaagctgctgcgcttgttggaattaccttaatcttcatgatccatgtttttggcgtctattggtggtacaggaacgattatctgcttagacctctgttcatgcttcctccaaaagatataccaccattctggcatgcaatttttatcatcatggtcaatgatacaatggtccgccaggcagcaatggccgcaaagtgcatattacttatgtattacaagaacagcagaggccgtaactaccgtaggcagggacaaatgctaacccttgtggagtaccttctacttctatatcgtgcattgttgccgacgcctgtttggtaccgtttctttctgaacaaggaatatgggagtctgttctcatccttaaccactgggctatacctcactttcaagttgacttcggtagttgagaaggttcaatcattcttatctgcagtaaaagcattgtcgcgtaaagatgtgcattatgggtcttatgcgacagcagaacaggcaattgctgctggtgatatgtgtgccatctgccaggagaagatgcatgttcctgttctccttcgctgtaaacatattttctgtgaggattgtgtctctgaatggtttgagcgagaacggacttgccccttgtgtagagcgttggtaaagcctgctgacattcggtcatttggtgatggttctaccagtcttttcttccagctcttttagactttaattggcaaaccctaacatataacaatgacaagcaattgcctgtaggggggaaaagattagaaatccttccttatcatgtggcaccattgtcgccatatgtaccgaggtcaatgtgagaatgttcattaaaattgtcttactacaaaccattctgtttgtccatatattcaagcgacagttagagagctggtcggttgcagtatcagcatagcttgcaacaaaagatccggagctggaatgatgctggatgagtgatagagtaaatgcgaatccctgaattgacggatcgcatcctgctgttggcttttatgtaaagtttggtaaaaaaatcacaagtgatgtgtcttggtgtataattggtactggagcctgcaagttctgtttgctagcagtgattctgtttggcaaggtggtagaaatgtaacctgtaaagctttggtacatggagttgaaaaccatataaaattgtaattgtacttgtaacaaacagtaaatattacgaggaccacaattttacacatatcttaaatgagttggtaccgttgtaaggtgaaagtgccggtcaaactattcattcttgctagtttctgactccgctcttgctgctatgtctttcggcagtaatctcaattatagtatttctggagcgacgaagctgattgtctgactgcaagtaatatcagcttgaaaca

SEQ ID NO: 4407 - DNA, 2686 bp, Triticum aestivum
ttacttttttgttagaaatacaagatcttagtatgatgtaacatgttaaagttccatttttcacagcagctattcaactttctaatgttgcggggtattattttggttaattttaggtcatcatggtaagagagatattatggtttttatttaccgtttagtgacgtagatgcaatgctgaatgtactcatagccaggtcttgggagttagctttcattacttactatagctatttcccatgcgttgcaacaggggcataaatattctagtggttcaacatcaatcatgtccgacgtataccttacactcaccgtattatagattttgataagatttaatttgatttgagtaagggtaggggaaggcatggaaagttttctgaaaacaaatccacaggttcgtgcggatcgagcgtgctcgcgagaggaagctacggtcgtgcggatctttcgctaacgaccagtccactggtcgttaagcacaaaatccacaggttcgatttctgaaaacaaattaaagcacacaaggaggggaggggcgcctcgacgaaaggccaaaaaggaaaataaaagcaatgtaaacaacccaagcaaagtggggatctcccgaacttcccatttcagggtctctgcctccgcctccgcgtgcgccgtcggcttcgcctttctaggtttccgccgccggttatggagacaccggcgggaggttccgccgatcgccgggtaaccgggtctggcgcctccgccggtgctgcggcttctggcctcagccgctacggtctcaatttctccgcctccagccttctccaggctccgctcgccgcgctcctcgagtactcaggcgttgtcccctccgggcccgtcccgcagacggtgcagcaggcggtaccctcctcttcatcgtcgtctgaggctgacgggctactttctgccgccgctgctggggatggagaggtctcgattcggatccagggtggccccggcgaccctgacacggcgagcgcgacggctacaggggcctcgccgcaggactcaattgaggtggccgcctcctccaactttgacccggcctccgtggcgggaaggggaggcggtgctgatgcggaggcaagcggcggtggcagtggcggtgctacggggaatggggctggggaccgcccatatcagcgttacgacgtgcaccacgttgctcggtggatcgagcagatactaccattctcgctgctgttgctcgtcgtcttcattcggcagcatctccaaggtttctttgtcacaatttggattgctgctgtaatgttcaagtcaaatgatatattgaagaagcaaacagcactgaagggtgagagaaaaattgctatgcttgttggaatcaccataatcttcatggtccatgtgtttggcgtctattggtggtacaggaacgactatcttcttagacctctgttcatggttcctccaaaagatataccaccattctggcatgcaatttttatcatcatggttaacgatacaatggtccgccaggcagcgatgaccgtcaagtgcatgctacttatgtactacaagaacagcagaggccgtaactaccgtaggcagggacaaatgctaacacttgtggagtaccttctgcttctatatcgtgctttattgccgactcctgtttggtaccgtttctttctgaacaaggaatatgggagtctgttctcatctttaactactgggctatacctgactttcaagttgacttcggtagttgagaaggttcaatcattcttatctgcagtgaaagcattgtcacgtaaagatgtgcactatgggtcttatgcgacagcagaacaggcaattgctgccggtgatatgtgtgccatctgccaggaaaagatgcacgttcctgttctccttcgctgtaaacatattttctgcgaggactgtgtctctgaatggtttgagcgagaacgaacttgccctttgtgtagagcattggtaaagcctgctgacattcggtcatttggtgatggttctacaagtctcttcttccagttgttttagagcccaaatggcaaaccctaacacataacaatcgatcacaagcaattggctataagaaaagtccaggtggaagtcctttgttctttatgatgtggcaccatcttccctgtgtggaatgaggatgctgagaatgtttgtgaaaattatctcattgcaaccattccgttcatgcatatgttgagagctggtcagttgcagcattgcataagtttgcaacagaaagaaatatagctggaggaatctgctcctgcgaaccctgaagtgccggaccacatctcgctattgacttgcgtaatgtaaatttggtaacatttttttacaaaagtgaatgcgttttggtttaattcgagcttgcaagttttgcatgctagcagaattctgtttgcgaaaggggtagaaatgtaacctgtaaagctgtgatatatgaaatgttgagaactgtatacattgtactatttacaaacagtaaatattacgaggagcacaatgttaacacatgtcttgttctggtaatcagatatgtttccggtattgcgtgtaatcctgaagcgctagtacattttgtctcaaacattcgttatttctggtttcctaccccctcttgctgctatgttcgtttataataatcgcaattata

SEQ ID NO: 4408 - DNA, 1870 bp, Fagus grandifolia
cgaatggaagcccctggaaacaatcctgaggcgtacaggagtccttcttcgggttcgggaagtagtggaattgggatttcgagaagatacgggttgctatctgcttccaatataattcaggcaccactctctgcgttgttggagtactccggtattcttcgtcccaatgctaggtctaatcaccaagagagcgaggctttgattcacggtggacgtctctcttcttcagcttccgggtttcaccattctcagctcgaccaacccaccactgccaccaccaatgacggcgaggtttccattaggataattggtgcggccgagcaagaacatgaaagggaacccactgctggattagtagttggccaacagctcggggaggggactgctactcgtactgatgtttctgcacaaccaaccgaggctcagggaggagattcaagggttgaccgtggtgtagcagagggaatttcgcaatccgcaaatgggaatgcggacggagaagctgtggatggaaatggggcaaatgggagggattcttcttaccagagatatgatattcagcaggctgccaggtggattgaacaggtcctgcccttttctttgcttctcctggtggtcttcattcgccagcatctgcaaggtttctttgttactatttggattgctgctgtcatgttcaagtcaaatgatattctgcggaaacagacagctcttaagggagagaggaaaatatctgttctagttggcatttctcttgcatttacaattcacgtggttggcgtttactggtggtatcagaatgatgatcttttgtatccattggtgatgcttcctccgaaagctataccacctttctggcatgctattttcatcatcatggtgaatgataccttggttcggcaggcagcaatgatatgcaagtgttttctgttgatgtattacaagaacagcagaggccgaaattatcgtaggcagggtcaaatgcttactttggttgagtatttgctgctgctgtaccgtgccttactgccaacaccagtgtggtatcgtttcttcttaaacaaagaatacggaagcctcttttcatcgttaatgacagggttgtatctaactttcaagctcacatccgttgttgagaaggtgcaatccttcttttcggcattgaaggcattatcacgtaaagaggtgcattatggggcttatgcaacgtcagagcaggttagcgcagcaggtgacatgtgtgctatttgccaggagaaaatgcatgctcctatcctacttcggtgtaaacacatattttgtgaagactgtgtatcagaatggtttgagagggaacggacatgtccattatgcagggctttggtcaaacctgccgatctcagatcatttggtgatggatcaactagtctgtttttccagttgttctaaaatattttcttgtaaaagggagtttttctgctttgaagccctaaattcttattcaaagcagccttctcctgatcttttcgtctacacaggtaatttgaccatattttgccttgttcacgggtagcgcctgaaagttaattgaagtgcctgaattgaactggcaatatgttcatatgttgtattgagaaaggttaacatgtatgtaatgggcccttaaagctacagaggaattcttgtaaggagtaaggactaccattatatgtcactgtaaatggaagttcttcaaacaaacccccctttcttttatttatatctactcctcctctatatatctatactctcctcgagactatatgtacttcgttcgtccgtggagtcgaccgaccggcctacgagtacgacgtccgaccgaacggacctacgaaccggaagggggtagtta

SEQ ID NO: 4409 - DNA, 1253 bp, Cynodon dactylon
gggcaagtcaaatgatattttgaagaagcaaactgctttgaagggagagagaaaagtatctgtacttgttgggattacgataatcttcatggtccatgtgtttcgtctattggtggtacaggaatgatgatcttatcagacctctgttcatgcttcctccaaaagatattccaccattctggcatgcgattttcatcatcatggttaatgatacaatggttcgacaagcagctatggccatcaaatgcatgctacttatgtactacaaaaactgcagaggccgtaactaccgtaggcagggccaaatgctaacccttgtggagtacctgctgcttctttatcgtgccttattgccaactcctgtttggtaccgtttctttttgaacaaggaatacggaagtcttttctcatctttaactactgggttgtacctgactttcaagttgacttctgtagttgagaaggttcagtcattcttggctgcggtgaaagcattgtcacggaaagatgtgcattatggctcttatgcgactgcagaacaggtagttgttgctggtgatatgtgtgctatctgccaggagaagatgcatgttcctgtgctccttcggtgtaaacatattttctgtgaggactgtgtttcagaatggtttgagcgagaaaggacttgccccttgtgtagagcattggtaaaacctgctgatattcggtcatttggtgatggttcaacaagtctattcttccagttgttttagaagattcccagatgtcaaactcctaacttataaacaatggacaagcaatcacatatgaaaaatttgagcaaggtcttttttctttaccatgtgacctgtgaagtcaaatgtgagaatgatgaagattatctgacagtgacctgtgaagtcaagctactttagagggctgttcagttgcgacatcagatatgcctgcagcaagcttgcattcgaagtttagttatgctggacgaagtatctgaatgtaaggacctgctgagactgactacgtccttgctaccggcttgattatgtaaaaagatggtgatttttgcacaggtgaatgcatctgggtgtaccaggaacctgcaaattctgcgtgctatattgacataggcagtatgaaactctgttagtaaaaatgtaacttgtaaagctttgacacatgatagtgctgaaaaccatatccaaacactctttatagagcagtaaatactagcgaacagcaatgaccatgatctt

SEQ ID NO: 4410 - DNA, 2141 bp, Vitis vinifera
caataatacaacgagagtgatgtatataataataataatgaatgtaagaagaatcgagaatcaggctccttgccgggttacgagttacgacctacgtatacaattagaatagaataagccatacattacatatattatatatatgggtgacggggacgctcatccccgtatctgcggatgaatacttgttttcttattcaaaggccgacgccgtagtagaccaacacggtgagattctgatgattatgattttcagttggaattgtcctctcaatttgatgaattcttttagttttcaggttttgtggattggaatgattggacgattagggtcaagagaggggggaggtgggtctcatttctgattggttgatcaccgctgtgaactagggcgtgcattttgggattctatttggttttgggacgaggttagggtttttttttcttttttttttttggaggaaaatggagacgtctggtagcaattcaagatacggaatccatatcgctgcttccaacttcatccaggcgccattggcggcgcttttggagtattctggtattttcagcaccaggtcttcttcttctcaggaaaccgacggcttgattgctccttcacctgcttcactcgatagcttccactcccgctccgacgatcgcgatcgcgatcacgatccgtcgactcctgcctccactcctgaggaggctcccgccgtttcggacgctagcaggaatgaaagtgggagtggtgtagcggctgttaattctggcgggtcaactgccgatggggagcctgccaatgggggcagtgttaataacagggattcttcttatcagagatacgatattcagcaatttgccagatggatcgagcagattcttccattttctttgcttttattggttgttttcatcagacaacatttgcaaggtttctttgttacgatttggattgctgcagtcatgtttaaatcaaatgatattctacgaaagcagacagctctaaagggggaaagaaaattatctgttctcacgggcatcactgcagtgtttatgcttcatgttatctgtgtttattggtggtatcggaataatgaccttctataccctctggttttgcttcctccaaaagcaatacctccattctggcatgctattttcatcatcatggtgaatgatacaatggtgcgtcaagcagcaatggctttaaagtgcatacttttgatgtattacaaaaatagtagaggccgtgattatcgtaaacagggtcagatgctaactcttgttgagtatctgttgttgctgtaccgtgccttgttgcctacaccagtctggtatcggttctttttgaacaaagaatatggaagcctcttttcttcattgactacagggttgtatttaacttttaagcttacatcagttgttgagaaggttcaatccttctttgctgcattgagggccttatcgcgtaaggaggtgcattatgggtcttatgccacatctgaacaggttaatgcagcaggggatctctgtgctatatgccaggagaagatgcatgctccgattttgcttcggtgtaaacacatattttgtgaagactgtgtatcagaatggtttgagcgagagaggacatgcccattgtgcagggccttggttaaacctgctgatatcagatcatatggtgatggatcgactagtctgtttttccagatattttaggattttacttgcaaagataatcaggcaacttgtgccttgagaccagagatcactcggttggaaaatctcgagtttcaccattaattcagagtagaatttttgctgagttactattttcccgtgtctagtccatctggaagacccaaactggaggtggagtagttgtatctcaatgtaatgttgtatgcgcgaggtggatatatgtcattggtctgtcaatggataaaaccatatgggtagctttatgacatatatcatattgtctatagaggtttttatttttatttttacatatgttgtattcttggaggatatattttattgacttctcaatggattctcaaatagacggttgccttgtgatacatacatatatatctatatatattgtttataaaaggtttattatatgtaaacagaaa

SEQ ID NO: 4411 - DNA, 2245 bp, Quercus alba
ttttttcaacaatacacactcttattacaaacactaccgaggaaagtaaagaaacagaagaaaaggaaaaagaaacccccaaaaccaaaaccaaaaccaaaacccaatactctccatccgtcaaactctcgaatccacatttctccgatcgaccaaaaccctaattccacgcggccatcggagccacctctaatcttctgatcgattggatttcacggactctgtaatataaaagagaatcgttgttttttgtgcttagtcaaagctcgaagtcttctttattcgatggttttattgcagtcaggcttggcgttctcacaatgatttgaaatttcaaggtcctcaacggagtttcgctttccaagggttaggtttagggctaggggattgacgcgaatggaagcgtctggaagcagtcctgaggggtttcggagtaattcttcgggttcggggagtggtggaattgggaattcgagaagatacggattgttctcggcttcgaatatcattcaggcgccactctctgcgttgttggagtattcggggattcttcgtaccaatgctagtaggtctaatcatcaggagactgattctttgattcacggaggacggctatcttcttcgggctctgggtttcaccttgctcagcttgatcaacctgccgctgctgctactgccaatgacggcgaggtttctattaggataattggtgcggcggaacaagaacaggatagggaacctgctgctggattggtagttgggcaccagcttgggagtgaggtagctgctgccgctcgtactgatgtttctccacgagcgactgaggctcagggaggggattcaaggattgagcgtggtggtgtagcggagggaatttcgcaatctgcaaatgggaatacggagggagaagctgtggatggaggtggggcaaatgggagggattcttcttaccagagatatgatattcagcaggctgctaggtggattgagcaggtcctgcccttctctttgctcctcttggtggtattcattcgccagcatttacaaggtttctttgttactatttggattgctgctgtcatgttcaagtcaaatgatattctgcggaaacagacagctcttaagggagagaggaaaatgtccattctgattggcattactcttgcattcacaattcatgtggttggcgtatactggtggtatcagaatgatgatcttttgtatccgttggtgatgcttcctccaaaagctataccacctttctggcatgctattttcattattatggtgaatgatacattggttcggcaggcagcaatgatatgcaagtgttttctgttgatgtattacaagaacagcagaggccgaaattatcgtaggcagggtcaaatgcttactttggttgagtatttgctgctgctgtaccgtgccttactgccaaccccagtttggtatcgtttcttcttgaacaaagaatatggaagcctcttttcatccttaatgacagggttgtatctaactttcaagctcacatccgttgttgagaaggtgcaatccttcttttcggcattgaaggcgttatcacgtaaagaggtgcattatggggcttatgcaacatcagagcaggttagcgcagcaggcgacatgtgtgctatttgccaggagaaaatgcatgcccctatcctacttcgttgtaaacacatattttgtgaagactgtgtatcagagtggtttgagagggagcgaacgtgcccattatgcagggctttggtcaaacctgcggatcttagatcatttggcgatggatcaactagtttgtttttccagttgttctaaaatcttttgctgtaaaagggagtttttctgctttgaagccctcaatccttattcaaagcagccttctcctgatatttttatctacacaggaaatttaaccataatttgctttgccttgttcacgggtagcactggaaagttacttgaagtgcctagaattgaattgaactggcaatatgttcatatttgtattgagaaaggttaaaatgtatgtaatgggcccaaagctacagaggaattcctgtaaggagtaaggacttaccatactgttcattttccgtaaatggaagttcttcaacccctcttccactctcgcttttctctgtaatttctctcattatattattagtctcctcaaggcatataatgtattgtttcccacaattgcacgatttttcagtggaagcag

SEQ ID NO: 4412 - DNA, 2047 bp, Elaeis guineensis
ccatctcctcttctcctccttaaatctcgccttccggcctcgcaggggaaaaagatacgatcccttctagggttagggtttccgcatgatctatcctgttttttgatctttatcctgatcgattccgccaatcggacggatctggtgtcgttccgttcagattcttgccggtttcttgggcggatttggtctcagatgatggaatcgtccggcgggaactcggattcctataggagccagagcgccggcagtggcggtggcagcggaggttcttcgaggcggtacggggttcacttctcgacctctaacttcatccaggcgccgctgtccgcgcttttggagtactctgggatcttgcgtccgagattgagtcaccaggagaacgagagcttgataagtggagctgcaggtagtggcttgcgagaccatgtctccggccggcttgatgattctgccgtcgctggggctggcggcgatggggaggtgacgataaggatcatcggcgttggggatcaggagaatttgagagtgggttccggccagccgcaagcactggatgttcgttcggggagagaggggagttccagtggtaatggtcttgctgctgagacgattccggctatatctgagaggcagggaggtgatggagggaacgatggtggggttggagaggtcgcttcttcatcgtcctcttctcttccatcatcgatttctgcagttggtccccagagcacggagggtgaggcgaatgctacgggaggcaacaatagggattcttcctaccagagatacgatatacagcaggttgcgaagtggatcgagcagatcctgccattctcgttgcttctgttggtggtgttcatcagacagcatttgcaaggtttctttgtcacgatttggattgctgctgtgatgttcaagtctaatgatattttacggaaacagactgctctaaagggggagagaaaaatctctgtgcttattgggattacattagttttcatgattcatgtgtttgcagtctattggtggtacaggaatgatgaccttctgtacccactggtcatgcttcctccaaaggaaataccacctttttggcatgcagtcttcatcattatggtgaatgatactatggtgcggcaggcggctatggttgtcaagtgtgtgctgctgatgtactacaaaaatggcaggggccgtaactaccgtaagcagggtcaaatgctaactcttgtggaatatcttttacttctgtaccgtgcgttgttgccaactcctgtttggtaccgattcttccttaacaaagaatatggtagcctcttttcatctctcactacagggctctaccttacattcaagttgacatcagttgttgagaaggttcaatcattttttgcagcactgaaggcactatcacgtaaagaagtgcattatgggtcttatgcaacaacagaacaggttattgcagctggtgatctgtgcgctatctgccaggagaagatgcatgctcccattctgctgcgctgtaaacacatattctgtgaagactgtgtttctgaatggtttgagagagaacgcacatgcccactgtgcagggcgttggttaaacctgcagaccttcgctcgtttggtgatggttccacaagcctgtttttccaattattctaggttgcactggcagcaaaccagcagaccttcgctcgtttggtgatggttccgcgagcctgtttttccagttattctaggttacactggcagcaaactccactgatcaccaaaatgtcaaactctggtctgaaatgagcaggatgaccacattccctgctttgccatgcggccgaaccagtgtttttgctggaagcgttacctatgaatgccacaaaatttgtttcgacagctgttgtgtccatattcctgtacccaatctatataggccctttttgggaaaattttaacagaaggagaagtccaatgtcatgtatatgaataaacatgtaatttttatcatggtattgttgagtgaaaagttcttaatatctaaccccct

SEQ ID NO: 4413 - DNA, 2255 bp, Oryza sativa
ttaagaacagaaatacaggccgaggccaccaccggcaccggggcgagagaagcaagaaaaaaaaaagccaaagaaaccaaaaggaaggcaggcaaagtaaaccaacccaagcaaggggatctctcgaatctccccattccaggggcctcgtctcctcctcctccgcctccgccttgtagggtttcgccgccgccgctgccgccggcgatggagccaccggcgggaggctcctccgatcatcgccggggtgccgggaccggcgcgggcgccggtggggccgcctcgccgtcgggcctccgccgctacggcttcagattctccgcctccagcctcctgcaggccccgctcgctgcgctgctcgagtactccggcgtcgtcccctccggccccggcgccccgcaggcggggccgccctcggcgctgtcgtcctcgccgtcttcttcgtcgtcgtcgtcggaggccgatgggctgctctccgcggccgcggctggggacggggaggtctcgatccggatccagggcggccccggggaggccgacgcggcgggcgtcgcgggggcggcctcgtcgggggaggactcgatcgaggcgaccgccgccggggacgttgacccggcctcggctgccgcggggaggggtggcggcgccgacgcggaggcgagtggtgggggcgcggacggcgcgtccgggaacgggggtggggaccgcgcctaccagcggtatgacgtgcaccatgtcgcgaggtggatcgagcagatactgccattctcgctgctgctgctcgtcgtcttcatacggcagcatctccaaggtttctttgtcacaatttggattgctgctgtaatgttcaagtcaaatgatatattgcggaagcaaactgctttgaagggcgagagaaaaattgctgtgcttgtcgggattacagtaatcttcatgattcatgtgtttggtgtctattggtggtacaggaatgatgatcttctcagacctctgttcatgcttccgccaaaagaaataccgccattttggcatgcgatttttatcatcatggtcaatgatacaatggttcgccaggcagcaatggccattaagtgcatgctacttatgtactataagaatagcagaggtcgtaactaccgtaagcagggtcaaatgctaacccttgtggaataccttctgctcctatatcgtgccttgttgccaactcctgtttggtaccgtttctttctgaacaaggaatatgggagtcttttctcatctttaaccactggactgtacctgaccttcaagttaacttcagtagttgaaaaggttcagtcattcttggctgcagtgaaagcattgtcacgtaaagatgtgcattatgggtcttatgcgacagcagaacaggtaattgctgctggtgatatgtgtgccatctgccaggaaaagatgcatgttcctgtcctcctccgctgtaaacatattttctgtgaggactgtgtctctgaatggtttgagcgagaacggacttgccccctgtgtagagcattggtaaagcctgctgatattcggtcatttggtgatggttctacaagtcttttcttccagttgttttagacaccaaatgggaaactgctaacatataacaatggacaagcaattgcttatgaaaatccaagtgaatcctttttttctttatcatgtcatgccgtcttcccctgcactgatgtcaaagtgagaagattcgcagagattatgtgagcgcaatatgtctgattcatctatatgttcgagaaatagtttagagaactggtctgtggtcagttgcgacgttagcatagatttgcagcaaatctttatgggcctggtcggtttctggaggaatgatcaatcctagtgcaaagccctggtgtgtgtgatccccgccacgctattggcttgcataatgtaaaaatttggaatttttgcaaaagtatatgtaccccggcgcaactggagtgaacaagttttgcttcttagcaagacgagggaaggcagtggtaaaattgtaacctgtaaagctttgatacgtcaaaatgttgaaaccatatataaaatgtactttttactaaacagtaaatagtaccagaccgcaatgttaacatgtcttgtatgtcattgtacagttttataacgcttcatttgagaaataactcaggttttatgtttcatttaagcaatggaatgagatggtctgtcactttttcttccggaaaaaaaagcggaattgggtc

SEQ ID NO: 4414 - DNA, 1668 bp, Panicum virgatum
gggaacctcatccgaggactcgatcgaggcgacaaccggctcggaggttgaccaggcgtccgccgccgggaggggagcagacgctgcggacgcggagactaacggcggtgggggcgcatcggggaacgggggcggggaccgcgcgtaccagcggtacaacgtgcaccacgtggcgcggtggatcgagcagatattgccgttctcgctgctccttctcgtcgtcttcattcggcagcatctccaaggtttctttgtcacaatttggattgctgctgtaatgttcaagtcaaatgatatactgaggaagcaaactgctttgaagggcgagagaaagatatctgtactcattgggattacagtaatcttcactattcatgtgtttggtgtctattggtggtacaggaatgatgatattctcagacctttgttcatgcttcctccaaaagatataccaccattctggcatgcaattttcatcatcctggtcaatgatacaatggttcgccaagccgcaatggctgtcaagtgcatgctacttatgtactacaagaactgcagaggtcggaactaccgtaggcagggccaaatgctaacccttgtggagtaccttctgcttctttatcgtgccttgttgccaactcctgtttggtaccggttctttctgaacaaggaatatgggagtctcttctcttctttaaccaccggcctgtacctgactttcaagttgacttcagtagttgagaaggtccagtcattcttggctgcagtgaaagcactgtcacgtaaagatgtgcattatgggtcttatgcgactgcagaacaggtacttgctgctggtgatatgtgtgccatctgccaggagaagatgcatgtgcctgttctccttcgctgtaaacatattttctgtgaagactgtgtttcagaatggtttgagcgagaacggacctgccccttgtgtagagcactggtaaaacctgctgatattcggtcatttggtgatggttctacaagtctattcttccagttgttttagacttcaaatggcaaatttctaacataacaatgaagaaacaatggcatatggaatattcaaatggtcatttttctttacccatgagagacaatcttcctcagtgtagagattgatgtgagaaggttcagcgtggtcacatgacagcacgatggtgatttttgtctatatggtaaagcaatagtttagagctgttcagttgcaacatgcggcaaaatatttcgagcaaactgcttctagagcctgtatgattctgctggacgttcctaatgtgggggcctattggggccgactgctggtggcttgctcgatgtaaaaagctggtaaattttgcacgtggatttatctgggtgtaactgaagcctgcaagttcgtattgcaggattgacttgcacaggcagcaagaattacctgtcgctggaaagtggtagaaaaaagtgtaacttgtaaagcatttgttacgtggaaaatgttgagaactgtatacaaaaaagtagcaccctttgcaaaaatagtaaatactactaggtacgatttatctgcaaattttgtaaatccgttgcgtggtttgctgtatactcggtgattgtatgtatgtgctgatctagcctgctggttaatattgtcggagaattttc

SEQ ID NO: 4415 - DNA, 1839 bp, Tabernaemontana elegans
gaataaacaattccttagccattgacttttcggtcacatctcccaaggattttacctttcttctccttttgggttgaggttccttccttgatgaatcgtcatctcttgtaattttcagtatcaagggttcttcgacggattttcgatctccaagggttagatttagggttaggggatcatccgcgcgaatggaagcgtccggttccaattcggacgcttacagagatactggttttactaatactaatactagtagccattctcggagacatgggatacagctgtctgcttccaatatcttgcgttccccaatatctgctctgctggaatactcgggaatcctcagaagcaggtctgcccctcattccgattcagacgctctattaaactccggggtcagtcacgcctatggcaatcatcttcagtcccgccttgaggaatccttgggggcagctgctgcagcacctaatgcctctgctggaggaggaggggaggtttccattaggatcattactgccgctgaacaagaccttgagagggttgcgactcccttaccctcgtcagctgtcacgttggtgagggaagtcaatcctcaaaatcaagttttttgtgcagcctattcccaggactggttctgctgtttcattggaggctcaaactgatagaggaggtgaaggtgatggagttgctcaatccacgaatacaagtgttgatacagaggccccagacggggttggaaccaataatagggactcttcctaccaaagatatgatatacaacaggctgctagatggatagagcaggtccttccattttctttgctattgctggttgttttcattcggcaacatttgcaaggttttttgttacaatatggattgctgcggtgatgttcaagtcaaatgatattctacggaagcagactgctcttaagggagagagaaaactgttgattctcttatgcatttcacttgttttcactcttcatgtggttggcgtttattggtggtatcggaatgatgatcttctgtatccattggtgatgcttccaccgaaggcaataccacctttctggcatgctatcttcataataatggtgaatgatactttggtccgtcaggcagctatggttgccaagtgtattctattaatgtattacaagaatagcagaggccgaagttatcgtaaacagggtcaaatgttgacattggttgagtatctgctattactataccgtgctttgcttccagcaccagtttggtatcggttcttcttgaacaaagagtatgggagtcttttttcgtcactaatgactgggttgtacttgactttcaagctcacatctgtagttgagaaggtccaatgctttgttactgctttgaaagctttgtcacgtaaagagattcattatggagcttatgcaacatctgaacaggtcaatgcagcaggagatttgtgtgctatatgtcaggaaaaaatgcatgctccaatcttgctacgttgtaaacacatattctgtgaggactgcgtatctgaatggtttgagagggaaaggacgtgtccactttgtagggcattggtgaaacctgcagatcttagatcctttggcgatggatcaactagcctattttttcagttattctaaacacccttacaatttgaaactaggaattcttttcctctgaagccttggtgctcacttcaagcggtttccatggagcatctatcctctcagagagatctgttgatctgcgtttggagaaaagaaccgccaaagctatgtgttcatatcttgtaactatagaaagggttgtatgtaatggatccctataaactac

SEQ ID NO: 4416 - DNA, 1869 bp, Vinca minor
actcccctggctccatgtcaacatttttatgtataaacgattaattcccattgattttttctctccaattttcaatctttttatgtgggtcgttgttcgtttttcttgatgaatcctcatttttcgtagttttcaacggattctcgatctccaagggttaggtttagggttagggattcttcaccatcaacggtcatggaagcgtccggagttgtgaattcggacgcttaccggggagctaataatagcatgggtagcatttctaggagacatgggatgcaattttctgcttcaaatattcttcgtgccccattatctgctttgcttgaatatacgggaatttttcgaagtggtaggttgtcctcctctcattcggattcggaatctttattgaactacggccacgatcatcatcatcgtcaatcccgccttgacgattcgtttgggggtggcggggcagctacagctgttgcagagcctaataatgcctcttctggagctggagaggtttcaattaggatcatttcagctgctgagcaagatgctggtctgttaccttcacctacatttaggagggaagttaattcccaaaatcaagcatttgcccagcagcccatttcaaggtcggcgtctgctgtttcgttggacgctcaaactgatagaggaggtctagctgctgatggagttgctcaatcgacgaatggtagtgttgatgctgaggcacaagatggggttgggacgaataatagggactcttcttatcaaagatatgatatacagcaagctgctagatggatagagcaggtccttccgttctctttgctattgctggttgtttttattcggcaacatttgcaaggttttttgttactatatggattgcggctgtgatgttcaagtcaaatgatatcgttcggaagcagactgctcttaagggagagagaaaactatccattctcttatgcatttcacttttcttcacactccatgtggttgggatttattggtggtacctgaatgatgatcttttgtatccgttggtgatgcttccgccgaaggcaataccacctttttggcatgccatcttcataataatggtgaatgatacattggtccgtcaggctgctatggttgacaagtgtattctattaatgtattacaagaatagcagaggccgaagttatcgtaaacagggtcaaatgctaacattagttgaatattttctgttactataccgtgctttgctaccagctccagtttggtaccggttctttttgaacaaagagtacgggagtcttttttcttcactaatgactgggttgtacttgactttcaagctcacatctgtagttgagaaggttcaatgctttgttactgctttgaaagctttgtcacgtaaagagattcactatggagcttatgcaacatctgaacaggtcaatgcagcaggggatctgtgcgccatatgccaggaaaaatgcatgcaccaatattgttacgttgtaaacacatattctgtgaggactgtgtatctgaatggttcgagagggaaaggacatgtccgttgtgtagggcattggtgaaacctgcagatcttagatcctttggcgatggatcaactagtctattctttcagttattctgataaacactctaatttagattttgaaactaggaattcttttgctctctggcctctcgcagagggacctgtcggtttatgcatacatttagaggaaaaagaagatccgccatagctgtgtgttaacgttcttgtaactaatcatacaaaaggtcgtatctgtatgtaatgtaatgcatccctacaaaactacagggagttatttatgtgaatttctgcaacctcca

SEQ ID NO: 4417 - DNA, 2050 bp, Triticum aestivum
ggcgcctcgacgaaaggccaaaaaggaaaataaaagcaatgtaaacaacccaagcaaagtggggatctcccgaacttcccatttcaggggtctctgcctccgcctccgcgtgcgccgtcggcttcgcctttctaggtttccgccgccggttatggagacaccggcgggaggttccgccgatcgccgggtaaccgggtctggcgcctccgccggtgctgcggcttctggcctcagccgctacggtctcaatttctccgcctccagccttctccaggctccgctcgccgcgctcctcgagtactcaggcgttgtcccctccgggcccgtcccgcagacggtgcagcaggcggtaccctcctcctcatcgtcgtctgaggctgacgggctactttctgccgccgctgctggggatggagaggtctcgattcggatccagggtggccccggcgaccctgacacggcgagcgcgacggctacaggggcctcgccgcaggactcaattgaggtggccgcctcctccaactttgacccggcctccgtggcgggaaggggaggcggtgctgatgcggaggcaagcggcggtggcagtggcggtgctacggggaatggggctggggaccgcccatatcagcgttacgacgtgcaccacgttgctcggtggatcgagcagatactaccattctcgctgctgttgctcgtcgtcttcattcggcagcatctccaaggtttctttgtcacaatttggattgctgctgtaatgttcaagtcaaatgatatattgaagaagcaaactgctttgaagggcgagagaaaagttgctatgcttgttggaatcaccataatcttcatggtccatgtgtttggcgtctattggtggtacaggaacgattatcttcttagacctctgttcatggttcctccaaaagatataccaccattctggcatgcaatttttatcatcatggtcaacgatacaatggtacgccaggcagcgatgaccgtcaagtgcatgctacttatgtactacaagaacagcagaggccgtaactaccgtaggcagggacaaatgctaacacttgtggagtaccttctgcttctatatcgtgctttattgccgactcctgtttggtaccgtttctttctgaacaaggaatatgggagtctgttctcatctttaactactgggctatacctgactttcaagttgacttcggtagttgagaaggttcaatcattcttatctgcagtgaaagcattgtcacgtaaagatgtgcactatgggtcttatgcgacagcagaacaggcaattgctgccggtgatatgtgtgccatctgccaggaaaagatgcacgttcctgttctccttcgctgtaaacatattttctgcgaggactgtgtctctgaatggtttgagcgagaacgaacttgccctttgtgtagagcattggtaaagcctgctgacattcggtcatttggtgatggttctacaagtctcttcttccagttgttttagagcccaaatggcaaaccctaacacataacaatcgatcacaagcaattggctataagaaaagtccaggtggaagtcctttgttctttatgatgtggcaccatcttccctgtggaatgaggatactgagaatgtttgtgaaaattatctcattgcaaccattccgttcatgcatatgttcaagcaatggttcgggtcagttgcagcatctgcataagtttgcaacagcaggaaatatagctggaggaatctgctcctgcgaatcctgaagtgccggaccacatcttgctattgacttgtgtaatgtaaatttggtaacatttttttacaaaagtgaatgcgttttggtttaattcgagcttgcaagttttgcattctagcagaattctgtttgagaaaggggtagaaatgtaacctgtaaagctgtgatatatgaaatgttgagagccgtatacattgtactatttacaaacagtaaatattacgaggaccacaatattaacacatgtcttgttctgataatcagatatgttcccggta

SEQ ID NO: 4418 - DNA, 2056 bp, Triticum aestivum
cctcgacgaaaggccaaaaaggaaaataaaagcaatgtaaacaacccaagcaaagtggggatctcccgaacttcccatttcaggggtctctgcctccgcctccgcgtgcgccgtcggcttcgcctttctaggtttccgccgccggttatggagacaccggcgggaggttccgccgatcgccgggtaaccgggtctggcgcctccgccggtgctgcggcttctggcctcagccgctacggtctcaatttctccgcctccagccttctccaggctccgctcgccgcgctcctcgagtactcaggcgttgtcccctccgggcccgtcccgcagacggtgcagcaggcggtaccctcctcctcatcgtcgtctgaggctgacgggctactttctgccgccgctgctggggatggagaggtctcgattcggatccagggtggccccggcgaccctgacacggcgagcgcgacggctacaggggcctcgccgcaggactcaattgaggtggccgcctcctccaactttgacccggcctccgtggcgggaaggggaggcggtgctgatgcggaggcaagcggcggtggcagtggcggtgctacggggaatggggctggggaccgcccatatcagcgttacgacgtgcaccacgttgctcggtggatcgagcagatactaccattctcgctgctgttgctcgtcgtcttcattcggcagcatctccaaggtttcttcgtcacaatttggattgctgctgtaatgttcaagtcaaatgatatattgaagaagcaaactgcattgaagggtgagagaaaagttgctatgcttgttggaatcaccataatcttcatggtccatgtgtttggcgtctattggtggtacatgaacgattatcttcttagacctctgttcatggttcctccaaaagatataccaccattctggcatgcaatttttatcatcatggttaacgatacaatggtccgccaagcagcgatgaccgtcaagtgcatgctacttatgtactacaagaacagcagaggccgtaactaccgtaggcagggacaaatgctaacacttgtggagtaccttctgcttctatatcgtgctttattgccgactcctgtttggtaccgtttctttctgaacaaggaatatgggagtctgttctcatctttaactactgggctatacctgactttcaagttgacttcggtagttgagaaggttcaatcattcttatctgcagtgaaagcattgtcacgtaaagatgtgcactatgggtcttatgcgacagtagaacaggcaattgctgccggtgatatgtgtgccatctgccaggaaaagatgcacgttcctgttctccttcgctgtaaacatattttctgcgaggactgtgtctctgaatggtttgagcgagaacgaacttgccctttgtgtagagcattggtaaagcctgctgacattcggtcatttggtgatggttctacaagtctcttcttccagttgttttagagcccaaatggcaaaccctaacacataacaatcgatcacaagcaattggctataagaaaagtccaggtggaagtcctttgttctttatgatgtggcaccatcttccctgtggaatgaggatactgagaatgtttgtgaaaattatctcattgcaaccattccgttcatgcatatgttcaagcaatggttcgggtcagttgcagcatctgcataagtttgcaacagcaggaaatatagctggaggaatctgctcctgcgaatcctgaagtgccggaccacatcttgctattgacttgtgtaatgtaaatttggtaacatttttttacaaaagtgaatgcgttttggtttaattcgagcttgcaagttttgcattctagcagaattctgtttgagaaaggggtagaaatgtaacctgtaaagctgtgatatatgaaatgttgagagccgtatacattgtactatttacaaacagtaaatattacgaggaccacaatgttaacacatgtcttgttctgataatcagatatgtttccggtattgcgtgtaa

SEQ ID NO: 4419 - DNA, 1311 bp, Allium cepa
atagaaagagaggcgttgatctctgagaattcagaggatgatttggcgagggagaacgagagagatggaggagatggggaagtgaatattttgggagggggcagtggtaatgttatcaacaataacggttcaagtaatattttggagggtgatgcgaacaataatggtagcggtaatggtggcggtaataataatagcggcagtggaggcgattctacttcacagagatatgacatacagcaggttgcaaggtggattgagcagattttaccgttttcgctactgctgttggttgtttttatacggcagcacttacaaggtttttttgtcacaatttggattgcagcagtgatgttcaagtcaaatgatgtgttgaggaaacagacggctctaaagggagaaaggaaaatccctatgcttattggaattgcacttgttttcacgattcatgtttttggtgtttattggtggtacaaggatgatgatctgttatatcctcttgtccttctccctcctaaggaaataccaccattttggcatgctatattcatcatcatggtaaatgatacgatggttcgtcaagcgacaatggtcctcaaatgtatactacttatgtactacaaaaatagcagaggtcgaaactaccgtaagcagggacagatgctaactcttgtggaatattttctccttttgtatcgagcactgttgcctgcaccagtttggtatagattcttccttaataaagaatatgggagcctcttttcctctctcactactgggttatatcttactttcaagcttacttcagttgttgagaaagttcagtctttctttgcagcattaaaggcattatcacgcaaagagatgcattatgggtcctatgcaaccactgagcaggtgattgcagcaggtgacttgtgcacaatttgccaagagaagatgcatgctcccatcttacttcgttgtaaacacatattctgtgaagattgtgtctctgaatggttcgagagagaaaggacatgtccattatgcagggctttagtaaaaccagccgatcttcggtcatttggtgatggttcgacaagtctatttttccagctcttctaatatgatatattcttggaggttgcaattataattatggcatgctttcggctttttgggtagaaaggtggttgtccatatgtaactcattaatgcagttatattttataaacttttctaaacgggcagagtaaaattgtacaaatagtatataaatatctctatatatacactaatgtttctgaaatagaaaaggtttgctaaagc

SEQ ID NO: 4420 - DNA, 1359 bp, Musa acuminata
attcgggcggcgatgatggagacctcaggcgcaagctccgatccctacagaagccaggccggtggcggaggcggttcgtcgaggaggttccggatccggttttcgccgtccaatttgatccgggcgccgctctcgacgctgttggagtactccgggatcttgcggactcgggcgggccactcggagggcgagatcatggtcggtgagtccatgcgcgaccatggccctggtcggattggggagtcctctctccctggcgtcggtggaagcggcagcggggaggtggctataaggataattgggctgcttggcactttgcctgaaaggcatggaagagatggagggagcgatattggcgttggggaaataggaccttcttcttcttctttgccggcatccatcttgggcggcggcggtcagagcgcggatggtgaggtgaacaatgcaggtggtaacggcagagattcagcataccagagatatgacatacaacaggttgctaggtggatcgagcaggtactgccgttctcgttgcttctattggtggtgttcatcagacagcatctgcaaggtttctttgtcactatctggattgctgcagtgatgtttaagtcaaatgatattttgagaaagcaaactgctttaaagggagagcgaaaaatatctctacttgttggaattacactagttttcatgattcatgtgtttggagtctactggtggtacaggaatgagggccttctgtatccactggtcatgcttcctcctaaagaagtacctccattttggcatgccatatttattatcatggttaatgatacattggtgcgccaggctgctatggtggtcaagtgtgtgctcttgatgtattacaaaaatagtaggggccgtaaatatcgtaagcagggtcaaatgctaactcttatagagtatttcttgctgctgtaccgtgccttgttgccgacacctgtttggtaccgattcttcttaaacaaagaatatggaagcctcttttcttctctgactacaggactataccttacctttaagctgacttcagttgtggagaaggttcaatcctttgttgctgcattgaaggcactatcacggaaagaagtactttatggctcctatgcaacaatggaacaggtaattgccgctggcgatctgtgtgctatttgccaggagaagatgcatgctcctatcctactcagctgtaaacacatcttctgcgaggactgcgtctctgaatggtttgagagagaaaggacatgcccgttgtgtagagcattggtgaaaccagcagaccttaggtcattcggcgatggttccacgagcttatttttccagctgttctga

SEQ ID NO: 4421 - DNA, 2077 bp, Musa acuminata
ctgttgtcccccgatctcttcccttcggcagctgggcggatagagaaagcgactcccagcgctcatcatctatgccggtttcttcttcttcttcttcttctgcgctcgatcgggttacttagggttttcgagaactctttccgcatcgatcgaaaccctattctccgtccgactaggtccgatcgatcgattgcccttctttaagctttctcttgctccgatttgcggtccgatgatggaagcctccggcagaagctcgaatccctaccgaagccagtccgcctcctccggcagcggttcttccaggtggtatcgggtgcagctgttggcgtccaatttcatccggtcgcgtctttccgacgttttggaccactttggggtcttgcgacccagggcgagtcacgcggaggccgagggcttggtcggtggtgagtctcgcgtccatgcttccggtcggattggtgggtctgcggcctctaccggcagcggtggggaagtgtctatacggattattggagtgggcgatcaggagagtctgcgggtgggatcgacccagccacatcctctggtagtggggtctggaagagagggaggttctaatgtttctggcgtctcaggtgagcccattgctactttttcggagaggcgaggaggagatggagggagtgatactatggttggtgagtcagcctcgtcatcttcttctgcgtcggcatctgtaccgcctgttggtagtaggagcatggatggagactcaaacatcacaggaggcaataatagagattcaacctaccagagatatgatatacagcaaatagcaaggtggatcgaacagatactaccgttctcgttgttgctactggtagtcttcatcaggcaacatttgcaaggcttctttgtcactatttggattgcagcagtgatgtttaagtccaatgatattttgaggaagcagactgctttaaagggtgagagaaaaatatctgtcctcattgcaatcacactagtcttcatgattcatgtatttggagtctactggtggtacaggaatgatgatcttctataccctctggtcatgcttcccccaaaggaaatactgccattttggcatgccatttttatcatcatggtcaatgatactatggtgcgccaggcagctatggttgttaagtgttttctattgatgtactacaaaaacagtaggggacacaactatcgaaagcagggacaaatgttgacgcttgttgaatacttccttcttttgtaccgagctttgttgccaactcctgtttggtaccggttcttcctgaacaaggaatatggaagcctcttttcatccctcactacagggctataccttactttcaagctgacatcagtggtggagaaagttcaatcatttttttctgcattgaaggcgctatcacggaaggtacattatgggtcttatgcaaccacagaacaggtgattgcagctggtgatctttgtgccatttgccaagagaaaatgcacgctcccatcttacttcattgtaaacacatcttctgtgaggactgtgtctctgagtggtttgagagagaaaggacgtgtcctctgtgcagggcactggtcaaacctgcagatctccggtcatttggtgatggttccacgagcttgttctttcagatgttctagttcaggtcatcagctacatatactgagcctgggatacagcattatggccaggaattagcaagcaggcttcttaccacattgtggtgtatatgttacggtgttctgacagcagctgaagctttctgtaaatgtcaccgctgctcgagttgattgctgtaaccaatctatatatgcccagtatggaatatcatgaaacagaagcaagagaagtttgacggcatttacagtataaatacgcatctacctcacattattgtcaataaaatgtccgcagcatatatttttcagtgagttagttgatggtcattgtcgatcagagacgatgatcaagtcgggcattcggtcatgcggacaaccaatcaaacttccgcatggtgcctgatttgtagataaaaatatcag

SEQ ID NO: 4422 - DNA, 1954 bp, Secale cereale
aagtggggatctcccgaacttctccgtctccgcctccgcgtgcgccgtcggcttcgcctttctaggtttcttccgccggttatggagacaccggcgggaggttccgccgatcgccgggtaaccgggtctggcgcctccgccggtgctgcggcttctggcctcagccgctacggtctcaatttctccgcctccagccttctccaggctccgctcgccgcgctcctcgagtactcaggcgttgtcccctccgggcccgtcccgcaggcggtgcagcaggcggtaccctcctcctcgtcgtcgtctgaggctgacgggctactttctgccgccgctgctggggatggagaggtctcgattcggatccagggtggccccggcgaccctgacacggcgagcgcgacggttacaggggcctcgccgcaggactcgattgaggtggctgcttccaactttgaccaggcctccggtggggggaaggggaggcggtgctgatgcggaggcaagcggcggtggcagtggtggtgctactgggaatggggccggggaccgcccatatcagcgttacgacgtgcaccacgttgctcggtggatcgagcagatactaccattctcgctgctgttgctcgtcgtcttcattcggcagcatctccaaggtttcttcgtcacaatttggattgctgctgtaatgttcaagtcaaatgatatattgaagaagcaaactgctttgaagggtgagagaaaagttgctatgcttgttggaatcaccataatcttcatggtccatgtgtttggcgtctattggtggtacaggaacgattatcttcttagacctctgttcatggttcctccaaaagatataccaccattctggcatgcaatttttatcatcatggtcaacgatacaatggtccgccaggcagcgatgaccgtcaagtgcatgctacttatgtactacatgaacagcagaggccgtaactaccgtaggcagggacaaatgctaacacttgtggagtaccttctgcttctatatcgtgctttattgccgactcctgtttggtaccgtttctttctgaacaaggaatatgggagtctgttctcatctttaactactgggctatacctgactttcaagttgacttcggtagttgagaaggttcaatcattcttatctgcagtgaaagcattgtcacgtaaagatgtgcactatgggtcttatgcgacagcagaacaggcaattgctgccggtgatatgtgtgccatctgccaggaaaagatgcatgttcctgttctccttcgctgtaaacatattttctgcgaggactgtgtctctgaatggtttgagcgagaacgaacttgccctttgtgtagagcattggtaaagcctgctgacattcggtcatttggtgatggttctacaagtctcttcttccagttgttttagagcccaaatgacaaaccctaacacataacaatcgatgacaagcaatgggctataaggaaagtccaggtggaagtccttttgtctttatgatgtggcaccatcttccctgtgtggaatgaggatactgagaatgtttgtgaaaattatctcactgcaactattacattcatccatatgttcaagcaatggtcggagagctggtcagttgcggcatttgcacaagtttgcaacagaaggaaatatagctggaggaatctgctcctgtgaaccctgaagtgccggaccacatcttgctattgacttgcgtaatgtaaatttggtaactttttacagaagtgaatgcgttttggtttaattcgagcttgcaagttttgcatgctagcgagaattttgtttgagaaaggggtagaaatgtaacctgtaaatctgtgatacatgaaatgttgagaacagtgtactatttacaaacagtaaatattacgaggaccacaatgttaacacatgtcttgttct

SEQ ID NO: 4423 - DNA, 2048 bp, Sorghum bicolor
gaagggtgctattgtgaaggcagacgccgaaccataaacaaaaggtgaagaagaccaaacccaagccaacgaatctcccgaatctcccgttcgagaggtctccgcgtcgtcgggcccgctccgcgtgcgacgccggcatatagggtttcgccggcgacggcgatggacccaccggctgggggctccgatcgccgggggcccagtcagagcgctggcttcgcgccctctggcctccgccgatatggcctcaatttctccgcctccagcctcctccaggcccccctcgcggtcctcctcgagtactccggcgtcgtccagtccggccctgccctggcggcgcaccacccgtccgcgggtccctcgtcgccgttgtcggcgtcggaggttgatggccttctctccgctgccgccgctgtggacggggaggtttcgatccggatccagggcggcccaggcgacacggaggccacgggcgggccggccgcggggacctcgtccgaggacttgatcgagacgaccgccggctctgaggtggaccaggcgtccgctgcgggcaggggagcaggcgctacggacgcggaaacaaacggtggtggggccggcacgtcggggaacgggggcggggaccgcgcgtaccagcggtacgacgtgcaccacgttgcgcggtggatcgaacagatattgccgttctcgctgcttctactcgtcgtcttcatacggcagcatctccaaggtttctttgtcacaatttggattgctgcagtaatgttcaagtcgaatgatatattgaggaagcaaactgctttgaagggcgagagaaaaatatctgtactcattggtattacagtaatcttcatgattcacgtgtttggcgtatattggtggtacaggaatgatgatcttctcagacctttgttcatgcttcctccaaaagatataccaccattctggcatgcaatttttgtcatcatggtcaatgatacaacggtccgccaagcagcaatggctgtcaaatgcatgctacttctatactacaagaactgcagaggtcgtaactaccgtagacagggtcaaatgttaaccctcgtagagtaccttctgcttctttatcgtgctttgttgccaactcctgtttggtaccgtttctttctgaacaaggaatatgggagtcttttctcatctttaaccactgggctgtatctgactttcaagttgacttcggttgtcgagaaggttcagtcattcttggccgcagtgaaagcactttcacgcaaagatgtgcattatggatcttatgcgactgcagaacaggtacttgctgctggtgatatgtgtgccatttgccaggaaaagatgcatgtgcctgttctccttcgctgtaaacatattttctgtgaagactgtgtttccgaatggttcgagcgagagcggacttgtcccttgtgtagagcgttggtaaagcctgctgatattcggtcatttggtgatggttctacaagtctattcttccagttgttctgactgcaagcggtaaaatcctaacataaccatggacaagctataacataaggagaactcgagtggaggtccttttctgttatcatgtgaaatcatcttcctcaatgttgagatcaatgtgagaagcgttcagacagtcacatgacagtgcaagtcgttatgtttgtatatatcttcaagcaaatagtttacagtgctttttagttgcaacagtggtaaaatgtttccagcaaactgctttcagagcctatagaatcctgccggacaaacgatttgaacgttgaggtcgggtgagaccgacagctgtaggcctcatgtaaaactctggtattttttttgcacatgtgggcttacctgggtgtaactgaaatttgaaagtgccgcctgtggcttgcacagcaagaattgcctgtcgaatggaaagtggtaaaggaatgtaactgtaagtgttgttacatggaaattgttgaaaaccacagtagaaattttcacccgttgcaacgtagtaaatgctgagaaacgcgacatgt

SEQ ID NO: 4424 - DNA, 1213 bp, Amaranthus tuberculatus
gaggaaaatgccagttctggttggtatctgtactttgttcactcttcatgttgctggtgtttactggtggtatcgaaacgacgatcttctctatccactgattatgcttcctccaaaagagatacctcccttctggcatgctgtttttatcatcatggtcaatgataccttggtacgccaggcagctatggttgtcaaatgccttctccttatgtattacaaaaatagcagaggaagaaattaccgtaggcagggacaaatgttgactttggtggagtatttgttgcttctttatcgtgcattattgccaactccagtttggtacagattctttctgaacaaagaatatggaagcttcttttcgtcactaatgaccggattgtatttgacttttaagctcacttctgttgttgaaaaggttcaatcattttttacggcagttaaggctttgtcacgcaaagagatccattatggggcttatgcaacatcagagcaggttactgcagcaggggatatgtgtgctatttgccaggaaaagatgcatgctccaatcctacttcgttgtaaacacattttttgtgaagattgtgtgtcagagtggtttgaacgggaaagaacatgtcctttatgcagggccttggtgaagccagccgatctaaaatcttttggtgatggatcaactagcctatttttccagttattctgaacaaggagtttcttttctttgaatccttgcttcgtcgagaatccaattatgaagcattcataactaaaagatggtgcggttaatgctgcactgctggttgtctacaggaatcaaagtctcaaattgacacataacttgacaggacctttgtttatatgctgtattaaaacactatctacttgtatctaagttagctcgtaaatttatagagattacattcaaatgatgtatacaactgtgcaatcttcagtaatggacgttctctgaaggaagcttcgtgtgtcctatcacctatgtgccacccagttgaatagtttgtttcctcatttccactgattgagtttgactgtttgttatctaattttactcaaatgccttttaagttttaacccatttttcagtgttttggaaagctggaaccagtacactttcttggcgttctcgattcattggtctttgaactctagttgttttattctttataatcaatgacttgattgtgctgtc

SEQ ID NO: 4425 - DNA, 2141 bp, Malus domestica
gaattcattgtttagagagggtacattgttagttgttgggggtgattggccacttctctcttctcgcgctgttcctcatcgagcgagaaagagaacacaaaacacacaaacaaatccaccaatctccatttccaatttccaccaaggaccacacacccaaccctaatctgcatttctgtgctccaaaccctagcctcctcgtctctacccatttctcaatttcctctaaccatcgatcgcctctgcccaatccccaaaattccgcctttggcaccgccgccgacgaacttccctccgcaatcggtttcgatttagggttcgggcttgttcgatgctatctctctcccctgacaactccatcgccggttcgcttacgcagggttagggcaattaggcaaatggaagggtcgggtggcaatcttgactcgtttagagcttctccgggaagcagtagtaataggagatatggggtgttatcggcttccaatatcattcgggcgccaatttctaccttattggagtactcgggtattctccgcggccgcactaatcaccaagaaggcgagtctttgattaacgggcgtagtgctgctgcgtttagggatcaccgtcatagtcagctagatcagtcaccgacaacgacaagcaatgatggggaggtttctattaggataattggtgcaggggaacaggagcatgatagggaaggacctgggatagtagctggacagttgagggaagttactgcaccgccaaatgatgtttctgtaccaccaatggctggggcggcctctgtagcattgggaacggaggaggtgggtcagacagatggcagaacggatcgtagttcgggagagggaattccccaatcgttaaatggaagtgctgctggagaaggaggtgatggaactggggctaatggcagggattcttcttaccagagatatgacattcagcaggctgctagggggattgaacaagtcctgcccttttccttgcttctattggtggtcttcatccgccagcatttgcaaggtttctttgttacaatttggattgctgtcgttatgttcaagtcaaatgatatattaaagaaacagacagctttgaagggagagaggaaaattgcagttctaataggcatttctcttgcattcgtgttgcatgtggttggtgtttactggtggtaccagaatgacgatcttttgcatccattaattatgcttcctcctaaagttataccacccttctggcatgctgttttcatcatcatggtgaatgacaccttggtccggcaggcagcaatggtgctgaagtgttttctattaatgtactacaaaaacagtagaggccgaaactatcgtaagcagggtcaaatgcttactctggttgagtatctactgctcttgtaccgtgccttgttgccaacaccagtgtggtatcggttcttcttgaacaaagaatatgggagtctcttttcgtcactaatgacagggttatatttgactttcaagctcacatctgttgttgagaaggtacaatccttctttgctgcattgaaggcattgtcacgtaaggaggtgcactatggggcatatgcaacatcagaacaggtcaatgcagctggcgatttatgtgctatttgccaggagaagatgcatgctcctatcctactgcgatgtaaacacatcttttgtgaggactgcgtatcagagtggtttgagagggagcggacgtgcccgttatgcagagctttggttaaacccgcagatatcagatcattcggcgatggatcaacgagtttgtttttccagctgttctgaagcaaccatccactgtaaaaaaaaaaggaacccgaagagtttttctgttttggagctccagctcatattggaagcagccatctcccaaatccgtatcctcataactatacactggtgtattcgattgtaatttttggtctgccttgttcacgtcttgccctcgcaaaaatattagaacggtcgggtataactgaacttggtactgttcatacgtcgtatcgagaaaatgtcaaatgtatgtaatgcgccaatttaagcaacagaagttgttttgatcacacaccattactataaatatctgtttattttgccatttta

SEQ ID NO: 4426 - DNA, 708 bp, Persea americana
atgatgatcttttatacccattgatcatactgcctccaaaagccataccaccattctggcatgcagtattcatcatcatggtgaatgataccatggtgcggcaggcaggtatggttgttaagagtatacttctgatgtattacaagaatagcagaggccgtaattatcgcaaacagggtcaaatgctaactctagtcgagtatctcctgctgttgtatcgtgcattactaccgacacctgtctggtatcgattcttcttgaacaaggaatacgggagcctcttttcatctcttaccacagggttatacctgacttttaagctgacatcacttgttgaaaagatccagtgcttcttcactgctttgaaggcattgtctcgtaaagatgtgcattatggttcttatgctacacctgaacaggtcattgcagctggcgatctgtgtgccatttgccaggagaagatgcatgcaccaatcttgcttcggtgtaaacatatcttctgtgaggattgtgtatctgaatggtttgagagagagaggacttgcccactgtgtagagctttggtgaagccagcggaccttagatcatttggtgatggttcaacgagtttgttctttcagttattctaagtcagctgatgatggaagcttgcttgagagcatgaaaacgtcattgtgtctcgaccttctctcatgggtaaattcattg

SEQ ID NO: 4427 - DNA, 1949 bp, Hordeum vulgare
gcccgaacttcccatttcaggggtctccgcctccgcgtgtgccgtcggcttcgcttttctaggtttccgccgccggttatggagacaccgtcgggaggttccgccgatcgccggggaaccgtgtctggcgcctccgccggtgccgcggcttctggcctcagccgctacggtctcaatttctccgcctccagccttcttcaggctccgctcgccgcgctcctcgagtactcaggcattgtcccctcggggcccggtccgcacactttgcagcaggcggtaccctcctcctcatcgccgtctgaggctgacgggctactttctgccgccgctgctggggatggagaggtctcgattcggatccagggtggccccggcgaccctgacgcgagcgcgacggctacaggggcctcgccgcaggactcgattgaggtggctgccgcctccaactttgacccggcctccgtggcgggaaggggaggcggtgctgatgcggaggcaagcggcggcggcagtggcggtgctacggggaatggggtgggggaccgcgcgtatcaacgttacgacgtgcaccacgttgctcggtggattgagcagatattaccattctctctgctgttgcttgtcgtcttcatacggcagcatctccaaggtttctttgtcacaatttggattgctgctgtaatgttcaagtcaaatgatatattgaagaagcaaactgctttgaagggtgagagaaaagttgctatgcttgttggaatcaccataatcttcatggttcacgtgtttggcttctattggtggtacagaaacgatgatctttttagacctctgttcatggttcctccaaaagatataccaccattctggcatgtaatttttatcatcatggtcaacgatacaatggtccgccaggcagctatgactgtcaagtgcatgctacttatgtactacaagaacagcagaggccgtaactaccgtaggcagggacaaatgctaacacttgtggagtaccttctgcttctatatcgtgctctgttgccgacacctgtttggtaccgtttctttctgaacaaggaatatgggagtctgttctcatctttaactactgggctatacctaactttcaagttgacttcggtagttgagaaggttcaatcattcttatctgcagtgaaagcattgtcacgtaaagatgtgcactatgggtcttatgcaacagcagaacaggcaatcgctgctggtgatatgtgtgccatctgccaggaaaagatgtatgttcctgtcctccttcgctgtaaacatattttctgcgaggactgtgtctctgaatggtttgagcgagaacgaacttgtcctttgtgtagagcattggtaaagcctgctgacattcggtcatttggtgatggttctacaagtctcttcttccagttgttttagggcccaaatggcaaaccctaacacataataatcgatcacaagtaattggctataaggaaagttcatgtggaagtcgtttgttctttatcatgtggcatcatcttccctccctgtgtggaatgagtatactgagaatgttttgtgaaagttatctcactgcaaccattccattcaaccatatgttcaagcaatggttggagagctggtcagttgcagcatctgcataagtttgcaacagaaggaaatatagctggaggaatctgctcctgcgaaccctgaaaagccggaccacatcttgctattgacttgcgtaatgtaaatttgggaacattttttttacaaaagtgaatgtgtcttggtttaattcgagcttgcaagttttgcatgctagcgagaattctgtttgagaaaggcatagaaatgtaacctgtaaagctgtgatacatgaaatgttgagaaccatatacattgtactatttacaaacagtaaatattacggggaccacaatgtt

SEQ ID NO: 4428 - DNA, 1683 bp, Cucumis sativus
gccattcacccgaatggaagggtctggtagcgaccccgactctcatagagctgcttccaccagtggtagttcaagaaggtttggaatgttagctgcctcaaatattattcaggctccgctttctgcactattagagtattcgggtcttcttcgtggccgtcaaagtcatcaagaatcagaggcattgataagtgctcgactgccttcggggtttcgagaccatcttcgcagccatattgaagaatcttcgggtgccaccaatgatggagaggtttcgattaggataattggggcaggggaaccagaacatggtagggatggtgctggactagtagttgggcaagcgagggatgttagtggtcagaatgcggtgtctttgcaatctgtttcagggttggcttctgtgaccttggggtcggagcttagccagggtgagtctgccaatgaacgcggtgcaagagagggtattcctgaatcgataaatgcaggtgctgatggagatgcctcggaggcagctggaggaaatagcagggattcttcttatcagagatatgacattcaacaggctgctcgggggattgagcagatactcccatttagttttcttctactggtggtcttcattcgacagcatttgcaaggcttctttgtgacaatatggatcgctgctttcatgtacaagtcaaatgatattttgcgaaaacaaacagctttgaagggagagagaaaaatttctgttttggtttgcatttctcttgcgttcactattcatgttattggtgtgtactggtggtatcagaatgatgaccttttatatccgttgatcatgtgtcctcccagagcgattcctcctttctggcatgctattttcatcattatggtgaatgacactttggtccgtcaggcagtgatggtggtcaagtgtgttctattgatgtattacaagaacagtagaggtcgcaattatcgtaaacagggtcaaatgctaactttggtcgaatatttgctactactgtaccgtgccttattgcctactcctgtttggtatcgtttcttcttgaacaaagagtatgggagtctattttcgtcactattgacgggactatacttaactttcaaactcacatctgttgttgaaaaggtgcaatccttctttgctgctttgaaagcactgtcacgtaaagaggtgcattatggggcatatgcaacatcagagcaggtcagcgcagcaggtgatttgtgtgctatttgccaagagaagatgcatgctcctatccttctccgatgtaaacacatattttgtgaagattgtgtatcagaatggtttgagcgggaacggacatgtccattgtgtagggcgttggttaaacccgcagatctgaggtcatttggtgatggatcaacaagtttgtttttccaggttttctaagccatttacttcaaagcccctcagaaggctttgtagtttgaagaggtgaagggaagccagccaattgcatttgtttacccctacacaaaattgtacatctaactaaatactgtgtagctgctgccaattgaggaagcaaaagactggggcttgtgaagttggaaaggcaaattcaaaatcgacatttatacatattatagtcctttttgtgctacagcaaagaacggtggatgttcgagaggagtttaaccctt

SEQ ID NO: 4429 - DNA, 1809 bp, Eschscholzia californica
atgttagggtttgggaaatgaattgtttaatctgatttggttggccatcgaaggagcttcagctttgtgaagaagggttagtgtgtttatttgaaatggatacttctaatagcaatccggacctgtatagaagttcttctggttctggtagtagtaattcaagaagatttgggatgcaattttctgctgcgaattttatccaggcacctttatcagctttattagagtattctggagttcttcgaacaagatcaagtcatcaagaaacggaaagcttgattaatggaagtaccttatctagtatacgtgatcgaattcagaatcgtgtggatgatcctggtccagccagcagtggtggggaggtttcgatacggataattggtgctgcagaccaagaaagagatggtgaagtagttgaaaatgctggctctgtcgaacagattactggacctttatctgaagcagtattggatcgtcagagtaatatgagtaatgaaggccgaaacagtgaagggtctttgttatcatcctcttcgtcatcgataggggcgggtaattctagtaatgaaagtaatggcggggaagccggtgatgggacggcaggtaatagggattcatcttcccaaagatatgatattcaacaggttgctaggtggattgagcaaattttgcctttctctttgcttctgttagtggttttcatccgacaacacttgcaaggtttcttcgtggcgatctttattgctgcggtgatgttcaaatcaaatgatattttacgaaagcaaacagcattaaagggagagagaaaaatgtcttttctcgttgctataactatagcattcatgcttcatgtagttggcgtttactactggtatcgaaacgacgatcttctatacccattagtcatgcttcctcccaaagaaataccacctttctggcatgctatattcattattatggtgaatgacacaatggtgcgtcaagcagcaatgatcctaaagtgcgccctattgatgtattacaagaatagcagaggccgtgattatcgtaagcagggtcagatgctaaccctggttgaatatatgctcttgctgtatcgtgcattattaccaactcctgtttggtatcgtttctttctaaacaaagaatatggaagcctcttttcatccctaactacaggattatatctcactttcaagctcacatcagttgttgagaaggttcagtctttctttactgcattgaaggcattgtcgcgtaaagaaattctttatggatctcacgccacgtctgatcaggttaatgcggcaggtgatctttgtgcaatttgccaggagaagatgcatgcaccaatcttacttcgctgcaaacacatattctgtgaagattgcgtgtctgagtggtttgagagagaaagaacatgcccattatgcagggcattggtgaaacctgcagatctcagatcatttagcgatggatcaacaagcttgttcttccagttgttctaaagaccgttctctttcgttactcgccacagcaaaatcacaagatgccttttgttgtttctgaagctcaagaaaaatattttccatagaagcaggccccttataatatatggttagcaacggatactcgttatatatattttcatacttgtttttgacgtaattgtgtagttaagcacggaagaaaaaggatgatgatggtataagttggtgggttcatggaactgaaaaagggttagccccctgatgtctgtctgtataagtatattgttatatgatgatgaggaggggtttcaaactcaaa

SEQ ID NO: 4430 - DNA, 2022 bp, Pennisetum glaucum
cggaggggatctcccgaatctcccattccagaggtctccccgccccgtgcgctgccggcatatagggtttcgcagtcgccgctgtcgccagtgatggacccaccggcggtgggttcccccgatcgccgggggagcggaccggccgctggcgctgcaccttccggcctccgccgctatggcctcaacttctccgcgtccagcctcctgcaggccccgctcgcggcgctcctcgagtactccggcgtcgtaccctccggcgccgccccgcaggcaccgcaccacccatccgccgcgccttcttcgccgtcgtcggcgtccgaggtcgacggcctcctctccgccgcggcagccggggacggggaggtctcgatccggattcagggcggcccgggcgactccgaggccgcgggcggggcggccacggggacctcgtccgaggactcgatcgaggcgacagctggctcggaggttgaccaggcatccgccgccgggaggggtgcaagcagcgctgacgcggaggcgaacggcgcgtcggggaacgggggcggggaccgcgcgtaccagcggtacgacgtgcaccacgtggctcggtggatcgagcagatactgccgttctccctgctcctgctcgtcgttttcattcggcagcatctccaaggtttctttgtcacaatttggattgctgctgtaatgtttaagtcaaatgatattttgaagaagcaaactgctttgaagggcgagagaaaagtacccgtactcattgggattacagtgatcttcatcattcatgtgtttggtgtctattggtggtacaggaatgatgatcttctcagaccgatgttcatgcttcctccaaaagatataccaccattctggcatgcaatttttatcatcatggttaatgatacaatggttcgccaagctgctatggctgtcaagtgcatgttacttatgtactacaagaactgcagaggccgtaactaccgtagacagggccaaatgcttacccttgtggagtaccttttgcttctttatcgtgccttgttgccaactcctgtttggtaccggttctttctgaacaaggaatatgggagtctcttctcatctttaaccactgggctgtacctgactttcaagttgacttcagtagttgagaaggttcagtcattcttagctgcagtgaaagcactgtcacgcaaagatgtgcattatgggtcatttgcaactgcagaacaggtacttgctgctggtgatatgtgtgccatctgccaggagaagatgcacgtgcctgttctccttcgctgtaaacatattttctgcgaagactgtgtttcagaatggtttgagcgagaacggacgtgccccttgtgtagagcactggtaaaaccagctgatattcgttcatttggtgatggatcaacaagtctattcttccagttgttttagactccaaatggcaaatttctaacataacaagacaagccaattgcatatggaatattaagtggaggtcatttttttacctatgtgagacaatcgtcctcagtttagagatcaaggtgagaaggttcaggatgataacatgccagcacgaatcgtgatatgttaagctttgtttagagctgttcagttgcaacatgaggcaaaatatttccagcaaattgcttccagagcctgttgtgttctgctggaccttcttaatgtgaaggtctgttgcttgatgtaaaaagcgggtaatttttgcacgtgtggatttacctggatgtaactgaaacctgcaagttctgattgcaggaggattgacttgcacaggcaagcaagaattatctgtcggtggaaagtggtaaaaaaaaaagtgtaacctgtaaagcattttcacgcgtatacagaagtggcctttgcaaatcaatcagcacgtaaatagtaaatgctactagacacagcttatttgcaaattttgtaaatctgttgtgcagtttgctatatacactgtaattgtatgtatgtgcggatccagtctgt

SEQ ID NO: 4431 - DNA, 1161 bp, Allium cepa
  misc_feature (689)..(689): n is a, c, g, or t
atagaaagagaggcgttgatctctgagaattcagaggatgatttggcgagggagaacgagagagatggaggagatggggaagtgaatattttgggagggggcagtggtaatgttatcaacaataacggttcaagtaatattttggagggtgatgcgaacaataatggtagcggtaatggtggcggtaataataatagcggcagtggaggcgattctacttcacagagatatgacatacagcaggttgcaaggtggattgagcagattttaccgttttcgctactgctgttggttgtttttatacggcagcacttacaaggtttttttgtcacaatttggattgcagcagtgatgttcaagtcaaatgatgtgttgaggaaacagacggctctaaagggagaaaggaaaatccctatgcttattggaattgcacttgttttcacgattcatgtttttggtgtttattggtggtacaaggatgatgatctgttatatcctcttgtccttctccctcctaaggaaataccaccattttggcatgctatattcatcatcatggtaaatgatacgatggttcgtcaagcgacaatggtcctcaaatgtatactacttatgtactacaaaaatagcagaggtcgaaactaccgtaagcagggacagatgctaactcttgtggaatattttctccntttgtatcgagcactgttgcctgcaccagtttggtatagattcttccttaataaagaatatgggagcctcttttcctctctcactactgggttatatcttactttcaagcttacttcagttgttgagaaagttcagtctttctttgcagcattaaaggcattatcacgcaaagagatgcattatgggtcctatgcaaccactgagcaggtgattgcagcaggtgacttgtgcacaatttgccaagagaagatgcatgctcccatcttacttcgttgtaaacacatattctgtgaagattgtgtctctgaatggttcgagagagaaaggacatgtccgttatgcagggctttagtaaaaccagccgatcttcggtcatttggtgatggttcgacaagtctatttttccagctcttctaatatgatataattcttggagggtgcaattataaattatgcatgctttcggctttt

SEQ ID NO: 4432 - DNA, 1989 bp, Cajanus cajan
tctctctcccttaccctctcctctctctgtggcgcttttccctgcacaccacagcagagacccactccgcactccccctaaccctaaccctaaccctaacccctctttcatgcttcccaattagggttatggaagggaacaacgccgacctcttcagaccctcctcctccccctccgcctccccccgccgctactccgccatcctctccccctccaccatcatccaggccccgctctcgctgctcctcgaatattccggcatcctcccccccaggtccaaccaccacacccaccccacccccgacgccgtcaacaacgacgccggcgaggtttccattaggatcatcggctccgcggagcaggagcagcagcagcagcagcaccaccacaatcatcatcagcatcatcccagggaggacgaaactacccctctcgccgggggaaacgacgccgtgttggcctcgacgtcgcctcgcggcgacgccgagggggataccgcctggagggattcgtcttaccagagatatgacattcagcatgccgccaggtggattgagcaggtgttgccgttttccttgcttctattggtggtcttcatcaggcagcatttgcaagggttttttgtgaccatttggattgctgctgtgcttttcaagtcgaatgatattctgaggaaacaaactgcgctgaagggagagaggaagataccggttttgattgggatttctgttgggttcgcgcttcatgtcgttggcgtttattggtggtatcaaaatgatgatctaatgtatcccttgatcatgcttcctcctaaggatataccgcctttctggcacgcgattttcatcataatggtgaatgatactttagtgcgccaggctgcaatggtattcaagtgtatattgttgatgtattacaagaatagccgtggccgaaattatcgtaaacagggccaaatgctgactttagttgaatacctcctcctgctttaccgtgccttgttgccaacaccagtttggtatcgtttcttcctgaacaaagaatatggaagcctcttttcatcactgatgacaggattgtatctaacatttaaactcacgtctgttgttgaaaaggtgcaatccttctttgctgcagtgaaggcattgtcacgaaaagaaatgcactatggggcttatgcaacatcagagcaggtcaatgcagctggtgatctttgtgctatttgtcaggagaagatgcatgccccaatcttgctacgctgtaaacatattttctgtgaagactgtgtctcagagtggtttgagagagaaagaacctgcccattgtgcagggctttggtaaaacccgcagatcttaggtcatttggagacggctctactagcctgtttttccagttattctgaaataatatataaatacaagccaggaagttttttctgctttgaagctttaccttttcaaagcagcagtggtaatcgtataatatacagcaacacatgtaaaatgctctagaggcaacgtggggatactcagaagatgaatgcagctgaatagaattaaagtggtcatgcgttcatataatgtactagtaaaaggatgagtgtatctaagtgaccctgtaaactaggaagttgattgaaaatataattaaatgagactcttcattggcaaggaatgaaggtgtctttctcctaattacatagcgattctgtgatatagtgcgaatcaaagtgtcaattttaaacatttattattttcaaatttctctttgtgggttctgaagcacaccttaaggagtgttgcccatggacagattatgattaaaaatctcacttcggttcatgtactaaatttgtggatactagtttatttttgtaatagtcaattggaccacaaggttaatgtattgctgatctccgtgtatcacggtattagaaagcaagtgtaagtccgtaatttgttcgagcctggttataaatagatgccctg

SEQ ID NO: 4433 - DNA, 2222 bp, Sorghum bicolor
gtgctattgtgaaggcagacgccgaaccataaacaaaaggtgaagaagaccaaacccaagccaacgaatctcccgaatctcccgttcgagaggtctccgcgtcgtcgggcccgctccgcgtgcgacgccggcatatagggtttcgccggcgacggcgatggacccaccggctgggggctccgatcgccgggggcccagtcagagcgctggcttcgcgccctctggcctccgccgatatggcctcaatttctccgcctccagcctcctccaggcccccctcgcggtcctcctcgagtactccggcgtcgtccagtccggccctgccctggcggcgcaccacccgtccgcgggtccctcgtcgccgttgtcggcgtcggaggttgatggccttctctccgctgccgccgctgtggacggggaggtttcgatccggatccagggcggcccaggcgacacggaggccacgggcgggccggccgcggggacctcgtccgaggacttgatcgagacgaccgccggctctgaggtggaccaggcgtccgctgcgggcaggggagcaggcgctacggacgcggaaacaaacggtggtggggccggcacgtcggggaacgggggcggggaccgcgcgtaccagcggtacgacgtgcaccacgttgcgcggtggatcgaacagatattgccgttctcgctgcttctactcgtcgtcttcatacggcagcatctccaaggtttctttgtcacaatttggattgctgcagtaatgttcaagtcgaatgatatattgaggaagcaaactgctttgaagggcgagagaaaaatatctgtactcattggtattacagtaatcttcatgattcacgtgtttggcgtatattggtggtacaggaatgatgatcttctcagacctttgttcatgcttcctccaaaagatataccaccattctggcatgcaatttttgtcatcatggtcaatgatacaacggtccgccaagcagcaatggctgtcaaatgcatgctacttctatactacaagaactgcagaggtcgtaactaccgtagacagggtcaaatgttaaccctcgtagagtaccttctgcttctttatcgtgctttgttgccaactcctgtttggtaccgtttctttctgaacaaggaatatgggagtcttttctcatctttaaccactgggctgtatctgactttcaagttgacttcggttgtcgagaaggttcagtcattcttggccgcagtgaaagcactttcacgcaaagatgtgcattatggatcttatgcgactgcagaacaggtacttgctgctggtgatatgtgtgccatttgccaggaaaagatgcatgtgcctgttctccttcgctgtaaacatattttctgtgaagactgtgtttccgaatggttcgagcgagagcggacttgtcccttgtgtagagcgttggtaaagcctgctgatattcggtcatttggtgatggttctacaagtctattcttccagttgttctgactgcaagcggtaaaatcctaacataaccatggacaagctataacataaggagaactcgagtggaggtccttttctgttatcatgtgaaatcatcttcctcaatgttgagatcaatgtgagaagcgttcagacagtcacatgacagtgcaagtcgttatgtttgtatatatcttcaagcaaatagtttacagtgctttttagttgcaacagtggtaaaatgtttccagcaaactgctttcagagcctatagaatcctgccggacaaacgatttgaacgttgaggtcgggtgagaccgacagctgtaggcctcatgtaaaactctggtattttttttgcacatgtgggcttacctgggtgtaactgaaatttgaaagtgccgcctgtggcttgcaaaaaaaaaaaaaagaaaaagaaaaagaaaaaaagaaaagaaaaaagtaaaaaaaggtgccgcctgtggcattgacatgcacaggcagcaagaattgcctgtcgaatggaaagtggtaaaggaatgtaactgtaagtgttgttacatggaaattgttgaaaaccacagtagaaattttcacccgttgcaacgtagtaaatgctgagaaacgcgacatgttcacagatctgctaaatcatctacagttctacactgcttgttatgtgtagtagggacctgattggccggctctcaggcggctccatgatacagtt

SEQ ID NO: 4434 - DNA, 2099 bp, Glycine max
aatggttgcttctctctttttcttgtatggtttgtcgtttgtcttgtacccaacccatctttgtttctctctctctctctctctcaagcttttccctgcacaccacagcagaagagaaagaaagaaaagaagacccatcccacccaaccaccctctttttcccttcaaccaccgccttcactcccctcgttaacctaacctaaccctaattcttcgtcttcaccgtccataaccccaaaccctagcccctctttcatgattttttagggttatggaaggcaacaacaacaacaacaacaacaacgctgacgtgttcagaccttctgtggggccctcctcctcgccgaactcgaggagatactcggggattttatcggcgtcgaacctcattcaggcaccgctatcggcgctgctggaatattccggcatccttccgtcacggtcgtccaaccaacacagccagcccagctccgacgccgccaacaatgacggcgaggtttcgattaggatcatcggcccggcggaacaggagcagagggaggaacaacagctgcagcagacccctcctcccggattggtcgtcggactctcgcattcccagaacgacaccgttttggcatcggggtcgccgcgcggcgacgccgagggcgcggcggggaccgagggcgccgccgctggaggggacggtgcagggagggattcatcttaccagagatatgacattcagcatgccgccaggtggattgagcaggttttgccgttttcgttgcttctgttggtggttttcattaggcagcatttgcaagggttttttgtgaccatttggattgctgctgtgcttttcaagtccaatgatattctaaggaaacaaactgcgttgaagggggagaggaagatgctggttttggttgggatttctgttgggttcgcgcttcatgtggttggtgtctactggtggtatcagaatgatgatctaatgtatccattgatcatgcttcctcccaaggatataccgcctttctggcacgcgattttcatcatcatggtcaatgatactttggttcgccaggctgcaatggtattcaagtgtatattgttgatgtattacaagaatagcagaggccgaaattatcgtaagcagggtcaaatgctgactttagttgaatacctcctcctgctttaccgtgccttgttgccaacaccagtttggtatcgtttcttcctgaacaaagaatatggaagcctcttttcatcactgatgacaggattgtatctaacatttaaactcacgtctgttgttgaaaaggtgcaatccttctttgctgcagtgaaagcattgtcgcgtaaagaaatgcactatggggcttatgcaacatcagagcaggtcaatgcagctggtgatctttgtgctatttgccaggagaagatgcatgctcccatcttactacgttgtaaacatattttctgtgaagattgcgtatcagagtggtttgagagagaaaggacctgcccattgtgcagggctttggtaaaacccgcagaccttaggtcatttggggatggctctactagcttgtttttccagttattctgaaatcatatataaataccaaccaggaagtttttttctgctttgaagctttactttttcaaagcagcagtcacgatctatatacatcaacacatgtaaaatgctctggaggcaattgtggggatactctttgaagatgaatgcagctgtatactggtcatgcgttcatataatgtactagcaaaaaaggttgagtgtatctaaatgaccctgtaaactaggaagtcgattgaaaatataatattaaacatgactcttcatttgcaaggaatgaaggtctttctccgaattgcatcacgattctgtcatatagtgccaaatcaaactgttaattttaaatatattttttatttttgaatctctctttatgtgggctttgatgcacacctcaaggagtgttgcccacgggcagattatggttaaagatctcgcacttcatgtattaaatctgtggatactagtttatttttgtagcagttaatagttaatttgaccatgattatgtgct

SEQ ID NO: 4435 - DNA, 2147 bp, Fragaria vesca
gtcttcttcattgtgcctttaagctcgtcgttggggcattcctctactttctttctcttctcgcgctcttcctctttgagcgagaaagagaaaccaaatttacacacacccccaaacccaaacccaaaaccaatttcaattctttcttaaattcccaaattcccaaattcccaatcaccttcttcatcatcatcatcaacctctccttattctctcccacatttctctccaaaccctagccctctccacccttcccactcatcatattcgcaatcgctcctccccggccgtctcaagattccgtcttggccgcgccgccggcgcgtttccttccgttccgggctcctccgatgccgtctctcccctgaagccccatcacctctgcgctttcgaagggtttgggcgtttagggaaatggaagcgccaggtggcaatctggactcgtatagagctccggtttcgggcaatagtagctctaggagatatgggatgctttcggcttcgaattttatacaggcgccactgtctgccttgctggagtactcggggcttctgcgcggccggtccggtcaccaggaagccgagtctctgattgggggacgcagcgcggccgcattcagggagcagcatcatgctcagactgagcaggccagcaatgatggggaggtttcgattaggataattgatgcaggggagcaggagaatgatagggagggagggggtttagtagttgggcagttgagggagagtggtcttctgcagaatgatgtttcagggcagcacatagcgagggtggggtctgttagtttggtatcggaggaaggtcaggtggatggtagaacggatattggttctggagaaggcatatcccagtcggtaaatggagttgctgatggagaagctggtgacggtgctggggctaatggtagggattcttcttatcagagatacgatattcagcaggcagctaggtggattgagcaggtcctgcccttttccttgcttttattggtggtcttcattcgccagcatttgcaaggtttctttgttactatctggattgctgctgttatgtttaagtcgaatgatatcctaaagaaacagacagctttgaagggagagaggaaaatatctgttctagccggcatctctattgcattttcagttcatgtgattggtgtttactggtggtatcagaatgatgatcttttgtaccctttagttatgcttcctcccaaagttataccacctttctggcatgcaatttttatcatcatggttaatgataccttggtccggcaggcagcaatggtgatcaagtttattctattaatgtactacaagaacagcagaggacgtaactatcgtaagcagggtcaaatgcttactttggttgagtatctacttctgttgtaccgggccttgttaccaacaccagtttggtatcgtttcttcttgaacaaagaatatggtagtctcttttcgtcactaatgacggggttatatttgaccttcaagcttacatctgttgttgagaaggtacaatctttctttgctgcattgaaggtcttgtcacgtaaagaggttcactatggggcgtatgcaacatcagagcaggtcgttgcagctggcgatctatgtgcaatttgccaggagaaaatgcatgctcctattttgcttcgttgtaagcacatcttctgtgaggactgtgtatcagaatggtttgagagggaacgaacctgcccgttgtgcagggctttggtaaaacctgcagatcttagatcatttggcgatggatcaacgagcttgttcttccagctgttttgaggtcgttcaactgtaaaaacgaggtgtgtttctgcatttgaagttcaaattatggttcgaagcaggcatctcctcatccttgtgactacactggtatattcgattgtatttttgctgtgccttgttcatgtttaccccttggaaagagagtagttaggtataactgaactgactactgttcatacagaagttgtattgagaaaatgtcaaaaatgtatgtaattcaccaattaagcaacaagaaattcctttaatcaccatttgcgttgatatctatatgtttgccttcaatgaaatttagcctggctccccttccatta

SEQ ID NO: 4436 - DNA, 2519 bp, Citrullus lanatus
aatttggaacgaaccaagtgagttctacatttcaaaaagaaaaattttgcaattcttttgatttttctggcttgtattccacgtatgattggcaacaacaaatagattgtaatagaaataaaggtatcaaattcaagcctgtttgaaaattgtgatcggatattgataatggagagctgaccttcttctttctcccttcaccctttgtttttcccctttttctcttgttcgccctctttcccttcttccctcgagcttcatagggctcaaatttccgccatttttgtatatcatcatcaccatcgagaccccaacaaagcttttttcccatattctttcatcttatttcgatcacccttcttttacttccaccattttcatccattcattccatcaaaccctccccttttcaccccttttcgtgattcgccggtttctttgacattctttaatccgatgatcgtgccccacttgcttgatttctgattcactattgttattgtgttattgtcgttgctagaagtactgtagatcggattttcttatctgggttgttgccatgtcgtgatttttctttatctgaggttctccacggagtctcgtttgcggagaagggttaggccattcagccgaatggaagggtctggtagcgaccccgactctcatagagctgcttccaccagtagtagttcaagaaggtttggaatgttatctgcctcgaatattattcaggctccgctttctgcgctgttagagtattcgggtcttcttcgcggccgcccaagtcatcaagaatctgaggcattgataagtgcgcgactgccttcggggtttcgagaccatcttcgcagccagattgaagaatcttcgggtgccactaatgatggagaggtttcgattaggataattggggcaggggaaccagaacatggtagggatggtgctggactagtagttgggcaagcaagggaagttagtggtcagaatgcggtgtctttgcaatctgtttcggggttggcatctgtgaccttggggtcggatcttagccagggcaattctgctactgaacgcggtgcaagagagggcattcctcaatcgataaatggaaatgctgatggagatgcctcggaggcggctgggggaaatagcagggattcttcttatcagaggtatgatattcaacaggctgctcgggggattgagcagattctcccatttagtttccttctactggtggtcttcattcgacagcatttgcaaggtttctttgtgacaatatggattgctgctttcatgtacaagtcaaatgatattttgcgaaaacaaacagctttgaagggggagagaaaaatctctgttttggttggcatttctcttgcattcactattcatgttattggtgtgtactggtggtatcagaatgatgaccttttatatccattgatcatgcttcccccaagagcgattcctcctttttggcatgctattttcatcatcatggtgaatgacactttggtccgtcaggcagtgatggtgatcaagtgtgttctattgatgtattacaagaacagcagaggccgcaattatcgtaaacagggtcaaatgttaactttagtcgaatatttgctgctactgtaccgtgccttattgcctactcccgtttggtatcgtttctttttgaacaaagagtacgggagcctattttcgtcactattgacaggactgtacttaactttcaaactcacctctgttgtcgaaaaggtgcaatccttctttgctgctttgaaagcactgtcacgtaaagaggtgcattatggggcatatgcaacgtcagagcaggtcagcgcagctggtgatttgtgtgctatttgccaagagaagatgcatgctcctatcctactccgatgtaaacacatattttgtgaagattgtgtatcagagtggttcgagcgggaacgaacgtgcccattgtgtagggctttggttaaacccgcggatctcaggtcatttggtgatggatcaacaagtctgtttttccaggttttctaagccattttcttcaagcccctcagaggctttgtggtttgaagagcggaagccagccattgcatttttacctacacaaaatgtacatctaactaatactgtgtagctgctactttggaggaagcaaaggctggcgctcgtgaactcggaaaggggaattcgaaatcgacatgtatacataaatagtcctctttgtgctacagatgaggacggtcgatgctcgagaggagtttttaacccttataatatgcaaatttgatgaatttttagtcgggtgtaaatttaatataccaaagccagctgctgtgttgattttattttagtccaaatccataaaatgagaatgctttggactcttagaaattgttatatacacatacagaatgtgaaacatgtttttggctctacagtttgcttgtggatttgaaaattaagaaaagaagtgaatatgatgaatttttagagttggataa

SEQ ID NO: 4437 - DNA, 2368 bp, Aquilegia formosa
ctctctctctctctctctctccgacataataataataataaattaataatcaaaattccagatagaaatacaatacaatacaatccaatcccactttaatttaatttatttttaggtattcatttcatttcgatcatctgtgctctgatattatcaatcatcaatcatcaatcatatcatcaatcatctctgaggtacggttttatttctatctatctatctatactatataagaatattttcttcttcttctgaggcggaggaggagaaggaggacgacgtcgatgccagagagatagatagatagatagatagtcagataatctttgcttacttaattaattattatctgcttcttctcttctcttctcttctcttctttctttctttctggattatattatattatattattgatgatgaattgatgatgatggtggtcgtcgtctgctatttcccaaatttaggttaactcaaactagggtttgtttcttcttcttcttcttcttcttctattctaatttccaacaatacaaatacaaataaattattaggtagatatggaaacatctactgcttctgtcaactcttcttcttctgatccttacaacaggaattcctcttcttcttcttcttcttcctcctttgggggtttgggtttaggtttaggaattaaccacaaccacaactccaacaatgattctactagaagatatttaactgctgccaatttctttcgctatcccttatctgctctcttggagtattctggtttattaagaaccaccaacaacaaccctactacatctaccaggtccgataccattaccaccaccgactcaacccaaactttcattaatgcctttcaccatcgtgacaattttcctcctactaccaccacaactgctgcttctgcttctggaggtggagaaggaggaggaggaggaggaggaggaccaggtgaggtttccattaggatcattggttccactgaacaagaccatgtcagaattggagcttctactcttacctcatcatcctcttcttctccactcataaaccaccatcacaaccatcatcatgtagacaatgcctcaccctctgacccttctgtccaaggcctttctttatcttcccaaccttcaatctccactcctaatcctgctgcagacgatgaggaggctaccaatggtgctttaggggctaataatactagggattcttcttatcagaggtatgacattcagcaggttgctcgatggattgaacagattcttcccttttccttgcttctcttagttgtcttcattcgccagcatttacaaggtttctttgtcacaatctgggttgctgctgtgatgttcaagtcgaatgatattttaagaaagcagactgctctaaagggagagaggaaaatgtctgttcttgttggtttctcgataggtttcatatttcatgtggttataatctactggtggtatagaaatgatgatctattatacccattggtcatgctgcctccaaaaacaataccacccttttggcatgcgatatttactatcatggtgaatgatacaatggtgcgacaggctgctatggttctgaagtgcatactactgatgtattttaagaacagtagaggccgtaattatcgtaaacaaggtcaaatgctaacattagttgaatatatgctgctgctttatcgtgcattgttaccagctcctgtctggtatcggttcttcttaaacaaggaatacgggagcctattttcatcactaaccacagggttgtatctgactttcaagcttacatcagttgttgaaaaggtccaatccttttttgcggcattgaaagcattgtctcgtaaagaagttcattatggttcgtatgcgacttctgaacaggttaattcagcaggagatttatgtgctatttgccaggaaaagatgcatgccccaatattacttcggtgtaaacacatcttttgtgaagattgtgtatctgaatggttcgagagggaacggacatgtcccttatgcagggctttggtgaaaccagcagatcttaaatcatttggcgatgggtcaactagtctgtttttccagctgttttaatctacttgcggtaggaagcgggaaactagtttgtaaattccaatcatctagaggcagcactctccgttcgttttgggtattcggcaattccaggtgtattgtgtcatagttgtgttgtccagagagagaagggagcaggctcaattatgttaatatgttgtatatcctgggccccttttgagggatttttcaatttacagatgaccctacttatattcatatatacatgttagtttcttattgaaatagcattg

SEQ ID NO: 4438 - DNA, 2166 bp, Phaseolus coccineus
cctgtagcgaccccatctttgtctctctttctctctctctttctctctgtgtggcgcttttccctgcacaccacagcagagaacaccaccatccatccaccacccaccaccaccacccacccgcgcttccttcaaccaccgtcttcactatcatcactccacacttctcaaaccataaacacaatcctcaacaatccctaaatcctcttctccggaaaccccaaaccctagcccctctttcatgattcacagttagggttatggaacccaacaacgcagacgctttccgcccttcttcttcacccttgtcttcccccaactccaggagaatttccgggattttgtcaccctccaatatcattcaggcgccgttatcggcgctgttggaatattccggcatccttccgtcgcgctcgtccaacaactacacccagcccgctcccgacgtcgttaacaatgacggtgaggtttcgattaggatcatcggccccgcggagcaggagcagcagccccgggaggagcagcatagccctcctcccgctgcgggattggccgttggactcgcgcattcgcaaaacgatgccgcgttgacctcggcttcgcctcgcagcgacgctgctgaggaaagcccggtccccggaggggacggcgttgggagagactcgtcttaccagagatacgacatccagcatgctgccaggtggattgagcaggtcttgccgttttcgttgcttctcttggttgttttcataaggcagcatttgcaagggttttttgtgacaatttggatcgctgctgtgcttttcaagtcgaatgatattctgaggaaacagactgcgttgaagggagagaggaaaataccggttttgattgggatttctgttgcgttcgggcttcatgtggttggtgtttattggtggtatcagaatgatgatctcatgtatcccttgatcatgcttcctcccaaggaaataccgcctttctggcatgccattttcatcatcatggtcaatgatactctggtccgccaagctgcaatggtattcaagtgtatattgttgatgtattacaagaatagcagaggccgaaattatcgtaagcagggtcaaatgctgactttagttgaatatctccttctgctttaccgtgccttgttgccgacaccagtttggtatcgtttcttcctgaacaaagaatatggaagcctcttttcgtcactgatgacaggattgtatctaacgtttaaactcacgtctgttgttgaaaaggtgcaatccttctttgctgcagtgaaggcattgtctcgcaaagaaatgcactatggggcttatgcaacattagagcaggtcaatgcagccggtgatctctgtgctatttgtcaggagaagatgcatgccccaatcttactacgttgtaagcatattttctgtgaagactgcgtatcagagtggtttgagagagaaaggacctgtccattgtgcagggctttggtaaaaccggcagaccttaggtcatttggggatggctcaactagcttgtttttccagttattctgaaatcatacatataaatagaagccaggaagttttttctgctttgaagctttacattttcaaagcagcagttgtgatctatatacatcgccacatgtaaaatgctctggaaggaaatcgtggggatactgagaagatgaatgcagctgagtacacgcgttcatataatgtactagtaaaaggtcgagtgtatctaaatgaccctgtaaactaggaagttgattgaaaatataattaaacacgactcttcatttgcaaggaatgaaggtctcttgctaaaaattgcatagctattccctcatatagtgccagtcaatctgtcaattttaaacttttttttacttttgaatttctcattatgtgggttttaatgcacacctcaaggagtgttgcccacgggcaggttatggttaaagatcacacacacttcgtttcatgtattcaatcggtcaaattgtggatactagtttgtttttgaagtacttaatttgaccatgattatgtactgatcaccatgtacacaatagaaaagcttgtgcaccactttaatttgttgaaacaaatatcagctgttgatcatactcttgtttaatcatagaatccctttcttcct

SEQ ID NO: 4439 - DNA, 1858 bp, Amorphophallus konjac
cttgggattggtcgtttccttttttggaatatctccggttgtctctgctgatctgtcattcgtggccagtctcgtttctgtacttctttgtttgtgggggtttttgttggtatttggaagtaggcggctgctggtattttttttctgcgtgttttttgcgtccatggaaacgcccggtgggggatctgattcatacaggaatgggcccgggaacgccggcgccggcggcaatggtggcgggtcgtcgaggcggtacgggatgcagttgtccgcttctaatttcatacagacgccgatttctgctcttttggagtattcggggatcttgcgacctcggtcggtccatccggagcacgagagtttggtcgatggaggggggcctgccgctggcttgcgggaccatgcctcggggcgggcgggggaggcttcggtctccaacgctgccggaggagaggtctccataaggattataggtcgggtgatcaagatggcctgagggcgggaacggggtcgcctcagcagctggctgccgtccgggaagagagggcgttgcgggagagaccggcgtgcaggcggagcatgctcccgcagcatctgatcgtcaggctggagatgctgggaatgaggatggagtggtgaggggccttcgtcaactgcttcttccccgtctgtctcttctgtaagttctccaagtacagagaatgaagcagggaatggtcctggggggagcaacagggattcaccataccagaggtatgacatacagcaagcggctaggtggatcgagcagatccttccgttctccctgcttctgttggttgtgttcatccggcagcatttacaaggtttcttcgtcacaatctggattgctgctgtgatgttcaaatcaaatgatattctgagaaaacagacagcactaaagggggagagaaaaatctctgtccttgttggcatcacaatcgttttcatgcttcatgtggttggggtttattggtggtacagaaatgacgatgttctatacccactagtcatgcttccaccaaaagagattccaccattttggcatgccatatttattatcatgttgaatgatacgatggtgagacaggcggcaatggtcttgaagtgcctgctgctggtgtattacaagaatggccggggacgtaattatcgtaggcagggacaaatgctaactctggtggagtatctcctacttctgtatcgtgctttgcttccaacacctgtttggtaccgattcttcttgaacaaggaatatgggagtctttttcatctctcactacagggctttacctaactttcaagctgacatcaatcgttgagaaggttcaatccttcttcacagcattgaaggcattgtcacgcaaggaggtgcattatgggtcttatgcaacagcagatcaggtgaacacagctggtgatttatgtgctatttgccaagagaagatgcatgctcctattctccttcgatgtaaacatattttctgtgaagactgtgtttctgaatggtttgaacgggaaaggacatgcccgttgtgcagggccttggtaaaacctgcggatcttagatcatttggtgatggctcaaccagcctgttcttccagctattctaagtcgcaccctgggggccgagacaactagattcagatacggaccggaatcgggaagaggtgaccaatggatgtcagctatgctaccaggtgacataaacgatgtatcgcgtgtgcccctctttcccaccattttgctgcgcagctttgctcacgatgccagagttcaattctcgtatgtctgccatgatgtaaggctgttacaggaaatttttagtatacaggaaaa

SEQ ID NO: 4440 - DNA, 979 bp, Aquilegia formosa
agactgctctaaagggagagaggaaaatgtctgttcttgttggtttctcgataggtttcatatttcatgtggttataatctactggtggtatagaaatgatgatctattatacccattggtcatgctgcctccaaaaacaataccacccttttggcatgcgatatttactatcatggtgaatgatacaatggtgcgacaggctgctatggttctgaagtgcatactactgatgtattttaagaacagtagaggccgtaattatcgtaaacaaggtcaaatgctaacattagttgaatatatgctgctgctttatcgtgcattgttaccagctcctgtctggtatcggttcttcttaaacaaggaatacgggagcctattttcatcactaaccacagggttgtatctgactttcaagcttacatcagttgttgaaaaggtccaatccttttttgcggcattgaaagcattgtctcgtaaagaagttcattatggttcgtatgcgacttctgaacaggttaattcagcaggagatttatgtgctatttgccaggaaaagatgcatgccccaatattacttcggtgtaaacacatcttttgtgaagattgtgtatctgaatggttcgagagggaacggacatgtcccttatgcagggctttggtgaaaccagcagatcttaaatcatttggcgatgggtcaactagtctgtttttccagctgttttaatctacttgcggtaggaagcgggaaactagtttgtaaattccaatcatctagaggcagcactctccgttcgttttgggtattcggcaattccaggtgtattgtgtcatagttatgttgtccagagagagaagggagcaggctcaattatgttaatatgttgtatatcctgggccccttttgagggatttttcaatttacagatgaccctacttatattcatatatacatgttagtttcttattgaaatagcattg

SEQ ID NO: 4441 - DNA, 1794 bp, Cicer arietinum
ttttctgattctattcctcaacggagaatcgtcttcacagagatagggttagggatttgacgcgaatggaagggagcggggacatattcagagcttctccggtagccggagcatcatcgccgtcttctttgtcatcaaattcgagaagatacggattcccttcagcagccagcataatccaggcaccgttatcggtgcttctagaatattcaggtattcttcccgcgaggtctaaccagcaccaacctagcaccgatgctgtccccaacgacagcgaggtttcaattaggataatcggttcgacagagcaggataatcacagggaagaacagactcctctggtggtggggaatgacggtgcttctgcaggtgcagctgggatgacgtcttctccttcacagggtgatgttgagggcgttttgcggacggggagtggaagtattgatgcagaagcaggtggtggtggtgatggtgttggtgccaatgggagggattcatcttaccagagatatgatattcaacatgctgctaggtggattgagcaagtcttgcccttttctttgcttcttttggttgttttcattcgccagcatttgcaagggttttttgttaccatttggattgctgctgtccttttcaagtcaaatgacgttctgcggaaacaaacagcattgaagggagagagaaaaatgcctgttttgattggaatttctgttgcttttgcacttcatgttgctggtgtttattggtggtatcaaaatgatgatctaatgaatccgttagtcatgcttcctcccaaagaaataccacctttctggcatgctattttcgtcatcatggtgaatgatactttggcgcgccaggcagcaatgattttcaagtgtatattgttaatgtattataagaatagcagaggccgcaattaccgtaagcaggggcaattgctgactttagttgagtacttcctcctgctttaccgagccttgttgccaacaccagtttggtatcgtttcttcctgaacaaagaatatggaagcctcttttcatcactgatgacagggttgtatctaacatttaagctcacatctgttgttgaaaaggtgcaatctttctttgctgcagtaaaggcattgtcacgtaaagaagtacactatggggcttatgcaacatccgagcaggtcattgcagcgggtgatctttgtgccatttgtcaagagaagatgcatgccccagtcttacttcgttgtaaacacattttctgtgaagactgtgtatcagagtggtttgagagggaaaggacctgcccattgtgcagggcgttggtaaaacctgcagacctcaggtcatttggtgatgggtctactagtttgtttttccagttattctgaaatcatatacaagccaggaagttttttctgctttgaagctttacttgtcaaagcagcaatcctgatctatatacatctacacatgtaaaattgactggagtcattttggagacactatgagaagatgaatgcagataaatagaatttaactggtcacctattattcatataatgtacttgtaagaggttaagtgtattatatgaccctgtaaactaggaagtttattaaatgtataattaaatgtggctcttcatttgcaagggaatgaagacgtctttctccaaactgcgatctgttatatattgtgaatcaaattagcaagtctatactttttctttctttcttttaatttctctcaatgtggtatactggtattagacacaagaagtgtttgatccactggca

SEQ ID NO: 4442 - DNA, 1393 bp, Fagopyrum esculentum
ctgctgagcaatctagggaagttgtcggccctgctggttctggtgttggatcctctttccagcagcttccgtcctctcctgaactggatgtccaagatgaatcaagaggtgatcgcgtatcagctaatgtgggctctcaatctagtattgatgctaccagtgctgacaatgaggctgttgatagttctggggccaatagctctaacagggattccacttaccagagatatgatatacagcaggctgctcgttggattgagcaggtcctccctttttctgctactgcttgttgtcttcatccgtcagcatttgcaaggattctttgctacaatttggatagctgtggttatgttcaaatcgaatgacattctaaagaagcatacagctttgaagggagagaggaaaattttcgttctcgttggttattgtatcatctttgctcttcacataattggtgtctactggtggtaccgaaaggacgaccttctttatccattaatcatgctacctccgaaagccatacctcctttttggcatactgtttttatcatcattgtcaatgacaccttggccaggcagacttcaatggtcgtcaaatgctttttactaatgtattacaaaaacagcagggggaggaattaccgtagacagggtcaaatgcttaccttggtagagtattttgtgctgctttatcgagccttgctaccaactccagtctggtaccgcttcttcctgaacaaagaatatggtagcctgttttcatcattgatgacaggattgtatctaacctttaagctgacatctgtggttgagaaggtccaggcattctttactgcagtgaaagcattgtcacgcaaagaggtacattatggagcatatgctacttcagagcaggtgaatgcagcaggggatttgtgtgccatatgtcaggagaaaatgcacacaccaattttactacgttgcaaacacatcttttgcgaagattgtgtgtcggaatggtttgagagggaaagaacatgcccactttgcagggctctagtaaagcctgctgatctaaaatcttttgctgatggatccacgagtctgtttttccaattattctgatccaacaagattcaatttttttatacaaaaaattgagaagcggccatttgtgattacggatgaagaagttaatcctgccttttgtattgtactttaacattacatgctgctgcttaagtcacaaattaacagcaatggctaagcaaggctgtgttgatagtatggtgtaatagaaacaaagtcccacatgtatgtaaaacatctgttgaagctaaagtatatatacatggaaatgatcaagttccatggcagctacgaaccccatgtgattatttcatcattcagaaga

SEQ ID NO: 4443 - DNA, 2124 bp, Setaria italica
ggcgacggtgaacaaactgacgccgaaccaaaaccaaaagccaaagcagaccaacccaagcaaaggcaaggggatctcccgaatctcccattccagaggtctccgcgccgcgtgcgctgccggcatataggttttcgccatcgccgctgccgccggcgatggacccaccggcggggggttcccccgatcgccgggggagcggaccgggcgctggcgctgcaccctccggcctccgccgctacggcctcaacttctccgcttccagcctcctgcaggcccccctcgcggcgctcctcgagtactccggcgtcgtaccctccgtccccgccccgcaggcgccgcaccacccgtccgccgcgccctcttcgccgtcgtcggcgtccgaggtcgacggcctcctctccgccgcggcagccggggacggggaggtctcgatccggatccagggcggcccgggcgactcggaggccgcgggcggggcggccgcggggacctcgtccgaggactcgatcgaggcgacagcaggctcggaggttgaccaggcatccgccgccgggaggggagcaggcggtgctgacgcggaggcgaacggcgctgggagcggcgcgtcggggaacgggggcggggaccgcgcgtaccagcggtacgacgtgcaccacgtggctcggtggatcgagcagatactgcctttctcgctgctcctgctcgtcgttttcattcggcagcatctccaaggtttcttcgtcacaatttggattgctgctgtaatgttcaagtcaaatgatatattgaggaagcaaactgctttgaagggcgagagaaaaatatctgtactcattgggattactgtgatcttcatgattcatgtgtttggtgtctattggtggtacaggaatgatgatcttctcagacccttgttcatgcttcctccaaaagatataccaccattctggcatgcaatttttatcatcatggtcaatgatacaatggttcgccaagccgctatggctgtcaagtgcatgctacttatgtactacaagaactgcagaggccgtaactatcgtagacagggccaaatgctaacccttgtggagtaccttctgcttctttatcgtgccttgttgccgacacctgtttggtaccggttctttctgaacaaggaatatggtagtctcttctcatctttaaccactgggctgtacctgactttcaagttgacttcagtagttgagaaggttcagtcattcttggctgcagtgaaagcactgtcacgtaaagatgtgcattatgggtcttatgcaactgcagaacaggtacttgttgctggtgatatgtgtgccatctgccaggagaagatgcatgtgcctgttctcctttgctgcaaacatattttctgcgaagactgtgtttcagaatggtttgagcgagaacggacgtgccccttgtgtagagcactggtaaaacctgctgatattcgttcatttggtgatggctcaacaagtctattcttccagttgttttagactccaaatggcaaatttctaacataacaatggacaagcaattgcatatggaatattcaagtggaggtcatttttctttgcccatgtgagacaatcttcctcagtgtagagatcaaggtgagaaggttcaggatgatcatatgccagcacggatcgtaatgtttgtctatatgttaagcaatagtttagagctgttcagttgcaacatgaggcaaaatatttccagcaaattgcttccagagcctgtagaattctgctggacgttcctgatgtgtgaaggcctgtttgctcgatgtaaaaagctggtaatttttgcacgtgtggatttacctggatgtaactgaaacctgcaagttctgattgctggaggattgacttgcacaggcagcaagaattacctgtcggtggaaagtggtaaaaaaagtgtaacctgcaaagcattttttacgtggaaaaatgttgaaaaccgtatgcaaaagtgacatcctttgcaaaatagtacgtaaatagtaaatactaccaggcacggcttatttgcaatttttctaaatctgttgcgcagtttgctccgtaattgtatgtatgtgcagatcaagtctgt

SEQ ID NO: 4444 - DNA, 2091 bp, Zea mays
gtggaatattactcgtgcggatgaacccaaccaacttggccggagggtgaatggtgatacggtgaaggcagacgccgaaccaaaccaaaaggcgaaggcgaagaagaccaaccaaagcaaagccaacgggatctccctctcattccagaggactccgcgtcgtcaggcccgcttcgcgtgcgacgccggcatatagggtttcgccggcgccggcgatggacccaccccccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctcgtcgccgttgtcggcgtcggaggtcgatggtcttctctccgctgccgccgctggggacggggaggtttcgatccggattcagggcggcccaggcgacacggaggccacgggcgggccggatgcggggacctcgtccgaggatttgatcgaggcgaccgccggctctgaggttgaccaggcctccgctgcgggcaggggtgcaggcgctacggatgcggaggcaaacggtggcggggccggcacgtcggggaacgggggcggggaccgcgcgtaccagcgctacgacgtgcaccacgttgcgcggtggttcgaacagatattgccgttctcgctgcttctactcgtcgtcttcatacggcagcatcttcaaggtttctttgtcacaatttggattgctgcggtaatgttcaagtcgaacgatatattgaggaagcaaactgccttgaagggcgagagaaaaatatctgtactcattggtattacagtaatcttcatgattcatgtgtttggcgtatattggtggtacaggaatgatgatcttctcagacctttgttcatgcttcctccaaaagatataccaccattctggcatgcgatttttgtcatcatggtcaacgatacaatggttcgccaagctgcaatggctgtcaagtgcatgctgcttctgtactacaagaactgcagaggtcgtaactaccgtagacagggccaaatgttaacccttgtggagtaccttctgcttctttatcgtgctttgttgccaacttctgtttggtatcgtttctttctgaacaaggaatatgggagtctcttctcatctttaaccactggactgtatctgactttcaagttgacttcggtagttgaaaaggttcagtcattcttggccgcggtgaaagcactgtcacgtaaagatgtgcattatgggtcttatgcgactgcagaacaggtacttgctgctggtgatatgtgtgccatttgccaggagaagatgcatgtgcctgttctccttcgctgtaaacatattttctgtgaagactgtgtttccgaatggttcgagcgagagcggacttgccccttgtgcagagcattggtaaaacctgctgatatccggtcatttggtgatggttctacaagtctattcttccagttgttctagactgcaagcggtaaaatcctaacataacaatggacgagctattgcatgaaaactcgagtggaggtccttttaacgccatcatgtgaaaccatcttccgcaatgttgagatcaatgtgagaaggttcatgacagtcacgacagtgcagtcgttatttgtttatatattcaaccaaatagtttacagagctttttagttgcaacagaggcaaaatgtttccagcagactgctttcagagcctttagaactctgctggacaaacaatttgatcgttgaggtctgctgagccgacaaccgtatgcctcctgtaaaattctggtatttttttttaattttttttttgcatatgtgggcttacgtgggtgtaactgaaatttgaaagtaccgcttgcacagcaagaattgccggtgggggttgaaagtggtaaatgaatgtaactgtaaagcgttgttacatgaagacaaaaatttccacccgttgcaacatagtaaatgctgacagacgcgacttgtgtact

SEQ ID NO: 4445 - DNA, 1188 bp, Cucumis melo
agagagaaaaatttctgttttggtttgcatttctcttgcattcaccattcatgttattggtgtgtactggtggtatcagaatgatgaccttttatatccgttgatcatgtgtcctcccagagcgattcctcctttttggcatgctattttcatcattatggtgaatgacactttggtccgtcaggcagtgatggtggtcaagtgtgttctattgatgtattacaagaacagtagaggcctcaattatcgtaaacagggtcaaatgctaactttagtcgaatatttgctgctactgtaccgagccttattgcctactcctgtttggtatcgtttctttttgaacaaagagtatgggagtctattttcgtcactattgaccggactgtacttaactttcaaactcacatctgttgttgaaaaggtgcaatccttctttgctgctttgaaagcactgtcacgtaaagaggtgcattatggggcgtatgcgacatcagagcaggtcagcgcagccggtgatttgtgtgctatttgccaagagaagatgcatgctcctatccttctccgatgtaaacacatattttgtgaagattgtgtatcagaatggtttgagcgggaaaggacatgcccattgtgtagggcgttggttaaacctgcggatctcaggtcatttggtgatggatcaacaagtttgtttttccaggttttctaagccatttacttcaaagcccctcgggagaaggctttgtagtttgaagaggtgaagccagccaattgcatctgtttgcctacacaaaattgtacatctaactaaatactgtgtagctgctgccagttgaggaagcaaaagactggcgcttgtgaactcggaaaggcgaactcaaaatcgacatttatacataatatagtcctttttgtgctacagcaaagaacggtcgatgttcaagaggagtttaacccttctatgaaaattttatgaaatgtgattctggggtgtaaatttattagcaaaaccagtttgctgtgttgtcgattttataatttagtccaaatgcatataatgagaatgttttggactcttagaaattgttatacacacatacacaatgtcaaacatgtcttttggctcttcagtttgtgcttttgtttgatttgaaaattaagaaaggaagtgaatatgatgaattttta

SEQ ID NO: 4446 - DNA, 1680 bp, Arachis hypogaea
ccggggggagttcttcgcaacaataacaacaccaccaccaccaggtcgaatttcaataaccaagaacctaaccctaaccctaattccgagccttccgtaaatgacggcgagttatcgatcaggatcattagtccttccgaacacgataatcacgataatcatcgtcacagggaggagcaaccttcgtcttctggtgggggtggtttggttgtggggcttcctcacgatgagggtgggtccgttatgcccaattcgagcaccggagacaccgggattgggaacgggaatgggattggaaacggcgacgcgaggaccggcggcgagggtggcggcaatgggagggattcttcttaccagaggtatgatattcagcatgctgcaaggtgggtggagcaggttcttccgttctccttgctcctcttggtggtcttcatccgccagcatttacaagggttttttgttacaatttggattgcggctgtccttttcaagtcgaatgacattctaagaaaacaaacagctctgaagggagagaggaaaatacctattctcattgggatttctgttgcattttcacttcatgtgattagcatctattggtggtatcagaatgatgatctgatgtatccgctggttatgcttcctccgagagagataccgcctttctggcatgcaattttcatcatcatggttaatgacactttggtccgccaggctgcaatggtattcaagtgtatattgttgatctattacaagaacagcagaggccgaaattatcgtaggcaggggcaaatgctgactctagttgagtaccttcttttgctataccgtgccttgctgccgacaccggtttggtatcgtttctttctaaacaaagaatatggaagcctgttttcatcattgatgacaggactgtatctgacatttaagctcacatccgtggttgaaaaggtgcaagccttctttgcttcagtgaaggcattgtcacggaaagaagtgcattatggttcttatgcaacatcagagcaggtgattgcggctggtgatctttgtgctatttgtcaagagaagatgcatgctccaatattacttcgttgtaaacacatcttctgtgaagattgtgtatcagagtggtttgagagggaaaggacctgcccattgtgcagggctttggtaaaaccagcagacttgaggtcatttggtgatggttctactagtttattcttccagttattctaagatattataaatacaagccaggatgtttttctgctatgaagctttttacatttttgaaagaagcaaccttgatatatatacaccaacaacacatgtaaaatttcgctggaggcattcgtggttacactttgagaacgtcgaatgcggatgagtcgcattgaactggtcgcatcatgttcatataatgtactagtaagaggttaagtgtatcttctaatgaccctgtaagctagaggaagttcattgtaagtctttgactcttcattaagaaatgaaggtctatttctgcagtttctgccatatatagtgtaaaagtgacaaatatttccgaatgtggtttatgaaacacacccgcaaggagtgttgcttcacttcacacaatctttgtgttagttttattgtttttgttttattgcatttgatctgatagtttccttttct

SEQ ID NO: 4447 - DNA, 604 bp, Platanus occidentalis
aatgataccatggtgcgacaggcagcaatggttttgaagtgtattctactgatgtattacaagaatggcagaggccgtaattatcgtaagcagggtcaaatgctaactttagttgagtatctgctactgctgtatcgcgccttgttaccagcacctgtgtggtaccggttcttcttgaacaaggaatatggcagcctttttttcatctttaactacgggattgtacctaacttttaagctcacatcagttgttgagaaggtccaatccttttttgctgctttaaaggcgctatcacgtaaagaggtccattatggttcttatgctacatctgaacaggtcaacgcagcaggtgatctgtgtgctatttgccaggagaagatgcatgctccaatcttacttcgttgtaaacatatcttctgcgaagattgtgtatcagagtggtttgaaagagaacgaacatgcccattgtgtagggcttggttaaacctgcaggccttagatcctttggggatggttccaccagcctgttcttccagttattctgaggtcagctacattttggaaatgagggagtactttttgttctgacagtctgaaatcttt

SEQ ID NO: 4448 - DNA, 1742 bp, Prunus persica
gggttagggttttttcgatgctatctctcccctgacaactccatcgctggttcgctttcgaagggttagggcatttaggcaaatggaagtgccgggtggcaatctggactcgtttagagctgcttcgggaaatagtagttctagaagatatggaatgttatccgcttccaatatcattcaggcaccactttctgccttgttggagtactcgggtcttctccgtggccgctctaatcaccaagaagctgaatctttaattaacggccgtagcgctgctgctttccgggatcaccatcatagtcagctggaccaatctccaactacaagcaacgacggggaggtttccattaggataattggtgcaggggagcaggagcatgacagggaaggcgcagggttagtagttggacagttgagggaagttactgttcccccaaatgaggtttctgcaccaccaatggcaggggtggcgtctgtgtcattgacaacagaggagggtcagacagatggcagaacagatcgtagttcgggagagggcatgccccaatcgttaaatggaagtgctgatggagaaggagttgatggagctgggtctaatggcagagattcttcttaccagagatatgacattcagcaggcagctaggtggattgagcaggtccttcccttttctttgcttctattggtggtcttcatccgccagcatttgcagggtttctttgttacaatttggattgctgctgttatgttcaagtcaaatgatattctaaggaaacagacagctttgaagggagagaggaaagtcgcagttctaatcggcatctctcttgcatttgcattgcacgtggttggtgtttactggtggtatcagaatgatgatctgttgtacccattaattatgcttcctcctaaacttataccaccattttggcacgctgttttcatcatcatggtgaatgacaccctggtccggcaggcagcaatggtgctcaagtgcattctattaatatactacaaaaacagcagaggccgaaactatcgtaagcagggtcaaatgcttactctgcttgagtatttactgctcttgtaccgtgccttgttgccaacaccagtgtggtatcgtttcttcttgaacaaagaatatgggagtctcttttcatccctaatgacggggttatatttgactttcaagctcacatctgttgttgagaaggtgcaatccttctttgctgcattgaaggcattgtcacgtaaagaggtgcactatggggcatatgcgacatcagaacaggtcaatgcagctggcgatctttgtgcaatttgccaggagaagatgcacgctcctatcctacttcgatgtaaacacatcttttgtgaggactgtgtatcagagtggtttgagagagaacggacgtgcccattgtgcagagctttggtaaaacctgcagatcttagatcattcggcgatggatcaacgagtttgtttttccagctgttctgaaatcgtctactgtaaaaacggggagtttttctgcttcggagttccaaatcttgttcaaagcagccatctcctgaaccctgatccttataactatacaacactggtatatttgattgtatttttgctctgccttgttcatgggttgcccttggaaagaaaaacaattgttgggtataactgaactgggtactgttcatacgtcctgtcgagaaaaagtcaaatgtatgtaatgcgccaatta

SEQ ID NO: 4449 - DNA, 2165 bp, Solanum phureja
gatttcttcatctttcgtttctttttcttctgaagcactgttgattcgccgcgttgactgattgttcttcattttcttccctcaaattgtatggattgagtgttcgtttaggttttgttgattcacatttcttgaaggaatcgttctccgtttgatcgtctaagttcttccacggcgtttccatatcgaagggttgggtctagggttagggcgatgcggatggaagcgtccggtgcaaattcggacgctcaaagaggtatttcatcaacgagtaataatattggtagtaattctagaaggcatggagtacaattgtcggctgccaatttatttcgttctccgttgtcgacgttgttggaatattctggaattttaaggacaagatcaagtcatacagaatcggatagtttgataaatagtcaatttcagcctcgtgtggatgatgctgggacatctccagcttctccgggtggctctggggaagtttcgattaggattattggtgctggtgagcaggaacatgatagagttgggaatgtagtgccatcaccagctgttggtggaacactgagggaaggggatggggaaaatgaggtttttgggaggacggtttcgaggtcggggtctgcagcttcagttggagcattggagagtcaatcgagtgatagaggggcgggagatggagttactcaacagatgaatggaaacacggagacagggactacggatggtgctggtgttaataatagggagtcttcttaccaaagatatgatatacagcaagctgccaggtggattgagcaaattattccattctctttgcttttgttgattgttttcattcggcaacatttgcaaggtttttttgttacaattttgattgctgctgtcatgttcaagtcaaatgatattgtaaagaagcagactgcacttaagggtgagaggaaaatctctattctgatcggcatatgtattctgttcagcagttatttatttgggttttactggtggtaccgaaatgatgatcttttgtctccattgttgatgcttccaccaaaggccatacctcctttttggcatgccatcttcatgatcatggtgaacgatactttggtccgtcaggcggcaatggtctgcaaatgttttcttctgatgtattacaagaatagcaggggccggaactaccgtaggcagggtcaattgttaactttggttgagtatcttttactgctgtatcgtgctttgctcccagctccagtttggtatcgtttctttttgaacaaggagtatggaagcctcttttcatcattaatgaccgggctgtatttaactttcaagctcacttctgttgtcgagaaggtccaatccttcttcacagctttaaaggcgttgtcacgtaaggagattcattatggagtatatgcgacttctgaacaggtcaatgctgctggggatctctgtgctatttgccaggagaaaatgcatacaccaatcttactacgttgtaaacatatattctgtgaagactgtgtgtctgaatggtttgagagggaaaggacgtgccctctgtgcaggtctttagtaaaacctgccgatctaaaatcatttggtgacggatcaactagtctctttttccagttattctgaagaaattgttgtcgacgagagggagtttcttcaaaagctgccaatttcactaagaacagctatagctgaacgcccatccacggaaaagcatattgacacacttatttcagaatcctgatctgtttgctcccgaaagtactaattggctcaacgcagtctcttgaggccattgtttatacacagttccacacaaggagcaggctattgttcatatgtttgtatccgtccattaatcaacagaactttcaagtgtacaatgtatgaaatagtgttgtagttagatatatctttttttatccccatggccagttaggtttcatcccctaaacaaacctatacagaaaaatgattatttctaccagtggtgtttgtatgtaaaatcaagctggcatcttttgggaaaagcatagtcttggttgcctcgaagattttgcgaccatcatttaagttgtatccgcaatgcataaacatttgtaagttcacctattttaatttgagacatgccacgttttgagttt

SEQ ID NO: 4450 - DNA, 2143 bp, Solanum lycopersicum
gatttcttcatctttcgtttttttcttgtgaagcactgttgattcgccgcgttgactgattgttcttcattttcttccctcaaatagtatggattaagtgtttgatttggttttgttgattcgcatttcctgaaggaatcgttctccgtttgatcgtgtaaattcttccacggcgtttccatatcgaagggttgggtctagggttagggcgatgcggatggaagcgtccggtgcaaattcggacgctcagagaggtatttcatcaacgagtaataatattggtagtaattctagaaggcatggagtacaattatcggctgccaatttgtttcgttctccgttatcgacgttgttggaatattctggaattttaaggacaagatcaagtcatacagaaacggatagtttgataaatagtcaatttcagcctcgtttggatgatgctgggacatctccagcttctccgggtggctctggggaagtttcaattaggattattggtgccggtgagcaggaacatgatagagttgggaatgtagtgccatcaccagctgttggtggaactctgagggaaggggatggagaaaatgaagtttttgggaggacgatttcgaggtcggcatctgcagcttcagttggagcattggagagtcaatcgagtgatagaggggcgggagatggagttactcagcaggtgaatggaaatacggagacagggactacggatggtgctggtgttaataatagggagtcttcttaccaaagatatgatatacagcaagcggccaggtggattgagcaaattattccgttctctttgcttttgttgattgttttcattcggcaacatttgcaaggtttttttgttacaattttgattgctgctgtcatgttcaagtcaaatgatattgtaaagaagcagactgcacttaagggtgagaggaaaatctctattctgatcggcatatgtattctgttcagcagttatttatttgggttttattggtggtaccgaaatgacgatcttttgtctccgttgttgatgcttccaccaaaggccatacctcctttttggcatgccatcttcatgatcatggtgaacgatactttggtccgccaggcggcaatggttttcaaatgttttcttctgatgtattacaagaatagcaggggccggaactaccgtaggcagggtcaattgttaactttggttgagtatcttttactgctgtatcgtgctttgctgccagctccagtttggtatcgtttctttttgaacaaggagtacggaagcctcttttcatcattaatgaccgggctgtatctaactttcaagctcacttctgttgtcgagaaggtccaatccttcttcacagctttaaaggcgttgtcacgtaaggagattcattatggagtatatgcgacttctgaacaggtcaatgctgctggggatctctgtgctatttgccaggagaaaatgcatacaccaatcttactacgttgtaaacatatattctgtgaagactgtgtgtctgaatggttcgagagggaaaggacgtgccctctgtgcaggtctttagtaaaacctgccgatctaaaatcatttggtgacggttcaactagtctctttttccagttattctgaagaaataattgtcgatgagagcgagtctcttcaaaagctgccaacttcactaaaagcagctatagctgaaccccccccatccatggaaagaaagcctattgacacacttatttcagaatcctgatctgtttgctcctgaaagttgtctaattggctcaacgcaggccattgtttatacacagttccacacatggagcaggctattgttcatacgtttgctcggagaaaatgtttgtatcagtctattaatccacagaattgtcaagtgtaccatgtatgaaaatagtgttgtagtcagatatatatatatctttttatccccatggccagttaggtttcatcccctaaacaaacctatacagaaaaatgcttatttgtgcctatatgtaaaaacaagctggcatcttttggaaaaaagcatagtcttggttggctcgaagatttttgggaccatcatttaagtcatatccgcagtgcataaacattcggttaagttca

SEQ ID NO: 4451 - DNA, 2086 bp, Triphysaria pusilla
aagacaaaaagccaacagagagaaaaagggaaaacgcgtattcaacgattgaaccccagcacagccgcgactcgcgagtctcccccgtcgccgcttctgtttctccgccgccggagccaaacaataattaatcaatacacaaactctgtttttgttggaatattttgaatatgcattcctgctccctttttgcatttagggttctttctgtcagaatgaatccgccatcgtccttctgagtctcaaacgatcatccacggagtttcgatctcgaagcgctgttaggtctaggtgtagggattcttcaagaatggaagcgtccggtggaaattcggacgcatacaggagctcgtcgtcttcctcaagtacctctgctcattcccgaagatatggaaatggaatgcatatttccgcctctaacatccttcgatcaccgttttccaccttattggaatacaccgggattctcggaacaacaaggtccagccattcagattccgatggtttactgagcggcggcggtggagcccacagcggttatcgatatcaccaccttcaaacacattcaggaaactctgcttcaccttccccagcttcaaacaatgctgatggtggtgcggcagaggtttccattaggatcatcgggcccagtgagcacgagcacgatagggtttcaaccgtgttgcattcggcaccaaccgttgggcagctcggcatacagaacgagtcgttttcgaggccgatttcaaggtcggggtctgcagcttctgagttgtcctcattggaaagtcaggtggatagagaggcaggagatggaggttcacgttcggcgagtggagctgatgctgctgctgagggagttggcaataacagggactcatcatcttcttaccagagatatgatatacaacaggctgctaggtggatcgagcaggtccttccgttctcattgcttctcctgatcgtcttcatacgtcagcacttggaaggattctgtgttaccatttggattgcagcttttatgttcaagtcaaatgatattgtacgaaagcaaactgcacttaagtgtgagaggagaatatttgttctcattgtcattgctgttctttccacgcttcatgtctttgggttttactggtggtatcggaatgatgatgtgctatatcctttgctgatgctgccaccaagaactgtaccacctttttggaatgcaatattcattattatggtgaatgatacactggtccggcaggcagcaatgattttcaagtgtgccctattgatatattacaaaaacagcagaggtcgaaactatcgtaggcagggtcaaatactaactttagttgagtacctattgctgctttatcgtgcactgctgcctgccccagtttggtatcgtttctttctgaacaaagaatatgggagccttttctcatcactaatgactggactttacttgactttcaagcttacgtcggttgttgagaaggtacaatcgttcattactgcccttaaagcactttcaaagaaagacatccattatggagcttatgcgacatctgaacaggttgttgcagcaggagatttgtgtgccatttgccaggagaaaatgcacactccagttcttctacgttgcaagcacatattttgcgaggactgtgtgtctgagtggtttgagagagaacgaacatgccctttatgccgggctctggtcaaacctgctgatcttaaatcgtttgctgatggatcaacaagtctattttttcagttattttaaatcgaagaagctttttctgctttgaagccgccatatcctctattcacagcagctctctatactattaatctcacctggcatagaaaatgtaactgcaactgtttttgtttgttgtcatcagcagggctgggtggttgatagaaaatcacaatctgttcataacatatacaactagaatatgtattttacagttcctgctgcaggagttacctttgttgtcaaatggtgtatgcaacatcttgtactgtatgtaaaagtttcttataatgaaaatgcagtaaatgttcatctctaaaaaaaaaaaaaaaa

SEQ ID NO: 4452 - DNA, 1395 bp, Beta vulgaris
gaggtttccattcggatcattggtgcagctgaacatgatcacgaccccacctccaccacaccatcccaacttcatccatgccccaccgtccaccctcttcccctccccaccactgccaccgatgctcaacctgctactgctggggaccctcacttctctacttctactaccgatgctgagtccggtgatgcctctgctgccccaaacaataatagggattctacttatcagaggtatgacattcaacaggctgcccgttggatcgagcagattctccctttctccttgctcctcctcgttgttttcatccgccaacatttgcaaggcttttttgtgacaatttggattgctgttttcatgttcaagtccaatgacatcctacgtaaacaaactgctcttaagggagagaggaagattcctctgctggttggcatctgtacgttgttcacacttcatgttgctggtgtttactggtggtaccgaaatgatgaccttctctatccattgatcatgctacctccaaaagagatacctcccttctggcatgccgtttttatcatcatggttaatgataccttggttcgccaggcagctatgattgtcaagtgcattctactcatgtattacaaaaacagcaggggaaggaattatcgtaggcaggggcaaatattgactttggtggagtatctgttgctactgtatcgtgcgttgttgccaactcctgtttggtacaggttcttcctgaacaaggaatatggaagccttttttcttcgctaatgaccggattgtatttgactttcaagcttacttctgttgttgaaaaggttcaatcattctttgcggcaataaaggcattgtcacgcaaagagatccattatggggcttatgcaacttcagagcaggttaccgctgctggggatatgtgtgctatttgccaggagaagatgcatgctccgatcctacttcgttgtaaacacattttttgtgaagattgtgtatcagagtggtttgagagggaaagaacatgtcctctatgtagggctttggtgaagcctgcagatctcaaatcatttggtgatggatcaactagtctgtttttccagttattttgagcaaggagtttttcttatctgattacttgttcattgaaatgccatttaacaaaagccctttcatgatttattcaagaacgcaagcatgccgcactgctggttgttggctacagaatctaagcaactgatttgacacataacttgacagaatgtctgtttatatgttgtattaaaaacatctacttgtatctaaattagctcgtaaatttatagagaacgcgtacattcagacaatgtatacaactgtgtaatctccagtaatggaagttttctgatggaatc

SEQ ID NO: 4453 - DNA, 2097 bp, Medicago truncatula
gaaaaatatgaattggggggatgagaaagcaaagcaagtatagtatccgaaatggttgcttctcttttgtttcatctcttctttgtcacatagctctctcttttccattctctctctcctctctctctctctctctctctggcgccattctccctcacaacacaccagagagcgagcgagcgagaatcacaacgaaaaatcacacaaaccatttcaccaatttcaactctttcattttttcttcaatcaattttcacccttttcaaacccaaaaccctaacccccttttcgtcaacgtcaacgcttttcccccaaattttcaatttttttacatgatttcgaattagggtttgggatttcacgtcaatggaagggaacggagcatcatcttcatcatcgagaagatatggattcccgtcggctgcaagcataattcaagcaccgttatcagcgctgttggaatattccggtattcttccggcgaggtcaaaccagcaacatcaaccaattcccgattctgcccctaacgatggtgaggtttcaattaggatcattgggtctaacgagcaagataatcatcgagatgaacagggtagtccactggtggtgaatgatggtggtggtgcggctgcgatgacgaattcctcagaacatggcgatgtcgagggcgttttgaggacggggagtgggaatgttgatgcagaatcaggtggtggtggtggtggtggtgacgttggtgctaatgggagagattcttcttatcaaagatacgatattcaacatgctgctaggtggattgaacaagtcttgccgttttctttgcttcttttggtggttttcattcgccaacatttgcaagggttttttgttaccatttggattgctgctgtgctttttaagtcaaatgacattctgcggaaacaaacggctttgaagggagagaggaaaatgccagttttgattggaatttcggttgcgtttacacttcatgtggttagtgtttattggtggtatcagaatgatgatctaatgtatccgttagtcatgcttcctcccaaggagataccgcctttctggcatgctattttcatcatcatggtgaatgatactttggcgcgccaggctgcaatggtagtcaagtgtatattgttaatgtattataagaacagcagaggccgcaattatcgtaagcaggggcaaatgctgactttagtcgaataccttctcttactttaccgagccttgttgccagcaccagtttggtatcgtttcttcctgaacaaagaatatggaagcctcttttcatcactgatgacaggattgtatctaacatttaagctcacatctgtcgttgaaaaggtgcaatccttctttgctgcggtgaaagcattgtcacgtaaagaagtgcactatggtgctcatgcaacatcagagcaggtcattgcagccggtgatctttgtgccatttgtcaagagaagatgcatgccccaatcttacttcgttgtaaacacattttctgtgaagactgtgtatcagaatggtttgagagggaaaggacatgcccattgtgcagggctttggtaaaacctgcagacctcaggtcatttggtgatggctctactagtttatttttccagttattctgaaatcatatacacaaaccaggaagtttttttcctgctttgaagctttacttttcaaagcagcaatcctgatggatatacatcaacacatgtaaaattcactagagtcattttggagacactctgagaagatgaatgcagctaaatagaatttaactggtcacctgttattcatataatgtacttttaagaggtgaaatgtattatatgaccctgtaaactaggaagtttattgaatgtataattaaatgtgaatcttcatttccaaggaatgaaggtctttctcccaactgctttctgtcatttattgtgaatcaaattagcagttaatttttttttttttttttaatttctctgcaattggttgtttagacacagaagtgtttgttacactggcaggatttggttgataatctcacatttcagtaaagttaatagatgtgtgatactatt

SEQ ID NO: 4454 - DNA, 2344 bp, Eucalyptus grandis
taaggacggacgaccccattcctctcttttttcaactgtttcccctttgtccttttcttcttcctccctccttctccttctccttctccttctctctctctctctctctctctctctcttcggcgagaactgagaggtgaaaagaaaagggggaagaaataaagggtcggtcagaggagacgacaggggacctgttcctcttcttgcggatttttctaatcgatcttcgtcatggggcgggtctcctcttgaatcgcccctacgcctgcccttcgcccacgctatcttgttttctctttttcttcttttctttgctttgttttttggtgggtttttcaagagaagggaaaaaagtatacgcggcccgcgtataagatcgctgatcctggtgcggttcctgctcggtccggtcaaatccgagctgcttttatcatatctgggtcgctgactttttcgcaaccctttcctcctctctctctctctctctacatctctcttcttcctcctccatctccgttcttcgcgattgcgatcggtgggtcttagggttatggtctcttacctcgagctcgcgctttgaattcctcccccgatcatccacggagtttcgctctcgaaggttttcggcgtctaggcaaatggaggcgtccggcggcggcaattcggacccgtacagaggatcggccgtgaccgggagtagtggtagcagtagcagtagcaattcgagaagatacagtctattatcggcttcgaacctcatacaggcgccgatatcgactttactggagtactcaggtctgttgagaacgaggccaaaccatctagagactgagcctttgttccatggaggggtctctggaggtcttcacggtcgggcggaggattctacagtgacgagcaatgatggggaggtttcgattcggataatcggggcaggagaacaggagcatcatagggagagggctggattggttgtgggtcagcaggtgagagaagctggcggaactaatgaggcatcgacacgatcgccggctgcaattgcggcagccgatggtcagggagatgctaggagtggagcgggtgagggggcttcgcagccggggaatggaggcagtgattcagaaggcggggaaactaatggcagggagtcttcgtaccagaggtatgatattcagcaggccgcgaggtggattgagcagattctgccattctcactgctcttgctggtggtcttcatccggcagcatttgcaaggtttctttgttaccatttggattgccgctttcttgttcaagtcaaatgatatcctacggaagcaaacagctctaaagggggagaggaaaatttcttatcttatcggcatttcacttttattcacacttcatattgttggggtatactggtggtaccgaaaggacgatctcttgtacccattgatcatgtttcctcccaagggaataccccctttttggcacgcaatgttcgtcattgtagtcaatgatactttggtccggcaagcagctatggtgatcaagtgtcttctgctaatatatttcaaaaacagtcgagggcggaattatcgcaagcagggtcaattgctaactctggtagagtatctgcttttgctgtaccgtgcgttattgccgacacctgtttggtaccggtttttcttgaataaagagtacggaagccttttctcttctctgatgacgggattgtatctgactttcaagctcacatctgttgtcgagaaggtacagtccttttttactgcattaaaggcattgtctcgtaaggacatccactacggggcttatgcaactgccgagcaggtgaatgcggctggagatttgtgtgcaatttgtcaggaaaagatgcatgctcccatcttacttcgctgcaagcacatcttttgtgaagattgtgtctctgaatggtttgaaagggaaaggacatgcccactgtgcagggctttggtgaaatctgcagatcttagatcatttggcgatggatcaacgagtctgttcttccagatattttaggatcttatattgttaaaagccttggagtttcatgaagaagtcaaatcccaggtacaatctcattggccttttcaaccgcagaggcagatcctccaatatcttgctgtgtcccatatttgtgttcctctgagaaaatcggattgatcgaagtagccctggattgtaaactggctatatgttcatatgttgtgccgagtgtacctaacctccggtatagaagaaagtatgtttcatagaaaacaatcgacatatgtaattctacccatttttcatcaatgaaagccttcttccatttgaactga

SEQ ID NO: 4455 - DNA, 1398 bp, Euphorbia peplus
gatggaagcgtccggtactaattccgacgcgtatagaggctcttcaggagggagcagttcaccaaatagtagcaattcgaggaggtacggtacgttatcggcttcaagtattatccaggctccaatttcggctttgttagagtattcgggtcttttacgaactgcgaggtcaactcaccatgaatcggaccctttgattggttctggtggaattggaattcataacaacaataggcttgatgattctacggcggtgacctcatcaaataacggtgaggttgccattaggataatcggagcaggggaacatgagcatgaaagtgacggttctgggttggtggttgggcagagtgaggtatctgtgcagcaaccaattgccggaacaacctcggatgttccgggagattctagaagtgatcctgggacccctcaaggtactcctcagcatccttcgagtggagaaggagaagcttctgatggtagtggggctgctaatgggagggattcttcgtaccagagatatgatattcaacaagctgccaggtggattgagcaagttctccctttttcattgcttctattggttgtcttcatacgccagcatttacaaggtttcttcgctacaatctggatcgctgttgtcatgttcaaatcaaacgatattctacggaaacagacggctctaaagggggagagaaagatctctgtattgattggcatttctcttgcattcacgcttcatgtggtttgtgtgtactggtggtatcaaaatgatgatcttctataccccttagtcatgcttcctcccaaatctataccgcctttctggcatgctattttcatcatcatggtgaatgatactttagtccggcaggcagcaatggtgctcaagtgtcttctgttgatgtattacaagaatagtagaggccggaattatcgtaaacagggccaattgctaactttggttgaatatctgatgctgctatatcgagccttattacctacaccggtttggtaccggttctttttgaataaagaatatggaagcctcttttcatcactgatgacagggttgtacttgactttcaagcttacatctgttgttgagaaggtccagtcgttcttttctgctttgaaggcactatctcgtaaagaggttcattatggggcttatgctacatcagagcaggtcaatgcagcaggagatctctgtgctatatgccaggagaagatgcatgctcctattctacttcgctgtaaacacatattttgtgaagattgtgtatcagaatggtttgagagagagaggacgtgtccattgtgcagggcattggtgaaacctgcagatcttagatcatttggcgatggatcaacaactttattcttccagatatttta

SEQ ID NO: 4456 - DNA, 1761 bp, Euphorbia peplus
tccttcatctcaaacccccctcaacggagtttcgctttcgcagggttagggttagggattctgcgcagatggaagcgtctggtactaattccgacgtgtatagaggttcttcgggagggagtagttcaccaaatagtagtaattcgaggaggtatggtacgttatcggcttccagtattattcaggctccaatttctgctttgttagagtattcaggtcttttgaggaggtcaactcaccatgaatcggaccctttgattgtcggttctggtggaattggggttcataataataataataggcttgatgattctgctgcggtaaccgcgtcgaatagcggggaggttgctattaggattattggagcaggggagcatgaccatgagagggatggggctggattggtggttggtcagagtgaggtatctgtccagcagccggttgttgggacgacgggggatgttccgggagattctagaagtgaacctgggacgccgctaggtactcctcagcatccttcgagtgcagacggggaaggttctgatggtagtggggctaatgggagggattcttcataccagagatatgatattcaacaagctgctagatggattgagcaagttctccccttttcattgcttttattggttgtcttcatacgccagcatttacaaggtttcttcgtgacaatctggattgctgttgtcatgttcaaatcaaatgatattctacggaaacagacggctctaaagggagagaggaagatctctgtattggttggcatttctcttgcattcacgcttcatgtggtttgtgtgtactggtggtatcaaaatgatgatcttctgtaccccttagtcatgcttcctcccaaatccataccacctttctggcatgctattttcatcatcatggtgaatgatactttggtccggcaagcagcaatggtgctcaagtgtcttctattgatgtattacaagaatagtagaggccggaattatcgtaaacagggtcaattgctaactttggttgaatatctgatgctgctgtatcgtgccttattacctacaccagtttggtaccggttctttttgaataaagaatatggaagcctcttttcatcactgatgacagggttgtacttgactttcaagcttacatctgttgtcgagaaggtgcaatccttcttttcagctttgaaggcactatctcgtaaagaggtacattatggggcttatgcaacatcagagcaggtgaatgcagcaggagatctgtgcgctatatgccaggagaagatgcatgctcctattctacttcgctgcaaacacatattttgtgaagattgtgtatcagaatggtttgagagagagagaacgtgtcccttgtgcagagcgttggtgaagcctgcagatctgaggtcatttggcgatggatcaacgactttattcttccagatattttagattcctatactgtaaaaattgaaggaattctacagcttttaacactcgatggacggacagacacagacggatgggcacttggtgagatgtacgacacaggtaaacttggatctggttttgttgaatagtgagttaaccaaggaattgaaaccagtacagatagatgatgatgaatagataggttgtgttccttgtatggagagaaacaagttgagtgtcgtagctaattctaatgctctctcgaagacgagtccctctcaggactaacattttttttatgtctcttgtgcatttgcca

SEQ ID NO: 4457 - DNA, 2534 bp, Vitis vinifera
ttgtaaatgataatatattgggtgtttatgggtgtggttggtgggtatcgtttgtcagatagtggaaaaagcaatacgccaaaaagtaaaagggaggctgtgagagctctgcagacgacactctcattcccaaccatcccatttctctatttatgactctttctctctttttcttctcctgtcattgatttttggactggaatcccctaaacgacgcgttttggtcacccaggaattcccccaaacgacgcgttttgatcggccccagggttcaattgctgtccctcagtccatcccggatgaattgatcgattgatttggggccgggaaggaagtggggcgcagctgctttcttcttcttcttcttctttttcttctgtttcttggagttgttgatttggtaaaaggttctcggaacgacgcgttttggacagggtcgtcgtgagcgtggggttctgaaatagtggatcggtttggggttttggtgggatgagtaatttgaagaacagcgacaaggggttttgttttggttctaatgcgactctctgtattgacttttccgcaatcggttcgtgggtttgatgattttaggggtgtttagggtttttctaggatgaataatcggtcctgatttggagggcttggacggagattcgtgagattttggatgacccatttgtgttttctcaaatgggtttctattgttcttagggattaaggaatttgagattagggttttgttggttgattctcggtggggtagggttaaggcattagtgcaaatggaagctcccggtggaaattacagggggtcttcggagatagggaatggtaattcgagaagatacggtatgcagctatcggcttcgaatatcatacaggcgccattgtcggcgttgttggagtattcaggtctgctgcgtggccgctcaagccatcaagaaacggagagtttgatctatggaagtggttttcgggatcgggtagaggagtcagcgccagtgagcaatggtggggaggtatcaattaggataattggtgcaggcgagcaagaaaatgagagggtgggggctggattggcatcgttggcggttggtccagtgcgggataatgaggcttctgtacagcagattgcggggcaggggtcggggacggtgacattggagggtcatggtcagggtcagggggagtctagggcgggagagggcatctctcaatcgggaaatgggaatggggatggggaagctgctgatggggctggggccaatgggagggattcgtcttatcagagatacgatattcagcaggctgccaggtggattgagcaggtgcttcctttcactttgctgctgttggtggttttcatccggcaacatttgcaaggattctttgttactatttggatatccgctgtaatgttcaagtccaatgaaattcttcggaagcaaacagcattgaagggagagaggaaaatatctgttctggttgggatctctcttgtgttcacacttcacgttgctggtgtttactggtggtatcataatggtgatcttttatatcctttgatcatgctgcctccaaaagctattccacctttctggcatgctattttcatcatcatggtgaatgatactttggtgaggcaggcagcaatggttttcaagtgtattctattgatgtactacaagaacagcagaggcagaaattatcgtaaacagggtcaactgctaactttggttgaatatacattactgttgtatcgtgccttgttgccagcacctgtctggtatcgttttttcttgaacaaagaatatgggagcctattttcatcactaatgacagggttgtatttaactttcaagctcacctctgttgttgagaaggtccagtctttctttgctgcattgaaggcattgtcacggaaagaggttcattatggagcttatgctacgtcagagcaggtcaatgcagctggggatctgtgcgctatttgccaggagaagatgcatgctccaatcttacttcgttgtaaacacatcttttgtgaagactgtgtatctgagtggtttgagagggaaaggacgtgcccgttgtgcagggctttggtcaagcctgcagatctaagatcatatggcgatggatcaactagtctctttttccagctattctaagaatcagttgctgcaaaaaccatgcagtttttccactttgaagaagaagctctaaatcctcattggagaggacgggaacctacctacctctcatggtctcatccacaggtaaaacttgaactgtatttttgtcaccctctcttgttcatggggctgctgctagaaatcacacctgaagtgcgtggataacatactggtttcaccatctgttcatagcttgtattgaaaaatgttgaatgtaatcccaatggaatgtatgtaatgggtcatttaagctacagacacagttgatcttaagctctaaccatatacacaactgttcatttatcggaaatgaaagttattttttttcctctcaaagtt

SEQ ID NO: 4458 - DNA, 2131 bp, Silene vulgaris
tcttagttttctaacagtctatccttttacaatatctaaataactaaacaaatattcaatttcaacaattaatgcttacgtgtcaaatggagatactgaatatatataagataaaacacgagaatgagacaagaaatcggaaactcaaaaggcacccactattttaatttttctggtatgaaaataacgaaatactcgaattaaaatcatccacgcttttccaccatttcttcttgttcctcccctttcttcttcctcaggttcctcaatcttcctcctcctcatataaaccctaattaaatatcttcctctaattaataatatcatcatccattgacgccctcatgctttttctactgatgaaaccgttaatggatttatccattaattaattaatacggataaaattatacatttcaaataattaaatatcaacgacgattccttgcggaatattcttctctagacgccatcgtcgccgtacctccatttctacggagcttccctatcgcagggttcgggttaggacgacatcggcaacaatggaaggagggagcgcgaattccgagggaaatagggacaggaattcagcttcttctagaagatacagagttccattatctgcctctaattttatacgttctccaatttccgcgcttctagaatattccggtttgttacggccgaggtcgaataattttgagtctgagccattgactgctggttcatcgttgtctccgccgcagtacacgccgcaggttcaggattctacgccggtgaatgacggtgaggtttctattaggattattggatcgtcggagggggattcgtcgaatttagggcaaaattgtggtagtggtgggagtgtgggtgagggaacaggggtggcagcagtggcgcaggaggaggtgaggggtgagcgagggactggggtggctgtggcagtgggagacggagtttcgagttctaatggtgatgctgaggctgatactagtggggcaggtaatcgggattctgcgtatcagagatatgatatacagcaggctgctaggtggattgagcaggttctgcctttctcattgctgttgctcgtcgtgtttatccgtcagcatttgcagggattctttgtcacaatttggattgctgttttcatgttcaagtcaaatgacatcctccgtaaacaaactgctctaaaggatgagaggaaagtacctattttggttggcatttccattttgttcacccttcatatcgctggggtatactggtggtatcgcaatgatgaccttctctatccactgattatgcttcctccaaaagatatacctccattttggcatgctgtttttatcatcatggtcaatgataccctggtccgtcaggcagcgatggtcatcaagtgcctcttacttatgtattacaaaaacagccgaggaaggaattaccgtaggcaggggcaaatgctgactctggtggagtacctattgctgctgtatcgtgcattgctgccgaccccagtttggtacaggttcttcctgaacaaagagtatggcagcctcttttcatcattaatgactggattgtatttgacttttaagctcacatcagtggttgaaaaggttcagtcatttttcgcttcaattaaggcattgtcacgcaaggaggtccattatggggcacatgccacttcagagcaggttactgcagcaggggatatgtgtgctatttgtcaggagaagatgcatgctccaattttgcttcgttgcaagcacattttttgcgaggactgtgtgtcagagtggtttgagagggaaagaacgtgccccttgtgccgtgctttggtcaagcctgcagatttaaaatcattcggtgatggttcgacaagtctgttttttcagttattctaagcagaagcggaatgtgctgtagatgatttgcgcagccaattgttaacttctggaattaaaccaagacctaactgacaacatctgtgttcatatgtctgtatcttaaaacgtgaacttgtatctaagctgtagttattagttactcgtattcgatagtcattttatagagtcaaaatgttgtatacaactgtacaatcttcggtaatggaaattttctggaagag

SEQ ID NO: 4459 - DNA, 2428 bp, Gossypium raimondii
aaagttgactaaattttttcccattcttttttatctctcgctcgctgcctgcctgcctgcctgccctcgcgcgagcgagaaaggtaaaaggaaaaaggaagggagaaaaaaggacaggaactaaacaaacaaaataaaacaattggaagagaaaggaaaggaaagaaatctctgaacttttctctcctctctgcatttcttttattaacaatcggaacagtcttcgatcatccccgctatacgccggtttttctcccaatccgcttctgattcagtcaaatcgcttcgcttcctactttctttacttgttttactcttctgactccgaccatagggttaagggttagggcaacaggttcatcatcggcatcatcatcggcgcaaatggatgcttcaggtacggattcagatgcttacggaggtgcctcttctaattcaaggagacacagaatactatcggcttcgaatataatccaagcgcctctttcagccttgttagaatactcaggtcttcttcgtacatcacgttctatccaccaagaatccgaccctcttatccctaatccgaacctagaaaattccacttctgcccttgccaacaatggacatgttgctattaggataattgggacgggagacaaccatgagagcgagagagatgcatctggtatggtagcgggccaactcagggaagttactcctcagaacgaggtgtttctggggttgggaacatctgatggtcaaggaggaaattccagaagcagcgagctaggggtggctgctggagaaggagaaggtgtttcccactcctcgtccaatgggagtgttagtgctgatgcagaagctggggatggaggtgggggtgggtctggagttaataatagcagagattcctcctaccaaagatatgacattcagcaggctgctaggtggattgagcaagttctgcccttttctttacttctcttggttgtttttatccggcaacatttgcaaggtttctttgttacaatttggattgctgctgtaatgttcaagtctaatgacattttacggaaacaaaccgctttgaagggggagagaaagatctctgttctgactggaatctgtgttgctttcacgctccatgttatcgctgtatattggtggtattggaatgatgatcttttgtatccattggtgatgcttcccccaaaatatattccacctttctggcatgctatttttattatcatggttaatgatactttagttcggcaggaagcaatggttttaaagtgctttctgttaatgtattacaagaacagcagaggcagaaattacaggaagcagggtcaaatgctgacattggttgagtacatgatgctactttaccgtgctttactgccaactccagtttggtaccgtttcttcttaaacaaagactatggaagcctcttttcatcactaatgacagggttgtacttaaccttcaagctgacttctgttgttgagaaggtgcaatccttctttgctgcattgaaggcattatctcgtaaagaggtacattatggtgcttatgcaacatcggagcaggtgaatgctgctggggacctgtgtgccatctgccaagagaagatgcatgctcctatactactacgttgtaaacacatcttttgtgaagattgtgtgtctgagtggtttgagagggaaagaacttgtcctttgtgcagggcgttggttaaacctgcagatctgagatcatatggtgatggatctactagtttgttttttcagatattctaatatcattgctaagatacgatcagaatcagaatcagaatcagggaagctttactgcttggatgttcctaaaatgtatccagagcagccctatcctgaacctcatcatcatcatcatcctctagaggggtaaattggattgtttggttttgccatgtcttgtcaatgtgaatttaactaagaagttgaaaccaaaacaactgatttggaaagaagtaaaaaaaaaaaaattggacgtcttctgttccttttgtatgttgtaatgtgaaagggttgaatttgaattgaatgtatctatctaatgggccctctaagcaacacatagagttggtcttatcagtatatgttacggttctattggcgtaaatgcaaacctcttttattttttctctctttccctcttaaaaagagtaaactttgtgatggatcctgggttttaagttttgtagagctattagtcttgcaagctggtgttggaaatggtcttcaagaacacgcaatctgccctgccagaggtagagcggcagctacatccttttttcttgccctaatattttgtttgtctacatgccattttatcaggttatataataaactcaattcctaatgattggcttctgaatggctaaactcattggatgtgaaa

SEQ ID NO: 4460 - DNA, 2267 bp, Abies balsamea
acggaaacgaagagaaaccagaaaccatcttcttgcctacaccatgggagcatgaaagcctttacgcgtcgtgctcgatcccggcggtccttcaattttccctcgaatcaccgaaaagaatcgtccgaggacagcagctaaagataagtatttgccccttcggtttggatggttagaaaattcgagatcaacttgaatttgcatttagaagacatatttagcctgaattttgcatattccaaggagtaattggtgtaaattcgagctatttttatcgagccagggcaccgtatcgattagaccctaagttgaaaaaagcgaactgttataatatatttcaaccctgttagggagggcttttagatttagacattgtagccaccaaaccctaagtcgaagccctgtgatttaaataaataaaccccaagtcgaggctctgctatttaaatttaaatggaaacatccagtacaacaagccctgatgggcttaggaacaatggttctagaagatatggaatgcgtttctctgctgcaaacgtaattcaggcgccattatctgctctgttggagtatacagggattttgaggggtcgaccacattatcatgaaattgagggtacagtcgggggttctgtgagggaaagggcagacgatggcggtagggccgaggtttcaattagaataattggtgccggggaacagataggagcggttcaactccagacaaatggtgtagaaacagggtctgctagtgttagtagtaatggccatcttcaggtttcatctgctggtttggagtcggcgcaaactgcaaggggtgctgatatcggcgacgatggcacaggatcctcggccacgatggcccctctgacaataagcgccggggcaaatggtgagactgatgcaaacagtaatactaatgcaaatggaagggatactgcctatcagagatatgatattcaacagcttgcgagatggattgaacagattttgcctttctccttattgctgctggtggtgttcatccggcaacacctgcaaggtttctttgtcacattctggatagctgcagtgatgatcaaatcaaatgatgttttgcgcaaacaaacagcattgaagggcgaaaggaaggtttcagttctcatcggcatcatattggtttttgttgtccacgtggttggagtttattggtggtatagaaaggatgatctactgtatccacttgttatgcttcctccaaaaacaataccaccattttggcatgctctattcatcattgtggtcaatgatacaatggtgcggcaagctgcaatggtttttaaatgtggtcttttgatatattttaagaatagccgaggccgtaactatcggaagcagggtcagatgttgactttagttgaatacattctattactctatcgtgcattacttcctacacctgtttggtatcgcttcttcttgaacaaagaatatggtagccttttttcatccctcacgacagggttgtacctgacctttaagctgacatcaattgtggagaaggttcaatcattctttgcggcattgaaggcactgtcccgcaaagaagtccagtatgggtcgtatgctactacagaggaggttgttgcagccggagatttgtgtgcaatctgccaggagaaaatgcatgcccccatattattacgttgtaagcatatattttgtgaggaatgcgtctcagaatggtttgaaagggagagaacatgcccactttgtcgtgctttggtaaagccagctgatttgagatcctttggtgatggttctactagtcttttctttcagctgttttaatttgtaccaagtaaaggggaggtgactaagttactcaaattgtggaattggacatattttagagcacttgggcgcaacagagaaaatttgaaaatattgtcctaattcctgataaatttctgccagcttgtgacaagtttaacatcagggatgtttgctgagaagtaaatctcatgcacttaattggcagttctagttgaactgtatgtcatttgaggtgatttatctgcaaataatttctttggtactattacactgaagtactcttcatatgacaaagggcatactgtgagtagtttttctcaatgaactccagaggaggccgttgatcagcctgtaaactacaagttaccaaaaggccggcttgttgagttagaatgtcagtttcttctaaactgaaacattcttaatttgattatgatatattggcatgaaac

SEQ ID NO: 4461 - DNA, 870 bp, Amsonia hubrichtii
cgtacttaggtaaggtagagaaaatagtctacttcttcttcttgtctatttctacttgttttctactacttcgtatgtggttggggtttagttggttggtagttcgaatgatgatcttcttatatccgttggttgatgcttcctaccgaacggtacaataccacctttttcggtctacgctatcttcgtaataatggtgaatagatactttggtccggtccaagctgctatggtcgccaagtgtgttctattaatgtattacaagaatagcagaggccgtagttacgtaaacaggtcaaatgctaacgttggttgagtatctgctactactataccgtgctttgctaccagctccagtttggtatcggttcttcttgaacaaagagtatgggagcttttttcatcactaatgactgggttgtacttgactttcaagcttacatctgtagttgagaaggtccaatgctttttaactgcttcgaaagctttgtcacgtaaagagattcattatggagtttatgcaacgtctgaacaggtcaatgcagcagggggtctgtgtgctatatgtcaggaaaaaatgcatgcaccaatcttgttacgttgtaagcacattttctgtgaggactgtgtatctgaatggtttgagagggaaaggacatgtccactgtgtagggcattggtcaaacctgcagatcttagatcctttggtgatggatcaactagtctattttttcagttattctaaacaccttacctttggaaactaggaattcttttgctctgaagccgtggtgcacatttgaagtggtttccgtagagcaactatcctctcatagagatctctgctggtatgcatttagaaaaaagacc

SEQ ID NO: 4462 - DNA, 1851 bp, Manihot esculenta
atgatggttagggttagggttagggcatctgcgcagatggaagcgtccggtagtaattctgacgggtacagaggttcttcgggagggagtagtacaagtagtggtaattctaggaggtatggaatgctatcggcttcaagtatcattcaggcacccatttctgccttgttagaatattcgggtcttttacgaacctctaggtcaactcaccaagaaacggacactttgatgaacgcctctggtggggttcatgatcatcgacttgatgattctacagctgtagcagcaggaatagctgcggcagccaacaacggtgaggttgcaattaggataattggtgcaggagaacatgagcatgacagggagagctctggattggcggttgggcagttgggttctcagcgtgaggtgtctgtgcagcagccaatggctgggatggaatcggatgttcagggagattctagaaatgatcgtggttcaggagaaggtcctcctcagcagccttccggtgcaagtggagatggggaagttgctgatggcagtgggactaatggaagggattcgtcttaccagagatatgatattcagcaagctgccagatggattgagcaagtccttcctttttctttgcttctgttggttgttttcatccgccagcacctgcaaggtttctttgttacaatttggattgctgttgtcatgttcaagtcaaatgacatcctacgtaaacaaacagctctgaagggagagaggaaaatctatgtcttgattggcatctctcttgcgttcacacttcatgtggttggtgtctactggtggtatcagaatgatgatcttttatacccattgattatgctccctcccaaaactataccacccttttggcatgctattttcatcataatgttgaatgatactttggtccggcaagcagcaatggtgttcaaatgtatattgttaatgtattacaagaacagtagaggccggaattatcgtaagcagggtcaaatgctaactcttgttgaatatctgatgctgctataccgcgccttgttgcctacaccagtctggtaccgtttctttttgaataaagaatatggtagcctcttttcatctctgatgacagggctgtacttgactttcaagctgacatctgtcttcgagaaggtgcaatctttctttgctgctttgaaggcactatcacgtaaagaggtacattatggggcttatgcaacatctgagcaggtcaatgcagcaggagacctgtgtgctatatgccaggagaagatgcatgctcccattttacttcgttgtaaacacatcttttgtgaagattgtgtatcagaatggttcgagagggaaaggacgtgtcccttgtgcagggccttggtcaaacctgcagatcttagatcgtttggcgatggttctactactttgttcttccagatattctagtacattctactgtaaaatcctaggagtttttcttcttcggagctcaaacgcctgctcaaagcttgccttttcctgatcagaagatatcaacacaagtatatgcgactatctggctgtgcttaattcagcagttgacccaaggaagttgaactgaagcaagtagatggaatttgatttggttccgttcctttgttgtatcgagaaaggttgaatgtatctaatggtccttaacggcagttcctttaaggactaacgctttatgtccgttttcgtttgccataaatgataagcttttccctcttgttgaattgtatatatttttctcaaaaggcatagatatttgtacatctttcgtttggagtacatgaaaggttcaccctagagcctaatttttgc

SEQ ID NO: 4463 - DNA, 2207 bp, Ricinus communis
ctcattattatctctctaccctttctctctcgcgctctatgccatcatcgtagagcgagaaaaagaaaaaacaacagaaagagaggaaggggaaagataaataataaaatttaaagcctaatgacagtccccaatttctgatcatcaccatttcttttccagttgtatcactatttcttttccttacaacatccatcgctggttttttaattcaaaagctaatcaaaattggccagagtcaaaatacgacgctttccccattgactttttcttcgttcatctattatcgagagggttaggtttagggtttctccaaatttgaatattttactcctccttcatctttttttttttttttttcttctcaagtcctcaacggagtttcgccttcgaaggttgttgttgttgttgatgatgatgatgatgatgatgattatatgatggttatggttagggttagaggttcatctgctgcacaaatggaagcgtccggagacgcatatagaggttcttcgtcttcatcttcatcttcgagtagcagtagcagtagtagtaacaataataataatttgaggcgttatggaatgttatctgcttcaagtataatccaagcaccgatttctgctttattagaatattcgggtctcttgagaacaacctcttctaccttgagctctaggtcaactcatcatcaagagacagaccctttggttaatgattctactgctgcgtcagcactagtgaatagtggggaggtttcaattaggataattggtgcaggggaacatgaaagtgatcatgacagggatggtggattggtgattggtcaaaatgaggtggtgtctgtgcagcagcagccaattgctggcctggcctcggatggagaaagtagaaatgatcacagcaatggtggtagggggacaggtgaaggtggtggtgctactcagcaggcttctaatgtcagtggagatggggaagctgctgctgatggtagtgggggtaatggaagggattcgtcttatcaaagatatgatattcaacaagctgctagatggattgagcaagtccttcccttttctttgcttctactggttgttttcattcgccagcatttgcaaggtttctttgttacaatttggattgctgttgttatgttcaagtcaaatgatattctgcggaagcaaacagctctaaagggagagaggaaaatctccatcttgattggcatctctcttgcattcacgcttcatgtggttggtgtctactggtggtatcagaatgatgatcttttgaaccctttaatcatgcttcctccaaagtctataccacccttttggcaagctatttttatcatcatggttaatgataccttggtccgacaggcggcaatggtcttaaaatgtattctcttaatgtattacaagaacagtagaggcaggaactaccgtaagcagggtcagatgctaactttggttgaatatctgatgctgttatatcgtgccttattgcctacaccagtttggtatcgtttctttttgaataaagaatacgggagcctcttttcatcactaatgacaggactgtacttgactttcaagctgacttcggtggtcgaaaaggtgcaatccttcttttctgccttgaaggcattatcacgcaaagaggtacattatggggcttatgcaacaactgagcaggtcaatgcagcgggggatctttgtgcaatttgccaggagaagatgcatgcccccattctactacgttgtaagcacatattttgtgaagattgtgtatcagaatggtttgagagggaaaggacatgtcccttgtgcagggctttggtgaaacctgcagatctcagatcatttggtgatgggtcaactactttattctttcagatattctgaattattctactgtaaagatgggagtttttctgcgagctccaaccacttacccaaagcttgccttttcttggtctacgcagtatatttgactcttttctggctctgctttgttcataaattatccaaggaaattgagctgattcaagtagattggaactggattagatattttcctttgttgtatggagaaagaaaggttgagtatatgttatggcccttaaaaacggctcctccaaggactaacaatatatgtcactgttcatttaccataaatgaaaggctttttaccacctgtttaaa

SEQ ID NO: 4464 - DNA, 1199 bp, Cedrus atlantica
agcagattttgcctttctccttattgctgttggtggtgttcattcggcaacacttgcaaggtttctttgttacattctggatagctgcagtgatgatcaaatcaaatgatgttctgcgcgagcaaacagcattgaagggcgaaaggaaggtttcggttctcatcggcatcatattggtttttgtgttccacgtggttggagtttattggtggtatagaaaggatgatctactgtatccacttgttatgcttcctccaaaaacaataccacccttttggcatgcactattcatcattgtggtcaatgatacaatggtgcggcaagctgcaatggtttttaaatgtggcttttgatatattataagaatagccgaggtcgtaactatcggaagcagggtcagatgttgactttggttgaatacattctactactctatcgtgccttgcttcctacacctgtttggtatcgcttctttttgaacaaagaatatggtagcctgttttcatctctcacgacagggttgtaccttacctttaaactgacatcgattgtggagaaggttcaatcgttctttgcggcattgaaggcactatcccgcaaagaagtgcagtatgggtcatatgctactacagaggaggttgttgcagctggagacttgtgtgcaatctgccaggagaaaatgcatgcccccatattattacgttgtaagcatatattttgtgaggaatgcgtctcagaatggtttgaaagggagaggacttgcccactttgtcgcgctttggtaaagccagctgatttgagatcctttggtgatggttctactagtcttttctttcagctgttttgatttgtacaagtaaatggaaggtgactaagttactcaaattgtggaactggacatattttagatctcttgggcagtggagaagagttgaaagtattgtcctaattcctgataaactttgccagcttgtgacaagtttaacgtcagtaatgtttgctgagaagtaagtctcatgcacttaattggcagttctagttgaactgtatgtcatttgaggtgatttatctgcaaataatttctttggtaccattacactgaggtttctcctcttcatatgacaagggccatattgtgagtagtttttctcaacggactccagaggaggccgtttatcagcctgtaaactacaagttac

SEQ ID NO: 4465 - DNA, 2003 bp, Coffea canephora
ctatctcacagatggaaacatcgaattccaattctgataatgctcatgccagtccttccgcttccaattccacgccatcatctcccagggattctaattcagctccttccagaaggtacggcgtccaattcccccctccgctccggtttttccactccccagtctcttccttgctggaatattccggttcgattaggctccgacccgaccattccgaagcggagcacctcattattgaccatcacgatactagtaatagcaatggcagcatcagcgcaaacggtcccgttccggtctcatcaacgactgctctaagaagtggcagtaatgctagtattgctacctccagtaatggggaggtatcgatacggataattgggcctggggatggggatcgggtcggattagtagctgacgctgatggtgatgaggagtctcttgggttggggtcgacttcggcgtcggtggatggaagcagtcaagatagaagcttgggtgctggggcaggagcggcggcggtggatgccgggggcgaaggaaattcgaccaatggaagcagtagaggggagtcttcgtatcagaggtatgatattcagcagtttggacgatggattgagcagattctgccattctctttgttgttattggtcgttttcattcgccagcacttgcaaggtttttttgtcacaatttggatcaccgctttcatgttcaagtcaaatgacattctgcggaagcagacagctctgaaggctgagagaaagatgttcgtccttgtcacttatttcgtggtctttatacttcacgcgtttgggatctactggtggtataggaatgatgatctttactacccattattcatggtccctccaaagtcaatcccacctttttggcacgcaattttcatcatccttgtcaatgatacaatggtgaggcagatagctatggccttgaagctggtgctactgatgtattacaagaatggcaggggccataatttccgaagacagggtcaaatgctaactttggttgaatacacattgttgctataccgtgcattattaccgactcctgtatggtatagattcttcttaaacaaggaatatggaagtcttttttcatcgctgacaacagggttgtatctaacatttaaacttacatctattgttgagaaggttcaatcctttttggcagccttgaaagcactatccaaaaaagaaattcattatggatcttatgctacatcagaacaggtaaatgctgcaggtgacttgtgtgctatatgccaggagaagatgcatgccccaattttattgcgttgtaaacacatcttctgcgaagattgtgtttcagaatggtttgaaagagagagaacttgcccgttgtgcagggcattggttagaccagctgatttacgatcatttggtgatggttcaacaagcttgttcatccaaatgttttgaagttttataccttcctagaaaaactctcccctacagtggcatttcactgaagtatcttcttataaagtaaaaacactgcctcattcttgggttgcctgttgcctcgttgtgctaaagacgatgcacgaggtagataaggtccgatccaagacctggacagatggaaggctaaattgccgtacagatgtttattcactctcaaagttgagcaaaagtaaatgtaaagtttgatgcctctctcccccaaccaaatgaaatccctatacaacccccaaaatcacaggcgggagtgaaagagcatatccttttctttatctgcaattagatgattacattattcgatcttctgggcagtttatctggtgttatgcctgtatagggtgataacattgtcgataagacagagccaaaattctgggacccttgtattcgacatcagtgtttctttagaaatatgcttaaatcaccatgattctgtctactgatatttcattatctgattggcaatgtacaagtttttagtaaaaaaaaaaaaaaaaa

SEQ ID NO: 4466 - DNA, 2097 bp, Gossypium hirsutum
cctgcctgcctgccttttaatgcgcgagcgagaaaggtaaaaggaaaaaggaccgtagaaaaaaagacaggaactaaacaaacaaaataaaacaattggaagagaaggaaaggaaagaaatctctgaatttttctctcctctctgcatttcttttattaacaatcggaacagtcttcgatcatccccgctatacgccggtttttctcccaatccgcttctgattcagtcaaatcgcttcgcctcctactttctttacttgttttactcttctgactccgaccatagggttaagggttagggcaacaggttcatcatcggcgcaaatggatgcttcaggtacggattcagatgcttacggaggtgcctcttctaattcaaggagacacagaatactatcggcttcgaatataatccaagcgcctctttccgccttgttagaatactcaggtcttcttcgtacatcacgttctatccaccaagaatccgaccctcttatccctaatccgaacctagaaaattccacttctgcccttgccaacaatggacatgttgctattaggataattgggacgggagacaaccatgagagcgagagagatgcatctggtatggtagcgggccaactcagggaagttacttctcagaacgaggtgtttctggggttgggaacatctgatggtcaaggaggaaattccagaagcagcgagctaggggtggctgctggagaaggagaaggtgtttcccactcctcgtccaatgggagtgttagtgctgatgcagaagctggggatggaggtgggggtgggtctggagttaataatagcagagattcctcctaccaaagatatgacattcagcaggctgctaggtggattgagcaagttctgccattttctttacttctcttggttgtttttatccggcaacatttgcaaggtttctttgttacgatttggattgctgctgtaatgttcaagtctaatgacattttacggaaacaaaccgctttgaagggggagagaaagatctctgttctgactggaatctgtgttgctttcacactccatgttatcgctgtatattggtggtattggaatgatgatcttttgtatccattggtgatgcttcccccaaaatatattccacctttctggcatgctatttttattatcatggttaatgatactttagttcggcaggaagcaatggttttaaagtgctttctgttaatgtattacaagaacagcagaggcagaaattacaggaagcagggtcaaatgctgacattggttgagtacatgatgctactttaccgtgctttactgccaactccagtttggtaccgtttcttcttaaacaaagactatggaagcctcttttcatcactaatgacagggttgtacttaaccttcaagctgacttctgttgttgagaaggtgcaatccttctttgctgcattgaaggcattatctcgtaaagaggtacattatggtgcttatgcaacatcggagcaggtgaatgctgctggggacctgtgtgccatctgccaagagaagatgcatgctcctatactactacgttgtaaacacatcttttgtgaagattgtgtgtctgagtggtttgagagggaaagaacttgtcctttgtgcagggcgttggttaaacctgcagatctgagatcatatggtgatggatctactagtttgttttttcagatattctaatatcattgctaagatacgaccagaatcagaatcagaatcagggaagctttactgcttggatgttcctaaaatgtatccagagcagccctatcctgaacctcatcatcatcatcatcctctagaggggtaaattggattgtttggttttgccatgtcttgtcaatgtgaatttaactaagaagttgaaaccaaaacaactgatttggaaagaagtaaaaaaaaaaaaattggacgtcttctgttccttttgtatgttgtaatgtgaaagggttgaatttgaattgaatgtatctatctaatgggccctctaagcaacacatagagttggtcttatcagtatatgttacggttctattggcgtaaatgcaaacc

SEQ ID NO: 4467 - DNA, 2260 bp, Gossypium hirsutum
gagaaaggaaaggaaagaaatctctgaacttttctctcctctctgcatttcttttgttaacaatcggaacagtcttcgatcatccccgctatacgccggtttttctcccaatccgcttctgattcagtcaaatcgcttcgcttcctactttctttacttgttttactcttctgactccgaccatagggttaagggttagggcaacaggttcatcatcggcatcatcatcggcgcaaatggatgcttcaggtacggattcagatgcttacggaggtgcctcttctaattcaaggagacacagaatactatcggcttcgaatataatccaagcgcctctttcagccttgttagaatactcaggtcttctccgtacatcacgttctatccaccaagaatccgaccctcttatcactaatccgaacctagaaaattccacttctgcccttgccaacaatggacatgttgctattaggataattgggacgggagacaaccatgagagcgagagagatgcatctggtatggtagcaggccaactcagggaagtaactcctcagaacgaggtgtttctggggttgggaacatctgatggtcaaggaggaaattccagaagcagcgatctaggggtggctgctggagaaggagaaggtgtttcccactcctcgtccaatgggagtgttagtgctgatgcagaagctggggatggaggtgggggtgggtctggagttaataatagcagagattcctcctaccaaagatatgacattcagcaggctgctaggtggattgagcaagttctgcccttttctttacttctcttggttgtttttatccggcaacatttgcaaggtttctttgttacaatttggattgctgctgtaatgttcaagtctaatggcattttacggaaacaaaccgctttgaagggggagagaaagatctctgttctgactggaatctgtcttgctttcacgctccatgttatcgctgtatattggtggtattggaatgatgatcttttgtatccattggtgatgcttcccccgaaatatattccacctttctggcatgctatttttattatcatggttaatgatactttagttcggcaggaagcaatggttttaaagtgctttctgttaatgtattacaagaacagcagaggcagaaattaccggaagcagggtcaaatgctgacattggttgagtacatgatgctactttaccgtgctttactgccaactccagtttggtaccgtttcttcttaaacaaagactatggaagcctcttttcatcactaatgacagggttgtacttaaccttcaagctgacatctgttgttgagaaggtacaatccttctttgctgcattgaaggcattatctcgtaaagaggtacattatggtgcttatgcaacatcagagcaggtgaatgctgctggggacctgtgtgccatctgccaagagaagatgcatgctcctatactactgcgttgtaaacacatcttttgtgaagattgtgtgtctgagtggtttgagagggaaagaacatgtcctttgtgcagggcgttggttaaacctgcagatctgagatcatatggtgatggatctactagtttgttttttcagatattctaatatcattgctaagatacgatcagaatcagaatcagaatcagggaagctttatctgcttggatgttcctaaaatgtatccagagcagccctatcctgaacctcatcatcatcatcatcctctagaggggtaaattggattgtttggttttgccatgtcttgtcaatgtgaatttaactaagaagttgaaaccaaaacaactgatttggaaagaagtaaaaaaaaaaaatttggacgtcttctgttccttttgtatgttgtaacgtgaaagggttgaatttgaattgaatgtatctatctaatgggccctctaagcaacacatagagttggtcttatcagtatatgttacggttctatctgcgtaaatgcaaaccctctcttttattttatttttttttctctctttccctcttaaaaagagtaaactttgtgatggatcctgggttttaagttttgtagagctgttagtcttgcaagctggtgttggaaatggtcttcaagaaagaacacgcaatctgccctgccagaggtagagcggcagctacatccttttttcgtgccctaatgttttgtttgtctacataccattttatcaggttatataataaactcaattcctaatga

SEQ ID NO: 4468 - DNA, 1326 bp, Lotus japonicus
aggttctccaacatcatcatcatcatcgtcgtcgttgaatttatcttccaattcgagaagattcgggttattatccgcgtcgaacatcattcaggcgccgttatcgttgcttcttgaatattccggtattctccctccgaggtccaaccagcatcagccgaattccgacgtcgctgctgctcccagcgacggcgaggtttcgatcagaatcatcggttccgcggagcacgatcatcagcgcagggaagagcagactctttctgatggggacttggctgtggggaatgacgctgtagacccttcacaggggggtgatgctgacggcggcgttggcgtttcgcggacgggaaatggcggcgggaacgctgaagctgggggtggccgcggggaaggagcagggcccaatgggagggattcttcataccagagatatgatattcagcatgcagctaggtggattgagcaggtcttgcccttttctttgcttctcttggttgtcttcatcaggcagcatttgcaagggttttttgttacaatttggattgctgttgtccttttcaagtcgaacgacattctgcggaaacaaacggcactgaagggagagaggaaagtacctgttttgattgggttttctgttgctttcgcgcttcacgtggttggtgtttattggtggtatcagaatgatgatctaatgtatccattggtcatgctcccccccaaagagataccaccattctggcatgcaattttcattatcatggtgaatgatactttagtccgccaggctgcaatggtattcaagtgtatattgttaatatattacaagaacagcagaggccggaattatcgtaagcaggggcaaatgttgaccctagttgaatacctgcttctgctttatcgggccttgttaccagcaccagtttggtatcgtttcttcctgaataaagaatatggaagcctcttttcatcattgatgacaggattgtatctaacatttaagctcacatctgttgttgaaaaggtgcaatctttctttgctgcagtgaaagcattgtcacgtaaagaagtgcactatggggctcatgcaacatcagagcaggtcaatgcagctggtgatctttgtgctatctgtcaggagaagatgcatgccccaatcttgctccgttgtaaacacattttctgtgaagactgtgtatctgagtggtttgagagggaaaggacctgcccattgtgcagggctttggtaaaacctgcagatctcaggtcatttggtgatggctctactagtttgtttttccagttattctgaaatcatcaaatcataca

SEQ ID NO: 4469 - DNA, 2617 bp, Pinus pinaster
ggagaaagcggtaagaaagagaaaagtcagtaaccatcttaccgccgaggcgatggaagtatattcgatcgtggcggacctctaatttcccctcgaattaccgaaaagaatcgtccgagaaataccaagataagtataggccccttcgttttgatggtttcaaagaaaattcgagatcagggtctgtgattatcagcttgaatttggaattagaagcgagaattttccatttttcatggaataattggtgtgaatttcagctatttatatcgagccagggtactgtatccaatagaccctgagttggaaaaacggaactgctataatatatttaaaccctgttgaagagggcttttagatttagacattgcatccaccaaacccttagttgatatcctgtgatttaaattaataaaccccaagtcgagaccatacaatttaaatttaaatggaaacgtctagtacaagcaccgaagggttcaggaacaacggctctagaagatatggaatgcgtttctctgctgcaaacatcattcaagcgccattatctgctctattggagtatacagggattttgaggggtcgaccacattatcatgaaattgagggtacaggtggaggttctattagggaaagggcagatgatggcagtggggccgaagtttcgattagaataattggtgccggagaacagataggggcggttcaacttcagaccaatggggtagaaacaggttctgctaatgttaatagtaatggccatcttcaaatttcgtctgctgggttggagtcggcgcagattgcaggggatgttgatgttggtgccgagagtacgggatcgtctactacgattaccccgctgacaataagcgccggggaaatggcgagaccgatgccggaaacagtaacaataatccaaatggaagggatactgcatatcagagatatgatattcaacagcttgcgagatggattgagcagattttgcctttctccttattgctgttggtagtgttcgttcggcaacatttgcaaggtttctttgttacattttggatcgctgcagtgatgatcaaatcaaatgatgttctgcgcaagcaaacagcgttgaagggtgaaaggaaggtttcagttctcatcggcatcatattggtttttgtgttacatgtggttggagtttattggtggtatagaagagatgatctactgtatccactagttatgcttcctccaaaaacaataccacccttttggcatgcactgttcatcattgtggtcaatgatacaatggtgcggcaagctgcaattggtttcaaatgtggtcttttgatatattataagaatagccgaggccgtaactatcggaagcagggacagatgttgactttggttgaatacattctgttactctatcgtgcattgcttcctacacctgtttggtatcgcttcttcttgaacaaagaatatggtagcctgttttcatctctcacaacagggttgtaccttacctttaagctgacatcaattgtggagaaggtgcaatcattctttgcagcattgaaggcactatcccgcaaagaagtccagtatgggtcatatgctactacagaggaggttcttgctgctggagacttgtgcgcaatctgccaggagaaaatgcacgcccccatattgttacgttgtaaacatatattttgtgaggaatgtgtctcggaatggtttgaaagggagaggacatgcccactttgtcgtgctttggtaaagccagctgatttgagatcctttggagatggttctaccagtcttttctttcagctgttttgatttctacaaaaggaaggtgaccaagttactcgaattgtggaactgcacatattttagagcacttgggggcaacggagaagatttgaactattgtcataattcccgataaccttcggccatctcgcgacaagtttgtgacaactttaacgtcagtaatgtttgctgagaagtagatctcatgcactaaattggcagttctagttgaactgtgtcatttgaggtgatttatctgcaaataatttctttggtacgattacacttggtagttctcttcatatgacaaaggccatattgtgagaagtttttctcaatgaactccaaaggccgttgaacagcctgtaaactacaagttaccaagatgacggcttgttgagttagaatgccagtttcttctaaactgaaatatgcttaatttgattatgtctattggcatgaaatgagagtatgatccaaaacaaaatctgatgaagatctccgcaactgtatatgcggtaaatctctgaagtgaatatccaaaattgtgtttaatggtctttttaaaatgcttgacaggtttttcttaatctgaggccctttgtagtttattagtgtaaactgttcccttaggatgtactaatggattgccgcagctttcaatttcagaacacttatatcctcggaatgcttttcagcagcctggaaagcattttaacgatgtccttttaatttgtttactgcaaagattaaatgatggccgaatatttatatgtgatttcagaccttgatattgagaataagctttaggaattaggtt

SEQ ID NO: 4470 - DNA, 2569 bp, Pinus taeda
caaaacgcgctcagggagaaagcgtaacaaatggaagtcagtaaccatcttaccgccgaggcgatggaagaatattcgatcgtggcggacctctaatttcccctcgaattaccgaaaagaatcgtccgagaaataccaagataagtataggccccttcgttttgatggttttaaagaaaattcgagatcagggtctgtgattatcagcttgaatttggaattagaaggcagaattttccatttttcatggaataattggtgtgaatttcagctatttatatcgagccagggtactgtatcaaatagaccctgagttggaaaacggaactgctataatatatttataccctgttgaagagggcttttagatttagacattgcatccaccaaacccttagttgatatcctgtgatttaaattaataaaccccaagtcgagaccgtataatttaaatttaaatggaaacgtctagtacaagcaccgaagggttcaggaacaatggctctagaagatatggaatgcgtttctctgctgcaaacatcattcaagcgccattatctgctctattggagtatacagggattttgaggggtcgaccacattatcatgaaattgagggtgcaggtggaggttctattagggaaagggcggatgatggcagtggggccgaagtttcgattagaataattggtgccggagaacagataggggcggttcaacttcagaccaatggggtagaaacaggttctgctaatgttaatagtaatggccatcttcaggtttcgtctgctggtttggagtcggcgcagattgcaggggatattgatgttggtgccgagggtacgggatcgtctactacgattaccccgctgacaataaacgccgggggaaatggcgagaccgataccggaaacagtaataataatccaaatggaagggatactgcatatcagagatatgatattcaacagcttgcgagatggattgagcagattttgcctttctccttattgctgttggtagtgttcgttcggcaacatttgcaaggtttctttgttacattttggatcgctgcagtgatgatcaaatcaaatgatgttctgcgcaagcaaacagcgttgaagggtgaaaggaaggtttcagttctcatcggcatcatattggtttttgtgttacatgtggttggagtttattggtggtatagaagagatgatctactgtatccacttgttatgcttcctccaaaaacaataccacccttttggcatgcactgttcatcattgtggtcaatgatacaatggtgcggcaagctgcaatggttttcaaatgtggtcttttgatatattataagaatagccgaggccgtaactatcggaagcagggccagatgttgactttggttgaatacattctgttactctatcgtgcattgcttcctacacctgtttggtatcgcttcttcttgaacaaagaatatggtagcctgttttcatctctcacaacagggttgtacctcacctttaagctgacatcaattgtggagaaggtgcaatcattctttgcagcattgaaggcactatctcgcaaagaagtccagtatgggtcatatgctactacagaggaggttcttgctgctggagacttgtgcgcaatctgccaggagaaaatgcacgcccccatattattacgttgtaaacatatattttgtgaggaatgtgtctcggaatggtttgaaagggagaggacatgcccactttgtcgtgctttggtaaagccagctgatttgagatcctttggagatggttctaccagtcttttctttcagctgttttgatttctacataaggaaggtgaccaagttactcaaattgtggaactgcacatattttagagcacttgggggcaacggagaagatttgaactattgtcataattcccgataaccttctgccatctcgcgacaagtttgtgacaactttaacgtcagtaatgtttgctgagaagtagatctcatgcactaaattggcagttctagttgaactgtgtcatttgaggtgatttatctgcaaataatttctttggtatgattacacttttggtagttctcttcatatgtcaaaggctatattgtgagaagtttttctcaatgaactccagagaccgttgatcagcctgtaaactacaagttaccaagatgacggctctttgagttagaatgccagtttcttctaaactgaaatacgcttaatttgattatgagtattggcatgaaatgagagtatgatccaaaacaaaatctgatgaaaatctccgtaactgtatatgcgataaatctctgaagtgaatatccaaaagtgtgtttaatagtctttttaaaatgcttgacagatttttcttaatctgaggccctttgtagtttattagtgtaaactgttcccttaggatgtactaatggattgtcgcagctttcaatttcagagcacttatatcctcagaatgcttttcagcagcctggaaagcattttaacgatgtccttttaatttgtttactgcaaagattaaatgacg

SEQ ID NO: 4471 - DNA, 2208 bp, Pseudotsuga menziesii
gaaacagggtctgctaatgttagcagtaatggtcatcttcaggcttcgtctgttgggttggagtcggcgcaaactgcagggggtctcatccactgtatctattagaccctaagttggaaaaactgaacggttgtaatatatttcaactcttccagggaggcctttttagatttagacattgtatctatcaaaccctaagttgaggtcccgtgattttaacaaataaaccccaattcgaggtcctgcaatttatatttaaatggaaacttctagtacgagcaccgaagggtttaggaacaatggctctagaagatatgggatgcgtttctccgctgcaaacgtaattcaggcgccattatctgctctgctggagtatacagggattttgaggggtcgaccacattatcatgaaattgagggtacaggtgggggctctgttagggaaagagcagacgatggcggtggggctgaggtttcgattagaataattggtgccggggaacagataggggcggttcaacttcagacaaatggggtagaaacagggtctgctaatgttagcagtaatggtcatcttcaggcttcgtctgttgggttggagtcggcgcaaactgcagggggtgctgatattagtgccgatggtacgggatcgtcggctacgatgaccccgctgactataagcgccggtgtaaatggcgagactgatgctggaaacagtaataatacagcaaatggaagggatactgcctatcagagatatgatattcaacagcttgcgagatggattgagcagattttgcctttctccttattgctattggtggtgttcattcggcaacacttgcaaggtttctttgttacattctggatagctgcagtgatgatcaaatcaaatgatgttcttcgcaagcaaactgcattgaagggtgaaagaaaggtttcggttctcattggcatcatattggttttcgtggtccatgtggttggagtttattggtggtatagaaaggatgatctactgtatccacttgttatgcttcctccaaaaacaataccacccttttggcatgcactgttcatcatcgtggtcaatgatacgatggtgcggcaagctgcaatggtatttaaatgtggtcttttgatatattataagaatagccgaggccgtaattatcggaagcagggtcagatgttgactttggttgaatacattctattactctatcgtgcattgcttcctacacctgtttggtatcgattcttcttgaacaaagaatatggtagcctgttttcatctctcacaacagggttgtaccttacctttaagctgacatcaattgtcgagaaggttcaatcattctttgcggcattgaaggcactatcccgcaaagaagtccagtatgggtcttatgctactacagaggaggttcttgcggctggagacttgtgtgcaatctgccaggagaaaatgcatgcccccatattattacgttgtaaacatatattttgtgaggaatgtgtctcagaatggtttgaaagggagagaacttgcccactttgtcgtgctctagtaaagccagctgatttgagatcctttggggatggttctaccagtcttttctttcagctgttttgatttgtacgagtaaagggacagtgaccaagttactcaaattgtggaactggacatattttagagcactttggcaacggagaagatttgaaaatattgtcctattcctgataaacttctgccagcttgtaacaagtttaacatcagtaattgtttgctgagaagtatatctcatgcacttaattggcggttctagttgaactgtatgtcatttgaggcgatttatctgcaaataatatcttggtactgttacactgaggtctcttctacatatgacaaaggccatattttgagaagtttttctcaatgaactccagaggaggccgttgatcagcctgtaaactaaaagttacaaaacggccggcttgttgagttagaatgcccagtttcttctaaaactgaaacattcttaatttgattatgatctattcgtatgaaatgagattatgatcttctaaatccaattctggtgaaagtctccgaaactgtacatgtgagacatgtctgaagtgactaactaaagttgtgttcaatagtctttctaaaatccttggcagtcttttaattaatatgaa

SEQ ID NO: 4472 - DNA, 2624 bp, Picea glauca
tgaaaggaagagctaagaaagagagaaacgtcagaaaccatcttacagccgacgcgagggaagcatattcgatcctggcggatttctaatttcccctcgaattaccgaaaagaatcgtccgagaaatgtcaaagataagtattggccccttcgtttcgatggttttaaagaaaattcgagatcagggtctgggatcatcagcttgaatttgcaattagaagctatagctagccataattttgcattttccatggagtaattggtgtaattttgagctatttttatggtgccagggcactgtatccattagaccctaagttggaaaaactgaactgctataatatatttcaaccctgttagggagggcttttagatttagacgttgcgtccaccaaaccctaagtcgatgtcctgtgatttaaataaataaaccccaagtcgagaccctacaatttaaatttataaatggaaacgtctagtacaagcaccgaagggtttaggaataatggctctagacgatatggaatgcgcttctctgctgcaaacatcattcaagcgccattatctgctttgttggagtatacagggattttgaggggtcgaccacattatcatgaaattgagggtacaggtggaggttctgttagggaaagggcagacgatggcggtggggccgaggtttccattagaataattggtgccggggaacagataggggcggttcaacttcaaaccaatggggtagaaacagggtctgctaatgttaatagtaatggccatcttcaggcttcgtctgctggtttggagtcggcacaaattgcaggggatgttgatattggtgccgatggtacgggatcgtcggctacgatgaacccgctgacaataagcgccgggggaaatggcgagactgatgccggaaacagtaataataatgcaaatggaagggatactgcctatcagagatatgatattcaacagcttgcgagatggattgagcagattttgcctttctccttattgctgttggtagtgttcgttcggcaacacttgcaaggtttctttgttacattctggatagctgcagtgatgatcaaatcaaatgatgttctgcgcaagcaaacggcattgaagggcgaaaggaaggtttcggttctcattggcatcatattggtttttgtggtccatgtggttggagtttattggtggtatagaaaggatgatctattgtatccacttgttatgcttcctccaaaaacaataccacccttttggcatgcactgttcatcattgtggttaatgatacaatggtgcggcaagctgcaatggtttttaaatgtggtcttttgatatattataagaatagccgaggacgtaactatcggaagcagggtcagatgttgactttggttgaatacattctattactctatcgtgcgttgcttcctacacctgtttggtatcgcttcttcttgaacaaagaatatggtagcctgttttcatctctcacaacagggttgtaccttacctttaagctgacatcaattgtggagaaggttcaatcattctttgcggcattgaaggcactatcccgcaaagaagttcagtatgggtcatatgctactacggaggaggttcttgcagctggagacttgtgtgcaatctgccaggagaaaatgcacgcccccatattattacgttgtaaacatatattttgtgaggaatgtgtctcagaatggtttgaaagggagaggacttgccccctttgtcgtgctttggtaaagccagctgatttgagatcctttggggatggttctaccagtcttttctttcagctgttttgatttgtacaagtaaagggaaggtgactaagttactcgaattgtggaactggatatattttagagcactcgggcaacggagaagatttgaaaatattgtcctaattcctgataaacttctggcagcttatgacaagtttaacggcagtaatgtttactgagaagtagatctcatgcactaaattggcagttctagttgaactgtatgtcatttgaggtgatttatcagcaaataatttctttggtacgtttacactgaggttctctcctcttcatatgacaaaggccatttgtgagaagtttttttcaatgaactccagaggaggccgttgatcagcctgtaaactacaagttaccaaaaggacggcttgttgagttagaatgccagtttcatctaaactgaaaatattcttaatttgattatgatctattggcatgaaatgagattatgatctaaacccaattctgttgaaaatctccaaaactgtatatgtgagacgcctgaagtgaatatccaaaattgtgtttaatagtctttctaaagtgctttggcagatttttcctaatctgaggccctttgtagtttattactggaaaccattcccttagtatatactattggattgtcgcagctttcaattttagaacacttggtatctgagaaatgcttttcggcagcccgaaaagcatttttacgatgtccttttaattcgttgacagtaaagatttaatgttgtctaaatatttatatgtgatttcagacacttgaaactaagaatcagttt

SEQ ID NO: 4473 - DNA, 1368 bp, Zostera marina
gctgtcattacagagcataacacggtgattgctgatcgtgccgatgtagatggtgagaatgttgccagagaagggatatctccttcatcttcatatacatcgtctgatgcttctgtgggagcagagggtgatgcagggaacactacgggtgcgaatagcagagatggggcataccagagatacgatatacagcaggttgcgaggtggatcgagcagattctcccattctcattgcttttgttggttgtattcattcgacagcacttacaaggtttctttgtcacaatttggattgctgcagtgatgtttaaatctaatgacattttgcgaaaacagacagctttaaagggagagagaaaaatatgtgtgcttgttgcctttgcctttgcattcacactacatgtagctggggtctactggtggtacagaaatgacgatcttgtgtatccactgttcatgcttcctccaaaagtgatcccccattttggcatgccatatttataattatggttaatgatacgatggtccgtcaggcagtgatgattcttaaatgcatgttactaatgtattacaagaacaccagaggtagaaaccaccgtagacagggtcaaatgctaaccttagtggaatacatgctgttgctgtaccgtgcattattaccggcacccgtttggtacagatttttcctgaacaaggagtatggtagccttttttcttctcttaccactggattatacttgactttcaagttaacatctgttgttgagaaggtccagtcgttcatcacagcattcagggcactgtctcgcagggaagtacagtatggatcacacgcaacatcggaacaggtaattgcagcaggagatttgtgtgccatctgccaagagaagatgcacactcccatcctgttgcgctgcaagcacattttttgtgaagactgtgtatccgaatggtttgaaagggaacggacatgtcccttgtgtagggctttggtgaaacctgcagagcttagatcatttggtgatgggtcgacaagcttgtactttcaactgttctgacttctgaatcccaatcacaaatagagcttgctgcttctgcgggtgtttcttcttccatattaaagggataagaagaactgcctttgatgctgtgtttatttgactgcctctgatccaagatcttctcagttacaccactaaaggtcacgtgctttattttgtatttaagatctatattgtaagtaggggggagttatctctgtccacgcactcaacttggtgacgttcatacttcataggtgtattttactgattatatttatataatatattatatccaatatataaaattcttaatttctcatgaaaa

SEQ ID NO: 4474 - DNA, 561 bp, Amborella trichopoda
actgctgatgtattacaagaatagcagaggccgcaactatcgcaagcagggccaatgctaacctagttgaatatgtgctcttactgtaccgtgctttgctacccacacctgtatggtaccggtttttcttaaacaaggattatgggagcctcttttcttctcttactactggtctatatctcactttcaagctgacatccattgttgagaaggttcaatcattctttgctgcattgaaggcattatcacgcaaagaagtccattatgggtcttatgcgacaacagagcaggtcctcgcagctggggatctttgtgccatttgtcaggagaagatgcatgcgccaattttgcttcgttgcaaacatattttctgtgaagattgtgtatcagaatggtttgagagggagagaacatgtcctctatgcagagctctggtgaaaccagctgacctcagatcatttggcgatggctcaaccagcctctttttccagatattttgaccactcaaccagctggaaaaattgttttatgtcctgatatcttgccagaaaatggcagttg

SEQ ID NO: 4475 - DNA, 1840 bp, Arabidopsis thaliana
aaaaaactctcaaccgttgatttgattcacacacagacgagacaagacaattccgtcccctctctctctctctttccgcagctcgccggatctcctttgtcttcttcccctgggttccgtttagctcaatccctttttaggaaagactccgtggctcgatcctagtcttggcgatcgcctctaccctttttgactctattcttcttcttcttcattcatttcccctcttattcattgcctttagggtttcttacacgatatgagctaaatacgattttgatttcaccctaagctttcttctattgcttctcgtcgttgcagggttttcttaaatggaaacgcccggcgccagtcatgattcatttaggggttctcctcgtagaaactccatcctctctgcttctaacatcatccaggcccctatttctaccttgttagagtattcgggtctctttcgagctaggccaagtcctagtcatgaggctgagacgcttgttagtgatgattcttcaggactctccaatggggaggttgccattaggatcattggcaacaccgagcaggatgctgaaactgataccaatgctctgagggaacccggacactctgaactcttgggttcttctgctactcaggttgatcccatgggaggtgcttcagaaggtgcctctcaggctgctccaggtgatcctgctgctggagacgccgcttcccgggattcgccttaccaaagatatgatattcagcaggctgcacgctggattgagcaaattcttcccttttctttgcttctgttggttgtttttatccgccagcatttgcaggggttctttgtcgccatttggattgctgctgtcatgttcaagtcaaatgatattctcaagaagcaaacagctttgaagggtgagaggcatatctcggcattaattggaatctctgtagcatttacggcccatgttgttggtgtttattggtggtttcggaaggatgacctcttgtatcccttaatcatgctgcctccaaagtccataccacctttctggcatgccatttttatcatagtggtgaatgatacacttgtccggcaggcctcaatgattttcaagtgttttttgttgatgtactacaaaaacagtaggggtcggaattatcgtaaacagggtcaattgctaactttggttgaatatttcatgcttctgtatcgctctttactgcctacccctgtatggtaccgtttctttttgaacaaggattatggaagcctcttctcctctcttatgacgggattgtatcttacattcaagctcacttcagtagttgagaaggttcaatccttctttacggcattgaaggctttgtcacgtaaagaggtgcactacggatcatatgcaactacagagcaggtaaatgcagcaggcgacctgtgtgccatctgccaggagaagatgcacaccccaattcttcttcgctgcaaacacatgttttgcgaagattgcgtttcagagtggtttgagagagagaggacgtgtcctttgtgcagggccttggtcaaaccagcagatctgaaatcattcggtgatggatccaccagcctcttcttccagattttctgattaaaacacatatacaagactgcaaagtaaaaaagaccctctagactcacttgctcactcgatagttttcttagagagtatttctatacaatgccattcaagctgtgaaagaaaccactgatgccttggaagatgttcatactatgtcatttgttaatatgaatgaaatcgccttttatattccgttgcaaaaaacaatctgatttcattcaagaagaaataattaa

SEQ ID NO: 4476 - DNA, 2313 bp, Theobroma cacao
atactaacaaattaaaaaaactactagacggaaatactatattttacagaaataaagaaaattattgggcttggtaacaaacacaagttgactaattttctctcgttttacttttatctctctccgccctcgcgagagcgagaaaggtagaatgaaagagaggaaatcgagaaggggaaagaaaaggaggccaatcaaaggaaaccattcatcgatcactctttgtttgtttcctcctatctctgcatttccaatttcccctctttccttcaacaatcgaaagactgtttgatcgtcccagcaacctcgattgagcctgcgccggcgtttctaccaattcgattcagattcagtcaaatcacttcgcttcctttcttgactttttcctcctactctcttgactccgacgatagggaaaacgtcttctagggttaggatacgtttcttcttttcttatcggatgattttttagttttcttgacaaaatttttctccacggagtttcgctttcgaaggaaataggcaagaaaaaaattggaaaagtaaaattagaagtcctgattcagatgataaaatgatggttagggttagggcaacggcatcagcatcatcgacgcaaatggaagcgtcaagtactaatctggacgcttacagaggtggctctacgaattcgagaagatatggaatgctttcggcttcgaatataattcaagcgcccatttcagccttgttggaatactcaggtcttctccgtacatcacgctctatccaccaagaaccagaccctctcatccccaatcagaatctagaaaattccactcctacccttgccaacaatggagaggttgctattaggataattggggcgggagaccatgagagcgagagggatgcctctggtatggtggttggccagctcagggaagttacttctcagagtgaggtctcgctggggttgggaacgtccgatggtcagggaggagataccaggagcagtgatcgcggggtggctactggagaaggtgtttcccagtcatcgccaaatgggagtgctggtgctgctgatgcggaagctggggatgggggtggggctggagttaataatagcagagattcctcctatcaaagatatgacattcagcaggctgctaggtggattgagcaagttctgccgttctcgttgcttctcttagttgtttttatccgccaacatttgcaaggtttctttgttacaatttggattgctgctgtcatgttcaagtcaaatgacattttacggaaacaaactgctttgaagggggaaaggaagatctctgttctgattggcatcgctcttgctttcacacttcatgttatagctgtctactggtggtactggaatgatgatcttttgtatccattagtgatgcttccccccaaatctattccacctttctggcatgctatttttattatcatggttaatgatactttggttcgacaggaagcaatggttttaaagtgttttctgttaatgtattacaagaacagtagagggcgaaactaccgtaagcagggtcaaatgctgacattggttgagtatatgatgctactttaccgagccttattgccaactccagtttggtatcgtttcttcttaaacaaagactatggaagcctcttttcgtcactaatgacagggttgtacttaaccttcaagctcacatctgttgttgagaaggtgcaatccttctttgctgcattgaaagcattatcacgtaaagaggtacattatggtgcttatgcgacattggagcaggtgaatgcagctggggacctctgtgccatctgccaggagaagatgcatgctcctatcctacttcgttgtaaacacattttttgtgaagattgtgtatcagagtggtttgagagggaaagaacgtgccccttgtgcagggcattggttaaacctgcagatctcagatcgtatggtgatggatcaactagtttgttttttcagatattctaagataattgctgtgtaaatcggggaggtttttctgcttcgacaatctaaaaaatacttaccgaaagctgctgtatcctaatcatcatggacatgggtaaatttgactgttgggttctgccatgtccactaagaaattgaaacggaaacaactggatagaagtgaaattggccgtctgttcctatgttgtatttgaaatgtggactgtatgtaatgggccctctaagctacacagagttcatgttaagtactaacagtatatgtcactgttcaattggcataaatgaaagcctcttttttttttttt

SEQ ID NO: 4477 - DNA, 1541 bp, Manihot esculenta
atgatgattatggttagggttagggcatctgcgcagatggaagcgtccggtagtaattctgacgtgtacagaggttcttcgggagtgagtaatccaactaatagtaattcgaggaggaacggaattctatcggcttcaagtatcatccaggcaccaataactgctttgttagagtattcaggtctgctgcgaaccaccagttcaactcaccaagaaacggaccccttgattaacaattcggctgggattcatgctcatcgacttgatgattctacagctacaccagcagcagcagccacagccaacaatggagaggttgccattaggataattggtgcaggagaacatgagcatgacagagaggggtctggattggtggttgggcaattgggtgctcagagtgaggtttctgtgcagcagccactggccggaatggaatcggatgttcagggggattctagaaatgatcgtgtctcaggagaaggtgcttctcagcaatcttccagcgcaagtggggatggggaagttgctgatggcagtggagctaatggaagggattcatcttaccaaaggtatgacattcagcaagctgccagatggattgagcaggtcctccccttctctttgcttctcttggttgtcttcatccgccagcatttgcaaggtttctttgttacaatttggattgccgttgtcatgttcaagtcaaatgatattgtacgtaaacaaacagctctgaagggagagaggaaaatgtctgtcttgattggcatctctcttgcattcacacttcatgtggttggtgtctattggtggtatcagaatgatgatcttttatacccattaattatgctccctcccaaatcaatcccacccttttggcatgcaattttcatcatcatggtgaatgatacattggttcggcaggcagcaatggtgttcaaatgcattctgttaatgtattacaagaacactagaggccggaattatcgtaagcagggtcaaatgctaactttggttgaatatctgatgctgctataccgtgctttgttgcctacaccagtatggtaccgtttctttttgaataaagaatatggtagcctcttttcatcactaatgacagggttatacttgactttcaagcttacatctgttgtggagaaggtgcaatctttctttgctgctttgaaggctttatcacgtaaagaggtgcattacggggcttatgcaacatcagagcaggtgaatgcagcaggagatctgtgcgctatatgccaagagaagatgcatgctccgattctgcttcgttgtaaacacatcttttgtgaagattgtgtatcagaatggtttgagagggaacggacgtgtcccttgtgcagggccttggtcaaacctgcagatctaagatcgtatggtgatggttcaactactttgttcttccagatattctaaaattttctactgtaaaaacgtaggagtttttcttcttcagagctccaaaaacttacccgaaatcttgccttttcctgatcagcaagagg

SEQ ID NO: 4478 - DNA, 1583 bp, Catharanthus roseus
aacaatttttccttttaaattttgttctgtaatcaataacaatcttgacgaaattcgggtaatttaatttttgttcaagagattttcttcgacaatggagacatcaagctctgatgctcacgcaaattccagttcaacttccaattcgacgccatcatctcctagggattccaattctctacaaaataggagctacggtattcaatttcctcctccgctcagattttttcgctctcccgtttctccctgcttgaatactctggtcttctccgtctccggcccgatcaatctgaagcggagccgctcgtccggggaaacaatagtaacaacaataatggtcgtaatacaatttccaaccccacgtttcggtatcaaggagcggaagtagccacaatagtagtactagtagtaacgctttccagtaatggggaggtttcaatacggataattggggctggagaaagggatcgacttgggtcagaagatggagatgatgatgatgatgaaggtatgaggttgggtttgaactcggtggaagaaggagctcaagagaggaatttgggcactacctctgcgtcggtggactcggttggtgaaggttctgtgggaggtgggagtagtagcaatggtagaggggagtcttcttatcagagatatgatattcagcaattcgcaagatggattgagcagattcttccattttttttgttgttattggtcgttttcattcgccagcacctgcaaggtttttttgtcaccatttggatcagtgccttcatgttcaagtcaaatgacattcttagaaagcagacagctctaaagggggagagaaaaatatttgttctggccggttactttgtggtttttatgcttcatgttcttggaatctactggtggtatcggaatgatgatctttactacccgttgtttatggttcctccaaaatcaataccaccattttggcatgcagtttttatcatccttgtcaatgatacaatggtgcggcaggcagcaatgtccttgaagcttctgctgctgatgtattataagaatggccggggccataatttccgcagacagggtcaaatgttaactctggttgagtacactttgttgctataccgtgcattattacccactcctgtatggtatagattcttcttgaacaaagaatatggaagccttttctcatcattgacaaccgggctgtatctgacattcaagcttacatcaattgttgaaaaggtccagtcctttttagcagcattgaaggcattatcgagaacggaaatccattatggttcttatgccacggcagagcaggtaaatgcagcaggagatctgtgtgccatttgccaagaaaagatgcatgctccaattttactgcgttgtaaacatatcttctgtgaagattgtgtttcagaatggtttgaaagggaaagaacttgccctctgtgcagggctttggttagaccagctgatttacgttcatttggggatggatcaacaagcttatttatccaggtgttctaaaaaaaaaactaaaagaaaaaggaaattcaactatccacatttactgattc

SEQ ID NO: 4479 - DNA, 1372 bp, Cephalotaxus harringtonia
ttaccccgctgacgataaattctgggcctaacagtgcagagacagatgccagcgagaataataataatacaaatggaaatggaagggatacagcatatcagagatatgatattcaacaacttgctagatggatcgagcagattttgccattttccttacttttgttggtggtctttattcgacagcatctgcaaggcttctttgttacgttctggatagctgcagtaatgatcaagtcaaatgatattctgcgtaagcagacagctttgaagggtgaacggaagatttcagttcttattggcatcatattggtttttgtagtccatgtggttggaatttactggtggtacaggaatgtcgatctgctgtatccacttgttatgcttcctcccaaaataataccaccattctggcatgcaatgtttatcattgtggttaatgatacaatggtgcggcaagctgcaatggttgtaaagtgtggccttctgatatattataaaaatagcagaggacgtaattatcgtaagcagggccagatgttgactttggttgaatacatcctactgctctaccgtgcattgcttcctactcctgtctggtaccggttcttcttgaacaaagattatggtagcttattttcatctcttacgacaggattatatcttacttttaaactcacgtcaattgtggagaaggttcaatcattctttgctgcattgaaagcattgtctcgcaaagaagttcagtatgggtcatatgctactacagaggaggttcttgcagctggagacttgtgtgcaatctgtcaggagaaaatgcatgccccaatattacttcgttgtaaacatatattttgcgaggaatgtgtgtcagaatggtttgaaagggagaggacttgcccactttgtcgagctttggtaaagccagctgatttgagatcctttggggatggctccaccagtcttttctttcagctattttgatttgttgcaaagggagcaagactagttactcacattgaaattatggttaattcataagagcacttggtcatatgagaatagacatcattgatattgtgctgatgtgtcagaaacccgtttcagtttgtgacaggtcagacatcagtggatgttgccaagaagtacgacactgaattttggatcgggttttattgcatgtcatttgagatgcttgtatctgcaatcagttatcaataccatttttcgtatgaggaaaccatcttgtaagaaaattttcgttaaggacgtatgatggagggcattgattaagtgtgtagacttagatgctggattgtattatattgccagtaattttaaaactggaaaatttagtttgaatgtggtctttt

SEQ ID NO: 4480 - DNA, 2454 bp, Citrus sinensis
  misc_feature (2168)..(2168): n is a, c, g, or t
atttggtcctctctctctctctctctctctttctctttctctctctatatttttctcgcgctcgccaatagagcgaaaagggaaagaagagcggaaacaacgaacaccataacaaaaataaaagccaaccataattatttaaaaattaagaattaaaaccgaacaaaaaaataaaggatttttattttcattactggtttcacttttgagcattttcatttcgatcgcataaatttttttcaatccaccaaagcttcaatttaatcaccggatgataacattggaaccgtttccggtcgaatcacggcgttcggttggttgaccttttttttcccccgtatttgactcgatttagggttagggtcttcgtcgaatgaaatttctccttgtctgattacgaggttgcctccacggagtttcgctttcgaagggttagggcatcaagagaaatggaagcgtctgttactaatcctgacgcttatagaggtccttctggaacgagtagcaattcgcgaagatatggaatgctttcggcttctaacataattcaagctccattatcaacgttattggagtactcaggtcttttaagaacgaggtcaagtcatcaggaatcagaacccttgattaattcgactgtttctgctcaccttagcaatcataatcggcttgacgatcctactgtgaacaatggggaggtggcaattaggataattggggcaggggagcacgagcatgagagggatgggtctggagggttggtgattgggcaggtaagggaagggactgggcagtctgatgtggcgtccgttgcgttggcaggtgataatcagggagatggtaggactgatcgtggggtgggtgctggagaaggtgttttacagtcttctaatgggaatggtgatgcagaagctggggatggtgctgcggttaatggtagagactcttcttatcagagatatgatattcagcaggctgctaggtggattgaacaggtccttccgttctctttgcttctcttggttgtcttcattcgccagcatttgcaaggtttctttgttacaatttggattgctgctgtcatgttcaaatcaaatgacgttctacggaaacaaacagctttgaagggagagaggaaggtctctgttctgattggcatctctatcgctttcatgcttcatgtggctggcgtctactggtggtacaggaatgatgatcttttgtaccctttggtcatgcttcctcccaaatccataccacctttctggcatgctattttcatcatcatggtgaatgatactttggtccggcaggcatcaatggtgctcaagtgttttcttttaatgtattacaagaacagcagaggccgaaattatcggaagcagggtcagttgctaactttggttgagtatttgatgcttctgtaccgtgcgttattgccaacaccagtatggtatcgtttcttcttgaacaaagaatatgggagtctcttctcatcgctgatgacagggctgtacttaactttcaagcttacatctgtggttgagaaggtgcaatccttcttttctgcgttgaaggcattgtcgcgtaaagaggtgcattatggggcctatgcaacaacagagcaggtgaatgcagctggagatttgtgtgctatatgtcaggagaagatgcatgctccaattctgcttcgttgtaaacacattttctgcgaagactgtgtctcagagtggtttgagagggaaaggacgtgcccattgtgcagagctttggtcaaggcagcagatctcagatcatttggtgatggatcaactagtttgtttttccagatattctgattgcactactgtagaaacccggagttttttgctttgaagatctagatatttaattgaagctgccttctccagattgccgtctacactagtaaatttgactgtatcctactcaaccctgttcatgagttgccgaggaaattaaagcaaaatgatggatagaatcaaattggctttccgttagtatatgttgtattgtcaaatttcttcaatgatggcaaagatgttgaatgtatgtaatgaggccattaagttacaggaattttttccccccaagactaacaatatatgtcaatgttaatttttcataaatgaaaagcacctaaatagaanaaaatccaaaaaaaaaaaaaaaaaaaaaaaaaaaaaaaaaaaaaaagggggcgcgccgctctaaaagaatcaaaatttacattacgccttgcttgcaaagtccataactcttctaaagtggctccctaaatttcaatttcctgggccgcctttttaaaacctcggtgacgggaaaaaccctgggggttaacccaacttaaatcccctttgcaaccaatcccccctttctcccacctggggggaaaaaacgaaaaaaagccccgcccccaatttcccctttttccaa

SEQ ID NO: 4481 - DNA, 2259 bp, Citrus clementina
agctgacaagctcaacgagcgtgggaccaatggcaattaaaacaagttggtattattttgtcattcatttggtcctctctctctctctctctctttctctttctctctctatatttttctcgcgctcgccaatagagcgaaaagggaaagaagagcggaaacaacgaacaccataacaaaaataaaagccaaccataattatttaaaaattaagaattaaaaccgaacaaaaaaataaaggatttttattttcattactggtttcacttttgagcattttcatttcgatcgcataaatttttttcaatccaccaaagcttcaatttaatcaccggatgataacattggaaccgtttccggtcgaatcacggcgttcggttggttgaccttttttttcccccgtatttgactcgatttagggttagggtcttcgtcgaatgaaatttctccttgtctgattacgaggttgcctccacggagtttcgctttcgaagggttagggcatcaagagaaatggaagcgtctgttactaatcctgacgcttatagaggtccttctggaacgagtagcaattcgcgaagatatggaatgctttcggcttctaacataattcaagctccattatcaacgttattggagtactcaggtcttttaagaacgaggtcaagtcatcaggaatcagaacccttgattaattcgactgtttctgctcaccttagcaatcataatcggcttgacgatcctactgtgaacaatggggaggtggcaattaggataattggggcaggggagcacgagcatgagagggatgggtctggagggttggtgattgggcaggtaagggaagggactgggcagtctgatgtggcgtccgttgcgttggcaggtgataatcagggagatggtaggactgatcgtggggtgggtgctggagaaggtgttttacagtcttctaatgggaatggtgatgcagaagctggggatggtgctgcggttaatggtagagactcttcttatcagagatatgatattcagcaggctgctaggtggattgaacaggtccttccgttctctttgcttctcttggttgtcttcattcgccagcatttgcaaggtttctttgttacaatttggattgctgctgtcatgttcaaatcaaatgacgttctacggaaacaaacagctttgaagggagagaggaaggtctctgttctgattggcatctctatcgctttcatgcttcatgtggctggcgtctactggtggtacaggaatgatgatcttttgtaccctttggtcatgcttcctcccaaatccataccacctttctggcatgctattttcatcatcatggtgaatgatactttggtccggcaggcatcaatggtgctcaagtgttttcttttaatgtattacaagaacagcagaggccgaaattatcggaagcagggtcagttgctaactttggttgagtatttgatgcttctgtaccgtgcgttattgccaacaccagtatggtatcgtttcttcttgaacaaagaatatgggagtctcttctcatcgctgatgacagggctgtacttaactttcaagcttacatctgtggttgagaaggtgcaatccttcttttctgcgttgaaggcattgtcgcgtaaagaggtgcattatggggcctatgcaacaacagagcaggtgaatgcagctggagatttgtgtgctatatgtcaggagaagatgcatgctccaattctgcttcgttgtaaacacattttctgcgaagactgtgtctcagagtggtttgagagggaaaggacgtgcccattgtgcagagctttggtcaaggcagcagatctcagatcatttggtgatggatcaactagtttgtttttccagatattctgattgcactactgtagaaacccggagttttttgctttgaagatctagatatttaattgaagctgccttctccagattgccgtctacactagtaaatttgactgtatcctactcaaccctgttcatgagttgccgaggaaattaaagcaaaatgatggatagaatcaaattggctttccgttagtatatgttgtattgtcaaatttcttcaatgatggcaaagatgttgaatgtatgtaatgaggccattaagttacaggaattttttccccccaagactaacaatatatgtcaatgttaatttttcataaatgaaaagcacctaaatagaaagcatcctttttcccgtgttcttcgcaa

SEQ ID NO: 4482 - DNA, 609 bp, Actinidia deliciosa
ctggcatgctatatttatcatcctggtaaatgacacactggtgcggcaggcagctatggctttgaagtgcatgcttctaatgtattataagaatggcagaggcaataatttccgtcgccagggtcaaatactaactctgattgagtataccttactgttgtaccgtgcattgttaccgactcctgtctggtatcggttcttcttgaacaaagagtatggaggcctcttttcatcactgactacaggattgtacttaactttcaagcttacatctgttgttgagaaggtccaatccttctttgcttccctgaaggcattatcacaaaaggacattcattatgggtcttatgctacgttggaacaggtaaatgcagcgggggacttgtgtgcgatttgccaggaaaagatgcatgcccccattctactacgctgtaaacacattttctgtgaagactgtgtttcagaatggtttgagagagaaaggacttgccctctgtgcagggccttagtgaaagctgccgacctgcgatccttcggagatggatcgacaagcttattcttccaactgttctaaaaataccgcgtcgtttcaaagccatgtatcttccc

SEQ ID NO: 4483 - DNA, 1626 bp, Carica papaya
gatttccaccttgttagagtattcgggtcttctgcggacgaggtccgggactcatcaagaaacggagagcttgatcagcggtggaattcataatcatcttcacaatcaaggtcgtctcgatgactctgctccgacggccagcaacggggaggtttccatcaggataattggcgcaggggagcaggagaccgagagggagagccctgggttggtggttggtcaggttagggatccaagtggacagagtgaggtatctgtccagccgatggcaggcttggtatctgatgtccagggagattctgttggtgatcgttccctgggtatgggcgaaggtgtttcacagccttcttcaaactcagcagctgatgcagaagctggcgatggggctggccctaatactagggattcatcttaccagagatatgatatccagcaagcagctaggtggattgagcaagtgttaccattttctttgcttctgttggtcgtcttcatccgccagcatttgcaaggtttctttgtcacaatttggattgctgctgtcatgttcaagtctaatgatattctacgaaaacaaacagccttgaagggagagcggaagatatctattttgattggcatttctctagcattcacaatccatgttattggcatttactggtggtatcggaatgatgatcttttgtatccattagtcatgcttcctcccaagtctataccaccattttggcatgcggtttttatcatcatggtgaacgatactttggtccggcagactgcaatggtgctgaaatgtttcctgttaatgtattacaagaacagtagaggccggaattatcgtaagcagggccaaatgctaactctggtcgagtatctcatgcttttataccgtgccttattgccaactccagtctggtatcgtttcttcttaaacaaagaatacggaagcctcttttcgtcactgatgacaggcttgtacttaactttcaaagtcacttctatagttgagaaggtgcaatccttctttgctgcattgaaagccttatcacgtaaagaggtacattatggagcatatgcgacgtcagagcaggttaatgcagctggagatctgtgtgccatttgccaggaaaagatgcatgctcctatcctacttcgttgcaagcacatattttgtgaagattgtgtctcagagtggtttgagcgggagaggacgtgtccgttatgcagggctttggttaaacctgcagatctgaggtcgtttggggacggatcaactagcttgtttctccagatgttctaaaatcattactgtataatccacgaatctttttctgcattgaagttctaaatatactcaaagcgggtttctcctgatggtcatctacagatgtaaaagttgactgtagttgacttttctctttctttttgcttttcatggattacccaagaacatcaactaaagaggcaactagtagaagtgaacagcctgtctcttcatgtactttaattgagaatgctaaatgtatctagtgagcccttggaactagagaaaaagttggaaaggggctaacagtatttcattgtgaatttaccatatataaaagatttttcccaccttttccccta

SEQ ID NO: 4484 - DNA, 1455 bp, Taxus baccata
gcacgtgagagtaggggcagttgcatctaatgttgaagaaacagagacaggtaatggtggtaataataatcatatacagggttcttcaacgcctttgcagagcacggggaatgttgatatcagtggtgggggtagtgtgggttcgtcttcttcaattaccccgctgacaataaattctgggcccaacagtgcagagacagatgccagcgacaatagtaataatacgaatggaaatggaagggataccgcatatcagagatatgatattcaacaacttgccagatggatcgagcagattttgccattttccttacttttgttggtggtcttcattcgacagcatttgcaaggcttctttgttacgttctggatagctgcagtgatgatcaaatcgaatgatgttctgcgtaagcagacagctttgaagggtgaacggaagatttcagttctcatcggcatcatattggtttttgtagttcatgtggttggaatttactggtggtacaggaatgttgatctactgtatccacttgttatgcttcctcccaaaaacataccaccgttctggcatgcaatgttcatcattgtggttaatgatacaatggtgcggcaagctgctatggtagcaaagtgtggccttttgatatattataaaaatagcagaggccgtaattaccgtaagcagggtcaaatgttgactctggttgaatacatcctactgctctaccgtgcattgcttcctactcctgtctggtaccggttcttcttgaacaaagattatggtagcctattttcatctctcacgacaggattatatcttacttttaaactcacatcaattgtggagaaggttcaatcattctttgctgcattgaaagcattgtctcgcaaagaagttcagtatgggtcatatgctactacagaggaggttcttgcagctggagacttgtgtgcaatctgccaggagaaaatgcatgctccaatattacttcgttgcaaacatatattttgtgaggaatgtgtgtcagaatggtttgagagggagaggacttgcccactttgtcgagctttggtaaagccagctgatttgagatcctttggggatggctccaccagtcttttctttcagctattttgatctgttgcaaagggagcaagaatagttactcaaatcgaaactatggatcattcataaaagcacttaaccgtctgagaagagatatcatcaatattgtgcttgtgtgtcagaaaccattttggtatgtgacaggtcagacatcagtgaattcctataggaagtgtgacactgaatttcaggtcgggttttattgcatgtcggttgagatgcttgtatctgcaagcaattattgttgccatatttctaaggtttcttcgtatgaggaaaccgtcttgtaagaaattattttgttaatgacatataatggaggtcattat

SEQ ID NO: 4485 - DNA, 1655 bp, Trigonella foenum-graecum
tgatttcgaattagggttagggatttaacgcgaatggaagggaacggggacatgttcagatcatctccggtttccggagcatcatcatcgtcgagaagatacggattcccgtcggcagccagcataatccaagcacctttatcggcgcttttagaatattccggtattcttccggcgaggtcaaaccagcagcatcaaccaattcctgattctgtccctaacgacggtgaggtttcgattaggattattggttctaacgagcaagataatcacagggaagaagagggttcttcggtagtggcgaatgatggtggtggtgtggctgcgatgacgtcgaatggtgatgttgagggtgcttcaagaacagggagtggaaatgttgatgcagaagcaggtggtggtggtggtgatgttgctgctaatgggagagattcttcttatcagagatatgatattcaacatgctgctaggtggattgaacaagtcttgccgttttctttgcttcttttggtggttttcattcgccaacatttgcaagggttttttgttaccatttggattgctgctgtgcttttcaagtcaaatgacattctgcggaaacaaacggcgttgaagggagagaggaaaatgccagttttgattggaatttctgttgcttttgcacttcatgtgattggtgtttattggtggtatcagaatgatgatctaatgtatccgttagtcatgcttcctcccaaagagataccgcctttctggcacgctattttcatcatcatggtgaatgatactttggcacgccaagctgcaatggtagtcaagtgtatattgttaatgtattataagaacagcagaggccgcaattatcgtaagcaggggcaaatgctgactttagttgaatacctcctcttactttaccgagccttgttgccagcaccagtttggtatcgtttttcctgaacaaagaatatggaagcctcttttcatcactgatgacaggattgtatctaacatttaagctcacatctgtcgttgaaaaggtgaaatctttctttgctgcagtgaaagcattgtcacgtaaagaagtgcactatggggctcatgcaacatcagagcaggtcattgcagctggtgatctttgtgctatttgtcaagagaagatgcatgccccaatcttacttcgttgtaaacacattttctgtgaagactgtgtatcagagtggtttgagagggagaggacatgccctttgtgcagggctttggtaaaacctgcagaccttaggtcatttggtgatggttctactagtttgtttttccagttattctgaaatcatataatacacaaaccaaggaagtttttttttccagctttgaagctttacttttcaaagcagcaacctgatctatatacatcaacacatgtaaaattcactggagtcattttggagacactctgagaagatgaatgcagctaaatagaatttaactggtcacacctattattcatataatgtacttgtaagaaagaggtgaagtgtattatatgaccctgtaaactaggaagattattgagtgtataattatatgtgactcttcatttccaaggaatgaaggtctctttctccaaactgcagcctgtcatatactgtgaatcaaat

SEQ ID NO: 4486 - DNA, 1807 bp, Musa acuminata
tgatggatacccccagcggaggttctgatccttacaggaccccttcctccggtagtgccggaggcggctcttcgaggaggtacgttatcccttactcggcgtctaatctcatccaggcaccgttgtcggcgctcctggagtactccgggatcttgcggcccgaagcgagccaatcggaaagcgagagattgatcggcgggggattaccgctgccagaggttggtcctgcccgggtggacgagtcttccacgtcccccaccggcggcggtggggaggtgtcgataaggatagtgggggctggcgatcaggagagcctccgggtggcgtcgagccagctgcatcgttcgactctgggtcccggtggagaggtgaattctggtgttgttgtccctggtgagctgatcgctgcttcatccgagaggcagggaggagatggagtaagtgataatggggttggagagggggcctcgccgtcttcttctgtgccgacatctgactccgcatttggcggccacagcgcagatggtgatgtgaacatgacaggtaacaacagggattcgtcgtatcagagatatgatatacaacggatcgctaaatggatcgagcagatactgccattctcgttgcttcttttggtagtctttatcagacagcatttgcagggtttcttggtcactatttggatctcagcagtgatgtttaagtccaatgctgttttgagaaaacagactgctttaaagggagagcgaaaaatatctgtgattgttggaattatactggtctgcatggtacacgtatttggcatctactggtggtacaggaacgatgatctcttgtatccactaattatgcttcctccaaaagaaataccacgattttggcatgccgtatttattatattggttaatgatgtagtgatgcgccaagcagctatggttgtgaagtgtattctcttgatatactacaaaaactttaaaggccgtagctatcgtaagcagggtcaaatgctaactcttgtagagtactttctacttttataccgctctttattgccaactgctgtttggtaccgattcttcctgaacaaggaatatgggagcctgttttcatctcttactactggactgtatcttactttcaagctgacatcagttgtagagcaggttcaatcattttttgctgcattgaaggcactatcacgtaaagaagtacattatgggtcttatgcaacgtctgaacaggtaattgcagctggtgatctgtgtgccatttgccaagagaagatgaatgttcctattctacttcgttgtaaacacatattctgtgaagactgtgtctctgaatggtttgaaagagaaaggacatgcccattgtgcagagttctggttaagccggcagggctgaggtcatttagtgatggttcgacgaccttgttcttccagctattctgattcctgcattggcgagattaacttattgcctctaatgccagactgtgttctggaagatgcagggacgatcttgtgttctggcactgttaaactctctctctctctctctctggatcttcggggaagcatctctaaaaatgctgttgagctttgttgagacagcccatgggcgcatattctatatccactatatctataatcccccgtatcaggaaatataaacagaatagatgcaagagcaagtatatgatatgtatatagttcatatttaccacacattgttattaataaaacctatgttcagaagtttagacaaataatgtacttgtgtgtgcatccatgagtgacttttgcag

SEQ ID NO: 4487 - DNA, 1409 bp, Amsonia hubrichtii
gaagccgagtcactcatcgtggaaaacaataataacaatagcgatggtggtaattcaacttccaacgtcgccatgtcgacatcaaggagcagcagtagccataatagtagtagtaataataacggttccagtaatggggaggtttcgatacggataattggggcaggcgagggggatcgactcgggtcagacgatgaagatgacgaggaggaggcaatgggcttgggtttggggacggtggatgaaggaggtcgagagaggagtatgggtactacatcggtgtccctggactccagtgctgaagggtcggtgggaggtgggagtaatagcaatggtagaggcgactcttcgtatcagagatacgatattcagcagttcgcccgatggattgagcagattcttccattttctttgctgttattgatcgttttcattcgccagcacctgcaaggattttttgtcaccatctggatcagtgccttcatgttcaagtccaatgacattcttcggaagcagacagctctaaagggagagagaaagatatttgtcctagttggttactttgtagtctttatgcttcatgttcttggaatctactggtggtatcagaatgatgatctttactacccattgttcatggttcctccaaaatcaatcccaccattttggcatgcaatttttatcatccttgtcaacgatacaatggtgcgtcaagtggcaatgtcattgaagctattgctgctaatgtattataagaatggccggggccataatttccgcagacagggtcaactgttgacactgattgaatacacattgttattatatcgtgcattattgccaactcctgtgtggtataggttcttcttgaacaaagagtatggaagccttttctcatcattgacaacagggttgtatctgacattcaagcttacgtcggttgttgagaagatccaatccttcttagcagctttgaaggcactatcaagaagggaaatccattatggttcttatgctacgtcagagcaggtaaatgcagcaggagatctttgtgccatttgccaggagaagatgcatgctccaatattattgcgttgtaaacatatcttctgtgaagattgtgtttcagaatggtttgaaagagaaagaacgtgccctctgtgcagggctttggttagaccagctgatctacggtcatttggggatggatcaacaagcttgtttatccaggttttctaaaattttgatttgtttgtggagtaaaacagtgctcccatcgtagcaaattcttttggaccaagaaaaaaaaagaaaagaaaccatcaatctccttcaaagtaaaagcaccacctcaattcctgggtgacctgaggtatgcagtggtgtactccaatagcaggtaagttggg

SEQ ID NO: 4488 - DNA, 1781 bp, Arabidopsis lyrata
tctctctctctccgcagctcgccggatctcctccgttgtcttcttgctctgagctccgtttagctcaatccctttttcggaaagactccgtgactcgactcgatcctagtctaagcgatcgcctacgttttatttttctttttgactctattcttcttcttcttcattcatttcccctcttattattcattggctttagggtttcatacacgatatgagctaaatacgatttgatttcacctaaataagctttcttctattgcttctcgtcgttgcagggttttcttaaatggaaacgcccggcgccaatcatgattcctttaggggttctcctcgcagaaactccatcctctctgcttctaacatcatccaggcccctatttctaccttgttagagtattcgggtctctttcgcactaggcctaatcctagtcaggaggctgaaacgctggttactgatgattcttcaggaatctccaatggggaggttgccattaggatcattggcaacggggagcaagatgctgaaactgatagcaatggtctcagggagcccggcggccttggacacactgaacttttgggttctgctactcaggttgatcccataggaggtgctccttcagaaggtgcctctcaggctgctcctggtgaatctgttgctggagacgccgccacccgggattcaccttaccaaagatatgatattcagcaggctgcacgctggattgagcaaattcttcccttttctttgcttctgttggttgtttttatccgccagcatttgcaggggttctttgtcgctatttggattgctgctgtcatgttcaagtcaaatgatattcttaagaagcaaacagctttgaagggtgagaggcatatctcggcattaattggaatctctgtagcatttacggcccatgttgttggtgtttattggtggtttaggaaagatgacctcttgtatcccttaatcatgctgcctccaaagtccataccacctttctggcatgccatttttatcatagtggttaatgatacacttgtccgacaggcctcaatgattttcaagtgttttctgttgatgtactacaaaaacagtaggggtcgaaattatcgtaaacagggtcaattgctaactttggttgaatatttgatgcttttgtatcgctctttactgcctacccctgtatggtaccgtttcttcttgaacaaggattatggaagtctcttctcctctcttatgacgggattatatcttacattcaagctcacttcagttgttgagaaggttcaatccttctttacggcattgaaggctttgtcacgtaaagaggtgcattacggatcatatgcaactacagagcaggtaaatgcggcaggcgacctgtgtgccatctgccaggagaagatgcacaccccaattcttcttcgctgcaaacacatgttttgcgaagattgcgtttcggagtggtttgagagagagagaacgtgtcctctgtgcagggccttggtcaaaccagcagatctaaaatcattcggtgatggatccaccagcctcttcttccagattttctgattaaaacacatacaagattccaaagtaaaaaaggccctcaagactcacttgctcactcgatagttttcttagagagtatttctatacaatgccattcaagctgtgaaagacaccactgatgccttgaagatgttcatactatgtcatttgttaatatgaaatagccttttatattccgttgcaaaaaacaatctgatttcat

SEQ ID NO: 4489 - DNA, 925 bp, Tropaeolum majus
ggaaagatggtcttctatacccgttggtcatgcttcctcccaaatctataccacctttctggcatgccatttttatcatcatggtgaacgatactttggtacgacagacatcaatggcactgaaatgtttattgttgatgtatttcaagaatagtagaggccggaattatcgtaagcagggtcaaatgttaactctgatagaatatcttatgctgctatatcgtgcattattgccgacaccagtctggtaccgtttttcctaaataaagagtatgggagtctcttctcatcattgatgacagggttatacttgactttcaagctcacatctgtagttgagaaggtgcaatccttctttactgcattgagggcattgtcacgtaaagaggtccattatggagcttatgcaacatctgagcaggttaatgcagctggagatttgtgtgctatttgccaggagaagatgcatgctcctattctacttcgttgcaaacacattttttgtgaagattgcgtctcggagtggtttgaaagggaaggacatgtccattgtgcagggctttggtgaaacaggcagatctgagatcatttggagatggatcaacaagcctgttttccagatgttttgaaattggtgaaataaagatggaatttttctgctttgaatgcttaattatatttaaggcagctttctcctgatgaatcatttacacagatagtacacaaagcaaaatagtagggtgaatagaaatagatgttgatttgtaatatggagagattgttgaatgtatttagtagttggcctttttttaagtttaaatatttgtaaggtaaggccatccatatatgaaaaggttttctatcttgagccatgattggtacttgaaaaaaaggatgttacacaggaaataaaaagaaactattt

SEQ ID NO: 4490 - DNA, 1956 bp, Tropaeolum majus
caactatcagtgtctcacctgcacctccaattttcctcgatcaaattagcttcctttcttcttttttttcatcatcgattcagttgttttcccttgtttttagcagacaatgatgataaaaatcacggaattaggttacgtaaacctaatttgacttttccgttttgtttttttttcaatatagaattctctttgtccaatttcttgtcgcacgggtttaggcgttagggtttggtttctctgcggtgatttttttttgtcttctttgattcaagaaaaggtcctcaacggagattcgtcttcgaagggttagggcttcaaggcaaatggaagcgtcaggtactaatccagacgcctacagaggctcttcgagcagtagtaattctagaaggtacggactgttgtctgcttctaatattattcaggcgccgatatctaccttgttagagtactcggggtttctaagaccgaggtctgatagtcatcatgagagggagagcttgatcggcgcaggaattcgcgatcattttcacaatcagagtcgtgtcgaagactctgctactgcagccacaaacggggaggttgctatcagaataatcggtgcaggagagaacgaaggggagagggaaggtgggggattggtggtcggtcaggtcagggaagttagtggacagagtgaggtgtcggtacagccaattacaggatttacgaacgatgggcagggagattccaggagtgatcgcggggtagcaacagctggagaaccggcttcacatccttcttccagttctggcgtggatacagaagctggggatgcgggtggggctaacagcagggattcttcttaccagagatatgatattcagcaagctgcgaggtggattgagcagatccttcccttttctctacttctgttggtcgtctttatacgtcaacatttgcaaggtttttttgtcacaatttggattggggctgtcatgttcaaatctaatgatattctacgtaaacaaacagctctgaagggagaaaggaagatttccatactaattgccatttcacttgcgttcacgcttcatgtggttggcatttactggtggtatagaaatgacgatcttctatatccattggtcatgcttccccccaaatctataccacctttctggcatgcgatctttatcatcatggtgaatgatactttggtacgacagacatcaatggtacttaaatgtctgttgctgatgtatttcaagaatagcagaggtagaaattatcgtaagcagggtcaactgttaactttggttgaatatcttatgctactctaccgtgcgctactgccaactcctgtctggtaccgttttttcttgaataaagaatatggaagtctcttttcgtcactgatgacagggttgtacttaaccttcaagttgacatctgtagtcgagaaggtgcaatccttctttactgcattgagggctttgtcgcgtaaagaggttcattatggcgcttatgcaacatcagagcaggttattgcagcaggagatctgtgtgctatttgccaagagaagacgcatgcacctgttctacttcgttgtaaacatatattttgcgaagattgtgtctcagagtggtttgaaagagagaggacgtgccctttgtgcagggctttggtgaaacctgctgatctcaaatcgtttggggatggatcaactagcctgttttccaaatgttttaaaatggatatagtaaacacccaaatccttaattatattcctagcaactttctcatgaatgattgtcagttgatgaagtggtcaggaatataaaaaaccaacagaggctggatagagatgttcttttgttgtattgaggttattgaatgtatctaacgagccgataacagtaacaatattcgtaatgttttaaaatattataccgtttcatttaacttatataaaa

SEQ ID NO: 4491 - DNA, 1717 bp, Phalaenopsis aphrodite
ttcccattcaattccagatcttcttctactacggtttcctgagaaattttgcctgtattgatggtttacattttcatccgttttcgtagaattcgaagttaggattagggtttgccatcatggaaacatccggcggaaattccgatgcttattggacctcgcgggctgccggaaccggtggtggcacgaggagttactcgacgcagttttcggcttcaagcatcatccaggcaccgctgactgctctactagagtattccggattcctgcggcctcgatcaagcaaccatgcggagagtgcaggtttgcttgctggtgaagccaacggcggccgggcggtacatggttccgctcagccggaaggatctttgagttcgagttctggaggtgaaggggaggtgttgataaggattattccatcgggggatcatgagaaccagactcatccgtctaccggcgagaatggtgtttctgaggatgcgattcctagggtttctggtgatgttggagttggagatgatggagggagagagtatcgggttcgggaggttggtggatcgccagcctctgctaatacgcagagcttggatgatgatgtgaaccttgcggatgctaacaatagggagtcatcttaccagagatatgatattcagcagcttgcgagatgggttgagcagatactacctttctcgttgcttttgttggtagtgttcattcgacagcatttgcaaggattctttgtcactatctggattgcagcagtcatgttcaaatcaaatgatatattgcggaagcaaactgctttgaagggggaaaggagaatgtcagttcttgttggaataacagtggttttcatgtttcatgtctttggcgtctactggtggtataggaatgatgatctcatgaatccactggtgcttcttcctccaaaggaaattccaccattctggcatgctatattttttattttagtcaatgatactatggttcgacaggcggctatggtgatcaaatgcatacttctaatttatttcaagaacagtcgtggtcgtagctaccgtaagcagggtcaaatgctaacgcttgtggaatattttctcctcttgtatcgcgcgttattgccaacaccagtttggtatagattcttcctgaacaaagaatatggaagcttcttttcctctcttatcactggactatacttgactttcaagttgacatctgttgtggagaaggttcgatctttctttgctgcattgaaggacctgtcctgtaaagaggtgcattatggctcaaacgcaacagctgaacaggtgattgcagctggtgatctgtgtgctatatgccaagagaagatgcatgtgcccattctccttcgttgcaagcacatcttctgcgaagactgtgtttccgaatggtttgatagggagcgcacgtgcccactgtgtagggctctagtgaaaccaacaggccttcggtcattcggagatggttctacaagtttgtttttccaactgttttaatatttgtacagtaatgctatacttttattttaaacttcagaggtgaatgaaactgttccatcccttccctgcattatctcatatcccttctttgatgaaaaaatattgcatcaggactccgcacgtagagttacgttcggagtccaataaaatcacgcaacatgaacacaataacatctcaataacacataaataac

SEQ ID NO: 4492 - DNA, 2124 bp, Populus trichocarpa
atcactagatatagatgtagagagagaaacaagaaacacagaaataaaatacccacctttttaatttttttgctccaattgtcagaatttcttgatcggaacataatcaagaagaggaagaaagcttcgatcgattcttccttccctccttcaatggcgataactcagtagtcaaattccgacgctttcttagggtttgtcgaatgccacctcaaatttcatccattccatatttctaaccccctttctctcttcctcgacggagtttcgctttcgcagggttagggcatcatctgctgctcatacggtgatggaaggttcagggagtatctctgatccgcacagaggtggaggtggaaatagtaatagtagcagcagcttgacttcttcttcgaggtggtatggcatgctatcggcttctagtattattcaagcgcccatttcttctttgttagagtattctggtcttttaagaacgactcgttcgaatcatcaagaaaatgagtctttgattcctggtggtcttggtggagggggacatggttctagtagacttgatgattcgtcggcttcagtggtgcctaataatggagaggtttccattaggataattggggcgggagagcatgagagggacggttctggtggattggttgttggacaagtaggtggggcacaaaatgaggtgttgggacagcagcaaatgatgggtgcggatgctcttcagggtgatttgaggagtgatcgtggaggaggagatgcagctgatggcgctggtggtcagcagagttcaagtgtgagtggggatggggaggctgcagatgaggctgggggtaatggaagggattcaacttaccagagatatgatattcagcaagttgctaggtggattgagcaagtgcttcctttttccttgcttctattggttgtcttcattcgccagcatttgcaaggtttctttgttacaattggaattgctgttgtcatgttcaagtctaatgatattctacgaaaacaaacagctctgaagggagagagaaaaatctctgtgctggttggcatctcactcgcattcatggtccatgtggttgctgtttactggtggtatcaaaatgatgatcttctgtacccattaatcatgcttcctcccaagtctattcctcctttctggcatgccattttcatcatcatggtgaatgatactttggtccgacaggcagcaatggcattcaaatgtgttctgttaatttattacaagaacagtagaggccgaaattaccgcaggcagggtcaaatgcttactttggttgagtatctgattctgctgtaccgtgccttgttgcctgcaccagtctggtaccgtttctttttaaacaaagaatatgggagcctcttttcatcactaatgactgggttgtatctaactttcaagctcacttcttttgttgagaaggtgcaatccttcttttctgctttgaaggcgctatcacgtaaagaggtgcactatggggcacatgcaacatcagagcaggtcaatgcagcaggagatctgtgtgccatatgccaggaaaagatgcatgctcctatactacttcgatgcaaacacatcttttgtgaggattgtgtatcagaatggtttgagagggaaaggacatgccccttgtgcagggctttggtcaaacctgcagatctcagatcatttggtgatggttcaactagtttattattccagatattctaaaagcatctactgtagaaaccaggagttttgctgcttgggagctctacacacatacccaaagctgcctttttctgatcatcatctcacctatacacgtatacgtggctgtttttggctctggcttgttcattagttagttaaccaagaaaaatcaaaccaaagaaagtaggtggaacttgaattggctgtccattcgacttgtgtcgtgaaaggatgagtgtatcaaatggccttgaagacccagttcctcaaatgactaacaatatatgtatcatcctcatttgccttgaatggaaattttctttcatttttttgtcataaaactgtacatgcttctattctcaaggaatgaatgagtgcctttgcaatttggagtgcttgag

SEQ ID NO: 4493 - DNA, 719 bp, Sarracenia psittacina
acgtttttatgattcaagtgattggtgtttactggtggcaccggaagatgatcttttatatccattgttcttggttccacctaaagcggtaccgcctttctggcatgctgtatttagcattctggtaaatgacacaacggtacggcaagctgctatggctttgaagtgtatgctgctaatgtattataagaatggaagaggcctaacttccgtcgccaggggcaatactgactctgatcgagtatactttattgttgtaccgtgcattgtttccgactcctgtctggtatcgatttttcttgaacaaagagtatggaagcctcttttcatcactgactacaggattgtacttaactttcaagctcacttctgtggttgagaaggtccaatccttctttgctgccttgaaggcattatcgcgaaaggacatccaatatgggtcttatgctacatcagagcaggtaaatgcagcgggagacttgtgtgcgatctgccaggaaaagatgcatgctccaattctactacgctgcaaacacattttctgtgaagactgtgtctcagaatggtttgagagagaaaggacatgcccgttgtgcagggccttggttagagctgcagatctgcgttcctttggagatggatccacaagtctgttctgcaattgttctgaaaaaaataaaaatccacattgcgccaaagcttgtatcttctttccccta

SEQ ID NO: 4494 - DNA, 1458 bp, Fragaria vesca
ggaggaccgcgggagtggtgaggaagcgacggcggtgcaggatggaggaggggtggggggttggatagtcaggctgggatggatgagagagtgcccttggtgcctccgtcggcgccggagaatgaggccggggagggtgggaatgcggtggaggagaattcgagggattcggcttaccagagatatgatattcaacaggtggccaggtggattgagcaggttcttccgttttcgctgctcttactcgttgtgttcatccgtcagcatttgcaaggtttctttgtcactatatggatatcagctgtcatgtataggtcgaatgatattgtcaggaagcagacggctctaaagggagacaggaaaatctcctttcttgtggccattgctggtgcttttatgcttcatgtggttggtgtttactggtggtatcgaaatgatgatcttttatatccgctggcaatgcttcctcccaaagccataccaccattctggcatgcaatattcatcattttggtaaatgatactttggtgagacaggcaacgatggctttcaagtgtttgttacttgtatactacaagaatggaagagggcataactatcgtcgacaaggtcaaatgttaactgtagttgagtattcgctgctgctgtaccgtgccttattaccagcacctgtttggtacagattcttcctgaacaaagaatacggaagcctcttttcatcacttattacaggactatacttgacttttaagttaacatctgttgttgagaaggtccaatccttttttgcttctataagggcattatcacgaaaagatatccattatgggtcccacgcaacattggagcaggtaaatgcagcaggagacctttgtgccatctgccaggagaagatgcatgctccaatcctattgcgatgtaaacacatcttctgtgaggactgtgtctccgaatggtttgagagagaaagaacttgccctctatgccgggcagtggtaaaacctgcagatctgcgaacgtttggggatgggtcaacaagtttatttttccagtttttctaatatctaagtcctgactttgattagcgtagatatatgagcagcattattgaaacggtcacgttttgttctttcttataagaaaaaatgaatgtaatctgataacaacgtatcgtctttaggttggcaccaggaaatcagatggtaggtattaaccctagagggagatgtggaatggtattatgtcaatctgttgccatcatgaggtcatcgttgaacctaatggatgagaaaacagatagacatgattgctacatttctatctacaaatcatgcctctgataaatggggggtcatcctcagatatgttatctcctttgtatagaagatctttgatcctcccttctctcctgcgtgcaaacatgaaatataaatctgatgcgtttgtttcaatgaaaa

SEQ ID NO: 4495 - DNA, 822 bp, Tabernaemontana elegans
tcggaagcagacagctactaaaggagagagaagataattgtccttgttggttactttgtggtctttatgcttcatgttcttggtacctactggtggtatcagaatgatgatactttactatccattgttcatggttcctccaaaatcagtcccaccatttggcatgcaatttttatcatccttgtgaacgatacaatggtgcggcaggtagcaatgtccttgaagctattgctgctaatgtattataagaacggccggggccataatttccgcagacagggtcaaatgttaacactggttgaatacacattgttgttataccgtgcattattaccagctcctgtatggtatagattcttcttgaacaaagactatggaagccttttctcatcattgacaacagggttgtatctgacgttcaagcttacatcgattgttgagaaggtccaatccttcttagcagccttgaaggcattatcaagaagggaaatccattatggttcctatgctacgtcagagcaggtaaatgcagctggagatctctgtgccatttgccaggagaaaatgcatgctccgattttattgcgctgtaaacacatcttctgtgaagattgtgtttctgaatggtttgaaagagaaagaacttgccctctgtgcagggccttggttagaccagctgatttacggtcatttggagatggatcaacaagcttgttcatccaggtgttctaaaattttgatttgtttcggagtaaaaagaagctcctattatagcagatatttttattttttttggtccccctatataaaaatagtcaacag

SEQ ID NO: 4496 - DNA, 1860 bp, Eutrema halophilum
aattcaattcaattcaagccgttgattcacgaagatcacaaccattacgcaattactctctctctccccgcagctcgccggatctccgttgtcttcttcgtctcttggatttgtttacctcttaactcttgtctcacactccggagcagatgcgcgactcgatcagggtttgagaccttggtcaaagcgatcgccttcctttgactcatatattttcatttcccctttttatcccattggccttagggtttcctacacgatatgagctaatacgatttgatttctcccaagctccccctctattggttgcagggttttcttctccggcctaaaatggaaacgtccggcaccaatcatgacgcctttaggggttcccctcgaagaaactccatcctctcagcttctaacatcatccaggcccctatatcaaccttgttagagtattcgggtctcttccgaacgaggactagtcctagtccggaggcggaaacgctggttagtgatgcttctgcaggaatctccaacggtgaggttgccattaggataattggcaacggggagcaggatgctgaaactgataatagtggtctcagggaagccgctgcccatgcccagcctgaagttttagcttctggtactcaagttgatcctttgggtgctggagatggggcctctcagtctcaggctgctccagttgattctgtagctggagatgccgcaagccgggattcaccttaccaacgatatgacattcagcaggctgcacggtggattgagcaaattcttcccttttctttgcttctcttggttgtttttatccgccagcatttgcaggggttctttgtcgcaatctggattgctgctgtcatgttcaagtcaaatgatattttgaagaagcaaacagcgctgaagggtgagaggcatatctcagcattaatcggaatctctgtagcgtttacggcccatgttgttggtgtttattggtggtttcgaaaggatgacctcttgtgtcccttaatcatgctccctcccaagtctataccacctttctggcatgccatttttatcatagtggtgaatgacacacttgtacggcaggcctcaatgatattcaagtgttttctgctgatgtactacaagaacagtaggggtcgaaattatcgtaaacagggtcaactgctaactttggttgaatatttgatgcttctgtatcgctctttgctgcctacccctgtatggtaccgtttcttcctgaacaaggattatggaagcctcttctcctctcttatgacgggattgtatctgactttcaagctcacttcagtggttgagaaggttcaatccttctttacggcattgaaggctttgtcacgtaaagaggtgcactatggatcatatgcaacttcagagcaggtgaatgcggcgggcgacctgtgtgccatctgccaggagaaaatgcacaccccaattcttcttcgctgcaaacacatgttttgcgaagattgcgtttcagagtggtttgagagagagaggacgtgtcctctgtgcagggccttggtcaaatcagcagatctaaagtcattcggtgatggatccaccagccttttcttccagatattctgattgaaacacatacgagactccaaagtacaaaagtcgctcaagactcactcactcactcactcactagtcttcttagagagtattgatgatatacaatgccattttgagctgtgaaccaaagacaccactgatgccttgaagatgttcatacaatcttactatttgttaatacgaaatcgccttttatattccgtagccaaaagaaaaaaaaaagaaaaaaaaaaaactgatttcatc

SEQ ID NO: 4497 - DNA, 1847 bp, Eutrema parvulum
aattccattccattcaaccgttgattcacgaagatcacacgaacaacaatacgcagattctactctctctccgcagctcgccggatctccgttgtcttcttcctctgggctctcttcacctcaacccttttctcacactgcgcgactcgatcagggttcgagaccttagtcaaagcgaccttctcccttttacctttttgactctatttcatttcccccttttttttccattggctttagggtttccttcacgatatgagctaatatacgatttgatttcaccctctctctattggttctcgccgttgcagggtcttcttctccggcctttataatggaaacgtccggcaccaatcatgacgcctttaggggttctcctcgaagaaaccccatcctctcagcttctaacctcatccaggcccccatatcaaccttgttagagtattcgggtctctttcgaacaaggacaagtccaactcaggaggcggaaacgctggttagtgatgattctgcaggaatctccaacggagaggttgccattaggatcattgggaacggggagcaggatgctgcaactgatattaatggtctcagggaagccgcttcccatggccagactgaagttttgggtcctggtactcaagttgatcccacgggaactggagaaggggcctctcaggctgctccgggtgattctgcagctgcagatgccgcaagccgggattcaccttaccaaagatatgatattcagcaggccgcacggtggatcgagcaaattcttcccttttctttgcttctcttggtggtttttattcgccagcatttgcagggcttctttgtcgcaatttggattgctgctgtcatgttcaagtcgaatgatattttgaagaagcaaacagctttgaagggtgagaggcatatctcggcattaatcggaatctctctagctttcacaacccatgttgttggtgtttattggtggtttcggaaggatgacctcttgtatcccttaatcatgctccccccaaagtccataccacctttctggcatgccatctttatcatagtggtgaatgatacacttgtacggcaggcctcaatgatattcaagtgttttctgttgatgtactataagaacagtaggggtcgaaattatcgtaaacagggtcagttgctaactttggttgaatatttgatgcttctgtatcgggctttgctgcccacccctgtatggtaccgtttcttcttgaacaaggattatggaagccttttctcctctcttatgacgggattgtatctgactttcaagctcacttcagtagttgagaaggttcaatcattctttacggcatcgaaagctttgtcgcgtaaagaggtgcactatggatcgtatgcaactacagagcaggtgaatgcggccggcgacctgtgtgccatctgccaggagaagatgcacaccccaattcttcttcgctgcaaacacatgttttgcgaagattgcgtttcagagtggtttgagagagagaggacgtgtcctctgtgcagggccttggtcaaaccagcagatctaaaatcattcggtgatggatccaccagccttttcttccagatattctgattaaaacacatacaagactccaaagtaaaaagaaaaggtcgctcaagactcacttgctcactcactagtcttcttagggagtattgatatacaatgccatttgagctgtgaacaaaagacaccactgatgccttgaagatgttcatacaatcttatttgttaatatgaaatcgccttttatattattttagcaaaaaaagaaaaaaacaatctgatttagtataaaata

SEQ ID NO: 4498 - DNA, 1848 bp, Tripterygium wilfordii
gttattgaagtttggtagatttggaaatggcaatcgctctctgatcattttctctctttgacttttctcttcttcccattctagggtttcggtttttccaccctacacttctcgattccctctgcttggccttctttctttcaattccggtggtcctcgactgagttttgctctcgaagatatagtgattgataggagtggagatacgctggatggttagggttcgggcatcgaatttgactacgcaaatggaggcgtccggcagcaattccgaggcgtacaggagttcttcacctgtgaatagtggtcattctagaagatacgggatcttgtctgcttccaacatcatccaggctccgatttcgacgttgttagagtattccggtcttctacggacggccaggtcgtctcatcaagaatcggagtcgttaataaatcaaatccataacaatcgtgcggatgactctggtacctcctcaccagtggctgccaacaatggcgaggttgcaattaggatcatcggcgctgatgagaatgagaacgatagggaggggtccgggctggttgttgagcaagttagggaaggagtcaacggtcaagcagaggtgtctattcagccaatcgcgtcaaatatacaactggaaggggtgggagatgacaggggtgatcgtgaggcgggcgatggagtttcacagcctgggagtgctagtggtgatggggaagctggtgaaggggttggggcgaacggcagggattcttcataccagagatatgatattcagcaagctgcaagatgcattgagcaaatactaccgttctctttacttctcttggttgtgttcattcgccagcatttgcaagggttctttgttacaatttggattgctgcggtcctattcaaatcaaatgacattttacggaaacaaactgctttgaagggagaaagaaagagttctgttcttattggaattgctcttgcattcaatgtacatgttgtttgcgtttactggtggtatcgggatgacgatcttttgtacccattggtcatgcttcctcccagatctatcccacctttttggcatgctattttcgttattatggtgaatgataccttggtgcgccaggcggcaatgattctcaagtgcattttattgatttattacaaaaacagtaggggcagaaactaccgtaagcagggccaaatgttaactttggttgagtatctgatgttgctgtaccgagccttattgccgacaccagtctggtatcgtttcttcttgaataaagactatggaagtccttttctcatctctaatgactgggttatatttgactttcaagctgacttctgtggtagagaaggtgcaatctttctttactgctttgaaagcactttcccgtaaggaggtgcattacggagcttatgcaacaacagagcaggtcaatgcagctggagatttgtgtgctatatgtcaagagaagatgcatgctcctgttctgcttcgttgtaaacacatcttttgtgaagattgtgtatcagaatggtttgaacgggagaggacatgccccttgtgcagggccttggtcaaacctgcggatcttaggtcatttagcgatggttcaaccagtttgtttttccaggtattctaaagagtctattgtaaagaaaacgcggacttttaactgctctggaccacttaaatcacttgttcagagggccgcttgatgatcactccatctgcacaggtatatttgactctatttttttccaccttgtttattaactacaaaatcaaagacggtcgaatcggaattgtgtactgggaaaaggttgaatgtatctattga

SEQ ID NO: 4499 - DNA, 1756 bp, Brassica juncea
caacgagatccatcttccacggttcatcagatgcttgactccatcaaggtttggctgctttagggtttccaacgattcgaagcttcctattggttcaggtttttatttcaaatggaaacgtcaagcaccaacaacgacaccttcagaggctctccgcgaagaaactcgtcgatcctctcagcctccaacctcatccaagcccctatatcaaccttactagagtactcaggcctttttcgaccaaggcccacaagtcccactcacgaggcctccgaaacagcaacgctggttagtactggtagtgatgattctccggggataaactccaacggaggagaggttgccattaggattatcgggaacgcggagcaggatgatgttgaaagtgatatcactggtgccgcccagactgaaggtcttggctcttcttctgcgggaactggagaaggggcttccacaggtgaatctgttggtggagatgctgctgctgcgagccgagattcgccttaccaaagatatgatattcagcaggctgcacggtggatcgagcagattcttcccttttctttgcttctcttggtcgtctttatacgccagcatctccagggtttctttgttgcgatttggattgctgctgtcatgttcaagtcgaatgatattttgaagaagcaaactgcattaaagggtgagaggcagatctcggctttaatcgggatctctgtagcgtttgctacccatgtggttggtgtttattggtggtttcgcaaggatgatctattgtatcccttaatcatgttccctcccaagtccattcctcctttctggcatgccattttcatcattgtcgtcaatgatacacttgtacggcaggcctcaatgatactcaagtgttttctcttgatgtactacaagaacagtaggggtcgaaattatcgtaaacagggtcaattgctaactttggttgaatatttgatgcttctgtaccgctctttgctgcctacccctgtatggtaccgtttcttcttgaacaaggattatggaagcctcttctcctctcttatgacaggactctatctgactttcaagctcacttctgtggttgagaaggttcaatccttctttacggcattaaaatctttgtcacgtaaagaggtgcattatggatcgtatgcaactacagagcaggtgaatgctgcgggagacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcagatctgaaatcgtttggtgatggatccaccagccttttcttccagatattctgattaacatgcatacaaagcacaacgtataaatagatcatcacaagccccttgggtagagagtattgccgtttaagctgtgcacgaaagacaccactactgatgatgatgtcttgaagatgtttatacaatctcatttgttaatatgaaaatcgccttttatatattcattagtctagaaagaaaaagaattcaatattcaaaaaatcgtatttattcaatatgcaaaagttcttactacaattatcgacaaaggcaaggaagctgttcataagttttttgaaacttttcttttgtcgaaaatcattgttattccaccatcaacttctacattgttttgctacaatccatgcttacgattctt

SEQ ID NO: 4500 - DNA, 1426 bp, Malus domestica
gggtttttggttttcatggaggcatcttccggaaatggtagtcccgccagtgggggagccagtgggggagccactggggatagcagcaatacgtcgtcgttcgggtctatgcagttccccgccctccggttattccagtcgccgctctcattcgtgttggattactccggaatactctctcccagctcttcgcgccgcgattccgacgctccggtggtcaacgctgtagtcgtcgccgattctcagccccactcccctacggcctgcacctccgggtcgagcaacaccggggaggtttcgattcggattatcggcgccagcgagcacgaggaccgcgggaacgggggtgcgacggtaccggttcaaggggaggagaatggtgggtcgccgggtagggttcaatcgttggatgatctggcgggtacagtcaatggggttgggtcggacgagagagtccccttggtggcttcgtcgtctcccacacacgctggggatactgggaatggcgcggaggatagttctagggattctgcttaccagagatatgatattcagcagatagctaggtggattgagcagattcttccgttttcgttgctcttactcgttgtgttcattcgtcagcatttgcaaggtttctttgtcactatatgggtatcagctgtcatgtataggtcgaatgatgttgttaagaagcagactgctctaaagcgagataggaaaatctctgttcttgtaagtattgctggtgcttttatgcttcatgtagttgttgtttacttgtggtatcgaagtgatgatcttctatacccattggcaatgcttcctccaaaaaccataccacctttctggcatgccatattcatcattttggtaaatgataccatggtgaggcaggcagcgatggctttcaagtgtttgttgcttatatattacaagaatggcagaggccataactatcgtcggcagggtcaaatgttaactgtcattgagtacacactgctgctgtaccgtgccttgttaccagcacccgtttggtacagattcttcctgaacaaagacaatgggagcctcttctcctcacttacaacgggattatatttaactttcaagctaacatctgttgttgagaaggtccaatccttttttgcttccataagggcattgtcaaggaaggatatccattatgggtctcatgcaacattggaacaggtaaatgcagcaggagacctttgtgccatttgccaggagaagatgcatgctccaattctgttgcgctgtaaacatattttctgcgaggattgtgtctctgaatggtttgagagagaaagaacttgccctctatgcagggcactagtaaaacctgcagatttgcgaacatatggggacggatcaacgagtttatttttccagttgttctgaactc

SEQ ID NO: 4501 - DNA, 1958 bp, Brassica rapa
atatggtcaggcctcaactgtaacagagattgacggacagagaaagttcctggaagatcctctttacccccgcgtacgatagaccttgttcctctctgagatcgatagccgacgacccacctgcttcctctggtcatcgccgcgtcacagatgttcgtttgacgacctattctcgacgcgtcttccttccatcgccgtcttcaactcgatctattttccacggttcatcagatgcttgactccatcaaggtttggctgctttagggtttccaacgattcgaagcttcctattggttcaggtttttatttcaaatggaaacgtcaagcaccaacaacgacaccttcagaggctctccgcgaagaaactcgtcgatcctctcagcctccaacctcatccaagcccctatatcaaccttactagagtactcaggcctttttcgaccaaggcccacaagtcccactcacgaggcctccgaaacagcaacgctggttagtactggtagtgatgattctccggggataaactccaacggaggagaggttgccattaggattatcgggaacgcggagcaggatgatgttgaaagtgatatcactggtgccgcccagactgaaggtcttggctcttcttctgcgggaactggagaaggggcttccacaggtgaatctgttggtggagatgctgctgctgcgagccgagattcgccttaccaaagatatgatattcagcaggctgcaaggtggatcgagcagattcttcccttttctttgcttctcttggtcgtcttcatccgccagcatctgcagggtttctttgttgcaatttggattgctgctgtcatgttcaagtctaatgatattatgaagaagcaaaccgcattaaagggtgagaggcagatatcggctttaatcgggatctctgtagcgtttgctacccatgtggttggtgtttattggtggtttcgcaaggatgatctattgtatcccttaatcatgttccctcccaagtccatacctcctttctggcatgccattttcatcattgtcgtcaatgatacacttgtacggcaggcctcaatgatactcaagtgttttctcttgatgtactacaagaacagtaggggtcgaaattatcgtaaacagggtcaattgctaactttggttgaatatttgatgcttctgtaccgctcattgctgcctacccctgtatggtaccgtttcttcttgaacaaggattatggaagcctcttctcctctcttatgacaggactctatctgactttcaagctcacttccgtagttgagaaagttcaatctttctttaccgcattaaaatctttgtcacgcaaagaagtgcattatggatcatatgcaaccacagagcaggtgaatgctgcaggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcagatctgaaatcgtttggtgatggatccaccagccttttcttccagatattctgattaacatgcatacaaagcacaacgtataaaatagatcatcacaagccccttgggtagagagtattgccgtttaagctgtgcacgaaagacaccactactgatgatgatgtcttgaagatgtttatacaatctcatttgttaatatgaaaatcgccttttatatattcgttagcctaaaaagaaaaagaattcaatattcaaaaaatcgtatttattcaatatgaaaaagttcttactacaattatcgacaaaggcaaggaagctgttcataagttttttgaaacttttcttttgtcgaaaatcattgttattccaccatcaacttctacattgttttgctacaatccatgcttacgattctt

SEQ ID NO: 4502 - DNA, 1128 bp, Fagus grandifolia
gaatgggatcactaaccgattcttcttaccagcgatacgatattctagcaggttgctcgatggattgagcagattctacctttttcattgttattgctccttgtcttcattcgtcagcatttgtcaaggtgtttttataacaattttggatttcggctgtgatgtttaagtcaaatgatatcattcggaagcagacagcattaaagggagagaggaaaaactcttggttctcgttggtatctcgattttctttatgctttcacgtgactaggtgtttattggtggtatcaaaatgatgatcttttgtacccattggtcatgcttcctccaaaaagcaatactaccattctggcatgctgtattcatcatcctggtaaatgatacaatggtgaggcaggcagcaatggctttcaagtgcttacttcttatgtattataagaatggcagaggccataatttccgtaggcagggtcaaatgttgactctcgttgagtacatgctgctgttataccgtgccttgttacctacacctgtctggtatagatttttcttgaacaaagactatggaagcctcttttcatcactgattacagggttgtatttaacttcaagctaacatctattgttgagaaggtccaatccttctttgctgcctttaaggcattatcacggaaggaagtccattatgggtcttatgccacatcagaacaggtaaatgcagcaggagacctctgtgctatttgccaggagaagatgcatgctccaatacagttgcgatgtaaacatatcttttgtgaggactgtgtttcagagtggtttgagagagaaaggacttgccctctatgcagggcgctgattaaacctgcggatctgcgaacgtttggggatggatcaacaagtctgtttttccagttgttctaaatatgaagttgtctgtcccgtgacatattttgagcggcattctcctgaaagttgtcttgtttcttacatggtcaaaatgggaatgtattttggtaacctattttccatcattgggttgctagaaagcatagtgggggaaagcatcatttgatacaaaaatatggatcagtgattcagtaaactgttcatgtgtcgtaatcatgagat

SEQ ID NO: 4503 - DNA, 1486 bp, Brassica napus
cgctacttaacgtagtcctaccgagctccgccgtacctacgtggttttttttttttaatttcaaatggaaacgtcaagcaccaacaacgacaccttcagaggctctccgcgaagaaactcctcgatcctctcagcttccaacctcatccaagcccctatatcaaccttgctagagtactcaggccttcttcgaccgaggactacgagtcccactcacgaggctgaaacgttggttagtagcgatgattccccggggataaactccaacggaggaggaggagaggttgccattaggatcatcgggaactcggagcaggatgaggttgctgaaagtgatatcactggtgccgcacagactactgaagttcctggttcttcttctgcaagtcccgtggggggaggaactggggaaggaggcgaatctgttggtggagatgctgctgcggcaagccgagattctccttaccagagatacgatattcagcaggctgcaaggtggatcgagcagattcttcccttttctttgctcctcttggtcgtcttcatccgccaacacttgcagggtttctttgttgcaatttggattgctgctgtaatgttcaagtctaatgatattatgaagaagcaaaccgcattaaagggtgagaggcagatctcggctttaatcgggatctctgtagcgtttgcggcccatgtggttggtgtttattggtggtttcgcaaggatgacctcttgtatcccttaatcatgttccctcccaagtccatacctcctttctggcatgccatttttatcattgtcgtcaatgatacacttgtacggcaggcctcaatgatactcaagtgttttctcttgatgtactacaagaacagtaggggtcgaaattatcgtaaacagggtcaattgctaactttggttgaatatttgatgcttctgtatcgctctttgctgcctacccctgtatggtaccgtttcttcttgaacaaggattatggaagcctcttctcctctcttatgacaggactctatctgactttcaagctcacttctgtagttgagaaagttcaatccttctttacggctttaaaatctttgtcacgcaaagaggtgcattatggatcgtatgcaactacagagcaggtgaatgctgcaggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcggatctgaaatcgtttggtgatggttcaaccagccttttcttccagatattctgattaacatgcatacaaagtacaacgtataaatagatcatccatcacaagcccttgggtagagagtattgccgtttaagttgtgcacgaaagacaccactactgatgatgatgccttgaagatgtttatacaatccc

SEQ ID NO: 4504 - DNA, 1830 bp, Brassica napus
cgacgacccacctgcttcctctggtcatcgccgcgtcacagatgttcgtttgacgacctattctcgacgcgtcttccttcaatcgccgtcttcaactcgatctattttccacggttcatcagatgcttgactccatcaaggtttggctgctttagagttttccaacgattcgaagcttcctattggttcaggtttttatttcaaatggaaacgtcaagcaccaacaacgacaccttcagaggctctccgcgaagaaactcatcaatcctctcagcttccaacctcatccaagcccctatatcaaccttgttagagtactcaggcctttttcgaccaaggcccacgagtcctactcacgaggcctccgaaacagcaacgctggttagtactggtagtgatgattctcccaacggaggaggaggagaggttgccattaggatcatcgggaacgcggagcaggatgatgttgaaagtgatatcactggtgccgcccagactgaaggtcttggttcttcttctgcgggaactggagaaggggcttctacaggtgaatctgttggtggagatgctgctgctgcgagccgagattcgccttaccaaagatatgatattcagcaggctgcaaggtggatcgagcagattcttcccttttctttgcttctcttggtcgtcttcattcgccagcatctgcagggtttctttgttgcaatttggattgctgctgtcatgttcaagtctaatgatattatgaagaagcaaaccgcattaaagggtgagaggcagatatcggctttaatcgggatctctgtagcgtttgctacccatgtggttggtgtttattggtggtttcgcaaggatgatctattgtatcccttaatcatgttccctcccaagtccattcctcctttctggcatgccattttcatcattgtggtcaatgatacacttgtacggcaggcctcaatgatactcaagtgttttctcttgatgtactacaagaacagtaggggtcgaaattatcgtaaacagggtcaattgctaactttggttgaatatttgatgcttctgtaccgctcattgctgcctacccctgtatggtaccgtttcttcttgaacaaggattatggaagcctcttctcctctcttatgacaggcctctatctgactttcaagctcacttccgtagttgagaaagttcaatctttctttaccgcattaaaatctttgtcacgcaaagaggtgcattatggatcatatgcaaccacagagcaggtgaatgctgcaggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcagatctgaaatcgtttggtgatggatccaccagccttttcttccagatattctgattaacatgcatacaaagcacaacgtataaatagatcatcacaagccccttgggtagagagtattgccgtttaagctgtgcacgaaagacaccactactgatgatgatgtcttgaagatgtttatacaatctcatttgttaatatgaaaatcgccttttatatattcattagcctaaaaagaaaagaattcaatattcaaaaatacgtatttattcaatatgcaaaagttcttactacaattatcgacaaaggacaaggaagctgttctataagttttttagtaaacttttacttttgttcgtaaaatacattgttatttcctaccactcaacttacgaaaaaaactaa

SEQ ID NO: 4505 - DNA, 2171 bp, Eucalyptus grandis
tgccaagacagagaaacggacagctccgggggaaggaaggaaccggttacgcgcaagttgtctcgattaagccgaatcttggcgcatgattcgttataatggccaagttctcttgatgggttttatttctttgatgttacttctcccaaaagttcttcccttttcgaaatttccctgtcaagattcattctcgactgccttggcttaacgtttcgttccaaaagaagctccttttcacactccccagtcctcagttgcgtcggagagagacaaatttgcgatctttgggatcagggtacttgcatctcttgagggcatccgtccatcagtcctctctcttcgtccgcattcaataactagggttgttgctaattgggcaaaaggatggaaacccctggtgatattgatgtataccctgttagttcatcctctactagtggcagcggcagctctgcctcgaggtttggtgtgcagttcccgtctctcagtttgtttcagtcgccgttgtcggttatactggagtactccggtattatcccgtctgcaccaaccgtgcccgagtcagagagtccggtcctcggggcgagtgccggtcacattcagacagaatcaccttattctgaggtcagaaatggcggcagtagcgaggaggtatcaattcggattattggctctagtgaggcagggagcggagttaatatgggggacggtggagggcaaattgggtgtgacgatttgatggacattgctgcagagagtgacgatttattgttggaggccgcttctacttcgtcagcgaatgtcatggattcagctgatagttctagggattctggttaccagagatatgatttacagcgggttgggagatggatcgagcagatactcccattctcattgctcttgttggttgtgttcattcgtcagcatttgcaaggcttctttgttacgatatggattgcagctgtcatgtttaagtcaaatgatattcttcggaagcagactgccctaaagggagagaggaaaaattctgttctcgtgagcatttctgttgtttttatagtctatgtggttggtgtttactggtggtatcgaaatgatggtgcattatatccattgctcatgcttcctccaaaggcaataccacccttctggcatgctatcttcatgatcatgctcaatgatataatggcgaggcaggcggctatgtccgtcaagtgtttgctgcttatttattacaagaatagcaggggccacaatttccgtcgtcagggtcaaatgctgacactggttgaatatacaatgctgctgtaccgagcattgttgccagctcctgtttggtatcgatttttcttgaacaaagattatgggagcctattttcatctttgacaactgggttgtacttgacattcaagctaacatctgttgttgagaaggtccggtctttccttgctgcggttaaggcattgtcacacaaggaagtgcattatggatcttatgccacaaaagagcaggtcaatgctgctggagacttgtgtgctatatgtcaggagaagatgcactctccgatattgttgcagtgtaaacacatcttttgtgaggaatgtgtttcagaatggtttgagagagaaaggacttgccctctatgcagggctctggttagaccggcagatttgcagtcatttggggatggatcaacaagtctattcttccagttgttttgaaatgtttcttcgaaacagcggttccgcattcagctcatgccatttgtatacaaagtaaatatgccttccccacaaaatctcatcatttgccctggaagagtaagctgtctggaagttggcagctaggcatcgcgccacttgtttgaatcatattgagtgtaacttttctagggaacttcccgattactgggaacaactagaatcagaatgaatgcccttcctgtggagatttgtagtcaagaaatgtgcgggtatatttatcttgctaccaaatcttgcctagctaagcgtgttgtgttttccagatgcctttagcggggctaaagttggggggttctttaatgaatactgtatctgggctatgaagaaacaatctgtaacataattagccctcttattcattgttcttcgaggtgtaagtaaccagccctgttgttcatcctcca

SEQ ID NO: 4506 - DNA, 1950 bp, Podocarpus macrophillus
cgattaggatttttggcgccggcgagcccgagaatttgagggtaggaactgcgcaggggaattttgatgtggggggtttcgaacgcgcgacctcagattcgtcttctttgcagggcaatggtgcggatgcggtaacatcgatgccatcgttagctattagtgctgtggggaacgtggagagcgctgctgatgtcgccgcgagggatgggactgaagatggaagcggtagaagtggtaatggtaatggggatgggagtaataacagcagtgggtcatggaggtatgaaattcagcatgtagccagggggatcgagcaggtcttgcccttctctctattgctcttcgtcatattcgttcgccaacacttgcaaggtttcttggtaacattctggataactgcagctatgattaaattgaatgatcttgtacggaagcaaacagcgcttaagggtgaaagaaaaatatcagttttgattgggattatattagtcctcttgttgcacttagctggagtatattggtggtataaggatgctgacctgtggtacccacttcttatgcttcctccaaagaccatacccccattttggaatgctatatttgttattattgtcaatgatactatggtgcgtctagctgccatgattttaaaatgtgttcttctgatctactacaaacacagtagaagctgtaattatcggaaacagggccagatgttgactgttgtggaatacactcttttactttatcgagcattacttcctacaccagtttggtaccgtttctttttgaataaagaatatggaagccttttctcatctctcaccacaggactctacctcactttcaagctgacatcaattgtggagaaggtgcaagcatccttcacagcacttaaagccttatcacacaaggaactacagtatggatcatatgctaccacagaagaggtcgtagcagctggtgatctttgtgcgatttgtcaggagaaaatgcatgcgccaattttgctacggtgcaagcatatattttgtgaggactgtgtatctgaatggtttgaaagggagaggacttgcccgctttgtcgagctgttgtgaagccagctgaattgagatcctttggtgatggctctactagtctctttttccagctattttaacttttatgctgaacagaaaatgattaagtacatgccaaggcactgatgtgtgatctgaaaagtcagcgttggaaggtggtacaagagtaatccatctgttcttaatatttatgcattgtacattgaaattattatctgccttttgcaaggcgaaaggtcgacaaagcagtgacatttcaagtccggtccagtagactatcttgtctaccacatgccttttgcatgtagttgtcaaggttcttagaatgccttgctatattacatcaaattgtttccgttcatcacaaaaatgatttccaatgttggagacactgattaaatttttcaaagtggtcgcagttcaggttggtcaatgagttgattgcgatactggatctttcttttggttttggcaaggcagaattccgcaatgtgcatatacttgtaaataatttaggcaaatgttatactggccaaaaaaaaatcctcaatctagagaggacaggaagtatgaaaaatgaggatttattttcaatttaggtatatcatgtactcgatgtactcatcatcattgaggcaccctgcccttgggtttttgtatatgttttgcttggaaatatccgtcggcagcatgtttcctattgtattgccttcttttctttctgcagttaactacagattatagagtatgtgatctgttgttccatctggtaatgctcatgattcatgggtactccactgtttcaagggcttatgggatatttatgtctaatgctttattcttgttgaatttggacttcggtattttctt

SEQ ID NO: 4507 - DNA, 1853 bp, Podocarpus macrophillus
acaacagaaatcgatgccactttcgaattcttcgtaattaaacatcggatgctgcagctaagaagtccagatcgacctcggcgttttgaagaattcgtcgtgaagtttattaaattctaggagtcgtgatcctaattgtggttattttggcttcaattcaagggtttgtattcgaatttaccctaatcgaggttgttctggttttaaaatggagaattctggagggagtgccgagggttttcggagcaacggatcttatagaaggaacggtctgcatttttctgctgcgaacataatccaggcgccgctgtccgcgcttttggagtattcagggcttttgcgtgatcgatcacagcagcagcaccacgagcgtgaggctgctgccggactgactggtggcagcgacgatgttagcggcgcagaagtatcgattaggataattggctccggggagcaggagaacgttagggttgggtcggttgaagaaacagaaattgttaataacaacataaataatagtattagtcacctacaggtgtcttcttcgctgccaacattacaggccgcagatggtgtggatggcggtggtgtcggttcgtcttcagttatggcaccgcttacaataagcgctgggacaaatgtggagaataatgttggtgataacagcaacagcagcaataacagtaataatgtaaatggaagggatgcagcataccagagatatgatatccaacagcttgcgagatggattgaacaaattttgcctttctcgttgcttctgctcgtggtctttattcgacaacatttgcaaggtttctttgttacgttctggatagctgcagtgatggtcaaatcgaatgatgttttgcgtaagcagacagcattgaagggtgaaaggaagagttcagttcttatgtgcatcatcttagtgtttatagtccatgtggttggaatttactggtggtacaggaatgctgatctactttatccacttgttatgcttcctccaaaaaatataccaccattttggcatgcaatgttcattatcgtggttaatgatacaatggtgcggcaagctgcgatggttttaaagtgtggtcttttgatatattacaaaaatagcagaggccgtaattatcgtaagcagggtcagatgttgactttggttgaatacatcttactgctttatcgtgcattacttcctactcctgtctggtatagattcttcttgaacaaagaatatggtagcttattctcatcacttacgacaggattatatcttacatttaaacttacatcaattgtagagaaggtccaatcattctttgctgcattgaagcactgtctcgcaagaagttcaatacgggtcatatgcaactacagaggaggttcttgcagctggagacttgtgtgcaattgccaggagaaaatgcatgccccaatattgcttcgttgtaaacatatattctgcgaggaatgtgtgtcagaatggtttgaaagggagaggacttgccctctttgtcgagctctagtaaaacaagctgatctgagatcttttgcggatggttcaacaagtctttctttcagctattttgattgttgtacagagagcaagaccaatctagttgatttatggattattattagaacaattgggcatctgcagagaaacggattcactagtttgtgtcaacaactcagaaacctgcttcggtttgtggcaagtcagacatcagagaactttgctaagaagtactgctacgctgaattttggatcggattttaattgcatgtcactagagatgcttgtatgtgtgcacggtgactatacaatgccatttgctaagatttcc

SEQ ID NO: 4508 - DNA, 1999 bp, Populus trichocarpa
gtgtatgcatcaccatcaacatagagagagaaacaagagaagggaggaagagggaaaataaataaattaaaaacctactttctttttgtttattcaattttgttccagataaagaagaagaagaaaaatccgattgattgtttgatcgattctccctttaatggcgatacaatagtcaagttacgacgctttctttgtcgttgaccttttccttttctcttcgttcattgacctcccttcaaccccccatatttattagggttagggtttctcgaatgccacctcgaatctcatatcctccttatttctaacccccttttctcttcctcgacggagtttcgctttcgtagggctagggcatcatctactgctgatacgataatggaagggtcagggaatatttctgatccgtacagaggcagaggcggaggaaatagtaatagcagtaacaattcttcaccttcttcgtcgaggagatatggaatgttatcagcttctagtattcttcaagcgcctatttctcttttattagagtattctggtctgttaagaactactcgttcatctcaccaagaaacagagtctttgattcctggtggaggaggacttggttctactagacttgatggttcgtcggctgcggtggtctctaataatggggaggttgcgattaggataattgggtcgggggaacatgaacatgacagggatagttctggtggattggttgtggggcaagttggtggagggcagaatgagagttcgagtgtgggtggggatggggaagctgctgatggggctgggggtaatgggagggattcaacataccagagatatgatatccagcaagctgccaggtggattgagcaagtgcttcctttttctttgcttctattggttgtcttcattcgccagcatttgcaaggtttctttgttacaatttggattgctgttgtcatgttcaagtctaatgatattctacgaaaacaaacagctctgaagggtgagaggaaagtctctatgcttgttggcatctctcttgcattcgcgattcatgtggtcggtgtttactggtggtatcaaaatgatgatcttctgtacccattaattatgcttccccccaaatctatacctcctttctggcatgctattttcatcatcatggtgaatgatactttggtccggcaggcagcaatggtattcaaatgtattctgttaatttcttacaagaacagtagaggccgaaattatcgtaaacagggtcaaatgcttactttggttgagtacctgatgctgctgtaccgtgccttattgcctacaccagtctggtatcgtttctttttgaacaaagaatatggcagcctcttttcgtcactcatgactgggttgtatctaactttcaagctcacatctgttgttgagaaggtacaatctttctgtgctgctttgaaggcattatcacgtaaagaggtgcactatggggcatatgcaacatcagagcaggtcaatgcagcaggagatctgtgtgccatatgccaggaaaagatgcacgcacctatactacttcgatgtaaacacatattttgcgaggattgtgtatcagaatggtttgagagggaagggacgtgccccttgtgcagggctttggtcaaacctgcagatctcagatcgttcagtgatggctcaactagtttattattccagatattctagaggtgtctactgtagagaccagcgagtttttctgcttgggagctccaaacacataccgaaaactgccttttcctgatcatcatctcatccatacacgtatatgtgactgtatttggccctggcttgttcagtggttacttacccaagaaaatcaaaccaaagattagtggaacttgaattggctgcccgttcttttgttgtatcggggaaggatgaatgtatctaatggcttttgaagacacagttcctcaaatgattaacaatatatatatatatatatacatat

SEQ ID NO: 4509 - DNA, 1723 bp, Silene vulgaris
tacgattccttctggaacattcttccgtagacgccttcttcggcgaacctccatttccaccaaccttccctttcgcagggttagggttagggttagggaatcaacaatggaaggtgcaggtgcgaataccgagggacatagagataggaattcaacaggaggaaattcagcttcttctagaagatatagacttcatttctctgcgtcgaatttcttacgatcgccggtttcttcgcttctggaatattccggtttgttacggccgaggtcgagtaataatgagactgaaccgttgatttctggctctagttcgggtttgacgcctgctggagcttatgattcgacttcttcgtcgttgaatgagggtgaggtttcgattaggattattggtggagcggagggggagaatgagagggttgagacgtctagtttggggcagagttgtggtgggaatgagagtggaggtgtggtggtgggtgaggaggaactgaggacggaagctggggtagggacagggactggggaaggggtttcttcgcagttttcgagttctagtggagatgcagaggcggctgatgcaagtggggggagtaatagggaaggtacttatcagagatatgatatacagcaggctgctaggtggattgagcaagtgcttcctttctcgttgcttctgcttgtcgtcttcatccgtcagcacttgcaagggttctttattacaatttgggtttctgtttttatgttcaagtctaatgacatcctccgtaaacatactgctctaaagggagagagaaaaaatttctgttctaattggctactgcatcttgttcacccttcatgttgttggtgtgtattggtggtaccggagtgatgaccttctccacccgctaattatgctcccaccaaaagaaatacctcctttctggcatgctttgttcatcatcatgatcaacgatactttggtccgccaggcggcaatgatcgtcaaatgtgtcttactcgtgtattacaaaaacagcagggggagaaattaccgtaggcaggggcaaatgttgactctggtggaatatctgttgttgctgtatcgtgcgctgcttccagccccagtttggtataggttcttcctgaacaaggaatatggcagcctcttctcttcacttatgactggactgtatctcacttttaagctgacttctgttgttgaaaaggttcagacattttttgctgctgtaagggcattatcacgcacggaggttcattatggcgcttatgcgacttcagagcaggtttctgcagcaggggatatgtgtgctatttgtcaggagaagatgcatactccagttttgcttcgttgcaagcacctcttttgtgaagactgtgtgtcagagtggtttgaaagggaaagaacatgccctctgtgtcgagctttggtgaaacctgcagatttgaaatcatttggtgacggttcgacaagtctattcttccagttgttttgagttctaccaattccaaaaggcctctgttcaaatcattttgtccatcaaatttaagttctgcagatgattggctctgctaactgtcaactgcaagaatgaaatcaaaactagctgctgttcgaacttagctgacgtctctgtttatatgccgaatgggtaaaaaaaagttatttttgacatgatgaaaaaaaaatatatatttgcttgtatctaagttagctagtaaa

SEQ ID NO: 4510 - DNA, 2019 bp, Solanum phureja
acacgttaatgtttaatgcttcatcttccctaaaacccctctctctataactctcttctgctaaaaagctctgttcttttgatctttctgtgatattttattcttctgtcagtatctgaacatcaattttctttacgtttgttagatttaatagtatttttatatcaagatttctcactcatctgacttctcttacaatttgaacatttctttgtgagattcttgtgtcatacataccctattcttcatcttcaagtaataccccataaaagccattcttggatcaatacaaattacacaaatcaccgactgacccttttgatggatacttctgagaatgcaaatgtttctccttcatctcctacaagttccaatttgtcgacttttggaatacagttcacaccgctccggttcttccaatcccctgtttccactttgcttgagtattccggactctttacggttcgacccgataacccagaaacggaccctcttgtagctgatgatactgttactaacgacgctgaatccagtagcgatgttggtggaggtaatagtagcagtggggaggtttcaattaggataattggtgctggggagaatcaagggataggggacgagtatgaagatgatgggtcggtgatggatggtgaggaagggggttctgttgaggaaaggggttctggtgtggaggcgtcgtctacggtgcctgatgatgatgctggtaatgctagtagggattcttcgtaccaaagatttgatatacagcaagttgctaggtggattgagcagattcttccattttcccttcttctcttgtttgttttcatacgccagcatttgcaaggtttctttgtcacaatttggataactgccgtcatgttcaagtcaaatgacattcttcggaagcagacagctttaaagggagagagaaaaacagatgtccttgttggttattttgtggtttttgtgatacatgttattggaatctactggtggtatcacaatgatgaccttttctatccattactaatggttcctccgaaggtcatcccacctttctggcatgctattttcatcatcctggtaaatgataccatggtgcggcaggcagcaatggctttgaagttggtgctgcttatgtattacaagaatggcaggggccacaactttcgtagacagggtcaaatcctgactctggtggagtacatgctgttgttataccgtgccttgttaccaactcctgtatggtatagattctttctcaataaagaatatggaagccttttctcatcactgacaacgggattgtacttaacgtttaagcttacctccattgttgagaaggtaaaatcattctatactgctttgaaggcattgtcaaaaaaggaagtccattatgggtctcatgccacacctgagcaggtgaatgcggctggtgatctgtgcgctatttgccaggagaagatgcatgcaccaattttgttacgttgcaaacacctcttctgtgaagactgtgtctcagaatggttcgaaagagaaagaacatgccctctgtgcagagcattggtcagaccagctgatctaagatcgtttggtgatggatccactagccttttcttccagttattctagactacatattaattatcctacgccaaagtaaatatctgtccacatctttgtccacctgatattactggattctgggggttgccccgttaaggtttctgccagaatgtagcattaaagtaaaaaaaaggattctttgaggaagatatacacatctactcccatattgtacataattttttttcccctactgtgaagagatgagatgtgttccctgtaatactttccaaaaagaaaaaagaatagaaagaaagcaattgtatgtagtatcacaatttcttaaccttagagcttgaatttttgtttcagtatgttgttttttttcaaatgccaaaaggtattatgtcttgaattatataacacataaagttggttctatattgcact

SEQ ID NO: 4511 - DNA, 2024 bp, Solanum lycopersicum
acacgttaatgtttaatgcttcatctctccctaaaacccttctctctataactctcttctgctaaaaagctctgttcttttacatctttctctgatatttttattcttctgtcagtatctgaacattaattttctttacttttgttagatttaatagtatatttatatcaagatttctcactcatctgacttctcttacaatttgaacatttctttgcgagattcttgtgtcaaataccctattcttcatcttcaagtaataccccataaagccattcttggatcagtacaaattacataatcatctatctctgtaacaccgactgacccttttgatggatacttctgagaataatgcaaatggttctctttcatctcctacaagttccaatttgacggcttttggagtacaattcacaccgcttcggttcttccaatcccctgtttccactttgcttgagtattccggactctttacggttcgacccgataacccagaaatggaccctcttgtagttgatgatactgttactaacgaggctgaatccagtagcaatgttggtggaggtaatagtagcagtggggaggtttcaattaggataattggtgctggggagaatcaagggatagggggtgaggatgaagatgatgggtcggtgatggatggtgaggaagggggtgctgttgaggaaaggggttctggtgtggacgcgtcgtctatggtggctgatgatgatgctggtaatgctagtagggattcgtcgtaccaaagatttgatatacagcaagttgctaggtggattgagcagattcttccattttcccttcttctcttgtttgttttcatacgccagcatttgcaaggtttctttgtcacaatttggataactgctgtcatgttcaagtcaaatgacattcttcggaagcagacagctttaaagggagagagaaaaatagatgtccttgttggttattttgtggtttttgtgatacatgttactggaatctactggtggtatcacaatgatgaacttttctatccattactaatggttcctccgaaggttatcccacctttctggcatgctattttcatcatcctggtaaatgataccatggtgcggcaggcagcaatggctttgaagttggtgctgcttatgtattacaagaatggcaggggccacaactttcgtagacagggtcaaatcctgactctggtggagtacatgctgttgttataccgtgctttgttaccaactcctgtgtggtatagattctttctcaataaagaatacggaagccttttctcatcactgacaacgggattgtacttaacgtttaagcttacctcaattgttgagaaggtaaaatcattctatactgctttgaaggcattgtcaaaaaaggaagtccattatgggtctcatgccacacctgagcaggtgaatgcggctggtgatttgtgcgctatttgccaggagaagatgcatgcaccaattttgttacgttgcaaacacctcttctgtgaagactgtgtctcagaatggttcgaaagagaaagaacatgccctctgtgcagagcgttggtcagaccggctgatctaagatcgtttggtgatggatccactagccttttcttccagttattctagactacatattaattatcctacgccaaagtaaatatctgtccacatctttgtccacctgatattactggattctgggggttgccccgttaaggtttctgctggaatgcagcattaaagtaaaaacaggcagattctttgaggaagatatacacatctactcccatatcgtacataattttttccccccatgagatatgtgcatgtaatactttccaaaaagaaaaaaaaaatagaaagaaagcaattgtatgtagtatcacactttcttaatcttagagcttgaatttttgtttcagtctgtttttttttatcaaatgtcaaaaggcattatgccttgaattatataacacaaagttggttctatattgcact

SEQ ID NO: 4512 - DNA, 1991 bp, Zostera marina
ttcttctcaccatcacgaccatcatcattaccattcttctcaatcttgttgggctgttgcacaagaaaattcccaattcatcacccatcgtggctgctgttcttgtcggttagggttttcggagaaactccaggaggatgttatcaagatcctgagacgattctgttgatgaccagggttttttgattttctccttttctaatattcggactttttctttctctctttcggatatggctttggagatggtgttgttctagggttttcttcggaaatggataccaacggagaaaacttcgacggttacgggaatcggaggtatggtggagtgcacttttcgccatatgctttcatgcaagcgccgatttcagttctgctggagtacgccggtgatcttcgcaatccctttctgtcttctcgaattattcactcagagaacgacgacgagatcttcgttagaagcagtggagatgatggctctgcaattccttacgaatacggatcagggaggacggatgattcagttccggaaggaagtgggggttcgggtggtgagatttcgattaggataatagaaccgggggatcgggatgttcttggtgctgtagatggtggtttgccgctaccggtgctggagattgattctgttagtgagtcgagtacagtgctcacagagcatctggatgcgaatacaccgtcttcctcgtcgtttacttccgatgattccaccagagaggagcctgatgctgcggagaacacggcaagtgcaaatagtagggatggattgttacaaagttttgatttacagcagatggcgaggtgggccgagaagtttttgccattttcgttacttctattagtcgtattcatccgccagcatttgcaaggattttttctcacactttggattgctgcagtgatgttcaaatccaatgacattttgcggaaacagacagctctaaagggagagagaaaagtatccgtactagtttcctttacaattatattcgcgttgcatgtggttgaagtttactggtggtacagaaatgatgggcttataaatccacttttcatggttccaccaaaagtgatccctccattttggcatgcagtattcatagttacagttaatgatacaatggtgcgtcaggcagcaatggttgttaaatgcatgctacttttactttacagggacagtaggggtagaagctaccgtaggcagggtcaaatgttaaccttagtggagtatctgctactactgtatcgtgcattattgccagcacctgtttggtaccgatttttcttaaacaaggaatacggaagcctttttcttccttgactacaggtctatacttgactttcaaactgacgtcggttgttgaaaaggttcagtcattctatacagccttcaaggcattatctcggaaagaagtgcagtatggatcctatgcaacaccggaacaggttattgcagctggagattttgtgtgctatttgtcaagagaaaatgcatgctcccattctgctgcgctgcaagcatattttctgtgaagactgtgtttctgaatggtttgaaagggaacgtacatgtccactctgcagggcgttggtgaaatcagcagagcttaaatcctatggtgacggctctacaagtttgttctttcaattattttgactccaaactgcagcagaacagcttattcattattctttgtcaaagaacagagagagagatagggagggaggggttctgtcatacttcatgactttctgcaatcagaacgatgctggactttgtctagtctgtaaatttcatattattggaaattaatgtaaatacttggttaattattttaacctatagccctaattcaaaatatataatgttatttatttaatatacaaaaaatattagaatttaatactaattgtggtattgacaatattaaatagctagtgatctagaatatatttaaagccaaacgtactgt

SEQ ID NO: 4513 - DNA, 860 bp, Brassica juncea
atcatgttccctcccaagtccatacctcctttctggcatgccattttcatcattgtggtcaatgatacacttgtacggcaggcctcaatgatactcaaatcttttctcttgatgtactacaagaacagtaggggtcgaaattatcgtaaacagggtcaattgctaactttggttgaatatttgatgcttctgtaccgctcattgctgcctacccctgtatggtaccgtttcttcttgaacaaggattatggaagcctcttctcctctcttatgacaggactctatctgactttcaagctcacttccgtagttgagaaggttcaatctttctttaccgcattaaaatctttgtcacgtaaagaggtgcattatggatcatatgcaaccacagagcaggtgaatgctgcaggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcagatctgaaatcgtttggtgatggatccaccagccttttcttccagatattctgattatacaagactccaaaagtacaaatagtgatcacaagcccttggtagaagagagtattgccgtttatgttgtgcacgaaagacaccactgatgatgccttgaagatgtttatacaatgtcatttgttaatatgaaatcgcctttttatattccttagcctaaaaaaaaaagaattcacgtgtttattcaatatgaaaaagttcttactacaatgatcaacaagagcaaggaagctgtttataagttatacata

SEQ ID NO: 4514 - DNA, 969 bp, Brassica napus
tcgccagcacttgcagggttcttgttgtcaatttggattgctgctgtcatgtcaagtctaatgatatatgaagaagcaaaccgcattaaacgggtgagaggcagatctcggctttaatcggggatctctgtagcatttgctacccatgtggttggtgttattggtggttcgtaaggatgatctattgtatcccttaatcatgtccctcccaagtccattcctccttctggcatgccatttttatcattgtcgtcaatgatacacttgtacggcaggcctcaatgatactcaagtgttttctcttgatgtactacaagaacagtaggggtcgaaatttatcgtaaacaggggttcaatttgctaactttggttgaataatttgatgcttctgtatcgctcttttgctgcctacccctgtatggtaccgtttcttcttgaacaaggattatggaagcctcttctcctctcttatgacaggactctatctgactttcaagctcacttctgtagttgagaaagttcaatcgttctttaccgcattaaaatctttgtcacgcaaagaggtgcattatggatcatatgcaactacagagcaggtgaatgctgcgggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcggatctgaaatcgtttggtgatggatcaaccagtcttttcttccagatattctgattaacatgcatacaaagtacaacgtataaatatatcatccatcacaagcccttgggtagagagtattgccgtttaagttgtgcacgaaagacaccactactgatgatgatgccttgaagatgtttatacaatcctatttgttaatatgaaaatcgccttttat

SEQ ID NO: 4515 - DNA, 1421 bp, Manihot esculenta
atggagacttgttctgctgccagttctgatgatatcttcagaaattcttcttcttcttcttcttcttcgtcgtcgtcgtctccgtccttttcgggttcggcaagcggcggcggtggcggcggcagtagaaatattagctcaagacgatatgggatcaatatagcagcatcgaatttgatacatgctcccttgacgacccttttggaatacgcgggtattttaagaggaggaggaaacgtttcctccgctgctcatgagagagagcaattgattcttcctcctcctgctgctgccgtacggtcaagcactggtgctcaccaccaccaggaggttactattaggataattggtgctgcagattctaatgttgaccctactgttgaggcgatgcctgcgtcattacctctatcagatgatcaacctggtagagctgttccttctgaaaccccaactgtggatggggtttccgggatcaccgctgacccctcttcctcttctcctcctcctcctccttcttaccagagatatgatattcagaacttcgctaggtggattgagcaaattgttccattctctttgttgcttctacttgttttcattcgtcaacatttacaagggttctgtgtggcattgtggattgctgcaattctgttcaaatcaaatgatattctaaagaaacagacagctctaaagggggagagaaagaattctattactatagccattactttagggttcatgcttcatgtgatgtcaatttattggtggtatagaaatgatgaccttctatatgcattggtcttacttcctgtgagcactatacctcctttctggcatgctttatttatcatcgtggtaaatgatgctatggtgcggcaggttgcaatggccttcaaatgtatactcttgatgtattacaagaatggcagagggcacagttaccgtaagcagggtcaaatgctaactttggttgagtattttttgttattgtaccgtgccctgttgccagctcctgtctggtataagttcttcttaaacaaagagtatggaagttttttttcttcgttaattacaggattgtatttaaccttcaagcttacatcagtcttgggaaaggttcgatcgttctttacagcattgagggctttatcatctaaagaaattcactatggttctaaagccacatctgaacaggtcaatgctgctggagatctctgtgctatttgccaagagaagatgagtgcaccaattttgctgcgctgtaaacatattttctgtgaagaatgtgtatcacaatggtttgagcgagaaaggacatgtccattgtgtagggcattggttaaacctgcagatatcaggtcatacggtgatggttcaactagtttgtttttccagttattttaagatcgctgcttgctgaa

SEQ ID NO: 4516 - DNA, 1781 bp, Euonymus alatus
agggtccggtcatcgaatttgacgacgcaaatggaggcgtccggcagcaattccgaggcgtacaggagttcttcgcctgtgaatggtggtcattcgagaagatacgggttattgtctgcttccaacatcatccaggctccgatttccgccttgttagaatattccggtcttctacggacggccaggtcgtctcatcaagaatccgagtctttaataaatcaaatccataacaatagcgccgatcactctggtaccgcctcaccagtggctgccaacaatgacgaggttgcaattaggatcatcggcgccggtgagaatgagaacgatagggagggctccggactggttgttgggcaagttagggaaggagtcaacggtcaaacagagatgtctcttcagcgaatcgcgtcaaatatacaactggaagggttgggagataacaggagtaatcgtgaggcgggtgatggggtttcacaacctgggagtgctagtggtcatggggaagctagtgaaggggctggggctaacggcagggattcttcataccagagatatgacattcagcaggctgcaagatgcattgagcaagtactaccgttctctctactactcttggttgtgttcattcgccagcatttgcaagggttctttgttacgatttggattgctgctgtcctgttcaagtcaaatgacattttacggaaacaaactgctttgaagggagaaagaaagatttctgttcttataggaatttctcttgcattcatggttcatattgtttgtgtttactggtggtatcggaatgacgatcttttgtatccattggtcatgcttcctcccagatccgtgccccctttttggcatgctattttcattattatggtgaacgataccttggcgcgccaggcagcaatgattctcaagtgcattttattgatttattacaaaaacagtaagggcagaaactaccgtaagcagggccaaatgttaactttgattgagtatctgatgttgctgtaccgagccttattgccaacaccagtctggtatcgtttcttcttgaataaagactatggcagccttttctcgtctttaatgactgggttatatttgactttcaagttgacttctgttgtcgagaaggtacaatctttctttactgctttgaaagcactttcccgtaaagaggtgcattatggagcttatgcaacaacagagcaggtcaatgcagctggagatttatgtgcaatatgtcaggagaagatgcatgctcctgttcttcttctttgtaaacacatcttttgtgaagattgtgtatcagaatggtttgaacgggagaggacatgccccttgtgcagggccttggtcaaacctgctgatctgaggtcatttagtgatggatcaaccagtctgtttttccagatattctgaagtctgctgtaaagaaaacgctgactttaactgctttgaattactttaagcacttgttcagaacgcctcgttgatggtcactccatcagcacaggtatttgactagatgaagccaaactttcagcatgtatgttgtacggggaaaggctgaatgtatctataatgaggctcttgagatgcaatggagattcttcaacattactcgtccatattcatttggtaatagtggtttttccaatataattgtaaagttatattttggagtgttagtgtgaggttttctatacatggtcagaagggggggaggtccgattctcttctgcttcttgtagtctgaactaaaaagaaat

SEQ ID NO: 4517 - DNA, 946 bp, Euonymus alatus
atttgcggttcatgttgtttgcgtttactggtggtatcagaatgaggatcttttgtatccattggtcatgcttccccccaaatccatcccacctttttggcatgctattttcattattgtggtgaacgataccttggtgcgccaggcagcaatgatgctcaagtgtattttactgatttattacaaaaacagtagggtcagaaactaccgtaggcagggccaaatgttaactttggttgagtatctgatgttgctgtaccgagacttattgccaacaccagtctggtatcgtttcttcttgaataaagactatggcagccttttttcttctttaatgactgggctatatttgattttcaagctgacttctgttgtcgagaaggtgcaatctttctttactgctctgaaagcactttcccgtaaagaggtgcattatggatcttatgcaacaaaagagcaggtcaatgcagctggagatttgtgtgctatatgtcaggagaagatgcttgctcctgttctgcttcgttgtaaacacgtattttgtgaagattgtgtatcagaatggtttgaacgggagaggacgtgccctttgtgcagggccttggtcaaacctgctgatctcaggtcatttagtgatggatcaaccagtttgtttttccagatattctagagtctaaagaaaacgtgaactcgttgaaccacttaaagcacttgttcagagtgccatatagatgatcaccccatctgcacaggtatatttgactgtatttttttttttcccaccttgtttattaactacaaagtcaaagacagtcatatgggaattggctagatgagtcaaagctttctgcttgtatgttgtaatgggaaaggttaatgtatctaatgaggcccttaagatgcaatggagtttttccggcatggcacatctatgttaatttgtagt

SEQ ID NO: 4518 - DNA, 1708 bp, Euonymus alatus
gagtggagatacgctggatggttagggttcgggcatcgaatttgacgacgcaaatggaggcgtccggcagcaattccgaggcgtacaggagttcttcacctgtgaatagtggtcattctagaagatacgggatcttgtctgcttccaacatcatccaggctccgatttcggcgttgttagaatattccggtcttctacggaccgccaggtcgtctcatcaagaatcggagtctttaataaatcaaatccataacaatcgcgccgatgactctggttccgcctcaccagtggctgccaacaatggcgaggttacaataaggatcatcggcgctggtgagaacgagaacgatagggaggggtccggactggttgttgggcaagttagggaaggagtcaacggtctaacagaggtgtctcttcagccaatcgcgtcgaatatacatctggaaggggtgggagataataggagtgatcgtggggcgggtgatggagtttcacaaccaggaagtgtcagtggtgatggggaagctggtgaaggggttggggcgaacggcagggattcctcatcccagagatacgatattcagcaagctgcaagatgcattgagcaagtgctaccgttctctttacttctattggttgtgttcattcgccagcatttgcaagggttctttgttacaatttggattgctgcagtcgtgttcaagtcaaatgacattttaaggaaacaaactgctttgaagggagaaagaaagatttctgttcttattggaattgctcttgcattcatggttcatgttgtttgtatttactggtggtatcggaatgacgatcttttgtacccattggtcatgcttcctcccagatccatcccacctttttggcatgctattttcattattatggtgaacgatacattggtgcgccaggcagcaatgatgctcaagtgcatgttattgatttattacaaaaacagtaagggcagaaactaccgtaagcagggccaattgttgactttggttgagtatctgatgttgctttaccgagccttattgccaacaccagtttggtatcgtttcttcttgaataaagactatggcagccttttctcttctttaatgactgggttatatttgactttcaagctgacttctgttgtagagaaggtgcaatctttctttactgctttgaaagcactttcccgtaaagaggtgcattacggagcttatgcaacaacggagcaggtcagtgcagctggagatttgtgtgctatatgtcaggagaagaggcatgctcctgttctccttcgttgtaaacatatattttgtgaagattgtgtatcagaatggtttgaacgggagaggacatgccccttgtgcagggccttggtcaaacctgctgatctcaggtcatttagtgatggatcaaccagtttgtttttccagatattctaaggtcgaccgtaaagaaaacaagaaaacacagacttttactgctttgaaccacttaaagcacttgatgatcactccattcgcacaggtatatttgaccgtatttttttttcccacttgtttattaactacaaagacagagacagtcagtatcagaattgactagatgaagccaagctttctgtttgtatgttgtactgggaaatgctaaaatgtatctaatgagttccttaagatgcaatggagcttcttcaaca

SEQ ID NO: 4519 - DNA, 1043 bp, Arachis hypogaea
ttaatgatgcattggtgcggcaagcagcaatggccttcaagtgtattctgttaatatattacaaaaagtggcagaggtcatagcttccgtcggcaggctcaaatgttaacgctggttgagtacacactgctattgtatcgtgccttattaccaacacctgtttggtaccggtttttcttaaacagggcatacggcagtctcttttcatccctgaccacagggttatatttaactttcaagctaacatctgttgttgagaaggtccaatgctttttatctgccttgaaagcattgtcaagaaaggaagttcattatggggttaatgccacaatggagcaggttaatgctgctggtgacttatgtgccatatgccaggagaaaatgcatgcccccatattgttgcgctgcaaacacattttctgcgaggagtgtgtgtcagaatggtttgagagagaaaggacatgccctctatgcagagcactggtaaagcctgctgatctgcgtaccttcggagacggatcaacgagtctctttttccagttgttctagactctagaagcttcttgttaggttggatcataattttgccaacctctggtcgaaagtaccttgcttcttactcggctatcgagggattttttcgtcaatcggttcctgggaaataagattgaaggaatcatcttggatatgactgtacactcagtcatggcttgagagcacaacattcctcctcttttaatgaattttaggtgtacaaaagaaaagggctcaaacttaagggaatcaactaaccctaagtattctttatatctcagtgtgatggacacagatttgttcttaatgttcatctttttgaaattcattcgcctcttatttttttttcaaagtatgtttatatttataatatataaatgtttctttcatagcccttttgtttatttttattattttaatgcaaaacatgtcaactgattttgtttcttgtacacatgtaaactgaaattgctacttggtgtaagaaacttggatttggatgctttcga

SEQ ID NO: 4520 - DNA, 814 bp, Hordeum vulgare
gcaggggcaaatgttaacactagtggaatactttctacttctgtaccgtgccttattgcctgctcctgtatggtaccgttttttcctgaacaaggagtatgggagcctattttcctctctaaccactggactgtatcttactttcaagctgacgtctgttgtggaaaagattcaatcatttttgacatcactgagagcattgtcccataaagacttccattatggctcatatgcaacgagtgaacaggttgctgccgctggagatatgtgtgctatatgccaagagaagatgcacgtccccattcttttgcgctgtaaacatgtcttctgcgaagattgtgtctctgaatggtttgagagggagcgcacctgcccgctgtgcagggcactggtgaagccagcagacctccggtcattcggcgacggttcgacaagcctctttttccagcttttctaggccgcaaacagcaagcgaggaacttggcttgcgcttgcttttacgctgtgcagataagaaagcaggtgttataggtgtgagtgcgtgcgttgtgtttgttcgtgtttcgcgagcagagcggcccggtgaggtgctgaaatgggtgcatttgttgccgagtgtgcatattatccggtgtataggctgtaagagatttacctggccctactacatttacataaatagaaatgagtccctatttcccggtccctggatttccgacctttgcacaggcgttacggcaaattggggaagtcttctaacccttgttggaattgaagaagaataaattcatttggaaagctcccaaaaggtaag

SEQ ID NO: 4521 - DNA, 1156 bp, Sarracenia psittacina
ggaatagtacggtcttctatatccactgatcatgcttccccaaaacgctatacacctttttggcatgctatcttcatcattatggtgaacgatacttcggttcgtcaggcagcaatggctctcaagtgttctctactaatgtactacaaaaacagcagaggccgaaattaccgtaagcagggtcaaatgctaactttagtagagtattcgctacctgccctgtaccgtgcccttgctgccagcaccagtctggcatcgtttctttttgaacaaagaatatggtagcctcttttcatcattaatgactgggctctacctaactttcaaactcacttctgtagttgagaaggtccaatatttttgtgctgcttttaaagcattgtctcgtaaagagattcatttcggtgcttacgccacatcagaacaggtcagtgcagtgggtgatttgtgtgctatctgccaggaaaagatgcacgctccaattttactgcgttgtaaacacatattttgtgaagattgtgtatcggaatggtttgagagggaaggaacatgcccactgtgcagggcattggtgaaacctgcagatctgagatcatttggtgatggatcgactagtctgtttttcagttattctaataagattaaactagaataacctgatgctgcagcagcagggagagttgttttttttggccttgaagtgtatgtaaaatcatttcgcttatcaaatcagctgactctccttgttccaacaccacccagccccagataaatctgatgatgggatcctcctctctccaccaccctcattattattattatttgccatgtggttgctgctgcctgctgggagttaaactgcactgcactgcactgtttatgttcatatatatgttgtattggtgaaattatttcttatcaactgctgcattgtctcaaattgatctgggccacagatttgtgtggtttcacgttaagtgttgaggcccacacaagatcagtttggggctctgaagtagttggtagggaataagaataacttgttggtgatgtctggttgatgggtcctttgagttgtaacaaaagtttctttgaatctctatcgtccaacagtatatatcactctccattttccatttgctataaatgaaagcaa

SEQ ID NO: 4522 - DNA, 2146 bp, Cannabis sativa
atataaaaaaatgaaaaaaaaaaaggaaagaaagaaatgaagaaagttaagtaatagtgaagaaagatatgatttttatttcttttttcattacaccacagccattattgctttataccactaaagtaccacttctactactactactactactactaattcaaggaaggaggagaggactcatcgtgaccaggaagtaccccacattcctattctttcttacggaaaagggttttccttcaaatcccaacttcttcaatcttcaataataataacccaaaaacaacacaaacctcatcactctctctctcttacgcggaaaaggtgtggtgggcggagatggagtcatcactgggtaattcagaaatgtatggaagaattaataacagtacgaggagatttggaattcaaattcctgagtcgaatttcataagggcgccattgactgcatttttggagcatacgggtatatttggaggtggagggagctctgtttctcaggcaacacgtggtttggttgggagccggcactctctgattcgtaactctcttcaggaggaggacgaagaagacgacgaatacgatgttgttccgggggatggtgaagatgaggaagatgaggtttctattaggatcattggagcaaccgagaatcagcatgaacttcctaccgttgatggtgctaatgtcgttttacgcagtggaaacgacaatgcaggacccagttcagggagcgaagatagcgagggcaacgccgagtctggagctggagctggagccacgagtaatagcagagactcttctccttatcagagatatgatattcaacactttgctaggtggtttgagcagattctcccttttactttgctacttcttcttgtcttcattagacaacattatcaaggtttttcaattactatttggattgccgcagttatgttcaaatcgaatgatattgtgcgaaaacaaacggctttaaagggggagagaaagattcctattcttgtgtgcataagttcagtgttcatgcttcatgtgatctgtttttactggtggtaccgaaaggatgaccttctgtaccctttggcattaattcctcccaaagtggtaccccctttctggcatgccgtattcatcatcatgataaatgatattatggtccggcaggctgcaatggccctgaaatgtatgcttttggtgtttttcagagatagtagaggtcgtgactaccgcaagcagggtcaaatgctaactcttgttgagtacctgttactgctgtaccgagcattgttgcctactcctgtttggtaccgatttttcttaaacaaagaatatggaagctttttttcttcgctaactactggattgtatttaaccttcaagctcacatcggttgtggagaaggttcagtgcttttttgtcgcattgagagccctatcccgtaaggaagtgcactacggatcatatgctacatccgaacaggtgagtgctgcaggagatctctgtgcaatttgccaggagaagatgcatgctcctatacttcttcgttgtaaacacatattctgtgaggattgtgtatcagaatggtttgagcgcgaaagaacttgtccattatgcagagccttggtgaaaccagcgggaatcaaatcgtacggggatggagcaactagtttgtacttccaactattttaagacacaccaaccatcattgatggaaacttgagcttctttgagaatcacaaaagggtctcatgtgttgcaagtaaatggattcatactacctatgaaaattcgaaattcgctgtccaatgaattcggaatagaatgtttggacttagatgaacttaaaatcaccccttaccagcatggtttttcaatccactgtagatagcctctacatgtaaaaatggaagaggttttatatttacttgtgaaatgcacacatataataatatatacatgaaatatacatatatgtagataacaaataaaggaatatttcgacataaaaactgagatatgtcaccgtaactgagttgacatcattattgatcatttgatttattgtttttaatgtccttgatttggtaactggtgcattgtcctcttttatttgcctagaacattcaaaaactagttattg

SEQ ID NO: 4523 - DNA, 2180 bp, Medicago truncatula
agtaaattgttctttatcgcattcacacgctcaacactctcaaaaagaaaaccaagttttcagctccctgattctgacttttcatcaccattgccaattcacttcaaatttcaaaccctattttccataattccttcattaatcgcttaatccataagctctcagggtagggaataaaaccctaaaaaatcgtcttttgaatatttttaatttaccccaaaattagaaattagtcgaaaagtggaagatcaaagaaatagggtgagtgaagaattgaggattagtttttttatttttatttttaatttgtgttaaagatggaaactttgggtggtaattcatcaccatcaccatcattatcatcagcatcatcatcatcatcttttggagggattaatactgatgataacaatggtagtgtatcttggtatggaatgaggttacctgttaacccctttttgtcaccgatttcgtttttgttggattattctggaattttgcgttcgggtaatgattctgagggtatgattgtcaacaatggagtttctggttcggagttacgacctcaggttgatgctggtggtgctgttgctgggagtagtgcaggggaggttgcaataagaattattggagctggagagaatattcataatcaggttggggaagtgggttatgatgattgcggtgaggagcttattgctgagagaagtggaatgcctggattgggtgagaatgatgccgagggtcgtggtggaattgaggctagtgaaggggttcctcttgtgtcttcatcttcttcttcgtcgttggctggtagtgggcaggttgatggtgaggctgctgggaatggaacagaaaataacagggattcgtcttcttaccagagatatgatattcagctggttgctaagtggattgagcagattcttcctttctcgcttttgttgttggttgttttcattcgacagcatttacaaggtttctttgtcacaatttggatagcggctgtgatgttcaagtcaaatgaaattgttaagaagcagacagctttgaagggagataggaaagtctctttgcttgctggtatcgcttttgcattcattcttcatgtgatatgcatttactggtggtatcgaaatgatgatattttatatccactggccatgttacctcctaacccaacacctttctggcatgcaatattcacgatcttggtcaatgatatattgatgcggcaagttgcaatggcttttaagtgtatccttcttatatattacaaaaaggggaaaggtcataacttccgtcggcaggctcaaatgttaactcttgttgagtacacgctgttgttgtatcgtgccttgttgccaacaccagtctggtaccggtttttcttgaatagggaatatggaagtctcttttcgtcactgaccacagggttgtatttaactttcaagctaacatctgtggttgagaaggtccaatgctttatttctgccttgaaagcattatcaagaaaggaagttcattacggggtctatgccacagcagaacaggttactgctgccggtgacctatgtgctatatgccaggagaagatgcattcccctatcttgttgcgctgtaaacacattttctgcgaagattgtgtatctgagtggtttgagagagaaaggacttgccccctatgcagagcattggttaaagcagctgatcttcgcaccttcggagatggatcaacaagtttgttcttccagttgttttaatcaactcatgatctttggattggatcatagtttttgaccagcctttgcttaaaaagtaccatgcatcttattcttactctgattcgatgagattttttatcaaaggaatggttatgaattgaaagttcacttcagttgcaacaatgtcagatgtacaaattaagggctttgctcagctgtgagatactcaaaatcgggggaacctgctaacctgatatattcctcgtatactatgatgaacacaaacttgttcttaatgttacattattttgatattaatccccatttctttgaagtttgtatatgtttttgcacagactttattgaaatatgttaactaagttattacacttggaagtgctgaaattgccatatgtaaaagaaatttggatttggatgcttttgttgattgtcatg

SEQ ID NO: 4524 - DNA, 1841 bp, Brachypodium distachyon
ggtttcgccgctggcgatggacccaccggcgggaggctctaccgatcgccggggagccgtgtccggcgcctccgccggtgccgcgtcgtccggcctccgccggtacggcctcaacttctccgcatccagccttctccaggctccgctcgccgcgctgctcgagtactcaggcgtcgttccttccgggccgccatcgcagacggtacaccaggcggtcccttcgtcgtcgtctgaggccgacgggctactttccgccgctgcggccgggaacggggaggtctcaattcggatccagggcggccccaacgactcggatgcggcgggcgcggcgtctaccggggcctccccgggggactcgatcgaggcgaccgctgccaccgatgttgacccggcctccgcggctgggaggggtgctggtgccgacgcggaggcgggcggcggtggcagtggcggggcgacggggaatggggccggggaccgcgcctatcaacggtatgacgtgcaccatgtcgcgcgttggatcgagcagatactaccattctcgctgctcctgctcgtcgtcttcatacggcagcatcttcaaggtttctttgtcacaatttggattgctgctgtaatgttcaagtcaaatgatatattgaagaagcaaacagcgttgaagagcgagagaaaagctgctgcgcttgttggaattaccttaatcttcatgatccatgtttttggcgtctattggtggtacaggaacgattatctgcttagacctctgttcatgcttcctccaaaagatataccaccattctggcatgcaatttttatcatcatggtcaatgatacaatggtccgccaggcagcaatggccgcaaagtgcatattacttatgtattacaagaacagcagaggccgtaactaccgtaggcagggacaaatgctaacccttgtggagtaccttctacttctatatcgtgcattgttgccgacgcctgtttggtaccgtttctttctgaacaaggaatatgggagtctgttctcatccttaaccactgggctatacctcactttcaagttgacttcggtagttgagaaggttcaatcattcttatctgcagtaaaagcattgtcgcgtaaagatgtgcattatgggtcttatgcgacagcagaacaggcaattgctgctggtgatatgtgtgccatctgccaggagaagatgcatgttcctgttctccttcgctgtaaacatattttctgtgaggattgtgtctctgaatggtttgagcgagaacggacttgccccttgtgtagagcgttggtaaagcctgctgacattcggtcatttggggggaaaagattagaaatccttccttatcatgtggcaccattgtcgccatatgtaccgaggtcaatgtgagaatgttcattaaaattgtcttactacaaaccattctgtttgtccatatattcaagcgacagttagagagctggtcggttgcagtatcagcatagcttgcaacaaaagatccggagctggaatgatgctggatgagtgatagagtaaatgcgaatccctgaattgacggatcgcatcctgctgttggcttttatgtaaagtttggtaaaaaaatcacaagtgatgtgtcttggtgtataattggtactggagcctgcaagttctgtttgctagcagtgattctgtttggcaaggtggtagaaatgtaacctgtaaagctttggtacatggagttgaaaaccatataaaattgtaattgtacttgtaacaaacagtaaatattacgaggaccacaattttacacatatcttaaatgagttggtaccgttgtaaggtg

SEQ ID NO: 4525 - DNA, 3289 bp, Ricinus communis
gtcacacacacttgtttagataacatattatataatatcacataatatgtttcctcaaaaagaaatttatacggcataatatgtttccttctttctttctatccatttttctcttctgaataaaccaagaaacagcagttagttgacacgtctgtatgtatgagaacctccatcgatcgatcccgtaattcgctgttggatacatttgtgaataaaggataagagagaaaacgtcagaacgagacaaccatttatgtacaaagatctgaattaaagaaggaaaaataaaaagggtacaaaagccgcgtagcagaagcggaaagctgtgacagggacgttaaagagaaagaaaggaaggtgaaaatgaaataacaatagtagccagcctgtgctttaaccaacaagacccttttcccaaatatttgttttgttttgttttttgttttctttgggcagagattaacaatggagacttcttcttcttcttcttcttcttcttctttttcttcttcttctattggtttgggtagcagtaattatgggggtgttagtagtgttagtggcagtaataatagcaattcaagaagatacgggataaatatagcagcgtctagtttgatacatgctccattgactacccttttggaatattcaggatttcttggaggaggaggaggaagcgcttcttcttctcaagaaagggagcaattgatttctcctcctccgtcttctaggggatcaaacagaggaggtggtggtgggggtgaacatcaccaggaccaggaggttactattaggataattggtggtgctgagtccagttctgcttcatcattacctttgtcagatgatcaagatcaaccacctggtggacccctcatttctcaagctctaccttcttctcatgggaccaccaccgaaccctcttcttcaacttcttatcaaagatatgatattcagaattttgctaggtggattgagcatgttcttcctttttctttgctgcttttgcttgtttttattcgccaacatttgcaagggttttgtatggcattatggattgctgcagttctgttcaaatcaaatgatattttaagaaagcagacagctctaaagggagaaagaaagaagttttttcttgtagccatgactgtactattcatgcttcatgtggtatcattttattggtggtatagaaatgatgaccttctatacccgttggctttgcttcctcctaccaaactacctcctttctggcatgctgtatttatcatcgtggtgaatgatgctatggtgcggcagctagcaatggctttcaaatgtatacttttgatgtattacaagaatagtagtgggcagaattaccgtaagcagggtcaaatgctaactctcgtggagtatcttttgttgttctaccgtgccttgttgccagcacctgtctggtataggttcttcttgaacaaagagtacggaagtcttttttcttcattagttacaggattgtatttaaccttcaagcttacttcagttttgaggaagattcaactgttcgttacagcattgagggctttatctcgtaaagaaatgcactatggttcttatgccacatctgagcaggtcaatgcagcaggagatctctgtgctatctgccaggagaagatgcatgcaccgattttgctgtgctgtaagcacatattctgtgaagattgtgtatcagaatggtttgagagagaaagaacatgtccattgtgcagggcattggtcaaaccagcagatatcagatcatacagtgatggttcaacaagtttgtatttccagctattctaagatctgctgctgaatcaaaaaaaaaaaaaaaaaaaaaaactctgctgcttgctgataccctggagccacttatactttcaaccaaaggtcatcttgcctttcagtttctgttcatatatgttctccccatcagatacaagtgtgtagacagttcagtcaagttagaggtgaaaatatgcgtttgtgtattgtactacagaaggtcgataggtctgacagaccattcattatattcttattattcctcctgtgcatcatgtttcttgtaatctgttataacatttgatttaatgaaagttgcagttgattgcagaacaaattgagctcaattttactgttccaaaaggcttcagtagatggtgtcaccttgcttcaatgttattcagaaatctctgaaagagatgagttcaatttcattcttttctatttgattcagtcaggtttcacaatcttgacaaaggctgcattggagaaaaaccaaataaaagacaacttcagaaagtaaatttcagctcgaataatgatttggattgtgttgtcaaaaattgcaatatgtcaggactccgaaaaattcaaaatacatttcagaaatctgaaaaagaattaaagacaactattgttttaacatgacaagaagcatgaaagtacatgataggaaatatacactagtatcagccagcaatgactgaaaaatgaattgacagatcgataacatacagttacaatttcaagcataagaagaagcaatgctgttcaaacggaagagctcgagtaattttttgtatccactgcagcattagcagtatttaaattcaagggggttgcacttttaggaacctccaaaagtcctggcggtggcacagggcgaggatagatgtcccgagttggtcgcagacttgaaccacgggaagcctcaggtgacagtgaagggggcagcgaagtattggagaaagaggaagtatccgacacaaccttgatgggataaacttcagtgacttcctcagtgctctcatctaagtatacaacatcctgcatggtgagttggtggtattcgacaacctcccttaggaagcgattctcacgtgcataaaccgagttctcatgcgccaaccgagccttctctgataatagtgtttcaagttgaagccgtatctgaaatggaaaaatggcatcagaatatgatagtttggtagaacaaatatgacttggctcaaccaataattgcagtttacccaaaagaagataaagctttccttgtcctaattctaataaacctcagcagtagttaaataaatgaatacaaaaccttaaactcgaaattataaactgtgaaaataaaactatgttatgattactaatttgaattctactctttaagcaatttaaattacaagataggtggaagaaagcatctagtttaatctccaaactttagtaataaatttctcacaaagtctaaaaa

SEQ ID NO: 4526 - DNA, 1337 bp, Cephalotaxus harringtonia
gcctctgtcatccttattggagttttcccggacgtcagaaacaagcacaaacttgggtgccggcggaccccttttcaggggcctcggcagggcaaatgacgtggcagggaggggccactcgactagagctgatgaggcaggtgctgctgaggtttctattaggattttcagtgcgggcgagggggaggagcatgtgaccgtgaatagttatggttccagcggggagcaagggttcgaacccgcgacctcttctttgcatagcaatggtgttgagagtgcgctgacctcgatgccatctttaactattagtgctgacggtgctgctgaggtggccagtcgaagggatagaaatgatgatgacgatgctaataatactagtaggaataataacaacagtggctctcagagatatgagattcagcaggtggccaggtggattgagcaggttttgcccttctcgctcttgcttttcgtcatcttcgttcggcaacacttgcaaggtttcctgatttcattctggataactgcagttatggtcaaaatgaatgatcttttacggaagcaaacatcgcttaagggtgaaagaaaatatcagttttaattggcattatttcagttcttttgttgcatgtagctggagtttattggtggtataataatgatgacttgtggtacccacttcttatgattcccccaaagaccataccaccattttggcatgttatatttgttatcattgtcaatgatacaatgttgcgacaagttgccatgatcttaaaatgtggtctcctgatatactacaaaagaaacagaggttgtaattatcggaagcaggggcaggtgttgacacttgtggaatacattctccttctttaccgtgcattgcttcctactccagtttggtatcgtttctttttgaacaaagaatacggcagccttttctcatctctgaccacaggactgtaccttactttcaagttaacgtcaattgtggagaaggtgcaagcatcctttgcagcactgaaagccttatcgcataaagaagtgcagtatggatcatatgctactgcagaagaggttgttgcagctggggatctatgtgcaatttgtcaggaaaaaatgcatgtgccaatcttgctacgttgtaagcatatattttgtgacgactgtgtatctgaatggtttgagagggagaggacttgtccactttgtcgagccattgtgaagccagctgaattgagatcctttggcgatggctctaccagtttgcttttccagctattttaactttctataaatagaatttgataagctgcttgccaaggcaaatggacaca

SEQ ID NO: 4527 - DNA, 1951 bp, Citrus clementina
cactttcgtccaatttgcagcgtaagaataaagaaaaagccttttgaagatcaagccaatcatattggatcatcgtcatctccacatctgattcattcttcagcttaatcttttttgtcaaaatcgactaaataccctccaaagtctcaatctttttcaaacaatcccccaggtcccaggtccaaggtcactgtgtctgcatcatcgcgtcccctcgttaaaaatggaaacttcagttcccggtcattcttcttcaccgctgccggatgatgatcgtactagtactagtgctagtgcaagtgataattcaagaagctatgaggttcagttaccagctgcgctcaacttgttccggtcaccactctctcttttattggaatattctcgtgtcatgtctacaagccaagaatctgagcaggatcgtttgacggtcaatgctgattctgaagctcggggtcaaacccagctgcccaattctgctctgagtacaggggaggtctctattcagataattaggcaagaaaatggtgaagccacgggggcaggagaagataatgagggaaatgcaattggggaaggtgaaacggtgccgttggcggcttcagaaggtagcaccagtagggaaggttcttatcagagctatgatattcaccagtttgctcggtgggtggaacaagttcttcctttttccttgctgttgttggtcgtttttgttcgtcagcatttgcaaggtttctttgttactgtttggattacagctgtaatttttaagtcgaatgatattcttcgaaagcagactgctttaaagggagagaggaaaaactatattctctttatgatctttataggttttatgtttcaggtgattggtatctactggtggtttcggagtgatgatattttatatccattgctcatgattcctccaagtacaataccacctttctggcatgccgtattcatcatcttagtgaatgatacaatggtaaggcaggctgctatggctatgaagtgtctactgctaatatattacaagaatggaagaggccacaatttccgtcggcagggtcaaatactaactctagtagagtatgcactgctgttataccgtgccttgttgccaacacctgtctggtacagatttttcttgaacaaagattatggaagcctcttttcatctctgacaacagggctgtatttaactttcaagctcacgactgttgttgataaggttcagagtctctttgctgccataagggcattatcacggaaagaagtacactatggatcgtatgccactacagaacaggtaaatgcagcaggggatctctgtgctatttgccaggaaaagatgcacgctcctatcctgttgcaatgtaaacacttattctgtgaggactgtgtttctgaatggttggagagagaaaggacttgcccactgtgcagagctttggttaagcctgctgatctgcgatcatttggggatggatcaacaagcttgctcttccagttgttctaaaaccatgtttttgcttcattgtatatctttacacatgcaaatagctgatgcatatcatttaaaacgtaattcgtggattggctagagaggtggaaaagaaaaatattaccagaatcaagatcagattggtaatgagttcattcgttacatatgtgaagttcgaggattgttaaacaaaggagagagaattctaacccctattccattcatacatttaactttctgataaaagaggaagcttgtagctgtttgcaacttattttatgttcatctttcgttcacacacttaattcagaatgggaattgggaaatcaactggagattatctacattacagccgtggtcagttataaatcaggttggacttagttttatctcttgcattctctcctgaaaactccaaattttttataatgatgccaccaagtattt

SEQ ID NO: 4528 - DNA, 662 bp, Cleome spinosa
tgttgttggaatttactggtggtttcacaatgagaacatgctccatcccttgatcttgcttcctcctaaatcaattccgcccttttggcatgcggtcttcatcataatggtaaatgatactttggtcaggcaagcagggatggtcttgaagtgtcttcttttaatctattacaagaacagtagaggtcgaagctaccgtaagcagggtcaattgctaaccgcagttgaatatctgatgctgctttaccgtgccttgttaccaactccagtatggtaccgtttcttcttgaataaagaatatgggagtcttttctcatcattgatgacagggttgtacctaacgttcaagctcacttctgttgttgagaaggtgcaatccttttttgctgccttgaaggtgctatcttgcagggatgtgcactatggagcttatgcaacctctgagcaggttcatgcagcaggagacatatgtgccatctgccaggagaagatgcatacgccggttctcctgagctgtaaacacattttttgcgaagattgcgtgtcggaatggtttgagagggagagaacatgcccactgtgcagggcattggtcaagcctgcagatataaagtcattcagtgatggatcaacaagcctgttttcccagatcttctgaaagg

SEQ ID NO: 4529 - DNA, 844 bp, Cucurbita pepo
atacgatggtgaggcagttggcaatggctttcaaatgtcttcttcttatctactacaaaaatggcagaggccataactttcgccggcagggtcaaatttaacgcttgtggaatactctcttctgttgtaccgtgcattattaccagcacccgtatggtaccggttcttcttgaataaagatcaagggagcctcttttcatcactgacaacaggattgtatttaaccttcaagctaacgtctgtggttgagaagattcaatcattcgttgctgcatttaaggctctatcacaaaaagaagttcattatggatcatatgccacatcagaacaggtaaatgctgcgggagacctctgtgctatctgccaggagaagatgaatgctccaatcctgttacgttgtaagcacatcttttgtgaagattgtgtttctgaatggtttgaaagagaaagaacttgccctctttgccgggcactcgtaaagcctgcagaacttcgaacattcggtgatgggtcaaccagcttactcttccagttgttttagacgaaaaccgtcgattactcgacataacaatactatcacttcaacaaagaaagatattgtttatcagatggaaacagggagaagtagaagaacaaagaaaaagggagaactagacatcgaggtaagtcttaagatattgtcaaattcaaaatgctttataatcattgagagctgtttatatgaattgttggtgataagtgttatctgtaagatttattccctgtaatttaggtctggaaagggctgccatgtgaatgcgatggtcagtctgtagtgatggtgtaacagatttgatattgattt

SEQ ID NO: 4530 - DNA, 1142 bp, Cucumis melo
ctgtccttgctggaacttccattacgtttttggttcatgtaattgggatttactggtggtgtcatagtgacgatcttctataccccttagtcatgcttccaccaaagactgttcctcctttttggcatgccttgttcatcattttggtcaacgatacaatggtgaggcagtttgcaatggctctcaaatgttttcttcttatctactacaagaatggcagaggccataattttcgtcggcagggtcaaattttaactcttgtggaatacactcttctattgtaccgtgcattattaccaacacctgtatggtaccgattcttcttgaataaagatcaagggagcctcttttcgtcattgacaacaggattgtatttaactttcaagctaacgtctgttgttgagaagattcaatcatttgttgctgcatttaaggcactatcacgaaaagaagtccattatggatcatatgccacttcagaacaggtaaatgctgcgggagatctttgtgctatttgccaggagaagatgaatgctccaattctattacgttgtaagcacatcttctgtgaagattgtgtttctgaatggtttgaaagagaaagaacttgccctctttgccgagcactggtaaagcctgcagaactccgtacatttggtgatggctcgaccagcttactcttccaattgttctagacaaaaaattttcgatttcccgacataacaaatctatcagtttaacaagggaagatattgattattgaacgaaaagggggaagaacaaagataaaagggagaaagaagaagaaagaggaaaaacaaaacatccaggcaatcctgaagatattgtgaaattcaaagttggattagtattatgttgatgctttataatctcattgtgatgagttagatccccaaacagaagatggatttaataaaatcccatttcattgaatacaatgaaatctaatttttttaacagaggaaagggctccaactgtgagaactgcaatgttatatgagaattgatagagaataagtgtaatccaatccttaaagatgattattccttgtaatttaggtatggagaggctgccatgtgaatttggtggtcagtctccattcgtgatgtaaacacagaaa

SEQ ID NO: 4531 - DNA, 1953 bp, Mimulus guttatus
atagatatagatgtatacatatactccgtcagccattgttaaccccttgtctcttcttccccaagatgattcttcctccttccctcaacgtatcatcccatttctctttctagttattagttaattcatatacacacacacacgtatatactaataaatatatataaatatatactggtttctatttgctgatcttttgtaacagttgccagttctcgctcctctgacttttatctgacatttctctgcattttccgttaccggaatattctccatctccgatatatccattccccctcttcttcttcaccaataatcgagtaattcttcactcaatttcgtgcgcttgtgtctggctgttttttaccttcttcctgatttttgagggtttttccttttatggagacaccaaaccgcgatgctttagattccgcctcacaaggcagcaatggagtcggaacctccagaatattccgttcccgtgctatccggttcctacggtcccccatttcatccctgctagaatattccggcgtccttcgtgaccggccggattaccccttctcggaagcttaccctctcatccctgagagtactggtgccaatttcaaccaaaaccctagacgttcggagccactcaatcgtaacgatgctgttgatgggggtggcactagcaactctggcggtagcaataactgtgcggaggtttcgattcggataatcggggagcaggagagtgttgggggtgcaaataatagcgatagtggtgtaaatggggtgggactgggtgcgggggagtctacggtaggggctggtgatgttaatcggaatgggaatgggaatggtaatagtaatgatgataataacaatagggaagcatcgtcgagcgagagatatgatatacagcaggctgcgaggtggattgagcagattcttccgttttcgttgctgttgttggttgtttttatccggcagcatttgcaaggatttgttgttaccatttattccaccgccatcttgttcaagtccaatgacattcttcggaaccaaactgctctaaagggagaaaggaagattactatcctagttggttcttcagtctttttcatgattcatatatttggaacctactggtggcaccgtagggatgatcttttttatccattaatcatgattcctccaaagtccatcccacctttctggcatgcaatattcatcattcttataaatgatacaatggcacggcagacagccatggttttcaagttggttctgttgatgtactataagaatggtcgaggacaaagtttccgcagacagggccaaatgttgactctggttgagtatacactgcttctttatcgtgcgttgttaccagcccctgtatggtatagattcttcatgaacaaagactacgggagtctcttttcatcactcataacgggattgtatttgactttcaagctaacatcaattgttgaaaaagtacaatccttcgttactgccttaaaggcattatccaaaaaggaagtccattacggatctcatgcaacatcagaacaggtaagtgcagctggagatatgtgtgctatatgccaggagaagatgcatgtacccattttcttgcggtgcaagcatatattttgtgaagactgcgtttcagaatggttcgaaagagagagaacatgcccgttatgcagggctctggtcagacctgctgatcttcaatcgtatggtgacggatcaactaatcttttcttccagttgttttaaaacttttcatcaacacacaaacttaacacctttctccttatacaatctctaaaataggtttcttggagaaaatattagtttgatgaggcgtatatgttatcgattccatcttcgtatatataactactatatacatatatatagaatattggtactcctgagttgagtgagttctgcccg

SEQ ID NO: 4532 - DNA, 1879 bp, Citrus sinensis
ggatcatcgtcatctccacatctgattcattcttcagcttaatctttttttgtcaaaatcgactaaataccctccaaagtctcaatctttttcaaacaatcccgcaggtccaaggtcactgtgtctgcatcatcgcgtcccctcgttaaaaatggaaacttcagttcccggtcattcttcttcaccgctgccggatgatgatcgtactagtactagtgctagtgcaagtgataattcaagaagctatgaggttcagttaccagctgcgctcaacttgttccggtcaccactctctcttttattggaatattctcgtgtcatgtctacaagccaagaatctgagcaggatcgtttgacggtcaatgctgattctgaagctcggggtcaaacccagctgcccaattctgctctgagtacaggggaggtctctattcagataattaggcaagaaaatggtgaagccacgggggcaggagaagataatgagggaaatgcaattggggaaggtgaaacggtgccgttggcggcttcagaaggtagcaccagtagggaaggttcttatcagagctatgatattcaccagtttgctcggtgggtggaacaagttcttcctttttccttgctgttgttggtcgtttttgttcgtcagcatttgcaaggtttctttgttactgtttggattacagctgtaatttttaagtcgaatgatattcttcgaaagcagactgctttaaagggagagaggaaaaactatattctctttatgatctttataggttttatgtttcaggtgattggtatctactggtggtttcggagtgatgatattttatatccattgctcatgattcctccaagtacaataccacctttctggcatgccgtattcatcatcttagtgaatgatacaatggtaaggcaggctgctatggctatgaagtgtctactgctaatatattacaagaatggaagaggccacaatttccgtcggcagggtcaaatactaactctagtagagtatgcactgctgttataccgtgccttgttgccaacacctgtctggtacagatttttcttgaacaaagattatggaagcctcttttcatctctgacaacagggctgtatttaactttcaagctcacaactgttgttgataaggttcagagtctctttgctgccataagggcattatcacggaaagaagtacactatggatcgtatgccactacagaacaggtaaatgcagcaggggatctctgtgctatttgccaggaaaagatgcacgctccaatcctgttgcaatgtaaacacttattctgtgaggactgtgtttctgaatggttggagagagaaaggacttgcccactgtgcagagctttggttaagcctgctgatctgcgatcatttggggatggatcaacaagcttgctcttccagttgttctaaaaccatgcttttgcttcattgtatatctttacacatgcaaatagctgatgcatatcatttaaaacgtaattcgtggattggctagagaggtggaaaagaaaaatattaccagaatcaagatcagattggtaatgagttcattcgttacatatgtgaagttcgaggattgttaaacaaaggagagagaattctaacccctattccattcatacatttaactttctgataaaagaggaagcttgtagctgtttgcaacttattttatgttcatctttcgttcacacacttaattcagaatgggaattgggaaatcaactggagattatctacattacagccgtggtcagttataaatcaggttggacttagttttatctcttgcattctctcctgaaaactccaaattttttataatgatgccaccaagtattt

SEQ ID NO: 4533 - DNA, 1990 bp, Phalaenopsis aphrodite
cgcaggtatgttcctggtgcacgttgtgcggaaacccaaagccggcatccaaggcgttggtgctttggtaaagaccaatctgcgacactcgcttttctcctgcgagccggagaagtgaaacggcaagtgattcagactttttcaggaaaaggggacatctcttttctctctctcgctcgccgtgcccgggttgatcggaggccaggaaggttagggttcaatctattcagctggccgttcgcaggagacgcgctctgtgtcccgacctttcatcggttccgccggcgaattgtggtccatcgcgtactatttcttgcttttctcccaatatgagcgcctccggtggcaactcaaactttttcaggagcccggctggttcgaccgtcggaggaaacggtgccggcggtggctctaggagatacggtttgccgttttcggtttccgatttgatccaggctcctttgtctgctctgctggagtattctgggattcttcgtccgagatcagtccacctagagagtgagagcttgagcggccgtagaatcatcgccagcacaggggagcgtgctcccggtcaggttgaagaatcctttgtcaccgatagcagtgacggggaagtatccattaggatctttgacattggcgatcaggagaatccaagaacgagcgctggtattcagcagccactgtctgttggcccgctaagggagggtagtcttggagatcatggtgtatctatggagcagatgcagatggattcagagagacagagaggagagggagggagcagtgatgccggagttggagtctccacatttgccggagctacgcagtctccatcggttttgggcgttggggggcagagtgtggaaggggaagggagcgtagcagaaggtaatgctagggattcagcataccagagatacgatatacagcaggctgctaggtgcattgagcaggtccttccattctcgctgcttcttttagtagtttttatccgacagcatctacaaggtttcttcatcacgatttggctgtctgctgtaatgttcaagtcaaatgatttattgtgtaagcagacagccttgaagggagagaggaaaatttcagtacttgttggaattggagtaattttcaccattcatgtgattggagtttattggtggtactgcaatgaagagctgctttatcccctggttttgcttcccccaagtgaagttccaccattttggcatgcaatatttatcattatggtgaatgataccatggtgcgtcaggcagctatggctgtgaaatgcgtccttttagtatgttataagaatagtagaggctgtaactatcggaaacagggtcaattgctaaccattgtggaatatctagtgctgctgtatcgagcattattaccaacaccagtttggtatcgtttcttcctgaacaaggaatacggcagccttttctcctcccttacaacagggctgtatctaacttttaagctaacatctgtggttgaaaaggttcaatcatttatggcagcagtgaaggcattgtcacggaaagaaatgcattatggatctcatgccacagtagatcaggtcattgctgccggtgatatctgtgctatctgccaggagagaatgcatgctcccatcctactccggtgcaaacacattttctgtgaggactgcgtttctgaatggtttgagagggaacgcacatgtcctttgtgccgggcgcttgtgaagccagcagatcttcgatcatttagtgatggttcgactagtcttttctttcagattttctagctagcatatttaaagaaagagttatacttggctccacacaggaaaagctgccctgagatacatgggcggctcccctagaatgctttgaaggctgtttaagtgcgacagattcttgcacatctggtggagatgtttatttaatgtacccaaaaaaaaggtaaattttcatccgctagtcaatttaatgg

SEQ ID NO: 4534 - DNA, 2171 bp, Cajanus cajan
ctcgcgtcctctttcacacacagtcacaaatttcgaaagacagggtttgtttgagcttcctgaccttgacttttctcctctcttcttccgcttctgcttccgccatgtccatcgcatcgcacaattaaaccctcgcatcctctcaccatgtacatccgcacctcttttcttcattcacctaacttcgcaattctaaatatcctaaacctaaacctaatgactctcaattaccgtcgctgatcgccgaaatcgggaaaaaaaaaaagaggaacacgccgttcgttagggtttcgatggaatcgtcgccgtcttcttcttcctcgtcgtcatcttccgggagcgagaccggcggtggcgctgtcacgtggttcgggatgagtttcccgttccgttctccgctctctctcgtcatggattactgcgcgcgcgaggattccgcggagcctgtgatcatcattccccgcacgcgccctcggtttcaggctcagcctgaatcggcttcggcttcggcttcggcttcggcttctgcgtccgcttcggcctctgattccgacgagaatgcctgcagcggcgcggaggaggttgcgatacgcataattggggccggcgagcaggagagcggctcgccgtcgtcgtcgcggggccgggaggcaggctgcgaggaggaagtgatcgggaggagcgcgatgctgtcgtccgaggctcgccggagaatggcggaggagagggttccgttggtttcgttggatgatgggattggtggcggcagggattcttcttcttcatcatcatcgtcgtctacctaccagaggtatgatattcagcaggtcgccaagtggattgagcagattcttccgttttcgctcttgttgttgatagttttcatccgccagcatttgcaaggtttcttcgtcacaatttgtatatcagctgtgatgttcaagtcaaatgaaattgttaagaagcagacagccctgaagggagatcggaaagtatctattctgattggcatctcttttgcctttatgctgcatgtgatatgcatttactggtggtatcgaaatgatgatcttttataccctttggctatgcttccaccaaaatcaacaccacctttctggcatacaatattcatcattttggttaatgatacattggtgcggcaagcagcgatggcttccaagtgtgtgttgcttatttactacaaaaatggaagaggccataacttccgtcggcagggtcaaatgttaactctggttgagtacactctgctgttgtatcgtgccttgttgccaacacctgtttggtaccgatttttcttgaacaaggagtacggaagtctcttttcctcactgaccacaggattgtatctaactttcaagctaacatcagtagttgagaaggtccaatgcttcgtttctgccttaaaagcgttatcgaaaaaggaagttcattatggggtttatgccacaacggaacaggtgaatgcagctggtgacatgtgtgctatatgccaggagaagatgcaggctcccatattgttgagctgtaaacacatgttctgtgaggagtgtgtatcggaatggtttgagagagaacgaacttgcccattatgcagggcattggtaaaaccagctgatctgcggacctttggagatggatcaacaagtctgttttttcagttattttaagctctcgctttgtttggcttgttgggtcattttttgagccaaaatcttcctggaaaatgttacgttctctggtttggtaaaatttcccattaatggattctaatgaaattgagattgaaaaaatatatatatagatatattacatttatggctaaagtgcaagttcttctgtgtaatgatatcagatgtacaatacaaacttcaaagggccttagacagctggctgatcctgaaagccgcgtggatcttttaacctgatattcgtcacgtcacacgttaaggaaactcttgtttataatgttacatttcaaattagtttccctcttctcccataccaatttcgtagggatatcttccacaagtgtgcgttgataaatttattccagaacaatattcgacatattttattaaataaatatcaacactgaattttgtcagcataacaagtggtttgaaattattttaaataaatgaaatcag

SEQ ID NO: 4535 - DNA, 2088 bp, Sciadopitys verticillata
agttggtaaagaagaaatagtctgcaatcattgttagggatcatggaaagctctagaagatatggcctgcccttctcattagcaggcgcaatacaggcgccattctcaactttattggatttttccggcctgtcaagaggccggccttcacaatctggagaggcgagcacgaatttggcatccggcagaccccttttcaggggtctaggtggtagcagggcggatgacctggcaggaaggggtcagggctcggatagggccgacgaagcagtgacaggagctgcagaagttgccattaggattttcagtacgggcgagccggagcatgtgagggtaggaagtgttaataatttggcctcagggtttgaacctgcgacctcttctgtgcagagtaatggggctgagaatggtgcgaatgcgctgacttcgatgccatccttaactattagtgcggagagtgctgctgacgtggccggtcatggagatgatgatgttaatagtaataataacagtagtaataacggcagtggctctcacagatatgatattcagcagctggccagatggattgagcaggttttgccattctcgctcttgctcttggtcatcttcgttcgacaacacttgcaaggtttcttggtttcattctggataactgcagttatgatcaaattgaatgatcttttacggaagcaaactgcacttaagggtgaaagaaaaatatcagttttgactggcattatgtcagtcctcctgttgcacgtcgttggggtttattggtggtataaggatgatgacttgtggtacccacttcttatgcttccgccaaagaccataccaccattttggcatgctatatttgttattattgtcaatgatacaatggtccggcaagctgccatgatcttaaaatgtggtctcctgatgtactacaaaagcaatagaggttgtaactaccggaagcagggtcagctgttgactcttgtagaatacatccttttgctttaccgggcattacttcctactccagtctggtatcgtttctttttgaacaaagagtatggaagcatttttcttcactgaccacaggactgtaccttactttcaagctgacatcaattgtggagaaggtgcaagcagccttcacagcactgagagccctatctcataaagaggtgcagtatggatcatatgctaccgcagaagaggtggttgcagccggagatctgtgtgcaatttgtcaggagaaaatgcattcaccaatcttgttacgttgtaagcatatattttgtgatgactgtgtatctgaatggtttgagagggagaggacttgcccactttgtcgagctgttgtgaagccatctgaattaagatcctttggtgatggttctaccagtctccttttccagctattttagctggttaagtaaatagatgttgacaagcagcttaccaaggcaaatgatgtacacaatctcaaaattcagtaccaacagattgtgtaagagccttgacaatgctctaccatagaatcgataccagttagaaaatacggtacctgacaatttactgctttttgcaaggcatcaagggtcagcatagtgttgaattttcaggtggagtagactactatgactactgcatgataccatgtaacattatagttttttaacacgccttagcattctcatcacatttcactgtgttttgtataaataacttccaaattgtaacaaggcagtgagaaattttcaaggtggtggggactggtgatactggaacttttcgttttggatattgggaatgcaaaaatgctggaatgtgcacacgcccctataaatggttagagctaatgttaaactgcggatatataatatctttactgtagacatgacacagtttaaaaaatggttgtaatgtatttatggttctaatcagatgcttggcatagagtcacacagctcatgtatttcattttgcttggaaaagtcctacacacttttatgtggcatgaccattggcgggcatgagtcctatggtgctccacagctgcccgcttttctgttcgctcaggcttgaccactgctt

SEQ ID NO: 4536 - DNA, 2242 bp, Glycine max
cgaaagagaagccttcagcttcctgaccttgacttttctcctcttcttccaccatgtccatcgcacgatccgcgttcacattaaaccctctcatcacacactaatcctctcacaccgtgctttgttccttcattcacaaaacttcatcccctttctcacaattaattcagcttcaaataatctaatctaaaaccgaaacccttatattatcaccaatgcatttgctttcgcaatatttgcgatcggtataattggagatcaccgtacggaaaaaaggaacacacgcggtaggtgaagcgaaagcgaaagaggtaagttagtttgttagggtttcgacgagatggaatcgtcaccgtcgtcttcgtcatcgtcgatgtcgtcgtcgtctggaagcgataccagcggtggtggtggtggtggcgctgtcacgtggttcgggatgagtttcccattccgttctccgctatctctcgtcatggattactgcgcgcgcgaggattccgcggagcctgtgattatcattccccgcacgcgccctcggtttcaggcgcatgccgaatccgcctctgcttcgtcctctgattccgatgagaatgcctgcaacggcgctgctgaggaggttgcgatacgcataattggggccggcgagcaggagagcggttcgtcgccatcgtcgtcgtcgaggggccggggaggggagccgggttgtgaggaggcggtggttgggaggagtgggatgctttcgtcggaggctcgccggcgaatggcggaggaaagggtgcctttggtgtctttggatgatgggattggtggcgttagggaatcttcctcttcttcttcttcttcttcttcctcttcttcatcgtcctctacttaccagaggtatgatattcagcaggttgcgaagtggattgagcagattctaccgttttctctcttgttgctgattgttttcatccgccaacatttgcaaggtttctttgtcacaatttgtatatcagctgtgatgttcaagtcaaatgaaattgttaagaagcagactgccctgaagggagatcggaaagtctctgttcttcttggtatctcttttgcctttgtgctgcatgtgataagcatttactggtggtatcaaaatgatgatcttttatacccactggccatgcttccaccaaaaacaccaccacctttctggcatacaatattcatcattttggttaatgatacattggtgcggcaagcagcgatggctttcaaatgtttgttgcttatttactacaaaaatggaagaggccataacttccgtcggcagggtcaaatgttaactttgattgagtatactctgctgctgtatcgtgctttgttgccaacaccagtttggtaccgatttttcttgaacaaggattatggaagtctcttttcctcattgactacaggattgtatctaactttcaagctaacatcagtagttgagaaggtccaatgctttgtttctgccttaaaagcattatcaaaaaaggaagttcattatggggtttatgccacaacggaacaggtgaatgctgctggtgacttgtgtgctatatgccaggagaagatgcaggctcccatattgttgagctgtaaacacatgttctgtgaggagtgtgtatctgaatggtttgagagagaacgaacttgcccattatgcagggcattggtaaaaccagctgatctgcggacctttggagatggatcaacaagtctgttttttcagttgttttaagctcattttctttggcttgttgggtcatgtttttgagtcaaaatcttcctggaaaatgtcacctctggtttggtaaaattttccattaatgaaattgagatcgataaaagaatgaagatatataatatatatatatatatggccaaagtatacaagttcattctagtgtaatgaggtcagatgttcagagggctatagacagctgacattataccgaaatccgcgtggatctcttaacctgatattcgtcacgtcacacaatggatactcttgtttataatgttacatttcaaattaatttccctcttcctcccatactaacctgtagggattacttctacaggtataccgtatacgttggtaaatttatttgagcaagttgacatattttattaaataaatgtttatcaacgttgaattttgtcaacataaccagtgttgaaaactttatctgggtagatgatatttaaaaaaaattag

SEQ ID NO: 4537 - DNA, 2030 bp, Trigonella foenum-graecum
aaaattagaaattagctgaaaagtggaaagatcaaataaatagggttgtagtgaagaaattgaggattagggtttttaatttgtgctaaaaatggaaacttggtagtaattcatcatcatcgccatcattatcatcagcatcatcatcatcatcatcttttggaggggttaatagtgatgataacagtggtagtgtaacttggtatggaatgaggttaccttctgttaacccctttttgtcgccgatttcatttttgttggattattctggaattttacgttcgaataatgattctgagggtatgattgtcaacaatggagtttctggttcggagttacggtctcaggttgatgctggtggtggtggtagtggtgggagtggtgcaggggaagttgcaataaggattattggagctggagagaatattcataatcaggttggagaagtgggttatgatgattgtggtgaggagcttgttggtgagagaagtggaacgcctgccttggatgatgatgatgccgagggccatggtggaattgaggctagtgaaggggttcctcttgtctcttcatcttcttcgtcgtcgttggctggtagtggacaagttgatggtgaggctgctgggaatggaacagaaaataatggaagggattcgtcttcttaccagagatatgatattcagctggttgctaagtggattgagcagattcttcccttttcgctcttgttattggttgttttcatccgacaacatttacaaggtttctttgtcacaatttggatagcagctgtgatgttcaagtcaaatgaaattgttaagaagcagacagctttgaagggagataggaaagtctctttgcttgctggtatcgcttttgctttcattcttcttgtgatatgcatttactggtggtatcgaaatgatgatatttatatccactggtcatgttacctcctaacccaacacctttctggcatgcaatattcaccatcttggtcaatgatatattgatgcggcaagttgcaatggcttttaagtgtatccttcttatatattacaaaaaggggaaaggtcataacttccgtcggcaggctcaaatgttaactcttgttgagtacacgttgctgttgtatcgtgccttgttgccaacaccagtttggtaccgctttttcttgaatagggaatatggaagtctcttttcgtcactgaccacagggttgtatttaactttcaagctaacatctgtggttgagaaggtccaatgcttcatttctgccttgaaagcattatcaagaaaggaagttcattatggggtctatgccacagcggaacaggttactgctgctggtgacctatgtgctatatgccaggagaagatgcattcccctatattgttgcgctgtaaacacattttctgcgaagactgtgtatctgagtggtttgagagagaaagaacgtgccccctatgcagagcgttggttaaagcagctgatcttcgcaccttcggagatggatcaacaagtttgtttttccagttgttttaataaactcgtgatcttaagtttacttcagttgcaacaatggcagatgtacaaattaagggctttgctcagctgtgagatactcaaaatcaggggaacccactaacatgatatattcctcatatactaaacagtatgatgaacagaaatttgttcttaatgttaaattattttgatattaatccccttcccttttctttaaagtttgtatatgtttttgcacaggctttattgaaatatgttaaccaagttgttgcacttggaagtgctgaaattgccatatgttataagaaatttggatgcttttgttgattgtcatgcctttttttcttttgctttttgctcagctagtgaaacttctatcttgaattacatacctttttttcttttgttgattgtcatgtctattcgatgatagaattgtactgtcatgtattaatgtatgtacaattatagaaatgtggtattgataaattaatttggaggt

SEQ ID NO: 4538 - DNA, 1019 bp, Vinca minor
ggaggtcaagagagggctacctcagtatcggtggacgaagaaggtcaaggatcggccggaagtgggaataatggaaatggtagaggggaatcttcgtaccagagatatgatattcagcagttcgctcgatggattgagcaatttcttccgttttttctgttgttattggtcgttttcattcgccagcaccttcaaggtttttttgtcaccatctggatcactgccttcatgttcaagtcaaatgacattctcaggaagcagactgccctaaagggagagagaaagatgtttgttcttgtcggttactttgtggtctttatgcttcatgttctgggaatctactggtggtatcggaatgatgatctttactacccgttatttatggttcctcctaaatcaattccaccattttggcatgcaatttttatcatccttgtcaacgacacaatggcgcgacaggcagcaatgtccttgaaactattgctgctaatgtattataagaatggccgaggccataatttccgcagacagggtcaaatgctaacactagtgaatacactttgttgcagtaccgtgcattattaccaactcctgtatggtatagattcttcttgaacaaagaatatggaagcctttactcatcattgacaaccgggttgtacctgacattcaagcttacatcaattgttgaaaaggtccagtcctttttagcagccttaaaggcattatcaagaagagaaatccattatggttcttatgctacagcagagcagataaacgcagcaggagatctgtgtgccatttgccaggagaagatgcatgctcccattttactgcattgtaaacatatcttctgtgaagattgtgtttcagaatggtttgagcgagaaagaacttgcccgctgtgcagggctttggtaagaccagctgatttgcggtcctttggggatggatcaacaagcttgtttatccaggtgttctaaacttttgatttgttcgggagtaaacaggccctcctt

SEQ ID NO: 4539 - DNA, 2224 bp, Citrullus lanatus
gtgccaattacgactcggcttccacgcgccactctatttgcttctctctaccttccattttccctttcaattctccattttttccctcatcttttttcttctttttctttttccttccccaaatctcaccggcgaccctccgacccatctccctccgccgcctttttccggctgtaattccctcattttgttttcacctggtgggatttcgaggggtcgattcggtatagcttttcataggagggggaaggtcgaagattagggcttttggtcacttgggcctctctgaaaatggagacctcgccttccaattccgatccttactccaattcttcttcacccacaactgctcgtacctcctccagatttggcctctcgctcccttccctcaatttcttccgttcgcctttgtctgtcatcttggattactctggaattcttcccactagggctgttcgtcatgaatccgaccctgtaatcaacgccgctgccacgcctgatttgcgggtttattctcaaaatcagaatcacttgatcaccacttcttcttcttcttcttcttcttcttcttcttctgccacaacctcttctggtaatactatcccctctggggaggtttccataaggattattgggtctggtgagcaagatccttctcccagtggcttgttgccaaatcaggctggttatgagcaaaatggcagacttcctgtttctggggatcagccggaatcccctgatgaggaacgagttcctttggtgtcaactgcttcttcatctattcaatctggaagcactcgtgtcgatggagaatctggaaatggaatggaagagagtgtcaatagagattcgtcttaccagagatatgatattcagcaggttgccagatggattgaacagattcttccgttctctttgctattgctgatagtctttatccgtcagcacttagaaggttttttcatcacaatttggatatcagctgttatgtataagtcgaacgacattgtcaagaaacagactgctctaaagggagagaggaaaatttctgtccttgctggaacttctattgcatttttggttcatgtaattgggatttactggtggtgtcatagtgacgatcttctataccccttagtcatgcttccaccaaagacagtaccacctttttggcatgccttgttcatcattttggttaacgatacgatggtgaggcagtttgctatggctctcaaatgttttcttcttatttactacaagaatggcagaggccataattttcgtcggcagggtcaaatcttaactcttgtggaatacactcttctattgtaccgtgcattattaccaacacctgtatggtacagattcttcttgaataaagatcaagggagcctcttttcatcgctaacaacaggattatatttaactttcaagctaacgtctgttgttgagaagattcaatcatttgttgctgcatttaaggctctatcacgaaaagaagtccattatggatcatatgccacatcagaacaggtaaatgctgcgggagacctctgtgccatttgccaggagaagatgaatgctccaatcctattacgttgtaagcacatcttctgtgaagattgtgtttctgaatggtttgaaagagagagaacttgccctctttgccgggcactggtaaagcctgcagaactccgaacatttggcgatggatcaaccagcttactcttccagttgttttagacgaaaattttccatttcttgacattacaaatctatcagttcgacaaagaaagatattgattaatgggtggaaacaggggaagaagaacaaagaaaaaagggagaaagagaagaaaaaagagaaaaaacgagacatccagacaagcctgaagatatgtcaaactcaactggattagtattatattaatgctttataatcattgtgatgagttagatgtccaaacagaagatggatttaataaaatcctatttcttcattgaatgcaatgaaatatagttttttaacggaagaaagagttccaagtgtgaaaaagtgcatgttatatgagaattgatggagactggagagtaattgtaatctttaaagatgattattccctgtaatttaggtctggagaggctgccatgtgaatgtgatggtcagtctgcattgatgatgtaaacacagaaatgatattgatttctatgtcaagtaattatt

SEQ ID NO: 4540 - DNA, 2257 bp, Phaseolus coccineus
atcatcattcgttcatcaatgtcaacctctcacacaacacgctccgacacagtcacacacaaaaataatcgaaagagaaggtttcagcttcgtgaccttgacttttctcctctctccctcttctgcttccgctatgcatctccatcgcatcgcatcgcacgatctgcgttcgcattaaaccctctcttaacgctctaaccctctctcaccatgttcatcttcgtctacgtatcttttcctctttctttaatcgtacttcaccccttcgctcgcgcccaataacctaatccagacactgtgcgcaacgcaaaacgaatgctgttgtgaattctgatcggagaataccgtacggaaaaaggaatataaggtaggtcaagttagggtttcgaggagatggaatcgtcgccgtcgtcttcgtcctccttgtcgtcgtcttctggaagcgatgccagcggtggtgccgctctcacgtggctcgggatgagtttcccgttccgttctccgctctctctcgtgatggattactgcacgcgtgaggattccgcagagcctgtgattatcattccccggacgcgcccgcggtttcaggcgccggctgaatctgttgcttctgcttcggcctctgattctggcgataatgcgtgcagcggcgctgaggaggttgcgatacgcatcattgggtccggcgagcaagacagcggctcgtcgccgtcgtcatcgaggagccgcggtggggaaccgggctgtgaggaggcggcggtggttgggaggggcgggatgctgtcgtcggaggctcgccggcgaatggctgaggaaagggtgccgttggtgtctttggatgatgggattggtggcggtagggattcttcttcgtcttcctctacctaccagaggtatgatattcagcaggttgcgaagtggattgaacagattcttccattctctctcttgctgttgattgttttcatccgccagcatttgcaaggtttctttgtcacaatttgtatatcagctgtgatgttcaagtcaaatgaaattgttaagaagcagactgccctgaagggagatcggaaagtctctgttcttctcagtatctcttttgcctttatgctgcatgttatatgcatttactggtggtatcgaaatgatgatcttttatacccactggccatgcttccaccaaagacaactccacctttctggcataccatattcatcattttggttaatgatacattggtgcggcaagcagcaatggctttgaagtgtttattgcttatttactacaaaaatggaagaggccataactttcgtcggcagggtcaaatgttaactctgattgagtacactctgctgctgtatcgtgccttgttgccaacaccagtttggtaccgatttttcttgaacaaagattatggaagtctgttttcctcactgaccacaggattgtatctaactttcaagctaacatcagtagttgagaaggtccaatgctttgtttctgccttaaaagcattatcaaaaaaggaagttcattatggggtttatgccacaacggaacaggtgagtgccgctggtgacatgtgtgctatatgccaagagaagatgcaggctcccatattgttgagctgcaaacacatgttctgtgaggagtgtgtatctgaatggtttgagagagaacgaacttgcccgttatgcagggcattggtaaaaccagctgatcttcggacctttggagatggatcgacaagtctgttttttcagctgttttaaagttcactttgttaggcttgttgggtcatattttagagcctaaatattcctggaaaatgtcaccctctttggtttggtaaaattttccattaatggtttctcatgaaattgagattggaaaaacgaataaacagatatttacatatatggctaaaatataagttctttttagtgtaatgaggtcagatgtacaaggggctatagacagctggcatatgaaatccgcgtggatctctcttaaccttataagcgtcacgtcaaacgaactggaaccattttgtttataatatacatttcaaattaatttcccatttcccttcatactattctgtagggggttacttcaacaggtataacttactaaatttataatggaataagttttgacattttattaaataaatattcgtcaacattgaattttgtcaacataaccagtgggtttgaaaattataaatatatttatgaaacttcatacaaatta

SEQ ID NO: 4541 - DNA, 1304 bp, Secale cereale
ccggcgcgggcggcgggagcgggaggggggactcgccgtaccagggctacgacgtgcagcgcctggccaggtgggtggagcacgcgctgcccttctccctgctcctgctcggcgtcttcatccgccagcacctgcaaggtttcttcgtgatgatctggattgccgcagtcatgttcaagtccaatgatatcttgcgcaagcagactgctctcaagggggagaggaaaatgccaatgcttatcgggattgtaatagtattcaccattcacgtgtttggagtctactggtggtacaggaatgatgaccttgttagacctttggtgatgcttcctccaaaagaaataccaccattctggcatgctatatttttcatcgcagtgaatgatacaatggtccggcaagctgctatggtggttaagtgtttgctgctcatgtactacaaaaacagcaaaggtcgccactatcgtagacagggtcaaatgttgacagttgtggaatattccctacttctgtaccgtgcgttattgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaggttcttgctgctggagatctgtgtgctatatgccaagaaaagatgcacactcccatcctcctgcagtgtaaacatatcttctgcgaagactgtgcctctgaatggttggagcgggagcggacatgcccattatgcagggcgctggtgaagccaggggacatccgatcattcagtgacggttcaacgaccctcttctttcagctcttctaacaagaacgaagaagcgctaaccttcggcctgcagatgttggatcgccccctgttactctccatcagcctgccgtgtgctgagacttattccagtccaggccctttccgccacttcatgacaagtagtaggtgccgtgggtgtgcatattaccctgtataggtccttgcgggattcttcatcacaaaaaaagagaggaatgatatgaccaaataactgaatctatagaggtgaatttccattagcatatggctggctgggtgggtgccgccacatctgcaaaattcagaattgaccttatacaagatcacaaatgtgaactcttgactcctgagccaacgtagcttgttgctcgtacaatgagatgaacatatccttct

SEQ ID NO: 4542 - DNA, 1863 bp, Cicer arietinum
cttagaaaatagttgacaaagaggaaagatcaaacaaaaagacgtatagtgaaaactagggttttgtttgtttgtttaatttgtgctaaagatggaaactttgaatggtaattcagaacaatatgcaaatgtttcttctaattcttcttcatcgtcatcatcatcatcatcattatcatcatcatcattattatcatcatcatcatcttttggagtgttaatagtgatgataacaatgatagtataacatggtatggtatgaggttaccttctattaaccctttacgttcaccactttcatttctattggattactctggcattctacgttcaaccaatgattctgaggctgtgattctcaacaatgaagtttctggtcatggatcacggtctcgggttgatgattctgctggttctgttgctgggagcagtgcaggggaagttgcaataaggattattggagctggagaaaatattcaaactcaggttggagaagtgggttatgatgattgtggtgatgatgtgattggtgagagaagtggaatgcctgcattggatgatgatgatgataccgagggtcgtagtggaattgcagctagtgaaggggttcctcttgtgtcttcgtcttcatcgtcgtcattggctggtagtggacaggttgatggtgatgcggctgagaatggaacagaaaatagcagtagggattcgtcttcctatcagagatatgatattcagcttgttgccaagtggattgagcagattcttcctttttcgctcttgttgttggttgttttcatccgacagcatttgcaaggtttctttgtcacaatttggattgcagctgtgatgttcaagtcaaatgaaattgttaagaagcagacagctttgaagggagataggaaagtctctttacttgctggtatctctttcgctttcattcttcacgtgataggcatttactggtggtatcgaaatgatgatgttttatatccactgatcatgttacctccaaaaccaacacctttctggcatgcaatattcaccatcttggtcaatgatatgttgatgcggcaagttgcaatggcttttaagtgtatccttcttatatattacaaaaaggggaaaggtcataacttccgtcggcaggctcaaatgttaactcttgttgagtacacgctgctgctgtatcgtgccttgttgccaacaccagtttggtaccggtttttcttgaatagggaatatggcagtctcttttcgtcactgaccacagggttgtatttaactttcaagctaacatctgttgttgagaaggtccaatacttcatatctgccttgaaagcgttatcaagaaaggacgttcattatggggtctatgccacaacagaacaggttactgctgctggtgacctatgtgctatatgccaggagaagatgcattcccctatcttgttgcgctgtaaacacattttctgtgaagattgtgtatctgagtggtttgagagagaaaggacttgccccctatgcagagcattggttaaagcagccgatcttcgaacttttggagatggatcaacaagtttgttttcctaattgttttagtaaactgatgatcttcggttggatcatagttttgtaccaatctctacttaaaatgtatcatgtttcttactcttatttggtaagattttttatcaaaacgattcttaggaaatatgattgttcggaatcttcaaaggcatggttatggattaaaagttcgcattgagttgcaacgtcattgtacaaattaagggctttactcagccgtcggggggaaacccgctaacctgatttatttttcatatcctagacagtaagaagaac

SEQ ID NO: 4543 - DNA, 1947 bp, Cichorium intybus
aatcttcctcaatttgcagcgatcacacgttactccatttttaatgcaaattcagtccttttcaaatttaccatttcgtttcttttctcattcctgaatcgaattgaagcttctatatcgattccaaacaaaacttagaaaaccctagaattcgatactcttattctgtttacaacgatcttggaagctattttcccgtttctccggttattgactcattatattacgcgaattctcatatatacatgtcaagatcgctatctaacccttgttacctccggcccatttgactttttatctttgtgttcttcttcttcatcgtaattatttgtcttttggggattttgttgattgagcctttaaaaaatacaatcagagaaggggttatatgcgtcgattaatggaaacaacaggtgttaacgttgattccacgagttctgataatcatgcgactaataatcctaattcatcaaaccctacatctccgacgattcggaggacaagcagtagcagttcgtcgccgagagcggtgtcgtcttctccgtttccgataattcgtttcctacaagcacctgtaactactataattgaatactcgggtgttcttcgacctaggtcgaataacgattatcacgaatcagagagcctgatttctaaccatcatcatcgtgatcataactcgagtagtcccggtacggctagcaatagaagtagtactggtgataatagcaatggggaggtttcgattcgtatactgggtggtgcagagcaagaagaggaacatggtgaatcggctacggtgaaccgtggagatggtggagaagagagggaggtggctgattccggtgatgcaagtggtggtaatggtgggagtaataataacgtggattcagcataccaacagcggtatgatttgcagcaggtttcaaggtggattgaacagattcttcccttttctttgctgttgttgatcgttttcattcgtcagcacttacaaggtctctttgttacaatctatattaccgctttcatgtacaagtcaaatgatattctacggaagcagacagctttaaagggggaaagaaaattgtctgttcttgctggctattgcatagttttcatgcttcatgtgattggagtttactggtggtaccaaaatgatgatctttgctatcccctgttcatgtttccacctaaagaaataccaccattttggaatgctattttcaccatcattgtaaatgatacgatggtacggcaggctgcaatggcttttaagttggtattgcttatgtactataagaatggcagggggcatagttttcgtaggcagggtcaaatgctgactttggttgagtacacacttcttttataccgtgcattcttacctgcccctgtgtggtaccgcttctttttaaacaaagaatacggaagcctcttttcttctttgacaacagggttatatttaactttaaagctcacatcagttgttgaaaaggtcggatccttttatgctgcattaaaggcactatcgcgaaaggaagtgaattatggatcatatgcaacgccagaacaggtgagcgaggcaggagacttgtgtgccatttgccaggaaaagatgcagtctccgattttgttgcgctgtaaacatattttctgtgaagactgtgtttcagaatggtttgaaagagaaagaacttgcccattatgcagagctttggtgagaccagcagatatgcggtcatttggggatggttcaacgagtttgttcttccagtttttctaaatggtgggggtaatgctatgcaaaccgtgcactttcttcaacatatccttttggattattacccaatgttataagcattaatttcttggaaaaaacttttttccctcaaattgtacagttgagcttatattcgtacacatataccatacaacatataacaa

SEQ ID NO: 4544 - DNA, 1088 bp, Vigna unguiculata
gctgtgatgttcaagtcaaatgaaattgttaagaagcagactgccctgaagggagatcggaaagtctctgttcttcttggtatctcttttgcctttatgctgcatgttatatgcatttactggtggtatcgaaatgatgatcttttatacccactggccatgcttccaccaaagacaactccacctttctggcatacaatattcatcattttggttaacgatacattggtgcggcaagcagcaatggctttgaagtgtttattgctcatttactacaaaaatggaagaggccataactttcgtcggcagggtcaaatgttaactctgattgagtacactcttctgctgtatcgtgccttgttgccaacaccagtttggtaccgatttttcttgaacaaagattatggaagtctgttttcctcactgaccacaggattgtatttaactttcaagctaacatcagtagttgagaaggtccaatgctttgtttctgccttaaaagcattatcgaaaaaggaagttcattacggggtttatgctacaacagaacaggtgagtgccgctggtgacatgtgtgctatatgtcaggagaagatgcaggctcccatattgttgagctgtaaacacatgttctgtgaggagtgtgtatctgaatggtttgagagagaacggacttgcccattatgcagggctttggtaaaaccagctgatcttcggactttcggagatggatcaacaagtctgttttttcagctgttttaagttcactttgttcggcttgttgggtcatatttttgagccaaaaatcttcctggaaaatgtcaccctttctggtttggtaaaattttccattaatggtttctaatgaaattgaaattggaattggaaaaaggaataaacagatattcccatacatggctaaagtataagttctttctagtgtaatgaggtcaggtgtacaaagggctatagacagccggcatatgaaatccgcgtggatcttttaaccttatacgcacatcaaacgtgctggaaacattttgtttataatgatacattccagattaattcccaaaaaaaagaaaaaa

SEQ ID NO: 4545 - DNA, 1088 bp, Vigna unguiculata
  misc_feature (914)..(914): n is a, c, g, or t
gctgtgatgttcaagtcaaatgaaattgttaagaagcagactgccctgaagggagatcggaaagtctctgttcttcttggtatctcttttgcctttatgctgcatgttatatgcatttactggtggtatcgaaatgatgatcttttatacccactggccatgcttccaccaaagacaactccacctttctggcatacaatattcatcattttggttaacgatacattggtgcggcaagcagcaatggctttgaagtgtttattgctcatttactacaaaaatggaagaggccataactttcgtcggcagggtcaaatgttaactctgattgagtacactcttctgctgtatcgtgccttgttgccaacaccagtttggtaccgatttttcttgaacaaagattatggaagtctgttttcctcactgaccacaggattgtatttaactttcaagctaacatcagtagttgagaaggtccaatgctttgtttctgccttaaaagcattatcgaaaaaggaagttcattacggggtttatgctacaacagaacaggtgagtgccgctggtgacatgtgtgctatatgtcaggagaagatgcaggctcccatattgttgagctgtaaacacatgttctgtgaggagtgtgtatctgaatggtttgagagagaacggacttgcccattatgcagggctttggtaaaaccagctgatcttcggactttcggagatggatcaacaagtctgttttttcagctgttttaagttcactttgttcggcttgttgggtcatatttttgagccaaaaatcttcctggaaaatgtcaccctttctggtttggtaaaattttccattaatggtttctaatgaaattgaaattggaattggaaaaaggaataaacagatattcccatanatggctaaagtataagttctttctagtgtaatgaggtcaggtgtacaaagggctatagacagccggcatatgaaatccgcgtggatcttttaaccttatacgcacatcaaacgtgctggaaacattttgtttataatgatacattccagattaattcccaaaaaaaagaaaaaa

SEQ ID NO: 4546 - DNA, 1576 bp, Euphorbia peplus
agaccaaaaaaacaaacaaaagcttcaatcactgtataatttatattctctctagattttaatcctctctcgctccatctatggagtcttgttctaccacttcctcgtcctctcctccttcgccggcgtcttccggcggttttagtaatcctacgacagctagaagatacggaattaacatagctgcgtccaatttgatacattctcccctcaccacgcttttggaatactccgggattctaggtggcaggggcggtgttggcggtggtgcgtcatcgattgagagggagcaattgattccttctcgtccttcatcatcgtcgtcttcaacgcgatcgaattcaggcgatcgacatgaggaggttactattaggataattggagcggcggaatcgaattctacggcggcggctactacatccggagaggcgtctactccttcgtcgccggtgtcggatgatcaatctagtagctctgctggtgttgttccggaaaccctagatgttgatggggcgtccgggatcactaccgatccttctactctacctactcctcctccttcttcgtcttcttcttatcagaggtacgatattcagaatttcgctaggtggattgagcagattcttcctttctcgttgttgcttctgctcgttttcattcgccagcacatacaagggttttgtttggcattatgggttggtgcagttctgttcaaatcaaatgatattctacggaagcagacatctctgaagggacaaagaaagaattcaattcttgtggccatgactatggtgtttatacttcatgttgcatcgatatattggtggtacagaaacgatgatcttctacacccgtttattctaattcctccggccactattcctcatttttggcaggctatattcatcattgtggtgaatgattcgatgataaggcaagtggcaatggcttccaaatgtatacttttgatgtattacaagaacagcagagggtgcaattaccggaaacaggggcaaatactgactatcatcgaatattttatgttattatatcgtgctttgcttccagcaccagtttggtacaggttcttcttaaacaaagagtacgggaactttttttcttcactaattacaggactgtatctaaccttcaaacttacatcggtccttggaaaggttcaattgttcttcactgcattgagggctctatcccataaagaaatgcattatggttcatatgccacttcagagcaggtcaatgcaataggagacatgtgtgctatttgccaggagaagatgcatacacccattttgctgcgctgtaaacacatattttgtgaagattgtgtatcagaatggtttgagagggaaaggacgtgtccattgtgcagggcattggtgaaaccagcagatatcagaacgtatagtgatggttcaactagtttatctttccagttattctaagataatacttttactacggaggttgaagccaaaaatgagatctactctacttctcccggacttagttcgattctgttgaggttatgttcataatgtctaacaattctgtatag

SEQ ID NO: 4547 - DNA, 2094 bp, Glycine max
gtctatcatcaatgtcaagcttgcgtcctctctctcacaggctgcgacacagtcacacacaaaatatcgaaagagaaggtttcagcttcctgaccttgacttttctcctctcttcctcttccaccatgtccatcgcacgatccgcgttcacattaaaccctctcatcacacactaaccctctcgacatcttctcttttctttattcacaaaacttcatcccctttctcacaattaattccgcgccaaataacctaatcctaaaccgaaatcttatatcatcacgaatgcttttgcttttccagtatttgcgatcggtataatcagaggacgccgtacggaaaaaggaacacgcacggtaggtgaagcgaaagcgaaagaggttagttagttagttagggtttcggcgagatggaatcgtcaccgtcctcgtcgtcttctggaagcgacaccagtggtggtggtggtggcggcggcgctgtcacgtggttcgggatgagtttcccattccgttctccgctctctctcgtgatggattactgcgtacgcgaggattctgcggagcctgtgattatcattccccgcacgcgcccgcgttttcaggcgcatgccgaatcggacgctgcttcggcctctgattccgatgagaatgcgtgcaacggcgctgctgaggaggttgcgatacgcataattggggtcggcgagcaggagagcggttcatcgccctcatcgtccaggggccggggcggggagctgggcggtgaggaggcggtggttgggaggagcgggatgctgtcgtctcgccggcgaatggcggaggagagggtgccgttggtgtctttggatgatgggattgttggcgctagggattcttcttcttcatcatcgtcctctacttaccagaggtatgatattcagcaggttgcgaagtggattgagcagattctaccgttttctctcttgttgctgattgttttcatccgccagcatttgcaaggtttctttgtcacaatttgtatatcagctgtgatgttcaagtcaaatgaaattgttaagaagcagactgccctgaagggagatcggaaagtctctgttcttctcggtatctcttttgcctttatgctgcatgtgataagcatttactggtggtatcgaaatgatgatcttttatacccactggccatgcttccaccaaaaacaccgccacctttctggcatacaatattcatcattttggtgaatgatacattggtgcggcaagcagcaatggctttcaaatgtttgttgcttatttactacaaaaatggaagaggccataacttccgtcggcagggtcaaatgttaactctggtcgagtatactctgctgctgtatcgtgccttgttgccaacaccagtttggtaccgatttttcttgaacaaggattatggaagtctcttttcctcactgaccacaggattgtatctaactttcaagctaacatcagtagttgagaaggtccagtgcttcgtttctgccttaaaagcattatcaaaaaaggaagttcattatggggttcatgccacaacggaacaggtgaatgctgctggtgacatgtgtgctatatgccaggagaagatgcaggctcccatattgttgagctgtaaacacatgttctgtgaggagtgtgtatctgaatggtttgagagagaacgaacttgtccattatgcagggcattggtaaaaccagctgatctgcggaccttcggagatggatcaacaagtctattttttcagttgttttaagttcattttctttgacttgttgggtcatgtttttgagccaaaatcttcctggaaaatgtcaccatctatggtttggtaaaattttccattaatgaaattgagattgaaaaaagaataaagagatatttatatgtatggttaaagtatataagttcattctagagtaatgaggtcagatgtacaaagggatatagatagctggcattatactgaaatccgcgtggatctcttaacctgatattcgtcacgtcacacaatggaaacttttgtttataatgttacatttcaaattaatttccctcttcctccca

SEQ ID NO: 4548 - DNA, 1974 bp, Solanum lycopersicum
cagacaagtcaattgtcgtttgttcttccccattttggtctgatatttctttctttgatgttaagttagctttctccctcatctgacttttcttcttcaccattttcttcccaactcttcacagctacaaaactactttgtgttatcttatcacataaccaaaacttcatagtcttccattgatggagactacgacttcttcaagcgtttcagattttgacagaaacccaaattccaattctaattctagttcatctccacatacttcaaattcaacagcctttggagttaatctatctcctctccgggttttcagatacccactttctactttccttgaatattccggtttgctccgagtccgacccgaaaacccagaaaccgatttgctccttcctgataatcctactcccaactcctctggatcaactacttctagtaacggggaagtttcaattaggataattggctctggagagaatgatcgggttaggactgatgatgggtcggtgatggatggtggggaaagggaggaggagaggggttcgaatgtggaagggtctacttcttctgggagtgggaataatagggattcttcatatcaaaggtatgatatacaacagattgcaaggtggattgaacagtttcttccattttctttgctacttttggttgttttcatccgccaacacttgcaaggtttctttgtcataatttggattacggccttcatgttcaggtcaaatgacattcttcgaaagcagacagctttaaagggggagagaaagatcactgtccttcttggttattttctggtgtttatgcttcatattagtggaatctactggtggaatcacaaagatgatatattttatccgttacttatggttcctcctaagggtatcccacctttctggcatgctattttcatcatcctggtaaacgatacaatggtgcggcaggcagcaatgactttgaagttggtactgcttatggtttacaagaatggcaggggccacaatttccgcagacagggccaattgctgactctggtggagtatatgttgctcctataccgtgcactattaccaacccctgtctggtataggttctttctcaacaaagattatggaagccttttttcatcactgataacaggattgtacttgacgtttaagcttacatcaatcgttgagaaggttcggtcattccttactgctttgaaggcactgtcaattaaggaaatccattatgggtcacatgccacacctgaacaggtaaatgcagctggtgatctatgtgctatttgccaagagaagatgaatacaccaattctattgtgctgcaaacacatcttttgtgaagattgtgtctcagaatggtttgaaagagagagaacttgtcctttgtgtagagccttggtcagacctgctgatctaagatcttttggagatggatcaactagccttttattccagttattctaatattgatattacacccccgataccattttgaaagaaagaaatgtcccatgttacaacaagcgaatgtctgctagtaccatttctcctcaacttggtctgttagagagttataacatcacctgattctgcgggttgccctgtttaggttgcctcccatgaagatgttgtgtaaaacggagcttctttgaggattttagtgggatgagaggagttgatacaatatgcagcacttgcattttggtgtattcttcttccttaagtacatattgtgcttcatttttgtttatacagggaaaaaacgtccatgtaaagttaatgtaattcacagaatttaaccacaatgtttaaaattgcctactgtactgatcatcattaacattccaatttacataaattaataccctagtatattccgtgtagtcaacaattgctaataaaaatgtatgtgttggatcggtgtacgttgtaccactgtatccaatttgtg

SEQ ID NO: 4549 - DNA, 731 bp, Brassica oleracea
  misc_feature (180)..(180): n is a, c, g, or t
  misc_feature (499)..(499): n is a, c, g, or t
gtactacaagaacagtaggggtcgaaattatcgtaaacagggtcaattgctaactttggttgaatatttgatgcttctgtatcgctctttgctgcctacccctgtatggtaccgtttcttcttgaacaaggattatggaagcctcttctcctctcttatgacaggactctatctgacttncaagctcacttctgtagttgagaaagttcaatccttctttacggctttaaaatctttgtcacgcaaagaggtgcattatggatcgtatgcaactacagagcaggtgaatgctgcaggggacctgtgtgccatctgccaggagaagatgcacacaccaattcttcttcgctgcaagcacatgttttgcgaagattgcgtttcagagtggtttgagagagagaggacttgtcctctgtgcagagccttggtcaagccagcggatctgaaatcgtttggtgatggttcaaccagccttttcttccagttattctgattaacntgcatacaaagtacaacgtataaatagatcatccatcacaagcccttgggtagagagtattgccgtttaagttgtgcacgaaagacaccactactgatgatgatgccttgaagatgtttatacaatcccatttgttaatatgaaaattgccttttatatattcgttagcctaaaaagaaaaagaattcaattttcagaaaatcgtatttattcaatatgaaaaaagtctcac

SEQ ID NO: 4550 - DNA, 1269 bp, Hordeum vulgare
cggcgggaggggggacctcgccgtaccagggctacgacgtgcagcgcctggccaggtgggtggagcacgcgctgcccttctccctgctcctgctcggcgtcttcatccgccagcacctgcaaggtttcttcgttatgatctggattgccgctgtcatgttcaagtccaatgatatcttgcgcaagcagaccgccctcaagggggagaggaaaatgccaatgcttatcgggattgtaatagtattcaccattcatgtgtttggagtctactggtggtacaggaatgatgaccttgttagacctttggtgatgcttcctccaaaagaaataccaccattctggcatgctatatttttcatcgcggtgaatgatacaatggtccggcaagctgctatggtggttaagtgtgtgctgctcatgtactacaagaacagcaaagggcgtcactatcgtagacagggccaaatgttgacagttgtggaatattccctacttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaggttcttgctgctggagatctgtgtgctatatgccaagaaaagatgcatactcccatcctcctacagtgtaaacatatcttctgcgaagactgtgcctccgaatggttggagcgggagcggacatgcccgttatgcagggcgctggtgaagccaggggacatccggtcattcagcgatggttcaacgaccctcttctttcagctcttctaacaagaaacaagaagtgctaaccttcggcctgcagatgttggatcgccccttgttactctccatcagcctgccgtgtgctgagacttgttccagtccaggtcctttgccgtcacttcgtgacaagtagtaggtgccgtgggtgtgcatattaccctgtataggtcttcgcgggattctccatcacgcaaaaaagaggggaatgatatgaggagataactgaatctatagaggtgaatttccattagcatgtggctgggtgggtgctgccatatctgcaaaattcagaattgaccttatacgagataacaaatgttaactcttgactcctgagccaacgtagcttgttgctcgtacaaaa

SEQ ID NO: 4551 - DNA, 1236 bp, Hordeum vulgare
taggtttcttcgttatgatctggattgccgctgtcatgttcaagtccaatgatatcttgcgcaagcagaccgccctcaagggggagaggaaaatgccaatgcttatcgggattgtaatagtattcaccattcatgtgtttggagtctactggtggtacaggaatgatgaccttgttagacctttggtgatgcttcctccaaaagaaataccaccattctggcatgctatatttttcatcgcggtgaatgatacaatggtccggcaagctgctatggtggttaagtgtgtgctgctcatgtactacaagaacagcaaagggcgtcactatcgtagacagggccaaatgttgacagttgtggaatattccctacttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaggttcttgctgctggagatctgtgtgctatatgccaagaaaagatgcatactcccatcctcctacagtgtaaacatatcttctgcgaagactgtgcctccgaatggttggagcgggagcggacatgcccgttatgcagggcgctggtgaagccaggggacatccggtcattcagcgatggttcaacgaccctcttctttcagctcttctaacaagaaacaagaagtgctaaccttcggcctgcagatgttggatcgccccttgttactctccatcagcctgccgtgtgctgagacttgttccagtccaggtcctttgccgtcacttcgtgacaagtagtaggtgccgtgggtgtgcatattaccctgtataggtcttcgcgggattctccatcacgcaaaaaagaggggaatgatatgaggagataactgaatctatagaggtgaatttccattagcatgtggctgggtgggtgctgccatatctgcaaaattcagaattgaccttatacgagataacaaatgttaactcttgactcctgagccaacgtagcttgttgctcgtacaatgagatgaacatatccttctgtttcctgctgtgtcgcatgactcacatcattattcttgccacctaaaatatgtgttagtaatttcggc

SEQ ID NO: 4552 - DNA, 2115 bp, Theobroma cacao
aaggaaacgttaataaggtgggaagcccaacaagactttttttcctactggcgtaaagggcagaggagacgcgtttttgggatttctcttttgtccttttttgtctcccaggggccacggggcattggcatttgcagagtgaagcaaggtatggcaacttgctgctacaatatataaacaaagggaatgaatgaatgatctaattataatatttaacttcttctcttccaaatccaataccccattttacttctcataaaatatggtctcccgaatctcagtctacaccgcttgaaaccatttttgttttggtctccagcaactctgtttccgctgtctccttctgtcagtttgactcttcagcctcttgcctgcagcgttttgtattgaatttgtaatcaaagctctcccttctcattcccacattcttctctctttcattcgtttcagaaaaaaagtcatcttgtttcttttttttttttatttagctgttggtctgtgaaatgtgaatggaagatcatactgggattttttcagagttgtaaataaaacaaggggcttgtttatgattttggagggtaggatcttgttataatggaaacgtcccctcccatctctggtcctccctcaccatcaccaacttcttcttcttctgttacaagcagtagtggtggtgataccagtgattcttcaagaagctttgccattcaagttccagctctaaacttgttccgatcacccctgtccctcctactggaatactctggcattttttccaatcccacccttaatcaacctcgtggggttttagtcaacactgatttgcaacctcctgctaatgctgcttctggggctggggaggtttctattcaaatcattgggcctgcaagagctgaagaagacaatgcccaaacctccctggaccacgatggagttgaggaggacgatcctcttaccggcagcagtaccagtaacgaggaaaggagttccaattcgtcttaccagatgcagagttatgatgtacagcgcattgcgaggtggtttgagcatattcttcccttttcattgctattgctgcttgtcttcattcgtgagcatttacaaggttttgttgtcatgatttgggttacaattgtcatgttcaagtcaaatgtaatcctccaaaagcagacagcactgaagggagagagaaagaatgcagttctaatcacatactcagtactttttatgcttcatgtgattggtgtttattggtggtatcgggacaatgatcttttatatcctctggtcatgcttcctccaaagacaattccacctttctggcatgcgatattcatcattctggtaaatgatgcaatggtgcggcaggcagtgatggcatttaagtgtgtactgctcatttattataagaatggcagagggcacaacttccgccgacagggacaagtgctaaccctggtcgaatatacactcctattataccgagcattgttaccaacacctgtctggtaccggttcttcttaaacaaagattatgggagccttttctcttcattgactactgggctgtatttaactttcaagctcacagctgttattgaaaaggttcaatccttctttgctgccctgaaagcattgtcacaaaaggaagttcactatggctcatatgccacattggaacaggtaaatgaagcaggagacctttgtgccatatgccaggagaagatgcaagcaccaatcctgttgcgttgtaaacacatattctgtgaggactgcgtctctgaatggtttgagagagaaaggacttgcccgctgtgcagagctgtaattaaagctccagatctacgatcctttggggatgggtctacaagtttgttttttcagttgttttagtatccagattttagttccatgccacggccttatttttttgagctgtgctctcccataggaaaaccaaagtatggagcgtagcacaggccatctcgcttatcaaatggaaatggttagttggcatggcttgcagggtccattattgacaggcgcctccagtctccgccccctttcctttttcctttttattggcagacaaattaagaaaagtgaaccttgcat

SEQ ID NO: 4553 - DNA, 1207 bp, Centaurea maculosa
  misc_feature (157)..(157): n is a, c, g, or t
  misc_feature (160)..(160): n is a, c, g, or t
  misc_feature (165)..(165): n is a, c, g, or t
  misc_feature (193)..(193): n is a, c, g, or t
  misc_feature (196)..(196): n is a, c, g, or t
  misc_feature (206)..(206): n is a, c, g, or t
  misc_feature (209)..(209): n is a, c, g, or t
  misc_feature (211)..(211): n is a, c, g, or t
  misc_feature (221)..(221): n is a, c, g, or t
  misc_feature (224)..(224): n is a, c, g, or t
  misc_feature (229)..(229): n is a, c, g, or t
  misc_feature (295)..(297): n is a, c, g, or t
  misc_feature (308)..(308): n is a, c, g, or t
  misc_feature (347)..(347): n is a, c, g, or t
  misc_feature (763)..(763): n is a, c, g, or t
  misc_feature (823)..(823): n is a, c, g, or t
  misc_feature (826)..(826): n is a, c, g, or t
  misc_feature (838)..(838): n is a, c, g, or t
  misc_feature (847)..(847): n is a, c, g, or t
  misc_feature (879)..(879): n is a, c, g, or t
  misc_feature (914)..(914): n is a, c, g, or t
  misc_feature (972)..(972): n is a, c, g, or t
gtagcagcaggtttcgaggtggatcgagcagattcttccgttttcgttgttgttgttgattgtcttcattcgccagcacttgcaaggattctttgtcacgatttatgtaaccactttcatgtacaagtctaatgatattcttcgaaagcagacggcnttnaaggnggagagaagactgtctgttcttgctggntantttatcgttntcntncttcatgtgnttngagtntactggtggtaccagaatgaagatctttgttatccgttgttcatggttccaccaacagcaataccnnnattttggcatnccatattcaccatcattgtgaatgatacaatggtgcagnaggcagcaatggcttttaagttggtattgcttatgtattataggaatggcaagggccataatttccgtaggcagggtcaaatgctgaccctggttgagtacggaatgctgttataccgtgctttcttacctgcgccagtctggtatcgcttcttcttaaacaaagaatacgggagcctcttttcgtctttgatcactgggttatatttaactttcaagctcacatcaatagttgagaaggttggatccttttggactgccttgaaggcgttgtcacgaaaggacgttcattatggatcttatgcgacaccggaacaggtaactgaagcaggagacttgtgtgctatttgccaggaaaagatgcaggctcctgttctgttgcgttgcaaacacattttctgcgaagattgtgtttcngaatggttcgaaagagaaagaacgtgcccgttatgcagagctttggtgaaaccagcgganttncggtcatttggngatggatcnacaagcctcttctttcagttgttctaaacttnatatttcattcttgaatacccacccaagttataancaggattacagtaaaagaaaagagtcctctgctggggtgggcataaaattcataatgntttttttattatatacacattgtacatgataaaatataccatcttcttgcattgtgggaataactcataagacacttttttagatatgattcatggatttgagagcaattttttggtcaaaagacaagaatgtaaaagaatgggttaatttgcatatatgtttatatcttctttcttttgctcttttgctaaatttgtattaataatcccttgtggggtctactcttttgcgaaa

SEQ ID NO: 4554 - DNA, 1639 bp, Flaveria ramosissima
tcccacggattctgatgatcatgtgagtaataatgcgaatttgtcaaatccttccatctccgagaacgacgtcgtcgccgtttccctgtaatcgggtttctgcaagcacctgtaactactttgatcgaatactctggtgttcttcgacctaggtcaaacaccgattatcgtgaatcggagagtttgattgctaataatcgtcgtcatgatcgtagctctagtggctctggtacggctagtagtaggagtagtggtggtgataatagtggcagtgaagtttcgattcggatagtgagtggtggagatcatgaagaggagcgtggtgaaccggctccggtgaaccgtggtgatggtggtggagagagggaggtggctggtggtggtgttagtggtggcggtggtgggaataataataataacaataataatagtaacaacgtggattcagcatatcaacaacggtatgatttgcagcaggtttcgaggtggattgagcaaattcttccgttttcgttgctgttgttgattgttttcgttcgtcagcacttacaaggcctctttgttacgatttatataactgctttcatgtacaaatcaaatgatatcttgcggaagcaaacagctttaaaggcggagaggaagttatctgttcttgttggatattgcattcttttcatgcttcatgtgattggagtttattggtggtaccgaaacgacaatctttgcaaccccttgttcatggttccaccaaaagctattccaccattctggaatgctatattcaccatcattgtaaatgatacgatggtacgacaggcagcaatggcatttaagttggtattgcttatgtactataaaaatggcaggggccacagttttcgtaggcagggtcagatgttgactctggttgagtacacacttctattataccgtgcatttttacccgcccctgtttggtaccgattctttttgaacaaagaatatgggagcctattttcgtctttgacaacagggttgtatttaaccttaaagctcacatcagttgttgagaagtttggatccttctatgctgccttaaaggcactatcacgaaaagaggtcaattatggatcacatgcaacagcagaacaggtgagtgaagcaggagacttgtgtgctatttgccaggaaaagatgcaggctccaatattgttgcgctgtaaacatattttctgtgaagactgtgtttcagaatggtttgaacgagaaagaacttgcccattatgcagagcgttggtgagaccagccgatatacgatcatttggggatggctcaacgagtttgttcttccagttgttctagaagctaccgtctagttatgcaggccatgtgctttcttcagcgagtctgatcactgctgtttatctgattacccgaagtcatataatcagtatcactacggtaatatgttggcatccttttcgctcgtattgtacagttgaactttacttgtggctctaatattagcagcattatactgatatacacaatagacatacaacaatataacacacgagacatcctcgcactctttgtgcgtctactagtacacttaagtctgtatcataatatgatatgaaactgagcctagtaatttgac

SEQ ID NO: 4555 - DNA, 1201 bp, Raphanus sativus
  misc_feature (736)..(736): n is a, c, g, or t
  misc_feature (739)..(739): n is a, c, g, or t
  misc_feature (1125)..(1127): n is a, c, g, or t
gaccagagatatgatatccagcaggctgcgcgctggatcgagcagattcttcccttttctttgctcctcttggtcgtctttatccgccagcatctccaaggtttctttgttgcaatctggattgctgctgtcatgttcaagtcgaatgatattttgaagaagcaaactgcattaaagggtgagaggcagatctcggctttaatcgggatctctgtagcgtttgctgcccatgtggttggtgtttattggtggttccgtaaggatgacctcttgtatcccttgatcatgttccctcccaagtccattcctcctttctggcatgccattttcatcatcgtcgtcaatgatacactagcacgtcaggcctcgatgatattaaagtgttttctcttgatttactacaagaacagtaggggtcgaaactatcgtaaacagggtcaattgctaactttggttgaatatatgatgcttctgtatcgctctttgctgcctacccctgtgtggtaccgtttcttcttgaacaaggattacggaagcctattctcctctctcatgacaggactgtatctcactttcaagctcacttctgtagttgagaaggttcaatctttctttacgtcgttaaagtctttgtcacgtaaagaagtgcattatggatcatatgcaactacggagcaggtgaatgctgcgggcgacctgtgtgctatttgccaggagaagatgcacaccccagttnttnttcgctgcaagcacatgttctgcgaagattgcgtttcagaatggtttgagagagagaggacttgtcctctgtgcagggccttggtgaaaccagcggatctgaaatcatttggtgatggatccaccagccttttctttcagatattctgattaaacatgcatacaaaagtacaaatagtgattacaactcccaagccccttgatagagagtattgcccgtttaagttgtgcacgaaagacaccactgatgatgatgccttgaagatgtgtatacaatgtcatttgttaatatgaaattgccttttatatttcttagtccagaaaaaaaaaagaattcagtaaccagaaatcgtatttattcaatatgaaaaaagttcttactacaannntcaacatttttaatttttttacaatggggaaggagatttaacttcacccgatttacaagaccaaatcaagagcc

SEQ ID NO: 4556 - DNA, 1866 bp, Solanum phureja
ttcttccccattttggtcttatatttctttctttgatgttaagttagctttctccctcatctgacttttcttcttcaccattttcttccttcctcttcacagctacaactactttgtgttatcttatcacaaaacaaaacttcagagtcttccattgatggagacaacgacttcttcaagcgtttcagattttgacacaaacccaaattccaattctaattctagttcatctccacatacttcaaattcaacagcctttggagttaatctatctcctcttcgggttttcagatacccactttctactttccttgaatattccggtttgctccgggtccgacccgaaaacccagaaaccgatttgctccttcctgacaatcctactcccaactcttctgaatcaactacttctagtaatggggaagtttcaattaggataattggctctggagagaatgatcgggttaggagtgatgatgggtcggtgatggatggtggggaaagagaggaagagaggggttcgaatgtggaagggtctacttcttctgggagtgggaataatagggattcttcatatcaaaggtatgatatacaacaggttgcaaggtggattgaacagtttcttccattttctttgctactcttggttgttttcatccgccaacacttgcaaggtttctttgtcataatttggattacggccttcatgttcaggtcaaatgacattcttcgaaagcagactgctttaaagggggagagaaagatcactgtccttcttggttattttctggtgtttatgcttcatattagtggaatctactggtggaatcgcaaggatgatatattttatccgttacttatggttcctcctaaggttatcccacctttctggcatgctattttcatcatcctggtaaacgatacaatggtgcggcaggcagcaatgactttgaagttggtgctgcttatggtttacaagaatggcaggggccacaatttccgcagacagggccaattgctgactctggtggagtatatgctgctcctataccgtgcactattaccaactgctgtctggtataggttttttctcaacaaagattatggaagccttttttcatcactgataacaggattgtacttgacgtttaagcttacatcaatcgttgagaaggttcggtcgttccttactgctttgaaggcactgtcgattaaggaaatccattacgggtcacatgccacacctgaacaggtaaatgcagctggtgatctatgtgctatttgccaagagaagatgaatacaccaattttattgtgctgcaaacacatcttttgtgaagactgtgtctcagaatggtttgaaagagagagaacttgtcctttgtgtagagccttggtcagacctgctgatctaagatcttttggagatggatcaactagccttttattccagttattctaatattgacgttacacctctgttaccattttgaaagaaagaaatgtccatgttacaacaagcgaatgtcttcctctactagtagcatttctcctcaacttggtcagttaccgagttataacctcacctgattctgtgggttgccctgttaaggttgcctgccatgaagatgtgtaaaaaggagcttctttgaggatttagtgggatgagaggagttggtacaatataagtacatattgtgcttcattttttttttatatagggaaaaaacgtccatgtaaagttaatgtaattcacagaatttaaccacaatgtttaaaattgcttcctttcaggcctgtactgatccacattaacatttcaattcgacagaaattaataccctagtatattccgtgtagtccaca

SEQ ID NO: 4557 - DNA, 1691 bp, Euphorbia esula
  misc_feature (96)..(96): n is a, c, g, or t
  misc_feature (107)..(107): n is a, c, g, or t
  misc_feature (156)..(156): n is a, c, g, or t
  misc_feature (249)..(249): n is a, c, g, or t
  misc_feature (253)..(253): n is a, c, g, or t
  misc_feature (278)..(278): n is a, c, g, or t
  misc_feature (348)..(348): n is a, c, g, or t
  misc_feature (417)..(417): n is a, c, g, or t
  misc_feature (443)..(443): n is a, c, g, or t
  misc_feature (811)..(811): n is a, c, g, or t
  misc_feature (1271)..(1271): n is a, c, g, or t
  misc_feature (1276)..(1276): n is a, c, g, or t
  misc_feature (1436)..(1436): n is a, c, g, or t
agaccaaaaaaacaaacaaaagcttcaatcactgtataatttatattctctctagattttaatcctctctcgctccatctatggagtcttgttctnccacttcctcntcctctcctccttcgccggcgtcttccggcggttttagtaatcctacgncagctagaagatacggaattaacatagctgcgtccaatttgatacattctcccctcaccacgcttttggaatactccgggattctaggtggcngggncggtgttggcggtggtgcgtcatcnattgagagggagcaattgattccttctcgtccttcatcatcgtcgtcttcaacgcgatcgaattcaggcnatcgacatgaggaggttactattaggataattggagcggcggaatcgaattctacggcggcggctactncatccggagaggcgtctactccttcntcgccggtgtcggatgatcaatctagtagctctgctggtgttgttccggaaaccctagatgttgatggggcgtccgggatcactaccgatccttctactctacctactcctcctccttcttcgtcttcttcttatcagaggtacgatattcagaatttcgctaggtggattgagcagattcttcctttctcgttgttgcttctgctcgttttcattcgccagcacatacaagggttttgtttggcattatgggttggtgcagttctgttcaaatcaaatgatattctacggaagcagacatctctgaagggacaaagaaagaattcaattcttgtggccatgactatggtgtttatacttcatgttgnatcgatatattggtggtacagaaacgatgatcttctacacccgtttattctaattcctccggccactattcctcatttttggcaggctatattcatcattgtggtgaatgattcgatgataaggcaagtggcaatggcttccaaatgtatacttttgatgtattacaagaacagcagagggtgcaattaccggaaacaggggcaaatactgactatcatcgaatattttatgttattatatcgtgctttgcttccagcaccagtttggtacaggttcttcttaaacaaagagtacgggaactttttttcttcactaattacaggactgtatctaaccttcaaacttacatcggtccttggaaaggttcaattgttcttcactgcattgagggctctatcccataaagaaatgcattatggttcatatgccacttcagagcaggtcaatgcaataggaganatgtntgctatttgccaggagaagatgcatacacccattttgctgcgctgtaaacacatattttgtgaagattgtgtatcagaatggtttgagagggaaaggacgtgtccattgtgcagggcattggtgaaaccagcagatatcagaacgtatagtgatggttcnactagtttatctttccagttattctaagataatacttttactacggaggttgaagccaaaaatgagatctactctacttctcccggacttagttcgattctgttgaggttatgttcataatgtgccaaaaatgagatctactctacttctcccggacttagttcgattctgttgaggttatgttcataatgtctaacaattctgtatagtatagccatcatcctataggtaaatattttatagcctactacctag

SEQ ID NO: 4558 - DNA, 1082 bp, Triticum aestivum
ttcacgtgtttggagtctactggtggtacaggaatgatgaccttgttagacctttggtgatgcttcctccaaaagaaatacctccattctggcatgctatatttttcatcgctgtgaacgatacaatggtccggcaagctgctatggtggtcaagtgtgtgctgctcatgtactacaaaaacagcaaaggtcgtcactatcgtagacagggccaaatgttgacagttgtggaatattccctacttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaggttcttgccgctggagatctgtgtgctatatgccaagaaaagatgcatactcccatcctcctgcagtgtaaacatatcttctgcgaagactgtgcctctgaatggttggagcgggagcggacatgcccgttatgcagggcgctggtgaagccaggggacattcggtcattcagcgacggttcaacgaccctcttctttcagctcttctaacaagaaacaagaagcgctaaccttcggcctgcagatgttggatcgccccctgttactctccatcagcctgccgtgtgctgagacttatccagtccaggtccttttccgccacttcgtgacaagtagtaggtgccatgggtgtgcatattaccctgtataggtccttgcgggattctccatcacaaaaaaagagaggattgttatgacgaaataactgaatctatagaggtgaatttccattagcatgtggttgggtgggtgccgccacatctgcaaaattcagaattgaccttatacatgatcacaaatgttaactcttgactcctgagccaacgtagcttgttgctcgtacaatgagatgaacatatcctattgtttcctgcttgtgtcacatgagtcacatcatcattcttgccacct

SEQ ID NO: 4559 - DNA, 1370 bp, Triticum aestivum
gcggggggacgaggccggcgcgggcggcgggagcgggaggggggactcgccgtaccagggctacgacgtgcagcgcctggccaggtgggtggagcacgcgctgcccttctccctgctcctgctcggcgtcttcatccgccagcacctgcaaggtttcttcgtcatgatctggattgccgcagtcatgttcaagtccaatgatatcttgcgcaagcagaccgctctcaagggggagaggaaaatgccaatgcttatcgggattgtaatagtattcaccattcacgtgtttggagtctactggtggtacaggaatgatgaccttgttagacctttggtgatgcttcctccaaaagaaataccaccattctggcatgctatatttttcatcgctgtgaatgatacaatggtccggcaagctgctatggtggtcaagtgtgtgctgctcatgtactacaaaaacagcaaaggtcgtcactatcgtagacagggccaaatgttgacagttgtggaatattccctacttctgtaccgtgcgttgttgccggctcctgtgtggtatcgttttttcctgaacaaggaatatggaagtcttttttcatctttaacaactggattgtaccttactttcaaggtggcatcaatggtggaaaaggttcgatcacttttggcttcagtgaatgcgctgtctcataaggacttgcattatggttcacatgcaacaactgagcaggttcttgctgctggagatctgtgtgctatatgccaagaaaagatgcatactcccatcctcctgcagtgtaaacatatcttctgcgaagactgtgcctctgaatggttggagcgggagcggacatgcccgttatgcagggcgctggtgaagccaggggacattcggtcattcagcgacggttcaacgaccctcttctttcagctcttctaacaagaaacaagaagcgctaaccttcggcctgcagatgttggatcgccccctgttactctccatcagcctgccgtgtgctgagactttctccagtccaggtccttttccgccacttcgtgacaagtagtaggtgccgtgggtgtgcatattaccctgtataggtccttgcgggattctccatcacaaaaaagaggattgttatgacgaaataactgaatctatagaggtgaatttccattagcatgtggttgggtgggtgccgccacatctgcaaaattcagaattgaccttatacaagatcacaaatgttaactcttgactcctgagccaacgtagcttgttgctcgtacaatgagatgaacatatccttttgtttcctgcttgtgtcacatgagtcccatcaccattcttgccacctaaaatatgtctt

SEQ ID NO: 4560 - DNA, 1873 bp, Brachypodium distachyon
gcgagccgccgagcacgcacgatcaaattataagcccgaaaagaaaaagaaacaaagaagcagaacacaacgagcacataaaccccctccctctctccctcttccgagttccgactgtaagcacggctccccccttccacctcctgagtcctgagtccttccttcttcccccggcgcgccatcgctcggatggaccaaccccctcacccgccgcagccggccgtctcggaggccgccgggggctacgccacccgcttctcccccgctggtctcatccacgcgccgctctccgcgctgctcgagtactcctcgggcctcctccgcgcccaggccaccgccggggcccacaggggggaggccgccgaccgggaggtgtcgattcggatcgtcgggcccggcggcgacgcggggccgcgcgctcctggggccggggaggtcccgcccgccgcggacgaggaggcgcccgccgtgcggggcgacgaggccggggccgggagcgggagggcggagtcgccgtaccagggctacgacgtgcagcgggtggccaggtggctggatcacgcgctgcccttctccctgctgctcctcggcgtcttcatccggcagcacctgcaaggtttcttcgtgatgatttggattgccgccgtgatgttcaagtccaatgatatcttgcgcaagcagaccgctctcaagggggagaggaaaatgccaatgcttattgggattgtagtagtattcattgttcacgtgtttggagtttactggtggtacaggaatgatgacctagttagaccactcatgatgcttcctccaaaagaaataccgccattttggcatgctatatttttcatcgcggtgaatgatacaatggtgcggcaagctgctatggtggtcaagtgtgtgctactcatgtattacaaaaacagcaaaggtcggcactatcgtagacagggtcaaatgttgacagttgtggaatattccctacttctgtaccgtgcattattgcctgctcctgtatggtatcgatttttcctgaacaaggaatatggaggtctattttcatctttaacaactggattgtaccttacattcaaggtggcatcattggtggaaaaggttcgatggcttttggcttcattgagggcgctgtctcataaggatttgcattatggcgcacatgcaacaactgaacaggttcttgctgctggagatctgtgtgctatatgccaagaaaagatgcattctcccatcctcctgcagtgtaaacatatcttctgtgaagactgtgcctctgaatggttggagcgggagaggacatgcccattgtgcagagcgctggtcaagccaggagacatccggtcattcagcgacggttcaacaaccctcttctttcagctgttctaggaaacccaatgagaaccgctaaccttcagcctgcagatgttggatcgccgttgttagtctccaccagcctgccgtgtgctgagactgctttcagttcaggtccttttctgccacttcgttacaagtaggtaccatggatgttcatattacccctgtataggttctcgcgggatggttgataacaaaaaagaaagagggatggtattacagaataactgaatctatagagttgagtttccatagcatatgtctaggtgggtgctgccgcatttgcttatttcagaactgaccttatgcaagattacacaactcctgactcctggcctcctggggcagcttagctacttgttgctcgtacaatgagcagaacatatgtttctcttttcttattgcaatttgtcgcattactcgcatcatcattcttgcctgtttccagatgtctctttcactcttcagtaattttgggtaa

SEQ ID NO: 4561 - DNA, 758 bp, Rosa hybrid cultivar
tatcagctgtcatgtagtaggtacaaatgacatttggttaaggaagcaggacggctacgtaaagggagacgaaggaaaattcttctttttcttggtgggactattgcttgttgtttttatgcttcatgtggttggtgtttactggtggtatcgaaatgacgatcttttatacccgctggcaatgcttcctccaaaagccataccgccattctggcatgcaatattcatcattttggtaaatgatactttggtgagacaggcaacaatggcttttaagtgtttgttgcttgtatactacaagaatggaagagggcataactatcgtcgacagggtcaaatgttaaccgtagttgagtattcactgctgctgtaccgtgccttattaccagcacctgtttggtacagattcttcctgaacaaagaatatggaagcctcttctcatcacttattacaggattatacttgacttttaagctaacatctgttgttgagaaggtccaatccttttttgcttctataagggcattatcacgaaaagatatccattatgggtcccacgcaacattggaacaggtaaatgcagcaggagacctttgtgctatttgccaggagaagatgcatgctcctatcctgttgcgctgcaaacacatcttctgcgaggactgtgtttccgaatggtttgagagagaaagaacttgccctctatgccgggcagtggtaaaacctgcagatctgcgaacgtttggggatggatcaa

SEQ ID NO: 4562 - DNA, 1512 bp, Fagus grandifolia
agcagagagagacagaaagagacggtgaataaacatttatggttctgtcaagatacgtgattaaaaagcacagacgctttcctttgcaaatatcatgaagtaaattatctttctaatatatttctatccacaagttaatcaaagaacacaaaaagatatagaaaatttgatcgtgaattatggagacagcggtgacttccagtgccaacactagtagtaatactggtcgaggatatggaattcaagtggcggtttcaaatttcatacaaggtccattaactgcattgttcgactattcagctgttcgcaattctgattctcaggaaacaattgatgaacatggaggtgaaggtgaggatgaggatgaagaagagctttccatcagaataattggtcctacagaggctgagacacacattccgtcttcaaattctgcacctgtctcagatgctggaaatgagtctggagggactcctgctgatcataccaattctggaagcagcagtggtaccagtagtagtagtagcagcagatatgatattcagcattttgcgcgatggattgagcagatcctacctttttcttgcttcttttgctcgtcttcattcgtcaacacctccaaggtttttctgttacgctttggattgctgctgtcatgttcaaatccaatgatattcttaaaaaacagaccgctcttaaggaggagaggaaaacctctgttctcgtcagcatcgctatggtatttatgcttcatgtctatttttgtttattggtggtatcggaatactgacctactatatcccttggtttacttcccccaaaagaatacctcccttttggcatgctgtattcatcatcactgtgaatgacattatggtgcggcaggcagcaatatccttcaaatgtatgcttttgatccattacaagaacagcagaggccgtgattaccggaaacagggtcaaatgctaactcttgttgagtatatcttgctgctgtaccgtgccttgttgcctgcacctgtttggtatcggtttctttttaaaataaaggatatggaagtcgttttttcttcgttaaccacggggttgtatttaaccttcaagcttacatcaattgtagagaaggtccaatccttcattgctgcattgaaggccttaacgcgtaaggaaatacattacgggtcttatgccacggctgaacaggtcaatgcagcaggggatctctgtgctatctgccaggagaagatgcatgctccaattttgcttcgctgtaaacacatattctgcgaagaatgtgtatcagaatggtttgagcgagaaaggacatgcccattgtgcagggtcttgattaaaacagcagacatcaaatcttatggtgatggatcaactagtttatttttccagttattttaagatctacttgctaaagaagccagaactgctttggaaacgaaagatcattttaccatttattcttgacacgctcctgtgacttacaattccattctttcc

SEQ ID NO: 4563 - DNA, 1631 bp, Brachypodium distachyon
atggaccaaccccctcacccgccgcagccggccgtctcggaggccgccgggggctacgccacccgcttctcccccgctggtctcatccacgcgccgctctccgcgctgctcgagtactcctcgggcctcctccgcgcccaggccaccgccggggcccacaggggggaggccgccgaccgggaggtgtcgattcggatcgtcgggcccggcggcgacgcggggccgcgcgctcctggggccggggaggtcccgcccgccgcggacgaggaggcgcccgccgtgcggggcgacgaggccggggccgggagcgggagggcggagtcgccgtaccagggctacgacgtgcagcgggtggccaggtggctggatcacgcgctgcccttctccctgctgctcctcggcgtcttcatccggcagcacctgcaaggtttcttcgtgatgatttggattgccgccgtgatgttcaagtccaatgatatcttgcgcaagcagaccgctctcaagggggagaggaaaatgccaatgcttattgggattgtagtagtattcattgttcacgtgtttggagtttactggtggtacaggaatgatgacctagttagaccactcatgatgcttcctccaaaagaaataccgccattttggcatgctatatttttcatcgcggtgaatgatacaatggtgcggcaagctgctatggtggtcaagtgtgtgctactcatgtattacaaaaacagcaaaggtcggcactatcgtagacagggtcaaatgttgacagttgtggaatattccctacttctgtaccgtgcattattgcctgctcctgtatggtatcgatttttcctgaacaaggaatatggaggtctattttcatctttaacaactggattgtaccttacattcaaggtggcatcattggtggaaaaggttcgatggcttttggcttcattgagggcgctgtctcataaggatttgcattatggcgcacatgcaacaactgaacaggttcttgctgctggagatctgtgtgctatatgccaagaaaagatgcattctcccatcctcctgcagtgtaaacatatcttctgtgaagactgtgcctctgaatggttggagcgggagaggacatgcccattgtgcagagcgctggtcaagccaggagacatccggtcattcagcgacggttcaacaaccctcttctttcagctgttctaggaaacccaatgagaaccgctaaccttcagcctgcagatgttggatcgccgttgttagtctccaccagcctgccgtgtgctgagactgctttcagttcaggtccttttctgccacttcgttacaagtaggtaccatggatgttcatattacccctgtataggttctcgcgggatggttgataacaaaaaagaaagagggatggtattacagaataactgaatctatagagttgagtttccatagcatatgtctaggtgggtgctgccgcatttgcttatttcagaactgaccttatgcaagattacacaactcctgactcctggcctcctggggcagcttagctacttgttgctcgtacaatgagcagaacatatgtttctcttttcttattgcaatttgtcgcattactcgcatca

SEQ ID NO: 4564 - DNA, 1191 bp, Lotus japonicus
gcgtgtgcgtgtggccatgtctgcagaggaccggcgtgcatttgctgctgacaatgttcctctggtggctctgcctaatgctattagcggtatccctcgggattcctcttctccgtacgggagattggatgtacagcagattgcaaaatggggtgaacagatactccctttcgccctcttgttgttgattgttttcgtccgccagcactggcaaggtttctttgtcaccatctgtgcatcagctgtgatgttcaaatcaaatgaaattgttaagaaacagacagctctaaagggagatcggaaagtctctgtacttctcagcatcgcttttgccttcatgttttatgtgatgtgcatttattggtggcattgtaatgatgatcttctgtccccactggcaatggttccgtcaaaagcaacaccaccattttggcacacaatattcattgttttggttaatgatacattggtgaggcaagcaacaatggctttcaagtgtttgttgcttatctactacaaagatagcagaggccataatttccgtcggcaggctcaaatgttaactctggttgagtacacactgctgttgtatcgggctttgttgccaacgccagtttggtaccgatttttcttgaacaaggaatatggaagtctcttttcatcactgaccacaggattgtatctaactttcaaactaacatctgtagttgagaaggtccggtgtttctttagtgctttaaaagcattatcaaaacatgaagttcattatggggcttatgcaacaatggaacaggtaaatgctgctggtaacctttgcgctatatgccaggagaagatgcattctcctatcttgttgtgctgtaaacacatgttctgcgaagagtgtgtatccgaatggtttgagagagaacggacttgcccattatgcagggcatcggtaaaacccgctgatctgcagacctttggagacggatcaacaagtctgttttttcagttgttttaacaccttgtttggcttgtatcatgtttttgagccaaaatcttcctgaataatttcatatttagaactgtgatttggtaatattttccatcaatggatgctatgaatttaagatggaaggaaagactaaagtaacattgcatctatggcaaagttcttttgtagcttaaatgaaaagttatttatagctt

SEQ ID NO: 4565 - DNA, 1705 bp, Mimulus guttatus
acttctccgccattttttttcttcctgtaaccgaaagccctaatcttcaaatactatcaccatatattcttcttcaccaagggtttcttcatttcagatattatttttttaatttttgtcaaatatttatggaggcatcgagttcagacgctacaaatatggaatcgtccccaccttcatcaacaagcaatggaggatcgagctcacgaatcctccacaacctcccttacatgcggtttctccagtccccggtctcgtcgcttctcgaatattccggcatcctcagggtccgacccgattacccatactccgaaacccgccccctcatacccgagaacgtggcccccactcttaactcgcaaaaccctagcaattcgcagtcaatcgacgctgttgacggaggcggcagtggtaacggggaggtttcgattcggataatcggggagcgggagcaggataataggattggggataacggcgagaatgatgttagtagggcgggattgggcgcggaggaggattctacggtgggcggtgaagatgttaatggaagcagcgacggcgatagcagtaacagagaagggtcgacttaccagagatatgatatacagcaggcggcgaggtggattgagcagattcttccgttttcgttgcttttgttggtcgtatttattcgacagcacttgcaaggatttgttgttgcaatttacatcactgccatccttttcaagtctaatgacattcttcggaagcaaacatccttaaagggagaaaggaagatatctgtccttattggttattcggttctgttcatgtttcatatccttggcatatattggtggcataaaaagaacgcgtttttcaattcactactaatgattccaccaaatgcgatcccacctttctggcatgccctgttcatcatcctcgtaaacgatacaatggtacgtcaggcatcaatggtcttgaaattggctgtgatgatgtattataagaatggtagaggccataattttcgtagacaggggcaaatgttgacccttgttgaatacacaaccctgctataccgtgcgttattaccgacacctgtatggtatcggtttttcttgaacaaagaatatgggagtctcttttcatcactgactacaggcttgtacttaactttcaagcttacgtcaattgttgacaaggttcaatcctttgtagcttcattgagggcattatcaagaaaggaaatacattacgggtcttatgcaacaccagaacaggtaagtgcggctggagatctatgtgctatttgccaggagaagatgcacactccaatcttattacgctgcaaacatgttttctgtgaagactgtgtctcagaatggtttgagagggagagaacttgccctttgtgcagggcacttgttagagctgctgatcttcgatcttacggtgacggatcgaccaatcttctcttccaattgttttagtcatattccccaaacacaaaaaaacgaagggaaaaaaaaaaactcgggtacataaaagataactgttgaattcttgggacaattctatgtgtatatttccccccctttttttcggtttcgacataagtttattttttgaaatatgttttgttgttgttacctttgtaacagaagcaaattgtgtaagtcaatatatattatgaagtagagattacactgagtggtgg

SEQ ID NO: 4566 - DNA, 2201 bp, Populus trichocarpa
tcagcttatgtttccctgtctgatcatcaactcagctctgcaggaaaagccctatcctcttcctctccttctcccaatcctaatcaagataaaatcagagaaaaggtcagatttcagcaccaccttgtagatattgtattgagaaagacccactttttttattattatcataataagaattaatcaaagcgcgtagccgaaaagctgttttagacaaggacataaagtgatagactccatcaatggaagcattaagaagaagatgaaagcaggagcagctgctgtatccagcctgtgagaaaaccaagcttccttttttttttttcagatatccatccctccacttcaattttgcattgaagtttcattctttctcataaatctccgttctttgtatatcatctgtagagggtagagattaggaaaaggtatggagatttgtggtgaaggcaattctggtgaaatctataggaattcttctttaggaagcagcagtgttggtggtggtggtgatggttatagcaacaatccaagaaggtatggaattaatatagcagcatcaaatttgatacatgctccattaacaacccttttggaatactcgggtatactaggaggaagcacctccagttattctcaagaaagggagcaactgatttcttctccatctaccgctactggtggtggtggtggtcatcaggaggttacaattaggataattggctccgcagagaatgatcatgatgatgaacccaatgcttccccaaatgttgaggcgttaccatatggtcaacgaggtggggttgtggaggggaatgcgaatactgaaagctctatttctgatgggtcttctgggattgccacagattcatcatcttcatcttcttcttatcagagatatgatattcagaacttggctaggtggattgagcacgttcttccattttctttgctgttgcttcttgtttttgttcgtcaacatttgcaaggcttttgtgctgcgttgtggattgctgcagttttatttaaatcaaatgatattctaaggaggcagacagctctaaagggagagagaaagaagtctgttctcctaggcatgactgtagtgttgattcttcatgtgatgtcaatttattggtggtataggaatgctgaccttctatatccattggttttacttcctccatccacaatacctcctttctggcatgttttatttatcatcattgtgaatgatgctttggtgcgacaggtagcaatggtgttcaaatgcatgcttttgttgttttacaagaatagcagaggccacaattaccgcaaacagggtcaaatgctaactctggttgagtattttctgttactgtaccgtgccttgttgccaacacctgtttggtatcgtttcttcttaaacagggaatatggaagctttttttcgtcattagtcacagggttatatttaaccttcaagcttaccacagttctgaggaaggtccaactattcttcactgcattgcggaccttgtcacataaagaaatgtactatggttcttatgccacatctgaacaggtcaatgcagtgggggatctctgtgccatttgccaggagaagatgcatgctcccattttactacgctgtaaacacatattctgtgaagattgtgtttctgaatggtttgatagagaaaggacgtgtccattatgcagggctttggtcaaatcagcagatattaagtcatatagtgacggatcaaccagtttgttcttccagctattctaagatatgatgcttgttcttaaaccaggaccactttcacctttcaaagccaaatgcctatgccattctacagattctcttcgtatgttctcggcagatattttttcgaagcactgctgacagttcactggatctaaatgttgacgttcttctatttgttgtaatccagaggttagatagatattccggccaattcaatgtatttataatctttgaaccacagatggagcacttccagatcttctgtcagtaaccaccgcgttaacttttttccttcttttttcttcttttctttttgtttttgaaaaatatattcaatgtattatatgctattgcaacaattatggttagcaatgcactttgcaatgttgcaaaagttcttatagttattgattggccaaataaattttgttcccaagtcatgagc

SEQ ID NO: 4567 - DNA, 543 bp, Primula obconica
aagtaacaacagcagaagcagaaactaccgtaggcaggggcaaatgcttactctagttgagtattttttgttgttgtaccgtgctttgctgccagcaccagtctggtatcggttctttttgaatgaagaatatggtagcctcttctcatctttaatgactgggctgtattttactttcaagctcacatctgtagttgaaaaggtccaattcttctttgctgcactaaaggctttgtcccgcaaagacattcattatgggtctcatgcaacgtcggaacaggtcattgcagcaggtgatctgtgcgctatttgccaagaaaagatgcacactccaattttactgcgctgtaaacatatttttttgtgaggaactgtgtatcagaatggtttgagagggaaagaacatgcccgttgtgtagggctttggtgaagccttctgatctaaaatcatttggtgacggatcgactagtcttttcttccagtttttctaaattaatcgattctcactctgaatatagtacataattatattatttttttaa

SEQ ID NO: 4568 - DNA, 846 bp, Vigna unguiculata
gatggtcaatgatactttggtccgccaagctgcaatggtagtcaagtgtatgttgttgatgtattacaagaatagcagaggccgaaattatcgtaagcagggtcaaatgctgactttagttgaatatctccttctgctttaccgtgccttgttgccaacaccagtttggtatcgtttcttcctgaacaaagaatatggaagcctcttttcgtcactgatgacaggattgtatctaacatttaaactcacgtctgttgttgaaaaggtgcaatccttctttgctgcagtaaaggcattgtcacgtaaagaaatgcactatggggcttatgcaacatcagagcaggtcaatgcagccggtgatctatgtgctatttgtcaggagaagatgcatgccccaatcttgctacgttgtaaacatattttctgtgaagactgcgtatcagagtggtttgagagagaaaggacctgtccattgtgcagggctttggtaaaacctgcagaccttaggtcatttggagatggctctactagcttgtttttccagttattctgaaatcataaatatatatatataaatacaagccaggaagttttttctgctttgaagctttagtttttcaaagcagcagtcatcgacacatgtaaaatgctgtggaaggaaatggtggggatactgagaagatgaatgcagctgagtacaggcgttcatataatgtactagtaaaaggtggagtgtatctaaatgaccctgtaaactaggaagttgattgaaaatataattaaacacgactcttcatttgcaaggaatgaaggtctctttctcaaaattgcatagctattccgtct

SEQ ID NO: 4569 - DNA, 974 bp, Brassica juncea
tcccagactactgaaggtcttggttcttcttctgcgggaactggagaaggggcttctacaggtgaatctgttggtggagatgctgctgcgagccgagattcgccttaccagagatatgatattcagcaggctgcaaggtggatcgagcagattcttcccttttctttgcttctcttggtcgtcttcatccgccagcatctgcagggtttctttgttgcaatttggattgctgctgtcatgttcaagtctaatgatattatgaagaagcaaaccgcattaaagggtgagaggcagatctcggctttaatcgggatctctgtagcgtttgctgcacatgtggttggtgtttattggtggtttcgtaaggatgacctcttgtatcccttaataatgttccctcccaagtccattccacctttctggcatgccatttttatcattgtcgtcaatgatacacttgtacggcaggcctcgatgatattcaagtgttttctcttgatttactacaagaacagtaggggtcgaaactatcgtaaacagggtcaattgctaactttggttgaatatttgatgcttctgtaccgctctttgctgcctacccctgtatggtaccgtttcttcttgaacaaggattatggaagcctcttctcctctcttatgacaggactctatctgactttcaagctcacttccgtagttgagaaagttcaatctttctttaccgcattaaaatctttgtcacgcaaagaggtgcattatggatcatatgcaaccacagagcaggtgaatgctgcaggggacctgtgtgccatctgccaggagaagatgcacacaccagttctacttcgatgcaagcacatgttttgcgaagattgcgtttcagagtggtttgagagagagaggacttgtcctctgtgcagggccttggtgaaaccagcagatctgaaatcatttggtgatggatccaccagcct

SEQ ID NO: 4570 - DNA, 1316 bp, Helianthus annuus
atggtaatggtaacggtaatggtgatggtaatagtgaggtttcgattcggataatgagcggcggagatcatgaagaggaacgcggtgaagcagagacggtggacaggggagatggtggaggagagagggaggtgagtggctctggtgatgtaagtggtgtgaatggtaatgatagtaatggtaatggtcgtggtaatgtggattcggtgtatcagcaacggtatgatttgcagcaagtttcgaggtggatcgaacaaattctgccgttttcgttgctgttgttggttgttttcgttcggcaacacttacaaggtatctttgttacactttatataactgctttcatgtacaaatcaaatgatattctacggaagcaaacagctttaaagaacttttgcagggggagagaaagttatctgttcttgttggatattgcatagttttcatggttcatgtgatcggagtatactggtggtaccaaaacgatgatctttgcaaccccttgttcatggttccgccaaaagcaattccaccattctggaatgctatattcaccatcattgtaaacgatacgatggtgcgacaggcagcaatggcatttaagttggtattgcttatgtactataaaaacggcaggggccacagttttcgtaggcagggtcagatgttgactctagttgagtacacacttctactataccgtgcttttttacccgccccggtttggtaccgattctttttgaacaaagaatatggaagccttttctcgtctttgacaacagggttgtatttaaccttaaagctcacatcagttgttgagaagattggatccttctatgctgcattaaaggcgttgtcacgaaaagaggtcaattatggatcacatgcaacagcagaacaggtgagtgaggcaggagacttgtgtgctatttgccaggaaaagatgcaggctccaattttgttgcgctgcaaacatattttctgtgaagactgtgtttcagaatggtttgaaagagaaagaacgtgtccattatgcagagcgttggtcagaccagctgacatccgaacatttggggatggctcaacgagcttgttcttccaggtgttctagaaacttccatcttgatatgcaggccgtgtggtttctccagtgagtttgatctgtgctctttgttcaatcatccaaagttatatacaacccgtatcgctaaagtgaattttcggcacccttttctcacaaattgtacagttgagctttacttgtggctctagtatatgatatacacaataaaacacatgagagaggtttcatgaat

SEQ ID NO: 4571 - DNA, 1875 bp, Helianthus annuus
cacggtcgtaatcgcccactgcactacttcttctagatccacaccatttcctcatctttataataataccaataatcccactttgcacccattacacacttcctcttgttcttcccgattaataattattctaatccccaatttcatttcaattattcaactttctcccaccccaaaccctacattccacccccaaatttcatccctttgacttcaatttcatgacccagaaactgttttagccattattccgatttgggtatctgatttcttcaccaattaatggaaacaaccggtgtaaacattaacacaaccacttctgatgcatctgtaagtaataataatagtatcccaccttcatcaaaccctttatctccaagaatcacaagcagtacaatttctccaagaagaacgacgtcgtctgaatctttccctgttattagattcctacaagctccggtcaccactgtgttggaatattccggtgtacttcgaccgcggtcgaatcccgaataccatgaatctgaaagtttgaatcatgatcaccacgatcatgatcacggtagtggtgatttaggtacaggtgtaggtagtagtggggaggtttcgattcggataattggggaggaagggcgcggtgagtcggtggcggtgaatgggggagatggtggtacaggggagagggaaatggctgattctagtgatgtggatgggagtgggagtcggggtgattcgtcgtcgcaacagcggtatgatatgcagcaggtttcgaggtggatcgagcagattcttccgttttcgttgttgttgttgatcgtgtttattcggcagcatttgcaaggtttctttgtgacaatatatgtaactgcttttatgtacaagtctaatgatattcttcaaaagcagacagctttaaagggggagagaaaactttctgttcttggtggttattttgtagtttttgttcttcatgtgattggagtttactggtggtaccaaaatgacgatctttgttatccgctgttcatggttccaccaagagcaataccaccgttctggcacgctatatttaccatcattgtgaacgatacaatggtgcgacaagcagcaatggcgattaagctggtattgcttatgtattacagaaatggcaagggtcataattttcgtagacagggtcaaatgctaacccttgtagaatacgcgttgctgttataccgtgcattcttacccgctccagtttggtaccggtttttcctaaacaaagaatacgggagccttttttcatctttgaccacagggttgtatttgactttcaagcttacatcaattgttgagaaggttggatccgtgtggactgcattgaaggcgttatcacgtaaggaagtccattatggatcgtatgcaacaccagaacaggtaattgaagcaggggacttgtgtgctatttgccaggaaaagatgcaagctccggttttgttgcgctgcaaacacattttctgtgaagattgtgtttcggaatggtttgaaaagagaaaggacgtgcccgttatgcagatctgtggtgaagccagcagagttacgttcattcggtgatggatccacaagcctcttcttccagttgttctagaaacagtgaaaaaaggcggcatatgcggatctctgttttaatttcgcacatcattcttcaaatacccaacttataaacaggattacagtaaaggaaggcagtcctgagcattcttttttcactaaaattgtagttattaagcattaaatgagccttacatatgttaatgtttgataagcattgtacatgagataccattttcatgcattttgttgatatttaaattaaattaaatgctctgggaa

SEQ ID NO: 4572 - DNA, 1574 bp, Lactuca sativa
gggactccatccatttgacgtttttctctttgttttcttctcatcatcgcaagtatttttcattttggggatttcgtggattgagcgtttaaaaggtacaatcagagaagggtttgtatgcgtcggttaatggaaacaacaggtgttagcgttgatcctacgagttctgataatcatgcgactaatagtccgaattcatcaaaccccacatcaccgacgatgcggaggataagcagtagcagttcttcgccgagagcgatgtcgtcttctccgtttccaataattcgtttcttacaagcacctgtaactactataattgaatactcgggtgttcttcgacctaggtcgaataccgattatcacgaatcagagagcttgatttctaaccatcatcatcgtgatcataactcgagtggttccggtactgctagtaatagaagtagtaatgatgagaatagcaatggggaggtttcgattcgaataatgggtggtgcagaccaagaagaggagcatggtgaaccggttgcggtgaaccgtgaagatggcggaggagaaagggaggtggctgattccggtgatggaagtggtggtaatggtgggagtaataataacgtggattcagcgtatcaacagcggtatgatttgcagcaggtgtcaaggtggattgaacagattcttccattttctttgctgttgttgatcgttttcattcgtcaacacttacaaggtctatttgttacaatttatattactgctttcatgtacaagtctaatgatattctacggaagcagacagccttaaagggggagagaaaactgtctgttcttgctgggtattgcatagttttcatgcttcatgtgattggtgtttactggtggtaccaaaatgatgatctttgccatccccttttcatggttccaccaaaagaaataccaccattttggaatgctattttcaccatcattgtaaatgatacgatggtaaggcaggcagcaatgggttttaagttggtattgcttatgtactataagaatggcaggggacatagctttcgtaggcagggtcaaatgctgactctggttgagtacacacttctgttataccgtgcattcttacctgctcctgtttggtaccgattctttttgaacaaagaatacaggagcctcttttcatctttgacaacgggcttatatttaactttaaagctcacatcagttgttgagaagattggatccttctacgctgcattaaaggcactatcgcggaaggaagtcaattatggatcatatgcaacggcagaacaggtaagcgaggcgggagacctgtgtgctatttgccaggaaaagatgcaggctccaattttgttgcgctgtaaacatatattttgtgaagactgtgtttcgggatggtttgaaagggaaagaacttgcccattatgcagagctttggtgagaccagcagatatacgatcatttggggatggttcaacgagcttgttcttccagtttttctagaagaccttccattccatgttggcactctcttcttcaacaaaagcagtaattttttggca

SEQ ID NO: 4573 - DNA, 852 bp, Helianthus annuus
acaataccgccattctggcatgctatattcataataatcgtaaacgatacaatggtccggcaggcagctatgactttaaaattggtactgcttatgtactataagaatggcaggggccataatttccgtaggcagggtcaaatgttgacactggtcgagtacgctctgttgttataccgtgcattcttgcctgctccagtttggtatagattctttttgaacaaagaatacgggagcctgttttcttctttgataacagggttatatttgactttcaagcttacatcagtagtggagaaggttggatctttctatgctgcattgaaggctttatcacgaaaagaaatgcattatggatcgtacgcaacatcagaacaggtaagtgaagcaggtgatatgtgtgcaatatgtcaagaaaagatgcaggccccagtattgctatgctgtaaccacatcttctgtgaagactgtgtttcagaatggtttgaaagagagagaacatgccctttatgcagagccttggttcgaccagctgacatacggtcatttggtgacggttccacaagtcttttctttcggctgttttaagttcgtttatcgacacacatgtttctccgttgctgctgatgtcatcacaaagttaatacacccgtcatggagtctgcttggtttgttctcaccgttagccggagttagagtaattattttctcgcactatttttcttttcttcctgagttgtacagccgggcttttaacgtcgcactcaaatatatatattctgctcgtataatacgcaagatgattgtttaatttatgcatttgtgtgtagtaaggtgtgagcgatgtttggt

SEQ ID NO: 4574 - DNA, 1865 bp, Helianthus annuus
cacggtcgtaatcgcccactgcactacttcttctagatccacaccatttcctcatctttataataataccaataatcccactttgcacccattacacacttcctcttgttcttcccgattaataattattctaatccccaatttcatttcaattattcaactttctcccaccccaaaccctacattccacccccaaatttcatccctttgacttcaatttcatgaccctgaaactgttttagccattattccgatttgggtatctgatttcttcaccaattaaattaatggaaacaaccggtgtaagcgttgacacaaccacttctgatgcatctgtaagtaataataatagtatcccaccttcatcaaaccctttatctccaagaatcacaagcagtacaatttctccaagaagaacgacgtcgtctgaatctttccctgttattagattcctacaagctccggtcaccactgtgttggaatattctggtgtacttcgaccgcggtcgaatcccgaataccatgaatctgaaagtttgaatcatgatcaccgcgatcatgatcatggtagtggtgatttaggtacaggtgtaggtagtagtggggaggtttcgattcggataattggggaggaagggcgcggtgagtcggtggcggtgaatgggggagatggtggtacaggggagagggaaatggctgattctagtgatgtggatgggagtgggagtcggggtgattcgtcgtcgcaacagcggtatgatatgcagcaggtttcgaggtggatcgagcagattcttccgttttcgttgttgttgttgatcgtgtttattcggcagcatttgcaaggtttctttgtcacaatatatgtaactgcttttatgtacaagtctaatgatattcttcaaaagcagacagctttaaagggggagagaaaactttccgttcttggtggttattttgtagtttttgttcttcatgtgattggagtttactggtggtaccaaaatgacgatctttgttatccgctgttcatggttccaccaagagcaataccaccgttctggcacgctatatttaccatcattgtgaacgatacaatggtgcgacaagcagcaatggcgattaagctggtattgcttatgtattacagaaatggcaagggtcataattttcgtagacagggtcaaatgctaacccttgtagaatacgcgttgctgttataccgtgcattcttacccgctccagtttggtaccggtttttcctaaacaaagaatacgggagccttttttcatctttgaccacagggttgtatttgactttcaagcttacatcaattgttgagaaggttggatccgtgtggactgcattgaaggcgttatcacgtaaggaagtccattatggatcgtatgcaacaccagaacaggtaattgaagcaggggacttgtgtgctatttgccaggaaaagatgcaagctccggttttgttgcgctgcaaacacattttctgtgaagattgtgtttcggaatggtttgaaagagaaagaacgtgcccgttatgcagatctgtggtgaagccagcagagttacgttcattcggtgatggatccacaagcctcttcttccagttgttctagaaacagtgaaaaaaggcggcatatgcggatctctgttttaatttcgcacatcattcttcaaatacccaacttataaacaggattacagtaaaggaaggcagtcctgagcattctttttttcactaaaattgtagttattaagcattaaatgagccttacatatgttaatgtttgataagcattgtacatgagataccattttcatgcattttgttgatattgaaattaaat

SEQ ID NO: 4575 - DNA, 514 bp, Nicotiana tabacum
gacaggcagcaatggcgttgaaattggcactgcttgtgtattacaagaatggaaggggccacaatttccgcagacagggccaaatgctgactttggtggagtataccctgcttctatatcgtgcattattaccggctcctggtctggtataggttctttctcaacaaagaatatggaagccttttttcatcattgacaacaggattgtacttgacgtttaagcttacatcaattgttgagaaggttcagtcattccttactgctttgaaggcattgtcgattaaggaaatccattatgggtcacatgccacacctgaccaggtaactgcagcgtggtgatctatgtgctatttgccaggagaagatgaatgcaccaattttgttgcgttgcaaacacatcttttgtgaagactgtgtctcagaatggtttgatagggaaagaacttgccctttgtgcagagccttggtcagacctgctgatctaaaatcttttggagatggatcgactagcctt

SEQ ID NO: 4576 - DNA, 533 bp, Vaccinium corymbosum
cgttcggcagggtcaaatgctaactctggttgagtataccttgctgctataccgtgcattgttaccaactgctgtctggtatcggttcttcttgaataaagagtatggaagccttttttcatcactgacgacaggattgtacttaacttttaagcttacatctgttgttgagaaggtacaatctttctttgctgctttgaaggcattatcacggaaggatatcaattatgggtcttatgccacattggaacaggtaaatgcagcgggagatttgtgtgcaatttgccaggaaaagatgcatgctccaattctactgcgctgtaaacacattttctgcgaagactgtgtttctgaatggtttgagagagaaaggacatgccctttgtgcagggccttggttagacccgcagatcttcgttcatttggggatggatcaacaagtttgttcttccaattattctgaaattccgcgatgttacgaagcatgtatcttcttcccccttaaactgctgttttccacaaaaaattttctg

SEQ ID NO: 4577 - DNA, 2173 bp, Cucumis sativus
gtgccaataccactcgccttccacgtgccactccttcccatttcactattgcctttcattttccatttcagttctccgtttttcttcttcttcttcttcttctccccttccccaaatctcaccggcgaccctccgacccatctccatccgcctctttttcctcccatttctcctttttctcctttttctctggtgggatttcgaagggtcgattcggtaaccacggggaagttcgaaggttagggcttttcttcactttgggcctctctgaaaatggagacttcgccttccaattctgatccttactccaattcttcttcacccacaactgctcgttcttcctccagatttgccttatccctcccttctctcaatttcttccgttcccctttgtctgtcatcttggattactctggaattcttcccactagggctgttcgtcatgaatccgaccctgtaattaacgctgctgctactcctgatttgcgggttttttctcaaaatcagaatcacttgatacacacttcttctccttcttcttctccttcttctgttacaacttcttctgttacaacttcttccgctaatactatcccttctggggaggtttccataaggattattgggtctggtgagcaagatccttctcccagggccttgttgccaaatcaggttgtttatgagcaaaatggtagactccctgtttctggggatcagccggaatcccctgatgaggaacgagttccattggtgtctactacttcttcgtctattcaacctggaggcactcgtgttgatggagaatctggaaatggaatggaagagagtgtcaatagagattcttcttaccagagatatgatattcagcaggttgccagatggattgaacaaattcttccattctctttgctattgctgattgtatttatccgtcagcatttagaagggtttttcatcacaatttggatatcagctgttatgtataagtcaaatgatattgtcaagaaacagactgctctaaagggggagaggagaatttctgtccttgctggaacttccattacatttttggttcatgtaattgggatttactggtggtgtcatagtgacgatcttctataccccttagtcatgcttccaccaaagactgttccacctttttggcatgccttgttcatcattttggtcaacgatacaatggtgaggcagtttgcaatggctctcaaatgttttcttcttatttactacaagaatggcagaggccacaattttcgtcggcagggtcaaattttaactcttgtggaatacactcttctattgtaccgtgcattattaccaacacctgtatggtaccgattcttcttgaataaagatcaagggagcctcttttcatcattgacaacaggattgtatttaactttcaagctaacatctgttgttgagaagattcaatcatttgttactgcatttaaggctctatcacaaaaagaagtccattatggatcatatgccacatcagaacaggcaagtacacttattctgtctgtaaatgctgcgggagatctctgtgctatttgccaggagaagatgaatgctccaattctattacgttgtaagcacatcttctgtgaagattgtgtttctgagtggtttgaaagagaaaggacttgccctctttgccgagcactggtaaagcctgcagaactccgtacatttggtgatggctcgaccagcttactcttccagttgttctagagaaaaattttccatttcccgacataacaaatctattagtttaacaaggaaagatatcgattattgaatggaaacagggggaagaacaaagataaaagggagagaagaaagaaagaggaaaaacaaaacatcgaggcaatcctgaagatactgtgaaaatcaaaattggattagtattatgttgatgctttataatctcattgtgatgagttagatgccaaaacagaagatggatttaataaaatcccatttcttcattgaatacaatgaaatctaattttttttaacagggaaaagggttccaagtgtgagtagtgcaatgttatatgagaattgttggagaataattgtaatccaatccttaaagatgattattccttgtaattttgtatggagtggctgccaagtgaatttggtg

SEQ ID NO: 4578 - DNA, 1965 bp, Helianthus annuus
aaagttaggttggtccatggctattgccatatgctcttctcttgctgtctttgtcttcaaacatcccttcttcccctgtcctcttcacccccaaattccattactccatccactatccttttcttccacacctacaactcccatttcttcacctcaatcacaccacccaaaccctaaccctaaccctaacaataccaatcatgatcaaaccaatcatcctcacacctcaatccatacccaaaaccgatcatcacacctcaatccattgactttcatcgccacaatcaagccctaattcacccaaacaccctctattacccgatcaatttccacaatttcaacattagggtttcagtttgatggagccagtaggcgttggtgctgccaccacaaattccgatacttccgttgcgaatacgacgtcgaattcatctcaaacgacgtcgtttcagatactacggttcttacaagctccggtaactactttgtttgaatactctggttttttacggcctaggttaagtaatagtaacgagtattatgaatctgagaggttgatttcacgtagaagtagtagtagtttgaatgatttaggtggtgctggtagtggtagtggtagtgttggtaggaatagtgagaataatgatggtgaggtttcgattcggataattggtgatggagaggaagaagaagggggagatggtggggataatagtgatttggatgggaggattggtggtggtggtgatgggagtagtggtaataataataatgcgagtgattcgtcgaatcagaatcagaatcagcagaggtatgatttgcagcaggtttcgaggtggattgagcagattcttccgttttctttgttgttgattgttgtgtttattcgtcaacacctgcaaggtttctttgtaacaatatatgtaaccgctttcatgtataagtcaaatgacattcttcgtaaacaaacagctttaaagggggagagaaaactatccgttcttgttggctatagtataatttttatgcttcatgtggttggagtatactggtggtatcaaaatgatgatcttagctacccgctgttcatggttccgccaaaaacaataccgccattctggcatgctatattcataataatcgtaaacgatacaatggtccggcaggcagctatgactttaaaattggtactgcttatgtactataagaatggcaggggccataatttccgtaggcagggtcaaatgttgacactggtcgagtacgctctgttgttataccgtgcattcttgcctgctccagtttggtatagattctttttgaacaaagaatacgggagcctgttttcttctttgataacagggttatatttgacttttaagcttacatcagtagtggagaaggttggatctttctatgctgcattgaaggctttatcacgaaaagaaatgcattatggatcgtacgcaacatcagaacagcaggtaagtgaagcaggtgatatgtgtgcaatatgtcaagaaaagatgcaggccccagtattgctatgctgtaaccacatcttctgtgaagactgtgtttcagaatggtttgaaagagagagaacatgccctttatgcagagccttggttcgaccagctgacatacggtcatttggtgacggttccacaagtcttttctttcggctgttttaaagttcgtttatcgacacacatgtttctccgttgctgctgatgttgtcatcacaaagttaatacacccgtcatcatggagtctgcttggtttgttctcaccgttagccggagttagagtaattattttctcgcactatttttcttttcttcctgagttgtacagccgggcttttaacgtcgcactcaaatatatatattctgctcgtataatacgcaagatgattgtttaatttatgcatttgtgtgtagtaaggtgtgagcgatgtttggt

SEQ ID NO: 4579 - DNA, 760 bp, Eschscholzia californica
tttagttgtatgtattacaagaatacgtagaggaccgtatctatcgtaagcagggcccgtatgctaactctggttgaatatctgctgctgttgtatcgtgctttgtctaccgactcctgtttggtaccgtttcttcttaaacaaggatatggaagcctatttctatccttaattacgggattgtatctgactttctaagctctacatcagtttgtcgagaaggttctaacccttttttgccgcatttagggctttatcgcgtaaggagatcaactacggatcctgtgccacatctgagcaggttaatgcagcaggcgatctgtgtgctatttgccaggagaagatgcatgccccaatcttacttcgctgtaaacacatattctgtgaagattgcgtatcagaatggtttgagagagaaaggacatgcccattgtgtagggccctggtaaaaccagcagatctcagatcatttggtgatggatcaacaagtctctttttccaattcttttagggttctatgagcacagcaaaatcccggaagacccatgtagcttctaaaagcccgattcaaacttctccgaagcagggataacatccccacaatatctccagtcagtcgtgtatttttcatacttatactcaagtaagtcttaaccgagtcttcagacactggtacagcttacagcaatgatatctaggtttctgcctcttgaaactgaaagaggggcaaatatcatgtttatattgttattgatgatgg

SEQ ID NO: 4580 - DNA, 773 bp, Tripterygium wilfordii
gataccttggtgcgccaggcagcaatgatgctcaagtgcattttattgatttattacaagaaccgtaggggcagaaactaccgtaggcagggccaaatgttaactttggttgagtatctgatgttgctgtaccgagccttattgccaacaccagtctggtaccgtttcttcttgaataaagactacggcagccttttctcttctttaatgactggattatatttgactttcaagctgacttctgttgtcgagaaggtgcaatctttctttactgctcttaaagcactttcccataaagaggtgcattacggagcttatgcaacaacagagcaggtgaacgcagctggagatttgtgtgccatatgtcaggagaagatgcttgttcctgtcctgcttcgttgtaaacatatcttttgtgaagattgtgtatcagaatggtttgaacgagagaggacatgccccctgtgcagggccttggtcaaaccggctgatctcaggtcatttagtgatggatcaaccagtttgtttttccagatattctaaagtctactctaaagaaaacacggacttttaactgctttgaaccacttaaagcacttgttcagagcgcctcattgatgatcactccatctgcacaggtatatttgactgtattttttttcttccaccttgtttattaaatacaaaatcaaagacagtcaaatcggaattgactagatgaggccaaactttctgcttgtatgttgtattgggaaaggtttaatgtatctaag

SEQ ID NO: 4581 - DNA, 1999 bp, Musa acuminata
cattcaaccacgagcgggtcgataaggcattcctaaattataacgctctcggttgatccttccgcttccgtcgatctcacccaaatcggacaaacaggagagagagagagagagagaatccttggctgcaagaaaacaaacacctcataacaattcgttgtccccttccctgccttcctccctcgaggcatcccctccactgcattgatcctcccgaatagggttttggattgacccccaggaatcccgctgcattgatcccaacttccgatttctcctctgcaaatcttaaccgggatccgttgatgcccgtcttcgcttcatagatcgccgtttcttgagcttccgcggctttggcccccgcactatggaaacccccggcggagactccgatccgtacgggtctcggtttccctcctcctccgccggcgggggcatcagtggtggcccttcgaggaggtaccgtgtccctttctcggcgaatctcatccacgcgcctttgtcggcgctcttggaatactccgggatcttgcgtcctggtgccagccaatcggagacggagagcttgattccgctgccggagctgaatcttgcccaggtggatgagtcgtccgtatccgccgttgctgaccgtggcgaggtgtcgattaggatcattgggagtggcgatcaggagagtctccggatggcgtcgacccagccgcagccttcgactgcctggtctggtggacagggtaattctggcggccgcggtgtctctggtgaatcgaaccctgctttctcagagaggcaccgaggaggagatggagggagcaatagcggggtcggagaggcagcctcctcgtccgcatcttctgtgtcagcatccatcgcggctgttgatggcccgagcacggacgcggaggcgagtatgacgggtggtcgcaacagggattcatcgtatcagagatatgacattcagcaggttgcacggtggatcgagcaaatactaccgttctcgttgcttcttttggtggtcttcatcagacagcatttgcaaggctttttcgttacgatttggatttcagcagtgatgtttaaatccaatgatatcttgaaaaaacaaactgctttaaagggagagcgaaaattgactgtgcttgttggaactgcatttttctccatgttacatatatttggcatctactggtggtaccgaaatgatgatatcttatacccacttatcatgttttctcccaaagcaataccacaattttggcatgccatatttattatcttggtcaatgatataatggtgcggcaagcagctatggttgtgaagtgtattctcttggtgtattacaaagatcgtaaaggtcgtaactatcgtcagcagtgtcaaatgcttactcttgtggagtaccttctacttttgtaccgttcttttttgccaactcctgtttggtaccgatttttcctgaacaaggaatatgggagtttcttttcatctctgactacggggctataccttactttgaagttgacatcagcagtagagaaggttcaatcatttatttctgcgtttaaggcgctatcatgcaaggatgtaagttatgggtcttatgcaacagctgaacaggtaattacagctggtgatatgtgtgccatttgccaagagaagatgcacgctcctattctacttcgttgtaaacacatcttttgtgaagactgtgtctctgaatggtttgaaagagaacggacatgcccattgtgcagagctgtggttaagccagcagggctgaggtcattcggcgatggttccacgagcttattctaccagttgttttgattattgcatctgtaacataaattgatttcctcggatgccagattggtcagaaggatgcaggctgaccttgctgtggtgctgttgctgttctctcatgatttgatctccatgtcacctcccgggagtcttttgatcaaagttcgatgagacacctccccatctatccatatt

SEQ ID NO: 4582 - DNA, 1994 bp, Lactuca sativa
gtcgccgtatatgttcaagatgctttttctcttgccgtctcgtctttcatacacggtctcctctgcccgcttcactatttcaatctcattgatcgaccatccttttcaatatctgtaatttaattccacttcataatctcaaatcgcaacaaagaaccctaaacttctcccttctcctaataatcatcaaacaattcatcattattcaaacctttgactttttattttttccatatatcatcgcaatcatgtccttttcggtgtaaatttcttcagtatttcgatcaatttgaggaatttgtagctctaagatcgttgaacgtgtgcaggaagaaaatattaaatttgacgattagggttttacttttatacacgattgatggaaacagtgggtgttggtgttgccacgacgaattctgatagctatactggtaatatttcaaactcagtctcatcagattcttcatctccgacgactaggggcgccggtggtggcatcagttcttcccgaaggtcgacgtcgtcttctgcgtttcctatagtccgcttcttacaagctcctgtaactactttatttgaatattcgggttttctacgacctaggtcaagcaacgataatcatgaatccgagagcttgattccacaccatcataatcatagttcgagtgattccagtacggcttctagtagcgatggtagtaataacgaaggggaggtttcaattcggataatgggtgacggagagcaagaagaggggcatggtgacgacggtggagaatccgctgtcataggcggagatggtggtggtagagagagggagatggccgattctagtgatgtggatgtcaggagtggagctaatgggagtaataataacagtgattcatcaaatcaacaaaggtatgacttgcagcaagtttcgaggtggattgagcagattcttccgttctccttactcttaattgtcgtgttcattcgtcaacacttgcaaggtttctttgtaacaatctatgtaactgctttcatgtacaagtcaaatgacattcttcgaaagcaaacagctttaaagggggagagaaaactttctgttctcataggctatggtataatctttacgcttcatgtaattggagtatactggtggtatcaaaacgatgatcttagttccccattgttaatggttcccccaaaatcaatcccaccattctggcatgccattttcataataatcgtaaatgatacaatggtgcgacaagcagcaatgactttaaaattagtactccttatgtactataaaaatggcaggggtcataattttcgtagacagggtcaaatgttgactttggtcgaatatgcccttctgttataccgtgcgtttttacctgctccagtttggtacagattctttttaaacaaagaatacgggagcttgttttcttctttgatcacagggctatatttgacttttaagcttacatcaatagtggagaaggttggttccttctatgctgcaatgaaggctttatcacgaaaagaaatgcattatggatcatatgcaacatcagaacaggtaagtgaggcaggagacatgtgtgctatttgccaagaaaaaatgcaagctccaatattgctgtgttgtaaccatattttctgtgaagactgtgtttcagaatggtttgaaagagagaggacgtgtcctttatgcagagctttagtaagaccagctgatatacgatcatttggtgatgggtcaacgagtcttttctttcgattgttttaaatgttgttcatcaacatacaaaatgatcatgaaatgggtttcttgttaattcttttttgggaattttttttttttcatttaaagttgtacagatgagggttttaatgttatttactgaaaaatatatatgttgtgatgggataatatgcaaggggattctttaatgcccttttacttgcattttgttaatattttattttattttgtatcttgg

SEQ ID NO: 4583 - DNA, 1908 bp, Ambrosia trifida
atttcctccctccttcctgaatccaactcaaaactttgttatcgataccaaaccctaacattcgattgttgtaattcataaaagtaacaatctgttcgttgaggaagccaagggcatattggtaattttggcacacctgaacgatcgattgtcggtttctaacccttgttatttgttgattttattattattaattgaacgtctaatcaaagggtttttgtatgcgtcgattaatggaaacatcaggtgttagcgttgttgattccaccacttctggtaataataataatattaataataatcatgagagtaataatacaaaattcgttcaaatccttcatctccgacgataaggaggagttccttgcaaacgacgtcgtttcctgtgattaggtttctgcaagcacctgtaactactttaattgaatactctggtgttcttcgacctaggtcgaacaacgattatcaggaatcagagagtttgattgctaatcatcatagccctagtgatgttaacagtagtaacggtgataatggaaacgatgaggtttcgattcggatatcgaatggtggaggacaaggagaggagcatagtgaaccgaattcggtgaaccatgttgataatggtggtggaggagatagggaaggttctgattctggtgatgtaagtggtggcaatggtggaggcagtagtaataataataataataatgtggattcggcgtatcaacaacggtatgatttgcagcaaatttcgcgatggattgaacaaattcttccgttttcgttgttgttgttgatcgttttcattcgtcagcacttacatggtatctttgttacaatatatatagctacctttatgtataaatcaaatgatattctacggaagcagacggcgttaaagggggagagaaagttatctgttcttgctggatattgtgtacttttcatgcttcaagtggctggagtttattggtggtaccagaacgatgatatttgcaatccgttgttcatgatgccaccgaaagcaataccatcattttggaatgctgtattcactattgttgtaaacgatacgatggttcgccaggcagcaatggcttttaagttggtattgcttatgtactataaaaatggcaggggccatagtttccgtaggcagggtcaaatcttgactctggttgagtacacacttctggtataccgtgcatttttacccgcccctgtttggtaccgcttctttttgaacaaagaatacgggagcctattttcatctttgacaacggggttgtatttaaccttaaaacttacatcagttgttgagaagattggatccttttatgctgcattaaaggccttgtcacgaaaagaggtaaattatggatcacacgcaacagcagaacaggtgagcgaggctggagacgtgtgtgctatttgccaggaaaagatgcaggcacctattttgttgcgttgtaaacatatcttctgtgaagactgcgtctcggaatggtttgaaagagaaagaacttgcccattatgcagagctttggtgagaccagcagatatacgatcattcggggatggctcaacgagtttgttcttccagttgttctagaagtatgaggaccatcagggtgtgaggactgtgtgctttcttcattgagttttgatctttagttgcccaaagttattgccgcgttaagttttttggcatccttttcccctcgaattgtacagttgagctttacttgtggctctcatatatatttatacacacaatatacatacaacaatctagtgctgtgtgtgcatctggtagtacaccaagtttatttacagtatatgtaatgattttagagattatttaaaccaactaaataaaacctaaacatttgtcgaaaaaagaaa

SEQ ID NO: 4584 - DNA, 1554 bp, Ambrosia trifida
ttatttattcttcttcttacaatccattttcaatcttattattaggttttgtgatggaaacatcagcagcaggagttgttggcgttgcttcgacggataattcgaattctgtttcctctcaaacgacgtcgtctcagataatacgattcttacaatccccagtcactagtctgtttgaatactctggttttctacgccctaggttaattaacagtaacaccaacagtaacgaatatcatcgtagtgttagtttgagtgatttgagtggtgtagttggtgatagtgtcgctaggaataatgacaataatgatggtcaggtttcgattcggataatcggtgagggagacgaagagaggggagatgctgatggtgctggtagtaatagtggtttggatattaataataataataataataatgataataataataatgataatgataataatgggggcgattcgtcgaatcagcagcagaggtatgatttgcagcaggtttcaaggtggattgagcagattcttccgttttctttgttgttgattgttgtgtttattcgtcaacacctgcaagggttctttgtaacaatatatgtaactgcttttatgtacaagtcaaatgacattcttcgtaaacagacagctttaaagggggagagaaaattatctgttcttgtcggctatagtgtaatttttatgctacatgtggttggagtatactggtggtatcaaaatgatgatcttagctacccattgttcatggttccgccaaaaacaataccgccattctggcatgctatattcataataattgtaaatgatacaatggtccggcaggcagctatgactttaaaattggtactgcttatgtactataagaatggcaggggccataatttccgtaggcagggtcaaatgttgacactggttgagtatgctctgttgttataccgtgcattcttgcctgctccggtttggtatagattctttttgaacaaagaatacgggagcctgttttcttccttgataacggggttatatttgactttcaagcttacatcagtcgtggagaaggttggatctttctatgctgcattgaaggctttatcacgaaaagaaatgcattatggatcatacgcaacaccagaacaggtaagtgaggcaggtgatatgtgtgccatatgccaagaaaagatgcaggccccaatattactatgctgtaaccacatcttctgtgaagactgtgtttcagaatggtttgaaagagagagaacgtgtcccttatgcagagccatggttcggccagctgacatacggtcatttggtgacggttccacaagtctcttcttccggctgttttaaacccgtgtatcgacacacatgtttctccataactgcttattttcttcagaaagttactacacccgtcaccatggagtctgcttggtttgttctcactcttaactgtagttagagtaattattttcttgcaatattttacttttcttcctgagttgtacagccgggctttcaacatttcactcaaaaatatatatat

SEQ ID NO: 4585 - DNA, 1155 bp, Centaurea maculosa
  misc_feature (499)..(499): n is a, c, g, or t
  misc_feature (504)..(504): n is a, c, g, or t
  misc_feature (536)..(536): n is a, c, g, or t
  misc_feature (646)..(646): n is a, c, g, or t
  misc_feature (657)..(657): n is a, c, g, or t
  misc_feature (660)..(660): n is a, c, g, or t
  misc_feature (676)..(676): n is a, c, g, or t
atggtgggatgctagtagtagtatcagaggtgttacggattccgtgagtgggaatgcggatgcagaggccgcagagggtgttggggttaacaacggcagagagtctccctaccagagatatgatatacagcaggctgccagatgggctgagcaggttcttccgttcagtttgttactgttggtggtcttcattcggcaacatttgcaaggcttttttgtcaccatctggattactgcttttatgttcaaatcgaatgatatgcttcgcaggcagacagctctcaagggagagaggaggatattatctctagcaagcatttctcttctgttcatgcttcatgtggctggggtttactggtggtatcgaaaagatgatctcctgtatccattagtcatgctccctccaaaaactataccacctttctggcatgcaattttcatagttatggtgaatgatactctagtgagacaagcagcaatggtgctcaatgctttctgntaatntattacaagaatagcagaggtagaaatcgccnaaagcagggtcaaatgctaactttggttgagtacttactgctgctataccgtgcattgctgcccgctccagtgtggtatcgcttctttttgaacaaagaatacggaagcntattttcgtcnctnatgactggattatatntgacattcaagctcacgtctgttgttgagaaggtccaatcgttcatttcagctataaaggcactgtcacgaaaagagattcattatggagcttatgcaacacttgaacaggtgaatgcagcgggtgacctttgtgccatttgccaagagaaaatgcacgctccagttgtgcttcgttgtaaacatgtcttctgtgaagaatgtgtgtccgaatggtttgaaagggaaaggacgtgtccattatgcagagcgatggtgagagctgcagatctgagatcgtttggtgacgggtctactactttatattttcagctgttttaaacatgcctgcaattattcttgttcatatatgatcatgttgtatgtaactcacttgaaatcactactaccctcatttcatgtacatgtatgtaactcacttgcttatgcatccatctataatgtaatttgatgcatacatttttggaacttttcatgtac

SEQ ID NO: 4586 - DNA, 1591 bp, Flaveria ramosissima
ttcaacacctgcaattcaatcttcgaagccattttctcttaattctttattcattgaatcattacatacatacattcacctgtataatcgctatcgaaccctcgttacctccaaatttgggtatttttgttaattgaacttgtataaggtgtaatcagaggggcttttatgcgtcaattgatggaaacatcaggtgtaagcgttgattccacgagttctgataatcatgtgaataacaatccgaattcatcaaatcctccatctccgacggtaaggaggagctcctctccgagaacgacgacgatgacgacatcgtcttctccgtttcctataatacggtttctacaagcacctgtaaccactttaattgaatattctggtgttcttcgacctaggtcgaacagcgatggtcaagaatcggagagtttgatttccaatcatcgtcgtcgagatcatagctctagtggttctagtgccgctagtaatcgcagtagtaccggtgatgatggtaacggtgaggtttcgattcggatatcgagtggtggaggccaagaagagggtcgagttgaaccgactccggtgaacactgttgatggtggaggagagagggaggctgctgattccggtggtgaaagtggtgagaatggtgggagtaataataacgtggattcagcataccaacaacggtatgatctgcagcaggtttcgaggttgattgaacagattcttccattttcattgctgttgttgattgttttcgttcgtcagcacttacaaggtatctttgttacgatttatataactgcgttcctatacaaatcaaatgatatcctacggaagcagacagcgttaaagggggagagaaagttatctgttcttgctggatactgcatactttttattcttcaagtgattggagtttactggtggtaccaaaacgatgatctttgcaatcctttgttcatgcttccaccaaaagcaataccaccattctggaatgctatattcaccatcattgtaaatgataccatggtacgacaggcagcaatggcttttaagttggtattgcttatgtactataaaaatggcagggggcatagttttcgtaggcagggtcaaatcttgactctggttgagtacgcccttctactataccgtgcatttttacccgcccctgtgtggtaccgattctttttgaacaaagaatatgggagtctgttttcatctttgactacagggttgtatttaaccttaaagctcacatcagttgttgagaagattggatctttctatgctgcattaaaggcactatcacgaaaagaggtcaattatggaacacatgcaactgcagaacaggtgagcgaggcaggagacgtgtgtgctatttgccaggaaaagatgcaggctccgattttattgcgttgtaaacatatcttctgtgaagactgtgtttctgaatggtttgaaagagagagaacttgtccattatgccgagctttggtaagaccagcagatatacgatcattcggggatgggtcaacgagtttgttcttccagttgttctagaagtttctgtttgactgtgtgcttt

SEQ ID NO: 4587 - DNA, 770 bp, Triphysaria pusilla
aatcagcaatgttctcaaaattgtttctgctaatgtattataaaaacggaaaaggccacaattttcgtagacagggccaactgttgacccttatggagtacacattgttgctatatcgagctttgttaccaacacctgtatggtatagattcttcttgaacaaagaatatgggagtctattttcatcgctgacaacaggcttgtatttaactttcaagcttacgtcaattgttgagaaggtccaatcctttgttatgtcgttgaaggcattatcaagaaaagaaatccattacgggttttgtgcaacttcagaacaggtaaatgcagccggggatttatgtgctatatgccaggaaaagatgcatgccccaattttactgcgttgcaaacatatattctgtgaagactgtgtttctgagtggttcgaacgggagagaacgtgccctttatgcagggcacttgttagaccggctgaacttcgatcctacgccgacgggtcgacaaatctttccatccagttgttttagtcttcgaatcaaccttctcaaatttccatcaccttatatatatgtctatattttttttttgggataattgaaaaaaagaccctgaggtttggtctaattacacgaatacccacacaggtttctgacgataatttcaaattatgtgaactgttatagggacatatacgaattgtgcagtcaacgtatgggattatagttgtaattttgttttgtgaattaatcatctctgaaatgtaaaatagt

SEQ ID NO: 4588 - DNA, 1703 bp, Cirsium arvense
ttatcacaatccattgactatgtatactttcctgtaaatttcgtccttctttcgatcaatttgcagactctgtagctcagatcgttcatcgtttgaaggaattactaagaaattcgaaaggttagggttttatatatatatatatatatagatatagaatcgattgatggaaacagtaggtggtgttggtgtttccacggccaattctgatgcttatgctactaattcaagctcagtttcgtcaaatcctccatctccgacggctagggctagttcttcttcccgtagggtttcgtcgtcttcctcgtttcctatagttcgattcttgcaagctcctgttactactattttcgagtattcaggttttctacgccctaggtcaagcagcagcgagtatcatgaatcggagggtttgattccgcatagtcgtggttcggttgattccggtgatgtttctagtagtggtggtaatgaaggggaggtttcgattaggataattggggatggagagcaggaaggggaacatggtggagaatctggtggtgtagatggagatggtggtgggagggagatggatgattctagtgatgttgatggtaggagtggtggtggtaatgggagtagtaataataatagtaatggtggtgattcgtcgaatcaacagaggtatgatttgcagcaggtttcgaggtggattgagcagattcttccgttttcgttgctgttgattgttgtgttcattcggcaacacttgcaaggtttctttgtaacaatctatgtaactgctttcatgtacaagtcaaatgatattctccgaaagcagacagctttaaagggggagagaaagttatctgttcttgttggctatagtataatttttatgcttcatgtgattggagtatactggtggtatcagaatgatgatcttagttacccattgttcatggttccgccaaaggcaataccaccattctggcacgctatatttataataatcatcaatgatacaatggtgcggcaggcagcaatgactataaagttggtactgctcatgtactataagaatggcaggggccataattttcgtagacagggtcaaatgctgactctggtagagtacggcctgttgttataccgtgcattcttgcctgctccagtttggtaccggttctttttgaacaaagaatatgggagcctgttttcttctttgataacagggttatatttaaccttcaagctcacgtcagtggtggaaaaggttggatccttttatgctgcattgaaggctttatcacgaaaagaaatgcattatggatcatatgcaacatcagaacaggtaagtgaggctggagacatgtgcgccatttgccaaagaaaaagatgcaacgccccaatattgctatgttgcaaccacatcttctgtgaagactgcgtatctgaatggtttgaaagagagcgaacatgcccgttatgcagagcgctggtgagaccagccgatatacgatcatttggcgatggctccacaagtcttttctttcgcttgttctaaacttccttcggtctgattgctgctgcatttatttgattataaccggtaattattttcttctttttcccaagttgtacagctgagtcttttgaatgtaaagtattctgatcctataacaatgatattaatttattaatacccaagagaggaaata

SEQ ID NO: 4589 - DNA, 896 bp, Helianthus annuus
caatggcttttaagttggtattgcttatgtactataaaaatggcaggggccatagttttcgtaggcagggtcaaatcttgcctctggttgagtacacacttctattataccgtgcgtttttacctgcccctgtttggtaccggttctttttgaacaaagagtacgggagcctgttttcatctttgacgacagggttgtatttaaccttaaagcttacatcagctgttgagaagattggatccttttatgctgcattaaaagcactgtcaaaaaaagaggtcaattacggatcacatgcaacagcagaacaggtgagcgaggcaggagatgtgtgtgctatttgccaggaaaagatgcaggctcctattttgttgcgttgtaaacatatcttctgcgaagactgtgtttcggaatggtttgaaagagagagaacttgcccattatgtagagctttggtgagaccagcagatatacggtcatttggggacgggtcaacgagtttgttcttccagttgttctagaagtttccatctgggtatgcgaactgtgtgctttcttcattgagtttgatcttcaattacccagagttatcgctgcattacctttttggcgtatttcccccctcaaactgtacagtagagctttacttgtggctctaatattaccagtaatatattgattgatacacacaatatacatacaacagtctataatgataaaaaaaaacatgattgttatcttgattgagctcaaactgttgaaataatggttaagacctgcaagtatgatggtcccttagcaaaatgaactacctttatgtaaaaaccaagtcttaaatacactcacaatgtttgaagctttgagaaacaaagtgattcacaatgttgcaaattaag

SEQ ID NO: 4590 - DNA, 1743 bp, Ambrosia trifida
cagctatcacacgttactccagttttaatgcaaattcagttcttttccaataataacttttctatttcctccctccttcctgaatccaactcaaaactttgttatcggtaccaaaccctaacattcgattgttgtaattcataaaacaatctgttcgttgaggaagccaagggcattttggtaattttggaacacctgaacgatcgattgtcggtttctaacccttgctatttgttgattttattattaattgagcgtttaatcaaagggtttttgtatgcgtcgattaatggaaacatcaggtgttagcgttgttgattccaccacttctgataataataataatattaataataataataatcatgagagtaataatcaaaattcgtcaaatccttcgtctccaacgataaggaggagttccttgcaaacgacgtcgtttcctgtaattaggtttctgcaagcacctgtaactactttaattgaatactctggtgttcttcgacctaggtcaaccaatgattatcaggaatcagagagtttgattgctaatcatcatagccctagtgatgttaacagtagtaatggtgataatggaaacgatgaggtttcgattcggatatcgagtggtggaggacaaggagaggagcatagtgaaccgaattcggtgaaccgtgttgataatggtggtggaggagatagggaaggttctgattctggtgatgtaagtggtggcaatggtggaggcactagtataataataataataatgtggattcggcgtatcaacaacggtatgatttgcagcaagtttcgcggtggattgaacaaattcttccgttttcgttgctgttgttggtcgttttcattcgtcagcacttacatggtatctttgttacaatatatatagctacgtttatgtataaatcaaatgatattctacggaagcagacagcgttaaagggggagtagaaagttatctgttctttctggatattgtgtacttttcatgattcaagtggctggagtttattggtggtaccagaacgatgatatttgcaatccgttgttcatgatgccaccgaaagcaataccatcgttttggaatgctgtattcactattgttgtaaatgatacaatggttcgtcaagcggcaatggcttttaagttggtattgcttatctactataaaaatggcaggggccatagttttcgtaggcagggtcaaatcttgactctggttgagtacacacttctggtataccgtgcatttttacccgcccctgtttggtaccgcttctttttgaacaaagaatacgggagcctattttcatctttgacaacagggttgtatttaaccttaaagcttacatcagttgtcgagaagattggatccttttatgctgcattaaaggcactgtcacgaaaagaggtaaattatggatcacatgcaacagcagaacaggtgagcgaggctggagacgtgtgtgctatttgccaggaaaagatgcaggcgcctattttgttgcgttgtaaacatatcttctgtgaagactgcgtctcggaatggtttgaaagagaaagaacttgcccattatgcagagctttggtgagaccagcagatatacgatcattcggggatggctcaacgagtttgttcttccagttgttctagaagtatgaggaccatcagggtatgaggactgtgtgcttttttcattgagttttgatcttcagttgccc

SEQ ID NO: 4591 - DNA, 957 bp, Ambrosia trifida
gatgcaagagcattgtgaatgcacgttgccctatgtacaaccaaattaagctttatgtttctttgtaacaatctacgtaaccgctttcatgtacaagtcaaatgatattctaagaaagcagacggctttaaagggggagagaagattatctgttcttattggctatagtatgatctttatgtttcatgtggttggagtctactggtggtatcagaatgacgatcttagctatcccctgttaatggttccaccaaaaacaataccgccattttggcatgctatattcataataattgtaaatgatacaatggtccggcaggcagctatgactttaaagttggtgctgcttatgtactatagaaatggcagaggccataatttccgtaggcagggtcagatgctgacactggtagagtacaccttgctgttataccgtgcgttcttgcctgctccagtttggtaccgattctttttgaataaagaatacgggagcctgttttcttctttgataacagggttatatttgacttttaagcttacatcagtagtggggaaggttggatccttctatgctgcgttgaaggctttatcacgaaaagaaatgcattacgggtcatatgcaacaccagaacaggtaaatgaggcaggtgacatgtgtgccatatgccaggaaaagatgcaggcccctatattgctttgttgtaaccacatcttctgtgaagactgtgtttcagaatggtttgaaagagagaggacgtgccctttatgcagagctctagtcagaccagctgacatacgttcgtttggtgatggttccactagccttttcttccggttgttttaaaattcaaatatcaccacccgggtctctgtgtggctgttgatgtttcttcaggtggctgctcttcgccatagagtctgcttggttcagtctcactcttaaccagggttatggtt

SEQ ID NO: 4592 - DNA, 3001 bp, Ceratodon purpureus
cggggtcaaactacgcattgagacgaaaccctcgacacacacatcatcgtctccgcgcatcgccatctccatcgccatcgccatcgccattttcttccgcgggtcgcacctccgtgacgtcaagctccgcggcggtcctctcggccacgcgcttcctgtcattttgagccgcgccgagagaaatttcgtccagtatcgaggccggtaggtccgttggaaggttcctgcgggccagtggcattgtggtttggtgtggcgtcgcgatttcgccgtcgtggtcgtgatcgttcggtgacacggcgtgtcgtggagtggaggatggatggacgcgacggccggccatttggattcgtctgttcgagaattcggagctagccagggtttgaaggttgattgttgggaggagttttccggcggtgtggtgcgggttggatcggcggcgtttcgtggagcggttttgactcgttgtggtgttgtccgggttatggcgacgtgagcgtgagtagccgtgaattgatttgtgattatcgaggttgttctgtgggaattccgcggtctcggtgcgacggattggagcaggtttatggaataagagtgcgtggcagggcttgcggctggcgctttgcatgaggatacgttataacgcatgtgactcggagtggttggtcgcgtgtgttgatgtcggtaaactagggtttccagggtgttttcagtggatttgttcacttcggagattatttgcattgtgattaagttgtattggttgtattggaagcgtagcgcggctacaacgaggttcaattttgagaactactcttttgcctacggggattgaatgattatatgatgggcgcttggattcacttgtgaggaaacgttgttttaacgacggaattacgccttttcatttggttcttctgcaagtctacgttcagctggcgagcaccatgctctgaagcatgctacagttcatcacttggagaatttgcaaatattctgtttagcactgaaggcgttacagtgaggacgcaccttggatttgaactttggctgtcccatggagtagcctccgtgtagttgtagttgtagttgtaggtgctgcatatacataacaattgattttatcagaggagaaattatcgttaagtttcaatcaaggtcgaccagatctttgtatcgttagtatataactcaagactgcgatcaacatggagagttctggatcaattcccgaagtgcatcgaagtagtagttcctctaggagatatggcatgcagctcacttccgcgaacttcctgcctgcacccctatccgccttgcttgaattcactggtctaatgcgtggtcgagctcaccaatcagagagtgaacaggaggttgccatgtctactggctcagtgggacaaaactctgatggtgaaagagctggtgacggaggtgccgaggtttcaatcaggatatttggcgttggagagcccgagcaggtccgggtcgcgtcttctccagcagtcctcaatgctaggagttctaccgacttgagtagtcagtcgctgcctactcttcttcctatgcgcatagcaggcaatgaaagcagccctaatactgcaatctcgccacattcatcaagtgcagaggagagaggagaggcatcggatactgaagcagctggaaatggtagagaagctgcttctcagaggtatgattttcagcagttggcacggtggattgagcaggcgttacctttcaccatattgctgttgatggtcttcatccgacagcatctgcaaggattctttgtggcattttggataacagccgtcatgtttaaggcaaatgacgttcttcgcaagcagacagcattaaagaatgagagaaaacctcccgttcttattgctttgggatgggtcctcgtggtacatattattggagtttactggtggtacagcggtgatgccctgtggcgtccgctgattctttttccaccccgaacaatccctccattttgggatgctatattcatcattgtcgtcaatgatactgtcgcaaggcaggcggcaatggtcttcaaatgtggtgttcttatctactataagaacagtagaggtcggaattatcggcgccaggcccagctgttgactcttgttgagtacgttttgctactataccgtgccttaataccaggaccagtctggtacaggttcttcttgaacaaaaattacggcaatttattctcatcccttacaactgggttgtacttaacgttcaagctgacgtccaatctcgagaaggtgcaaacatttttggcagcactacgagcattgtcgcgtagggaagtgcagtatggatcttacgcaactagtgaggaggtacttgcagctggagatatgtgcgcgatatgtcaagagaagatgcatgctcctatatcactccgctgcaaacacattttctgtgaagattgtgtttctgaatggtttgagagggagcggacatgtcccttgtgtcgggccgtagtaaaatcggcaggtctgcgctcctatggcgatggctcaactagcctcttcatccagttattctagagcttgatgtcactgctcacgttagtataattctacaagggcgaagacagccgaaaagagtgcactttggaacttgcctttcccttccgaggtcgttcagatctctctgcttgtgcactccgttgcatgattgaaagcatcggacggccagaaagctagcgttacagcttgaccccctcactcgaaacactggaaactaccaggagtttgataagctgagtgtcttcgtgtggggagaactttacgcctgagtcacgttctattcccatcttgttcgccatgaaacaccgcgcgagctgtggatcacgagagcactcgagtagcgatgcatgggtaactgaccctgcaaaaacgtcagtgatggggatacattcatatgctctcccacgggccttgtaagaaaattattttcgataatgtgggca

SEQ ID NO: 4593 - DNA, 1817 bp, Flaveria ramosissima
ctcttcaattgcccttctgtcttcactgtttccccaaattcaaccatcatttctcctattattcattcatcgattctactcttcttcatctcaaatcccatcaaacaaccctaaaatttctttaatctcccaatcacaatcataaagtcatcatcttgattcaaccctttgacttttcccctctaatcatcgtcaccacatatacttttctgtaaatttcgtccttctttcgaccaatttgtagagtgtgtagctccatgattagcgtgtgaacgaagaaataagcgatttcaagattagggttttctttatcattgatggagacagctgctacgacgaattcggatgcttatgtcagtaatccgttgaatacttcatctataacgacaccatcttcatcgtttcctgtagtaagattcttacaagctcctgtaaccactatattcgaatactctgggtttctacgacctaggtcaagcaacgattaccatgaatcagagagcttgatttcgcacagtaatattcataattcgagtgattccggtggtaatgagggggatgtttcgattcggattatgggtgatggtgagcaagaggaggaacgtggtggtgatggtggtgaatcgtggtgttaggcggagatgatggtggtggtggtggagagagggagatggctgataccagtgatgttgatggtaggagtaatggtaacagtgattcatcgaatcagcagaggtatgatttgcagcaggtttcgaggtggattgagcagattcttccgttttcgttgttgttgattgttgtgttcattcgtcaacacttgcaaggtttctttgtaaccatctatgtaaccgctttcatgtacaagtcaaatgatattcttcgaaagcagacagctttaaagggggagagaagattatctgttcttattggctatagtatgatttttatgcttcatgtggttggagtatattggtggtatcagaatgatgatcttagctatccgctgttcatgattccaccaaaaacaataccacctttttggcatgctatattcattataattgtaaatgatacaatggtgcggcaggcagctatgactttaaaactggtactacttatgtactataaaaatggcaggggccataatttccgtaggcagggtcaaatgctgacactggtagagtatgccctgttattataccgtgcattcttgcctgctccagtttggtaccgattctttttgaataaagaatacggcagcctgttttcttctttgataacagggttatatttgacgtttaagcttacatcagtagtaggaaaggttagatccttctatgctgcattgaaagctttatcacgaaaagaaatgcattacggatcacatgcaacatcagaacaggtaagtgaggcaggtgacatgtgtgccatatgccaggaaaagatgcaggcccctatattgctgtgttgtaaccacatcttctgtgaagactgtgtttcagaatggtttgaaagagagagaacgtgccctttatgcagagctctggttagaccagctgacatacggtcgtttggagatggttccaccagtcttttcttccgggtgttttgaaatacaaatatcatcactcaggtttctctgtggctgttgatgttttctagtcacgctcatcaccatggagtctgcttcgttaagtctcgctcttaactaaagttcatgagtgatttttattttctaagttgtacagctgagcttctaatatatctcaacgagaaatataagatgcaagaggatccttgaatacctactgttt

SEQ ID NO: 4594 - DNA, 1797 bp, Flaveria ramosissima
ttatttccccaaattcaaccctcattttctcctattattcatcgattctactgttcttcatctcaaatcccatcaaacaaccctaaaatttctttaatttcccaatcataatcataaagtcatcatcttaattcaaccctttgacttttcccctctaatcatcgtcaccacatatatttatctgttaatttcttggttctttcgaccaatttgtagagtgtgtagctcgatgatccttgattagcgtgtgaacgaagaaataagcgatttgaagattagggttttctttatcattgatggagacagttgctacgacgaattcggatgcttatgtcagtaattcgttgaatacttcatctacaacggcatcgtcttcttcgtttcctgtagtaagattcttacaagctcctgtaactactatattcgaatactctgggtttctacgacctaggtctagcaacgattaccatgaatcagaaagcttgatttcgcccaataatattcataatccgagtgattccggtggtaatgagggggatgtttcgattcggataatgggtgatggggaacaagaggaggaacacggtggtgatggtggtgaatccgtcgtgttaggcggagatggtggtggtggagagagggagatggctgattccagtcatgtggaaggtaggagtaatggtaacagtgaatcatcgaatcaacagaggtatgatttgcagcaggtttcgaggtggattgagcagattctgccgttttcgttgttgttgattgttgtgttcattcgtcaacacttgcaaggtttctttgtaaccatctatgtaaccgctttcatgtacaagtcaaatgatattcttcgaaagcagacagctttaaagggggagagaagattatctgttcttattggctatagtatgatttttatgcttcatgtggttggagtatactggtggtatcagaatgatgatcttagttatccactgttcatgattccaccaaaaacaataccacctttttggcatgctatattcattataattgtgaatgatactatggtgcggcaggcagctatgactttaaaactggtactacttatgtactataaaaatggcaggggccataatttccgtaggcagggtcaaatgctgacactggtagagtatgccctgttgttataccgtgcattcttgcctgctccagtttggtaccgattctttttgaataaagaatacggcagcctgttttcttctttgataacagggttatatttgacttttaagcttacatcagtagtagggaaggttagatccttctatgctgcattgaaagctttatcacgaaaagaaatgcattacggatcacatgcaacatcagaacaggtaagtgaggcaggtgacatgtgtgccatatgccaggaaaagatgcaggcccctatattgctgtgttgtaaccacatcttctgtgaagactgtgtttcagaatggtttgaaagagagagaacgtgccctttatgcagagctctggttagaccagctgacatacggtcgtttggagatggttccaccagtcttttcttccgggtgttttgaatataatatcatcactcaggtttttctgtggctgtcgatgttttctacagtcacgctcatcaccatggagtctgcttcgttaagtctcgctcttaactaaagttcatgagcgtatttttttttctttctaagttgtacagctgagcttctaaatatatctcaaggagaaattataagatgcaaaggggattccttagaactacctact

SEQ ID NO: 4595 - DNA, 1911 bp, Lotus japonicus
atggaaactttggatggtaattcagaccaatacgccactgtttcttctaattcaccatcgtcatcatctggagggtttaatagtagtgatgatcacaacaatggtagtgtgtcttggtatgggatgaggttaccttctgttaaccctttacggtccccgctttcgttgttgttggattactctggcattttaacccaaacccatgattctgggtctgtgattgtcaacaatggtgttccggcttcggagattcggtctcaggttcaaatgcagccatttgatgatgctgtggggggtagtgcaggggaagttgcaataaggatcattggagctggggagcatgatcagaatcagattggggaagtggggtttgatggttgtgataatctgatgggtgagagaagaggtgctggaatgtctccgttggacgatgatcctgagggtcgtggtggagctgcggttaatgagacggttcctttggtgtcttcatcggcttcgttggcaggtagtgtacagggtgatggtgatgctgctgggaatggtgcagaaagtgacagcaggggttcatcatcctaccagaggtatgatattcagcaggtcgcaaagtggattgagcagattcttcctttctcactcttgttgttgattgttttcatcagacagcatttacaaggtttctttgtcactatttggatatcagctgtgatgttcaaatcgaatgaaattgttaagaagcagacagctttaaagggagataggaaagtgtctgtacttgtcggtatctcttttgctttcattcttcaggtcacatgcatttactggtggtatcgaaatgatgatctcttatacccactaatcatgcttcctcctagacctacacctttctggcattcagtattcatcatcttggtcaatgatgtattggtgcggcaagctgcaatggttttcaagtgtttcctgcttatatattacaaaaatggcaaaggtcataacttccgccggcaggctcaaatgttaactttggttgagtacatgctgctgttgtatcgtgccttattgccaacactggtttggtaccggtttttcttgaacagagattatggcagtctcttttcgtcactgactacagggctttatttaactttcaagctaacatctatcattgagaaggtccgaggcttcatttctgccttcaaagcattgtcaagaaaggatgttcattatggggtttatgctacaatggaacaggtcaatgctgctggcgacctatgtgctatatgccaggaaaagatgcattccccagtcttgttgcgctgtaaacacattttttgcgaggagtgtgtatcagaatggtttgagagggaaaggacttgcccactatgcagagcattggtgaaacctgctgatcttcagacctttggagacggatcaacaagtctgtttttccagttgttttaaacacatggtctttcggttggatcatagttttgggccaccctccgccttaaaactatcgggtttattgctctaatttgataagatttttcatccatcgattctggggaaataagattgtagggaatcatcagggcatggctttcggctaaggattaaaagttagcgttctcttgtgacgatgtcacatgtacaaaggacttcactcagctgccacatactaaaatttgagggaatttactaacctgatatgttccacacatcagtgtgatgaacacaaatttgttcataacgttgaatcattttgaaattcatctacctcccccaaccccaccaccctttttcaaagtatgtatatgtttctatacaggctttttgcaaatatgtcatatgagttgttcttgcacttggaagtgctgaaaattgttatttatataagaaatttggatttggatg

SEQ ID NO: 4596 - DNA, 791 bp, Utricularia gibba
tgggtgatggacttttttacactttagtaatgattcctccaaaggcaatccccgcccttctggcatgcgatattttattatccttgtcaatgatacaatggtgcggcaggcggctatggtcctgaagttggtaatcttgatgtattacaggaatggtcgggggcacagcttccgcaagcagggtcaaatgttaacactggtggagtacgccctaatgttgtaccgtgcattgcttcctacacctatttggtatagatttttcttgaacaaggagtacgggaatctcttttcctcactcataacaggcctctatctgaccttcaaacttacatccgttgttgagaaggtacggtcattcttcatttcattgaaggcattatcgagaaaagaaattcactatggctcttatgcaacattggaacaggtgaatgctgctggggatatgtgcgctatatgccaggagaaaatgcattccccgatactcttgcgctgcaaacacatattctgtgaagactgtgtctcagaatggttcgaacgtgaacggacctgccccttgtgcagagctcttgttcggccagctgacattcgatcgtatggtgatggatcaacaactctctttttccagttcttttagtaacccctcgaaactggaaagcagaaaaaaaagaacactaatacgccaaacgaaaaagtgtaacagggaaaaccacttggttttgtccacaactatttttcttgtgttatgtgtacaggaagaagccatccttatgcccttcgtgaaacgtcttttt

SEQ ID NO: 4597 - DNA, 787 bp, Malus domestica
atgcttactctggttgagtatctactgctcttgtaccgtgccttgttgccaacaccagtgtggtaccggttcttcttgaacaaagaatatgggagtctcttttcgtcactaatgacagggttatatttgactttcaagctaacatctgttgtcgagaaggtgcaatccttctttgctgcattgaaggcattgtcacgaaaagaggtgcactatggggcatatgcaacttcagaacaggtcaatgcagcaggtgatctatgtgctatttgccaagagaagatgcatgctcctatcctacttcgatgtaaacacatcttttgcgaggactgcgtatcagagtggtttgagagggaacggacgtgtccgttgtgcagagctctggtaaaacctgcagatctaagatcattcggcgatggatcaacgagtttgtttttccagctgttctaaagccgtccactgtaaagaaaaaaagagaggagtttttctgttttggagttccaattcatatccaaagcagccatctcccaaatccatatcctcataactatacactggtatattcgattgtcatttttgctccgccttgttcacgggtttgccctcgcaaaaaaattacaacggctgggtataaccgaactgggtactgtttatacgttgtatcgagcaaaggtcaaatgtatgtaatgctccatatataactgtttatttgccgtggatcataccttccttcctccccttagactttgtcgaacgtatttggtgaattggcatcacgtcgtccgccaat

SEQ ID NO: 4598 - DNA, 752 bp, Eschscholzia californica
caccatggtgcgtcaggcggcaatggtcctcaagtgcgcagtacttatttatttcaagaatagcagagggcataattatcgtaagcagggtcagatgctaacactggttgaatacatgctgttgctgtatcgtgcattgttaccagctcctgtttggtatcgcttctttttaaacaaggaatatggaagcctcttttcatcactaactaccggattgtacctcactttcaagctgacttcggttgttgagaaggtccagtccttttttgctgcattgaaggcattgtctcgtaaagaggtgcactatgggtcttacgccacgactgaacaggttattgcagcgggtgatctatgtgcaatttgccaggagaaaatgcaagcaccagtcttacttcgatgtagacacatcttttgtgaagattgcgtatcggaatggtttgagagagaaaggacatgcccattgtgtcgggcgctggtaaaaccagcagatatcagatcatttggtgatggatcaaccagtctcttcttccaattattctaataacaccagctattcactcacattgcacatggtggaatgcagaggagaacattgacaaatcatgacgacccctacccgctactccctgtgattatgcggttagcaacaggaactcgcttaaatgtattttgcatacccttaactgtcaactgtccatacaagccgataaagaaaaatgtaagttgtctatattgttgttatatgatgatga

SEQ ID NO: 4599 - DNA, 1072 bp, Cannabis sativa
ctgctctggatttttcaatattggttgcttccatcttgaaaaatgagaatcgtctttttgcttcatctttagtcttttctcttaatggatctttatgtaattctgtgcacttgtctatgttttggctttcattattgtcttttaattcctacactcgctgttgcattgtcattagatacactggtgaggcaggtggcaatggctttcaagtgtttgctgcttatatattacaagaatgggagaggctataacttccgccggcagggacaactgttaaccctgcttgaatatgcattgctgttgtaccgtgcttttttaccaacacctgtctggtatcgcttcttcttaaacaaagaaaatggaagcctcttctcatcactaaccacaggattgtatctaacgtttaagcttacatctatagtcgagaaggttcaatttttctttgctgctgcaaaggcattgacacggaaggaactccaatttgggtctcatgccacaccagaacaggtaaatgcagctggagatctttgtgctatttgccaggagaaaatgcatgctccaattcttttgcgttgtaaacacatcttctgcgaggactgtgtttcagagtggtttgagagagaaaggacttgtcctctatgcagggcaatggttaaacctcctgatttacgaactttcggggacggatcaacgaatttgctgtttcagctattctgaaaatcaaaggtctctgttttgttttacaagcagccgccttcaattaaaggagccatttcgtctcatcagctagtggtatatatgtatacttggttacacaatctcaccattaagttgcctccaaaatattcgatggaaggtactatcaaagtccaatacgaacagatagtccatgttttcctagtcatactcaaaaagaaaaaaaactgatgagatggttaaatactgtatcctcatcgacacagattttgaattattttttctataatacgaatcccataccaatcttttgtatatacattatatagaaaacttcattcctctgctccaaaatttgcctaaatgaaaatcttcc

SEQ ID NO: 4600 - DNA, 2331 bp, Cannabis sativa
ttggtcatcgttctcgcatactggtcttcgatcggtattgtgaaagccttcattctcggacgtgtataataataatgcccaacgcaaacgccattgttttcaacgtaacaaactcatctcacatctaaataccttcggttatctgtcctcaacacaaaatatacattatttatttatttatttttaattatcttctattacttattaacccactagtacaattaaacaaatttattttttttcttttgtaaattttaatacgcaatttgtttatttccgggaattcctcaaagtgtgatctgtgaaaaagttgtttcacaaatcaaaatcccctaaagacctcgttttgcgccagtctgagatgaacactcgtcgttttatacgtttccgcttaatttgattgtcgttttgtgaacctctgtagtccgtttcgtttctctcctttcttctctccgttctcatctccctaaccgatcacaaacacaacgaagcattgaaaagaagagagaggagagagaaaggttaaagcttaaaaaatggaggtgtctggtaacgcttctgaaccctacgaaaacagtggtagtccgagaagaggtggtgttggtggtggcatgttgaaccatctgcctcccctcagtttgtttcattcgccgttatcgtttttgttggagtattccggtatacttccggtgaggtcaactcaccgggatagcgaggaggaagcggtcaatagcgttggcgctgttactcctgattcgccgcctacctcccctgctccgtgtgcagctggcggaaccagcggcggtgactcggctgaggtttcgattaggattatcggcggtggagagcaggaggataggtctatttcttctccgcggcgtagcggagaaggaggtgtggatggggatggttcgttgagaatgcatgaattggatgatcagcctggttctgcacgagttggcagcggcgcaggagttgcggaggccagcgggagagcgcccttggtttctccttcgtcgtcggtacccgtatctcgttccggagtttcgtctcttcaggatgagtcttcttcccagagttacgacattcaacaaattgccaaatggattgagcaaattcttccgttttcaattctcttgttggtggtcttcattcgtcagcatttgctaggtttttttgttacaatatggatatcagctgttatgtttaaatctaatgatattgtgcggaggcaaacagctttaaagggagaaaggaaaacttatgtccttcttggcatttttagcgcttttatgcttcatgtggttggtatttactggtggtttcaaaatgatgatctattatatccgttggtcatgcttcctccgaaagcaataccacctttctggcatgctattttcatcgttttagtgaatgatacactggtgaggcaggtggcaatggctttcaagtgtttgctgcttatatattacaagaatgggagaggctataacttccgccggcagggacaactgttaaccctgcttgaatatgcattgctgttgtaccgtgcttttttaccaacacctgtctggtatcgcttcttcttaaacaaagaaaatggaagcctcttctcatcactaaccacaggattgtatctaacgtttaagcttacatctatagtcgagaaggttcaatttttctttgctgctgcaaaggcattgacacggaaggaactccaatttgggtctcatgccacaccagaacaggtaaatgcagctggagatctttgtgctatttgccaggagaaaatgcatgctccaattcttttgcgttgtaaacacatcttctgcgaggactgtgtttcagagtggtttgagagagaaaggacttgtcctctatgcagggcaatggttaaacctcctgatttacgaactttcggggacggatcaacgaatttgctgtttcagctattctgaaaatcaaaggtctctgttttgttttacaagcagccgccttcaattaaaggagccatttcgtctcatcagctagtggtatatatgtatacttggttacacaatctcaccattaagttgcctccaaaatattcgatggaaggtactatcaaagtccaatacgaacagatagtccatgttttcctagtcatactcaaaaagaaaaaaaactgatgagatggttaaatactgtatcctcatccacacagattttgaattattttttctataatacgaatcccataccaatcttttgtatatacattatatagaaaacttcattcctctgctccaaaatttgcctaaattaaaatcttccggccactttacttctgct

SEQ ID NO: 4601 - DNA, 1294 bp, Helianthus annuus
atcagcagaggtatgatttacagcaggtttcgaggtggattgagcaggtgcttccgttctcgttgttgttgattgtcgtcttcattcggcaacacttgcaaggtttctttgtaacaatctatgtaaccgctttcatgtacaagtcaaacgatattctacgaaagcagacagctttaaagggggagagaagattatccgttcttattggctatagtatgatctttatgtttcatgtggttggagtatactggtggtatcagaatgacgatcttagctatcctttgttcatgattccaccaaaaacaataccgccattttggcatgctatattcataataattgtaaatgatacaatggttcggcaggcagctatgactttaaagttggtgctgcttatgtactatagaaatagcagaggccataatttccgtaggcagggtcagatgctgacgctggtagagtacgccttgttgttataccgtgcgttcttgcctgctccagtttggtaccgattctttttgaataaagaatacggaagcctgttttcttctttaataacagggttatatttgacttttaagcttacatcagtagtggggaaggttggatccttttatgctgcattgaaggtgttatcacgaaaagaaatgcattacgggtcatatgcaacaccagaaaaggtaagcgaggcaggtgacatgtgtgccatatgccaagaaaagatgcaggcccctatattgctgtgttgtaaccacatcttctgtgaagactgtgtttcagaatggtttgaaagagagaggacgtgcccattatgcagggctctagttagaccagctgacatacggtcgtttggtgatggttccactagtcttttcttcagattgttttagatttcaagtatcaccacccgggtttctgcttggttaagtctcactcttaaccgaggctatggtaattcttttcattttcttctcaaatagtacagctgagcttctgatatgtgacactcagaaatacgatatgcaagaggattctttaatgcctgctgtttgcttgcatttgtgcatagtgaaattggcaacaaaactagtgattaacagtaacatggatggagtcatttcacttactaccatggtttgtagtttgacttttgattgaaaaaggttatataaagatgtgtgtcaatgcttaataattttagtcaatacacgggtcaaagagtcatttcattgtttagccttttaaagcatcattttcgtgttgatcgtcatatcaaattcattacttgttgctc

SEQ ID NO: 4602 - DNA, 834 bp, Ambrosia trifida
aagtctaatgatattcttcaaaagcagacagctttaaagggggagagaaaactgtctgttcttgctggctattttgtagtttttgttcttcatgtgatcggagtttactggtggtaccagaatgaagatctttgttatccactgttcatggttccaccaagagcaataccacctttctggcatgctatatttaccatcattgtgaatgatacaatggtgcgacaagctgcaatggctattaagctggtaatgcttatgtattacagaaatggcaagggtcacaattttcgtagacagggtcaaatgctaaccctggtggaatatgcgtttctgttgtaccgtgcattcttacctgctccggtctggtaccggtttttcctaaacaaagaatacgggagccttttttcatctttgaccacagggttatatttgactttcaagcttacatcaatagttgagaaggttggatccttgtggactgcattgaaggctttatcacgaaaggaagtccattatggatcgtatgcaacaccagaacaggtaattgaagcaggggacttgtgtgctatttgccaggaaaagatgcaagctccagttttgttgcgctgcaaacacattttctgcgaagattgtgtttcagaatggtttgaaagagaaagaacatgcccgttatgcaggtcggtggtgaaaccagctgagttacgatcattcggtgatggatccacaagcctcttcttccaaatgttctagaaacagtgaaaaaaaagacgtttccttgacgcatctgcggtttccgtttgttttggttataaaatttacttcacatcattcttc

SEQ ID NO: 4603 - DNA, 578 bp, Flaveria ramosissima
aataccaccattctggcatgctatatttaccatcatgtgaacgatacaatggtgcgacaagcagcaatggctattaagctagtattgcttatgtattatagaaatggcaagggtcataatttccgtaggcagggtcaaatgctaaccctggtggaatacgcatcactgttataccgtgcattcttacctgctccggtctggtaccggttttttctaaacaaagaatatgggagccttttttcatctttgacaacagggttatatttgactttcaagcttacatcaatagttgagaaggttggatccttgtggactgcaatgaaggcgttatcacgaaaggatgtccattatggatcatatgcaacaccagaacaggtaatagaagcaggggatctgtgtgctatttgccaggaaaagatgcaagctccggttttattgcgttgtaaacacattttctgtgaagattgtgtttcagaatggtttgaaagagaaagaacatgccctttatgcagatctgtggtgaaacccgcggatataaggtcatttggtgatggatccacaagcctcttcttccagtt

SEQ ID NO: 4604 - DNA, 1170 bp, Helianthus annuus
atagtgattcattgatcagcagaggtatgatttgcagcaggtttcgaggtggattgagcaggtgcttccgttctcgttgttgttgattgtcgtcttcattcggcaacacttgcaaggtttctttgtaacaatctatgtaaccgctttcatgtacaagtcaaacgatattctacgaaagcagacagctttaaagggggagagaagattatccgttcttattggctatagtatgatctttatgtttcatgtggttggagtatactggtggtatcagaatgacgatcttagctatcctttgttcatgattccaccaaaaacaataccgccattttggcatgctatattcataataattgtaaatgatacaatggttcggcaggcagctatgactttaaagttggtgctgcttatgtactatagaaatagcagaggccataatttccgtaggcagggtcagatgctgacgctggtagagtacgccttgttgttataccgtgcgttcttgcctgctccagtttggtaccgattctttttgaataaagaatacggaagcctgttttcttctttaataacagggttatatttgacttttaagcttacatcagtagtggggaaggttggatccttttatgctgcattgaaggtgttatcacgaaaagaaatgcattacgggtcatatgcaacaccagaaaaggtaagcgaggcaggtgacatgtgtgccatatgccaagaaaagatgcaggcccctatattgctgtgttgtaaccacatcttctgtgaagactgtgtttcagaatggtttgaaagagagaggacgtgcccattatgcagggctctagttagaccagctgacatacggtcgtttggtgatggttccactagtcttttcttcagattgttttagatttcaagtatcaccacccgggtttctgcttggttaagtctcactcttaaccgaggctatggtaattcttttcattttcttctcaaattgtacagctgagcttctgatatgtgacactcagaaatacgatatgcaagaggattctttaatgcctgctgtttgcttgcatttgtgcagcatagtgaaattggcaacaaaactagtgattaacactaacatggatggagtcatttcacttactaccatggtttgtagtttgactttgg

SEQ ID NO: 4605 - DNA, 1174 bp, Phaseolus coccineus
ccattttcatcatcatggtcaatgatactctggtccgccaagctgcaatggtattcaagtgtatattgttgatgtattacaagaatagcagaggccgaaattatcgtaagcagggtcaaatgctgactttagttgaatatctccttctgctttaccgtgccttgttgccgacaccagtttggtatcgtttcttcctgaacaaagaatatggaagcctcttttcgtcactgatgacaggattgtatctaacgtttaaactcacgtctgttgttgaaaaggtgcaatccttctttgctgcagtgaaggcattgtctcgcaaagaaatgcactatggggcttatgcaacattagagcaggtcaatgcagccggtgatctctgtgctatttgtcaggagaagatgcatgccccaatcttactacgttgtaagcatattttctgtgaagactgcgtatcagagtggtttgagagagaaaggacctgtccattgtgcagggctttggtaaaacctgcagaccttaggtcatttggggatggctcaactagcttgtttttccagttattctgaaatcatacatataaatagaagccaggaagttttttctgctttgaagctttacattttcaaagcagcagttgtgatctatatacatcgccacatgtaaaatgctctggaaggaaatcgtggggatactgagaagatgaatgcagctgagtacacgcattcatataatgtactagtaaaaggtcgagtgtatctaaatgaccctgtaaactaggaagttgattgaaaatataattaaacacgactcttcatttgcaaggaatgaaggtctcttgctaaaaattgcatagctattccctcatatagtgccagtcaatctgtcaattttaaacttttttttacttttgaatttctcattatgtgggttttaatgcacacctcaaggagtgttgcccacgggcaggttatggttaaagatcacacacttcgtttcatgtattcaatcggtcaaattgtggatactagtttgtttttgaagtacttaatttgaccatgattatgtactgatcatcatgtacacaatagaaaagcttgtgcaccactttaatttgttgaaacaaatatcagctgttgatcatactcttgtttaatcatagaatccctttcttcct

SEQ ID NO: 4606 - DNA, 2003 bp, Lactuca sativa
gcccttggagacacggcccccactgaactacttgttctagatccaccccattttccgttttccattttcttttataatagtaatttctttcaatcttctccactttgcagccattacacgcttcttcatattcaattcaattctttattgtgttttcatttcctatcccaaatttgaattgaatctttcaactacgcaaaccctataattcatccccaaattctcatcaccacaatcttcgaatcactgattcaatatacgcatatcatatacacacattcatacacacacaaacgtctatatcgctacccaatctttcattatctcccattgctttgactttattttccttctgtttttctctctcaatttcataacatttcaagggtttcagagttttttctggattaaaggtgttttctacaccaattttaatggaaacaacaggtttgagcgttgataccaccaattccgatgcgtatgagactgataatttagcttcatcaaactctttaacaccgaggattacgagtcgaagtagttcttccaggaggatgacgccgtcttcttcgttttctgtaattcgatttctacaagcgcctgtaactactgtacttgaatattctggtgttcttcgacctaggtcaaacaacgattaccatgaatcagagagtttgattcatgatcatcatcatcatcatgatgcccgtagttcgagtgattcggatacggctacgagcagtaatggcgataatggggaggtttctatacggataatcggtgcggtagatccagaagaacaacatggtggggagggtggagaaccggtggccttgaatggcggcgataatgatggaggagagagagagatggctgattccaccgacgtagatggtgaaaatggcaggagtgggagtcatagtgattcatcttatcaacagcggtatgatatgcaacaggtttcgaggtggattgaacagattcttccattttctttgctgttgttgatcgtgttcattcgtcagcatttgcaaggtttctttgtcacagtctatgtaactgctttcatgtacaagtctaatgatattcttcgaaagcagacagctttaaagggggagagaagactctctgttcttggtggttattttatagtttttatccttcatgtaattggagtatactggtggtaccaaaacgatgatctttgttacccattgttcatggttccaccaagagcaattccaccattctggcatgctatattcaccatccttgtgaatgatacaatggtgaggcagacagcaatggcttttaagcttgtattgcttatgtactataaaaatggcaaagggcataactttcgtagacagggtcaaatgctgactgtgattgagtatgcactgctgttataccgtgcatttttacctgctccagtttggtatcgattctttttaaacaaagaatatggaagcctcttttcctctttgacaacaggcttatatctaactttcaagcttacatcaatagttgagaaggttggatccttctggactgcattgaaggcgttgtcaagaaaagaagtccattatggatcctacgcgacaccagaccaggtaattgaagcaggggacatgtgtgctatttgtcaggaaaagatgcaagctccagttttattacgttgtaaacacattttctgtgaagattgtgtttcagaatggtttgatagagaaagaacatgccctttatgcagagctgtggtgaaaccagcagaaatacgttcatatggggatggatccacgactttgtttttccagttgttttaatttttaatttttttttggtttataattcttgaaatacgcaagttataacccgaattacagtaaaagagtagagtcctaacatttttttttacactaaagctgtagttattaatgttttaatatatttacaatgtacatgagatacaattttcatgcattctgttgagttttgaaagtgca

SEQ ID NO: 4607 - DNA, 741 bp, Ambrosia trifida
aatagctatattcatcatcattgtaaatgatacgatggtgcggcaagcggcggatggcattaagttggtattgcttatgtacttaaaaaatggcagggggccatagttttcgcaggcagggtcagttgtttactctagttgagtacacacttctattataccgtgcatttttacccactcctatttggtaccgattctttttgaacaaagaatatggaagccttttttcgtctttgataacagggttgtatttaactttaaagctcacatcagttgtcgagaagatcggctccttttatgccgcattaaaggcactatcacgtaaagaggtcaattatggatcacatgcaacagccgaacaggtgagtgaggcaggagacttgtgtgctatttgccaggaaaagatgcaggctccaattttgttgcgctgtaaacatattttctgtgaagactgtgtttcagaatggtttgaaagagaaagaacatgcccattatgcagagcgttggtgagaccagccgatatccgaacatttggggatgggtcaacgagcttgttcttccaggtgttctaaaaatttccatctggatacgcaggccgtatgctttcttcagtgagtttgatctctgttctttgttcaatcacccaaagttatacaaccggtattgctacagtgaatttcggcatccttttccctcgaattgtcagttgagctttacttgtggctctagtatattgatata

SEQ ID NO: 4608 - DNA, 1612 bp, Arnica chamissonis
agttttctttgccctaatcttcttcttttttcggatttttgtctcaatttcatggtcttgcaggtgttttagagaaaattttcgattaaaagtgtgaattacgatttgaatttgtgttgtgtgcatcaattaatggaaagaatcggtgtgagcgttgatacaacgagttctgatgcgtttgtgagtgataatttagcttcgttaaacccgttatctcagtcttcagggattacgagcaggacgaattcttcgaggagaacgacgtcgtcctcttcgtttcccctaattcgatttctacaagcgcctgtaactactgtattggaatactctggtgttcttcgacctaggtcaaccaacgattatcatgaatccgagagtttgattcatgatcgccatcataatcatgatactcgtagttcgagtgattccgataccgctacaagtagtaatggtgataacggggaggtttcgatacggataattggtgctgcagatcgagaacaagaacatggtgcggacggtggtgaaccggtggctgttaatgccggagatggtggtagaggaggcggagaaacggctgattccagtgacgcagatggtgggaatggggagagtgggagtcatagtgattcatcgtatcaacagcggtatgatatgcagcaggtttcaaggtggattgagcagattcttccgttttctttgctgttgttgattgtgttcattagacagcatttgcaaggtttctttgtcacgatttatgtaactgcttttttgtacaagtctaatgatattcttcgaaagcagacggcattaaagggggagagaagactgtatgttcttgctggttattttgtagtttttgtgcttcatgtgattggagtttattggtggtaccaaaatgacgatctttgttatcctttattcatggttccaccaaggtcaataccaccattctggcatgctatattcaccatcattgtgaacgatacaatggtgcgacagacagcaatggcttttaagctggtactgcttatgtattatagaaatggcaagggtcgtaattttcgtaggcagggtcaaatgctgacactagtcgagtatgcactgctgttataccgtgcattcttacctgctccagtatggtaccgtttttttctaaataaagaatacgggagcctcttttcgtctttgataacagggttatatcttactttcaagcttacatcaatagttgagaaggttcgatctttatggactgcattcaaggcgttatcacgaaaggaagtccattatggatcatatgcaacaccagaacaggtaactgaagcaggagacatgtgtgccatttgccaagaaaagatgcaaacaccagttttgttgcgttgtaaacacattttctgtgaagattgcgtttcagaatggtttgaaagagaaagaacatgccctttatgtagatctgtggtgaaaccagcagatatacgttcgttcgctgatggatccacaagtctcttcttccagtggttctaaaactagagacttgtcaatgaaaatgagccatatatatttaatgttttgatacacattgtacatgaaatataaagcttcatgcatc

SEQ ID NO: 4609 - DNA, 1054 bp, Arnica chamissonis
tttttatgcttcatgtggctggagtatactggtggtatcaaaatgatgatcttagctacccgctgttcatggttccgccaaagacaataccgccattctggcatgctatattcataataattgtaaatgatacaatgacccgggagcagctatgactttaaaattggtactgcttatgtactataagaatggcaggggccataattttcgtaggcagggtcaaatgttgacattggtcgagtacgctctcttgttataccgtgcattcttgcctgctccagtttggtatagattctttttaaacaaagaatacgggagcttgttttcttctttgataacagggttatatttgacttttaagcttacatcagtagtggagaaggttggatctttttacgctgcattgaaggctttatcacgaagagaaatgcattatggatcatatgcaacatcagaacaggtaagtgggacaggtgacatgtgttccatatgccaggaaaagatgcgggccccaatattgctacattgtaaccacatcttctgtgaagattgtgtttcagaatggtttgaaagagagagaacatgccctttatgcagagctctagttagaccagctgacatacggtcgtttgctgatggctccacaagtcttttcttacggttgttttaaagttcatttatcgacacatgcacgggtttcaccatggcgtctgcttggttcattctcactcttaaccagagatcaagagaagttcttccatgcattgttttcttcttcccaagttgtacatcccatctcactcaaaaatacgtgttaccaccacaatttgtggtttctagtttgagtttagatttagaaggttgtatatagataatgagtcggtggttggtcaattctagtcgataaaccactcaaaaactggtctatatttggtttagtgtgcaaagtcctagcaatcacactcctaagaccctctgggcctggttttaggatgtattttctatctattgattagctagctaacatgcagcagggttgcttttacgactggtt

SEQ ID NO: 4610 - DNA, 1493 bp, Cicer arietinum
cgtgttgccgcaacatgatggtatcagaatcaccttcatcatcttgtggaggtttaattagcaacatcagtagtaacgttactggaattaggtctgtgatgagtttccattccgttatcaatttcctctcgtggtgattctaccgaggccgttaccgttatcatgtttcctagtacgcgccctcggtttcgagcttcttccgattctgattctgaggaagttttgctacgcaacggcgtggtgcgcgggaacagttcatctccccggaatcgggttggggaattgaactgtaatgacgtgatcggcggtggtcgtggtatgttgttgtcggaggaggctcgccgtgccatcgctgaggagagagttccactcgcgtctttggccagtgttgtcggtggtggtggtggtggtggtgatagggatagctcctccactcggccgagatttgattttcagcagattgcaaaatgggttgaacaaattcttccattctctcttttgttgttggttgttttgattcgacagcatttacaaggattctttgtcacaatcagtgtatcagctgtgatgttcaagtcaaatgaaattgttaagaaacaaactgctctaaagggagatcagaaagtctctgctcttcttggtgtatcttttgtcttcatgctgtatgtgatatgcatttactggtggtatcgaaatgatgatcttttataccctctggccttgtttccgccaaaagcaacaccacctttctggcatacaatatttatcattttggtcaatgatatattggtgcgccaagcggcaatggctttcaagtgtttgttgttgatatactacaaaaatagcagaggccataatttccgtcaacagggtcaaatgttaactctggtcgagtacactctgctgttgtatcgtgctttcttgccaacaccagtttggtaccaatttttctttaacaaggactatggaagtctcttctcatcgctgatcacaggattgtatctaactttcaagctaacatctgcagttgagaaggtccaatgcttcatttgtgccttaaaagcattatcaaaaaaggaaattcattatggggtttatgccacaacagaacaggtaaatgctgctggtgatctgtgtgctatatgccaggggaagatgcatgatcctatcctgttgtgttgtaaacacatgttctgcgacgagtgtgtatccgaatggtttgagagagaatggacttgcccattatgcaggaagtcggtaaaaccggctgatctgcggaccttcggggatggatcaacgagtttgttttttcagttattttgagctcgctttgtttggcttgaatcatattattgagctaaaatctgcctaccaaatgttatgtttattactttggtttggcaatgttgttccattaatggattctatgaaattcatatgaaggaaataaaatttatggccattgaaagttcgattaaattttcttcgcccgt

SEQ ID NO: 4611 - DNA, 1657 bp, Citrus sinensis
aatctgcagcgtaagaataaaggaaaaggcttttgaagatcaagccaatcatagtggatcatcgtcatctccacatctgattcattcttcagcttaatctttttttgtcaaaatcgactaaataccctccaaagtctcaaatctttttcaaacaatcccgcaggtccaaggtcactgtgtctgcatcatcacatcccctcgttaaaaatggaaacttcagttcccggtcattcttcttcaccgctgccggatgatgatcgtactagtactagtgctagtgccagtgataattcaagaagctatgaggttcagttaccagctgcactcaacttgttccggtcaccactctctcttttattggaatattctcgtgtcatgtctacaagccaagaatctgagcaggatcgtttgatggtcaatgctgattctgaagctcggggtcaaacccagctgcccaattctgctctgagtaccggggaggtctctattcagataattaggcaagaaaatggtgaagccacgggggcaggagaagataatgagggaaatgcaattggggaaggtgaaacggtgccgttggcggcttcagaaggtagcaccagtagggaaggttcttatcagagctatgatattcaccagtttgctcggtgggtggaacaagttcttcctttttccttgctgttgttggtcgtttttgttcgtcagcatttgcaaggtttctttgttactgtttggattacagctgtaatttttaagtcaaatgatattcttcgaaagcagactgctttaaagggagagaggaaaactatattctctttatgatctttataggttttatgtttcaggtgattggtatctactggtggtttcggagtgatgatattttatatccattgctcatgattcctccaagtacaataccacctttctggcatgctgtattcataatcttagtgaatgatacaatggtaaggcaggctgctatggctatgaagtgtctactgctaatatattacaagaatggaagaggccacaatttccgtcggcagggtcaaatactaactctagtagagtatgcactgctgttataccgtgccttgttgccaacacctgtctggtacagatttttcttgaacaaagattatggaagcctcttttcatctctgacaacagggctgtatttaactttcaagctcacaactgttgttgataaggttcagagtctctttgctgccataagggcattatcacggaaagaagtacactatggatcgtatgccactacagaacaggtaaatgcagcaggggatctctgtgctatttgccaggaaaagatgcacgctccaatcctgttgcaatgtaaacacttattctgtgaggactgtgtttctgaatggttggaaaagaaaagaactgcccactatgcaaagctttggttaaccctgctggatctgcgattctttggggatggattaacaagcttggtcttcccgttgttctaaaaacatgcttttgctttctttgaaatctttaaccctggcaaatactgaagcctattatttaaaaactaatttggggaatgggctaaaaaaggggaaaaaaaaaaattttccccaaaaccaaaataaaaatggtaaatggatttctttctttaaat

SEQ ID NO: 4612 - DNA, 2150 bp, Phalaenopsis aphrodite
aaagggtctgccagccagccactcttctgacaagagatactgttgtcctcgtcgaccctataaaatcctggtgtttgattcttctagggttttcagagaaactttcccagcatttttctttatcattcgactcctctcggggcatttgcggtcttcgccgctgttacatctaattttgtacttttctggaaatttgggcctcatttgttcctccagcttcttaagaattttgaccgaggatagggatttcgatccatggaaacatccggaagagaatcagatccttatcgaacctccggtgctgttgcgaatggcggccggtcgaggagttacgcgatgcagctgtcgacttcgagcttcatccaagcgcttactgcttttctggagtactctggagtcctgcggtcgcaatcgagcaatcatcgggggagcgagagctttctgtcaggtgaagccaacgggggcccggttgaacatgcttctggccggcgggagttgttttcgagctcgagtgctggcggtgatggtgaggtactgataaggattatcgttccgggtgatcatgatggcgttagggccggtggtcaggggccggctccgccgtctgctagagtaagggccactggtgagaatagcgcgcctgtcgaggagattccgacggcgtccgatgatagtgggctgggagatgatggcgggagcgagtatggggccagggaggttgatggatcaccgccctctcagctgccatcggtgttacccgctaatacgcagagatcagatggtgaagggacccttgggggtgctaacagtagcgaatcatcgtaccagagatttgatatccagcagcttgcgaaatgggttgaacaaatactgccattctcattacttttgttggtcgtgttcattagacaacatttgcaagggttttttgtcactatctggatagcagcagtgatgttcaaatctaacgacatattacggaagcaaactgctttaaagggggaaaggaaaatgctagtgcttgtcgtaataacagtggttttcatgcttcatgtctttggcgtatactggtggtataggaatgatgatcttttgaatccactggtgctactcccccctaaggaaattccaccattctggcatgctatattcataattttggtgaatgacacaatggttagacaggcagctatggtgttaaaatgtgtggtgctaatgtgctacaggaacaatagagggcgaagctatcgtaagcagggtcaaatgttaactcttctggaatattttctcttcttgtaccgtgcattattgccagcacctgtttggtatagatttttccttaacaaggaatatgggagcttcttttcatctcttattaccgggctatacttgaccatcaagttgacaactattgttgataagattcattcattccttgcagcagtgaagtctttgtcttgtaaagatgtgcattatgggtcacatgcaacagcagaacaggtaattatagccggtgatctttgtgctatttgccaagagaagatgcagacacccattctccttcgttgtaagcacatcttctgtgaagattgtgtatctgaatggtttgatagagagcggacatgcccattgtgcagggccttagtaaagcctgcaggtcttcgctcttttggggacggttcaaccactctgttcttccaactgttttgatttgtacggtagaatctgaaacttaatttatttcagaaaatgagactaatgaagttagcttcacaacagcagaaacgccatcttccgccatctttttgagaggcaaagaaattttttctcctctccagccatggaagaactgggccggtacagtacttcatctccatcctcctgtatatttgatgattttgtttcttgattagcaagaacaacaaatctcatccatgtatattataactggtgctattctgtagtatatgataaaacttatattataactagtgctattctgtaatatataatagtgtgaacgaaatatctgaagaaatgcccgagcgacccgctcgtaggtggtttctgtgatgccttgatgtgaaatccgaaacttctgtatagaatataagctactgatagtcagattagaatgctgagtttgtttt

SEQ ID NO: 4613 - DNA, 820 bp, Utricularia gibba
ccccctttcctggcatgctgtatttgttattgttgtcaatgatgcactagttcgacaagcggctatggtcatcaagctgttaatcttgatgtattacaagaacagtcggggccaaagctttcgtaagcagggccaaatgctaacactagtcgaatatggcttactgctctaccgcacattactgcctgcccctatatggtaccgattcttcttgaacaaagaatatggcagtctcttttcgtcgttgataacaggcctgtatttaaccttcaagcttacagcagttgttgagaaggtccggtctctcgtcatctctgtcaaggtgttgtcgagaaaggaagttcactacggtgcatatgcaacatcagaacaggtgaatgctgccggcgatatgtgcgccatctgccaagagaagatgcgcactccagtactgctgcggtgcaaacacatattctgcgatgactgcgtctcagaatggtttgaacgcgaaagaacgtgccctctgtgcagggccctcgtccggcccgctgatcttcgatcatatggcgatgggtcgacaactcttttcttccagttgttttagcgctcgatcagtcatcatgcaaggtcactttgcgatgagcattgcaccttcagaagaaccgaaaatggagaaacgcatttaccagagaaacctctactgttgacacacaaccggcttcttttctttcaatgctggcttctatactctgtacaggtttttacgaggagcttggcttccccatctccttgactatcctcacaatgtcggccttatgccatcgtctctgtctgcaagatt

SEQ ID NO: 4614 - DNA, 1360 bp, Zea mays
atagaaaatgatattttatagtggtagtggggtatagggggagtatttagggggaaccgctgcgggagatggaaaaatatggggaaaaatagggggaaaagtgatatagggggaaaaatttaggggtaacggttgcggatagcctaactagcgattagcgaaaagaagaggacaagtcatcaagccccacgggccacggcgaacaaacagacatataggcagtacaaaagtgaggaaaaaaaacgaaaaaaaaacagggcgccctcacggcgaactcccacctcctatcgcccctcacctctcctttctctctctagccccgcacaaatctctcctcccctctcgccctcgccgcattgcccgccgacgaccccccggcccccgccggatagagaggaggaggagcggcgcggctgcgggagagccgggcggcggcggcggagcgggcttcatgtgcgacctagtggcccgcacgggccggcatcagcagcggtacgaggatggccgtcggctagtggccggatgcataccatttaggtatagagctaacaatgatgaaacctctggtgacaaaactaagaaactcgtggaagttctcatgataaattcccaaagcggacctggtcttttgtttccaaagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgacaagtggagcagaggcggcggcggcacaaactgtgacccggcctaactgctgacaggcccatctgcagtcgtccaatttgttcatctcctctctttccctaggcccccaaccttgcagaatgcaataatacagtgtacttgtcttgatgctgggttggtcattgacatgttatcttagttgtagtgggacgaggtacatctcatcaagacgagaattctcacaacttttaagtgtcaattctcgtgccctattatttctcggtttcatccgctgtcgtcgcggtgctgcagcctgcaggcacgcgccgcacgcattttgtaactccgctcctgattctggagatgcatatgctatatgtatgaactggtataactttgaaatcaaaagttgccactgttgactcga

SEQ ID NO: 4615 - DNA, 1269 bp, Setaria italica
caaaaaagcaagccaggatgcgagcacggaacaaacagcagaaaaaaagaaaagaaaaaacagggcgccctcacggcaaggaactcccaccttttatctccctccctctcctctctgcctagccccgcacaaatctctcctcccctctcgccctcgccgcattgcccgccgacgacccccgccggagagagaggaggagcggcgcggcgcggctgcgggagaagcgggcgtcggcggagcgggcagcatgtgcgacctggtggcccgcacgggccggcatcagcagcggtacgaggatggccgtcggctagtggccgggtgcataccatttaggtatagagctaataatgatgaaacctctgatgacaaacataagaaacttgtggaagttctcatgataaattcccaaagtggacctggtcttttgtttccaaagggaggatgggagaatgatgaaactgttgaagaggcagcagctcgagaagctatagaagaggctggagttcgaggtgatatagtgcatcttctgggtttttatgacttcaaaagcaagacacatcaagatgcgtgctgtcctgagggtatgtgcagagctgcggtgtttgcactgcatgtaaaggaagagctaacctcatggcctgaacagagcacccggcagagaacctggctcacggttcctgaagctgcatcacagtgccggtaccagtggatgcaagaggccttgctcacaggcttctccgagtggcatgacaagtggagcagaagtggcggtggtaccaactgcgaccctgcctaaccgctgaacctatcagtggtcctccaatttgttcatcgtctctctttccctaggcgccaaccttgcagaatacaataatacagtgtaattctcttgatgctgggtggtcattgacccttgatgtcacatgtcaggatggttatctagtttagcagaacggggtatatctcatcaagacgagaattatcacaacttttaagtgtcgattctcgcacatatttatttctcggtttcagctgctgtcgtctcggtgctgcaagcacgcaccgtgcgcattttgtaactcgctcctgattctggagatgcatatgctatgtattcctgactgctataactgaaatcaaaaggtcaccattgactgggggtcacagagcagtgcgtccagaaccttgcaatctgtcttgctcgagcagaggctggcttgggagtgagccgggtagaagaaatcttggtggattcccagtgcaagtgat

SEQ ID NO: 4616 - DNA, 1142 bp, Zea mays
ggagaataaaaaggaaaagaacgaagaatgaaaagggggaaaaaaacagggcaccctcacggcgaactccccacctcctatcgcccccctctctctagcgccgcacaaatctctcctcccccgctcgccctcgctgcattgggcgccgccaagcccccgccggatagagaggacgagaagcggcgtggctgcgggaggagcgggcggcatgtgcgacctggtggcccgcacgggccggcaccagcagcggtacgaggatggccgtcggctagtggccggatgcataccatttaggtatagagctaacaatgatgaaacctctggtgacaaaactaagaaagtcgtggaagttctcatgataaattcccagagcggacctggtcttttgtttccaaagggaggatgggaaaatgatgaaactgttgaagaggcagcagctcgagaagctatagaagaagccggagttcgaggtgatatagtgcattttctggggtcgtatgacttcaaaagcaagacacatcaagatgcgtgctgccctgagggtatgtgcagggctgcagtgtttgcgctgcatgtaaaggaagagctgaactcatggcctgagcagagcacccggcagaggacctggctcacggttcctgaagctgcatccaggtgccggtaccagtggatggaagaggccttgctcacaggcttctctgactggcacgacaagtggagcataggtgacggcggtggcggcggtgccaactgtgtgacccggcctaactgctgatgaacccatctgcagtcgtccaatttgtccatcctcccccatttcccctaggctccgacattgcgtaacgcaataaatacagtgtacttctctcgatgctgggttggtcattgacccttggatggttatcttagttattagtgggacgaggtatatagtatttatatctgatgaagacgagaattctcacaacttttaagtgtcgattctcgtgcctgtttatttctcggtttcaggtcagctgcagcctgcaggcaggcacgcaccctgcgcactttgtaactctgctcctgattctggagatgcacatcctgtgtatgaactgaactggtataacttgaaaataactgttaagtcaaccatgcat

SEQ ID NO: 4617 - DNA, 1475 bp, Oryza sativa
ggcgtatataatctaaaaaagaaaaatctaagatactgtataaacaatagcagcttccaaacggcaaagaatatcttaaaatggcaaaggatatcttaaaaaaacggcaactaacttcaaataatacatccttcaaacaacaaaagatatctttaaaaacggcaactaactccaaaaaataacaaacagaaaacagaaagagaaatgaaaaaaaaaacaaaagaaagcaaaggaaagtcaccgcccaccacgccctccaaataaaagcgagcgcccaacccaacgacaccaaaatacacacacacacaaaaaaatccagaaaaaaaaaccgcacgaaaaaaaaagagcgccctcatcacggcgaggaattcccacctcctatctctctcctcctcctcctcctcttctctctccacgcacaaatctctctcctcctccgctcccccacgccgcacgcattgccgccgtgggctcaccgccggcgagggcggccgcagaggaggaggggagcggcggcggcggccaacccgggcggtgtgggtagcatgtgtgaccttgtggcccgaacgggtcggcatcagcagcggtacgaggatggccggcggctggtggccggatgcataccgttcaggtatagaactagtaatgatgaaacttctgatgatgaaccgaagaaaattgttgaagttctcatgataaactctcaaagtggtccaggtctcctgtttccaaagggaggatgggagaatgatgaaactgttgagcaggcagctgctcgagaggctgtagaagaagctggagttcgtggagatatagtgcaatttctgggtttctacgacttcaaaagcaagacgcatcaagatgcgtgctgccccgagggtatgtgcagagccgcggtgtttgcgctgcatgtgaaggaagagctggactcatggcctgagcagagcacccgcaggaggacctggttgacagttcctgaagccacgtcgcagtgccggtatcagtggatgcaagaggctttgcttactggcttctctgactggcatgacaactggagcaaaggtggcggtggcgacaccaactatgactctctctagttgcagaaggcatccacaggagttctggttttgtttatcttcttttaactctccctaggctccaactttgcagaatgcaataatacaatgtacacttgttctgatactagtaggtggtctttgacccttcattgctatctagcgtagtatatctcatcgaagacgggaattctcacaacttttaagtgtcaattctcgtgtctattgttccctcaccacctatcaagctcaattactttatcctggtgagcattttgtacgtcactgctccagattacggagctgcatacgctatgtattaacttgaccacacctgaaatcaaaaggtatttcttggctcgaatgagccacggtggctatacatttggcatccagcgc

SEQ ID NO: 4618 - DNA, 946 bp, Secale cereale
ggccggcgagacggcgcgcaggaagagcgggcgggcggcggcggcggcggcgggcagggtagcatgtgcgacctcgtggcccgcacgggtcgccaccagcagcggtatgaggacggccgacgcctcgtcgccgggtgcataccattcaggtatagagctgatgaaacttctggtgatgaacagaaaaagttgttgaagttctcatgataaattcccaaagcggaccaggtttattattccccaagggaggatgggagaacgatgaaacagttgaacaagcagctgctcgagaagctatagaagaagctggagttcgaggagatatagtgcaatttctaggtttctatgatttcaagagcaagacgcatcaggacgcatgctgccccgagggcatgtgcagagcggcagtgtttgcgctgcatgtgaaggaggagctggcctcatggcctgagcagagcacccgtcggaggacctggctgacggtccccgaagccacgacacaatgtcggtaccagtggatgcaagaggccttgctgacgggcttctccgagtggcatgacaactggagcaaaggcggcggcgcaggcggcgacccaatctaaacgcaagaaggcgtcgtcgtctctcgctttcctttgccttctcctatgttctcctcctccctaggccccaaccttgcacgcaaattgcaataatacagtgtggtgcttttacttgatgatgcctagtaggtcattgatccttggttcctgggattgaagtcttagtgtagtcgtatatctcatcaaagacgagaattatcacaaattttaagtgtctgattctcgcggcgtcaaattatttctcaaatttcagcttgattttgatttcttgctcctgatgatggggatgcatgccgcattgtatttaccagacctgaaatcgaaagtgatacttgttgactcag

SEQ ID NO: 4619 - DNA, 819 bp, Triticum aestivum
cgagacggcgcgcaggaagagcgggcgggcggcggcggcggaggcgggcagggtagcatgtgcgacctcgtggcccgcacggggcgccaccagcagcggtacgaagacggcagacggctcgtcgccgggtgcataccattcaggtatagagctgatgaaacttctggtgatgaacagaaaaaagttgttgaagttctcatgataaactcccaaagcggaccaggtttattattccccaagggaggatgggagaacgatgaaacggttgaacaagcagctgctcgagaagctatagaagaagctggagttcgaggagatatagtgcaatttctaggtttctatgatttcaagagcaagacacatcaggatgcgtgctgccccgagggcatgtgcagagcggcagtgtttgcgctgcacgtgaaggaagagctggcctcatggcccgagcagagcacccgccggaggacctggctgacggtccccgaagccacatcacaatgtcggtaccagtggatgcaagaggccttgctgacgggcttctccgagtggcatgataactggagcaaagggggcagtgcaggtggcgacccaatctaaacgcaagaaggcgtcgtcgtctgtcgtctctcactttcctttgccttctcctctgttctcctctctaggccccaaccttgcacacaaattgcaataatacagtgtggtgcttttacttgatgatgcctagtaggtcattgacccttggttcctgggattgaagtcttagcgtagtggtatatctcatcgaagacgagaattatcacaaatttgctgatacta

SEQ ID NO: 4620 - DNA, 979 bp, Triticum aestivum
cgggcagggtagcatgtgcgacctcgtggcccgcacggggcgccaccagcagcggtacgaagacggcagacggctcgtcgccgggtgcataccattcaggtatagagctgatgaaacttctggtgatgaacagaaaaaagttgttgaagttctcatgataaactcccaaagcggaccaggtttattattccccaagggaggatgggagaacgatgaaacggttgaacaagcagctgctcgagaagctatagaagaagctggagttcgaggagatatagtgcaatttctaggtttctacgatttcaagagcaagacgcatcaggacgcgtgctgccccgagggcatgtgcagagcggcagtgtttgcgctgcacgtgaaggaggagctggcctcatggcccgagcagagcacccgccggaggacctggctgacggtccccgaagccacgtcacaatgtcggtaccagtggatgcaagaggccttgctgacgggcttctccgagtggcatgacaactggagcaaaggcggcagtgcaggtggcgacccaatctaaacgcaagaaggcgtcgtcgtctgtcgtctctcactttcctttgccttctcctctgttctcctctctaggccccaaccttgcacgcaaattgcaataatacagtgtggtgcttttacttgatgatgcctagtaggtcattgacccttggttcctgggattgaagtcttagcgtagtggtatatctcatcgaagacgagaattatcacaaattttaagtgtctgattctcgcggcgtcatattatttctcaaatttcagcttgattttgatttcttgctcctgattctggggatgcataccgcaatgtatttaccagacctgaaatcgaaaagtgtacttgttgactcagagcggccggtgcctctggttaccaaattacaactgtattttaagaagtaaaacgatttagctggaagtaaaaaaaaaa

SEQ ID NO: 4621 - DNA, 961 bp, Hordeum vulgare
gtggatccaaagcccacctccaccaatctcccaatctcctccccgcacaaatctctccgcctccccctccccccaacccctcccccacccccccgccgcattgctccccgtgcaccgccggacccgacttgcctccgacgccggcgagacggcgcgcaggaagagcgggcgggcggcggcggcggcggacaaggaggaggagatcgagcgcggcggggtagcatgtgcgacctcgtggcccgcacgggtcgccaccagcaacgctacgaggacgggcggcggctcgtcgccgggtgcataccattcaggtatagagttgatgaaacttctggtgatgaacagaagaaagccgttgaggttctcatgataaactcccaaagcggaccaggtttattgtttccaaagggaggatgggagaatgatgaaactgttgaacaagcagctgctcgagaagctatagaagaagctggagttcgaggagatatagtgcaatttctaggtttctacgatttcaagagcaagacgcatcaagacgcgtgctgccccgagggcatgtgcagagcggcggtgtttgcgctgcacgtgaaggaggagctggcctcatggcccgagcagagcacccgccggaggacttggctgacggtccctgaagccacgtcacaatgtcggtatcagtggatgcaagaggccttgctgacgggcttctccgagtggcatgacaactggagcaaaagcgacggcgggggcggcggcaacccggtctaaacgctccctctctcgctttccgcctgttcttcctccctaggccccaaccttgcacgcaaattgcaataatacagtgtggtgcttttacttgatgatgcctagtaggtggtcattgacccttggttcctgggattgaagtctttagcgtagtggtatatctcatcgaagacgagaattatcacaaattttaagtgcc

SEQ ID NO: 4622 - DNA, 1025 bp, Hordeum vulgare
cgccgcattgctccccgtgcaccgccggacccgacttgcctccgacgccggcgagacggcgcgcaggaagagcgggcgggcggcggcggcggcggacaaggaggaggagatcgagcgcggcggggtagcatgtgcgacctcgtggcccgcacgggtcgccaccagcaacgctacgaggacgggcggcggctcgtcgccgggtgcataccattcaggtatagagttgatgaaacttctggtgatgaacagaagaaagccgttgaggttctcatgataaactcccaaagcggaccaggtttattgtttccaaagggaggatgggagaatgatgaaactgttgaacaagcagctgctcgagaagctatagaagaagctggagttcgaggagatatagtgcaatttctaggtttctacgatttcaagagcaagacgcatcaagacgcgtgctgccccgagggcatgtgcagagcggcggtgtttgcgctgcacgtgaaggaggagctggcctcatggcccgagcagagcacccgccggaggacttggctgacggtccctgaagccacgtcacaatgtcggtatcagtggatgcaagaggccttgctgacgggcttctccgagtggcatgacaactggagcaaaagcgacggcgggggcggcggcaacccggtctaaacgctccctctctcgctttccgcctgttcttcctccctaggccccaaccttgcacgcaaattgcaataatacagtgtggtgcttttacttgatgatgcctagtaggtggtcattgacccttggttcctgggattgaagtctttagcatagtggtatatctcatcgaagacgagaattatcacaaattttaagtgcctgattctcgcggcgtcatattatttctcgaaattcagcttgattttgattccttgctcctgattctggggatgcataccgcaatgtatttaccagacctgaaaattgaaaagtgtacttgactcgagctgccggtgctggcgtgaattgcaaactgt

SEQ ID NO: 4623 - DNA, 933 bp, Leymus cinereus x Leymus triticoides
caaatctctccggctccccctcccccaccccctcccctcccccgccgcattgctccccgtgcaccgccgaccccaccgcccccacaggccggcgagacggcgcgcaggaagagcgggcgggcggcggcggcggcggcagagaagaagccgggcagggtagtatgtgcgacctcgtggcccgcacgggtcgccaccaacaacgctacgaggacggcaggcgactcgtggccgggtgcataccattcaggtataaagttgatgaaacttctggtgatgaacagaaaaaagttgttgaagttcttatgataaactcccaaagcggaccaggtttattgtttccaaagggaggatgggagaatgatgaaactgttgaacaagcagctgctcgagaagctatagaagaagctggagttcgaggagatatagtgcaatttctaggtttctacgatttcaagagcaagacgcatcaagacgcgtgctgccccgagggcatgtgcagagcagcggtgtttgcgctgcacatgaaggaggagctggcctcatggcccgagcagagcacccgccggaggacctggctgacggtccctgaagccacgtcacaatgtcggtatcagtggatgcaagaggccttgctgacgggcttctctgagtggcatgacaactggagcaaaagcggcggcggcggtggcgacccaatctaaacgcttcgtctctcgctttcctttgctttctcatctgatctcctccctaggccccgaccttgcacgcaaattgcaataatacagtgtggttcttttacttgatgatgcctagtaggtcattgacccttggttcctgggattgaagtcttagcgtagtggtatatctcatcgaagacgggaattatcacaaattttaagtgcctgcttctcgcggcgtcttattattttccca

SEQ ID NO: 4624 - DNA, 876 bp, Panicum virgatum
gtcgctagtggccggatgcataccatttaggtatagaactaataatgatgaaacctctgatgatgaacataagaaacttgtggaagttctcatgataaattcccaaagtggacctggtcttttgtttccaaagggaggatgggagaacgatgaaactgttgaagaggcagcagctcgagaagctatagaagaggctggagttcgaggtgatatagtgcatcttctggggttttatgactttaaaagcaagacacatcaagatgcgtgctgtcctgagggtatgtgcagagctgccgtgtttgcactgcatgtgaaggaagagctgacctcatggcctgagcagagcacccggcagagaacctggctcacggttcctgaagctgcatcacagtgccggtaccagtggatgcaagaggccctgctcacaggcttctctgattggcacgacaagtggagcagaggtggcggtggtactaactgtgacccagcctaaccgctgagtccatcaggagaactccaatttcatcttctctttccctaggcgccaactttgcagaatgcaataatacagtgtacttctcttgtgtctgggtaggccattgacccttgatgtcacatgtcaggatggttatctagtttagtgggatgtggtatatctcatcaagacgagaattctcacaacttttaagtgtcgattctcgcgcttattatttctcggtttcagctgctgttgttgcggtgctgcaaggacgcgccgtgcacattttgtaactcgctcctgattctggagatgcgtatgctatgtattcctaactgctataaagcctgtaactgaaatcaaatggtcacctttgactggagtcaccacccagtgaa

SEQ ID NO: 4625 - DNA, 825 bp, Pennisetum glaucum
ggtgcataccatttaggtatagagctaacaatgatgaaacctctgatgacaaacatgataaactcgtggaagttctcatgataaattcccaaagtggacctggtcttttgtttccaaagggaggatgggagaatgatgaaactgttgaagaggcagcagctcgagaagctatagaagaggctggagttcgaggtgatatagtgcatcttttaggtttttatgacttcaaaagcaagacacatcaagatgcgtgctgtcctgagggtatgtgcagagctgcggtgtttgcactgcatgtaaaggaagagctaacctcatggcctgaacagagcacccggcagagaacctggctcacggttcctgaagctgcatcacagtgccggtaccagtggatgcaagaggccttgctcacaggcttctctgagtggcatgacaagtggagcagaggtggcggtggtactaactgcgaccctgcctaaccgctgaacctatcagcggtcctccaatttgttcatcgtctctccttccctaggcgccaaccttgcaggatgcaataatacagtgtacttcttttgatgctgggtggtcattgacccttgatgtcacatgtcgggatggttatctagtttagcggaacggggtatatctcatcaagacgagaattatcacaacttttaagtgtcgattctcgcgcatatttgtttctcggtttctagctgctgctgtctcggtgctgcagcacgcaccgtgcgcatttgtaacccagctcctgattctggagatgcatatgctattgtattcttgactgctataactgaaatcaaa

SEQ ID NO: 4626 - DNA, 697 bp, Saccharum officinarum
  misc_feature (429)..(429): n is a, c, g, or t
  misc_feature (658)..(658): n is a, c, g, or t
gacccccgccggatagagaggaggaggagcggtcggcggcggagccggcggcatgtgcgacctggtggcccgcacgggccggcaccagcagcggtacgaggatggccgtcggctagtggccggatgcataccatttaggtatagagctaatagtgatgaaacctctggtgacaaaactaagaaacttgtggaagttctcatgataaattcccaaagcggacctggtcttttgtttccaaagggaggatgggagaacgatgaaactgttgaagaggcagcagctcgagaagctatagaagaagctggagttcgaggtgatatagtggagacgccgcgcccgcgacatacgcagggccaccaagcgtacggaggccaggcccagcacggcgcaggagatggttgcccaacaaactgcattttctggggctntatgacttcaaaagcaagacacatcaagatgcgtgctgccctgagggtatgtgcagagctgcagtgtttgcgctgcatgtaaaggaagagctggtctcatggcctgagcaaagcacccggcaaaggacctggctcacggttcctgatgctgcatcaaggtgccggtaccagtggatgcaagatgccttgctcacaggcttctcggactggcacgacaagtggagcaaangcggcggcggcactaaatgtgatccagcctaactgctga

SEQ ID NO: 4627 - DNA, 1499 bp, Oryza sativa
gggatgaagttgaaaatgtttaccaaaccaaaaccacataccaaagccaaaaaccatagaaaccagagaaaaagtcctaaaaaagctacacaaagggggtaaaaaggggaccaaaacagggcaaaaaattcccaaaataaaaagggcaagaacagcgagagacccaggaaggaacgaagcaaggcgcttaggcgcacgcacgcacgcacatctctcgagcccctcaccctccccttcttcctcctccttccgccgcattgctcgtcgccggcggcgaccaaccctacccctctctctccctctcgagcggcggcggaggcggtttccggtagtggcggcggcggcggggacaggaagaagccatgtgcgatttggtggcgagaacggggcggcaccagcagcgctacgagcatgggcgtcgactcgtggccgggtgcataccttttagatataaagataacaatgatgaaacttctgatgatggacacaagaaacttgtggaagttctcatgatcaactcccagagtggatctggtctcctatttcctaagggaggatgggagaatgatgaaactgttgaagaggcagctgctcgtgaagctattgaagaagctggagttcgaggagatttagtgcaattattgggcttctacgacttcaagagcaagacgcatcaagacaagttctgccccgaggggatgtgcagagctgcggtgttcgcgcttcgagttaaggaagagcttgcctcctggcccgagcagagcacccgcaagaggacctggctcactctcagtgaggcggtggagcggagccgttacccatgggtgcgagaggcccttacaacgggtttcaccacctggcatgagaactggagcaacggggacgaccatgtcgacccaagttcaagatgaccgcacctcaagcatcagggccaggggtcatgctctcttttaccatgctagtggtttcagaaacatgaccatttcggcgtatgtgtgctccctgatgcttcagtagttccgatcgccctatattactacctaggatgggaccaatcttagttctggaaatgtcgagatgggaccaatcttagttctggaaatgtcgagaatcgctggaattgtaagttttaattgattctcgctgctaccattatcagtcctcttggttctttatttctttttacaccatgcagtatcagctggtgtgttgccccttgtgtgtgcgcaaaaatacctgaaatcaaagaaggctttgtggatcaatgtgctgcaatgctccttctgagttggcttgttcgtgagcactggtctccaaaagaatattgcagaaagggggtaaagaaatcctgatgttctttgtcagcattgctgtctgttctggtctgtcagaatcaaagttgaattcagttgttaagaacgagtcaaggtgaacaattcacaacacagatcttgttgaggagtatctgttcttaaggaatgcaaccatttatttccagc

SEQ ID NO: 4628 - DNA, 1152 bp, Zea mays
atttcaggttcgtgccccgtttccactctccactccactcgcgcgtccgttccgcctccactgaacatctccttttaacacccggctccggcgactcgccccttcctccactggtgcatccaccattccacctaccccacccccacaacccgctcgcgcggctgtccaatggcgggaggcggggcgccgtcagcgtggggcccgagcccggcgctggtgaccgcactggtggcgctgcttgggctcggcctcgccgcctacatcgtcggcccgcagctctactggcacgccgcggaggtgctcacggcggcggccgcgtgccccgcctgcgactgcaactgcgacgcgcgcccgctcctcgaccttccggaagattgtgctaaacacttcaaaggggtcaagagtcgcgcatctggtgaagagacagaaaagagtttcacagagctgcttgtagaagaactaaaacagagagaagaggaggcaacacaagctcagcaagaggccgatgttaagttgctcgaggccaaaaagttagcttcacagtatcagaaggaagctgacaaatgcagctcaggcatggatacctgtgaagaaactagggagaactcagcggaagcattggtccaacaaaagaaactgacttctttgtgggagcgaagggctcgggaactaggatggagacccgagaatgccaaggcacgtctaaagtagtaaaaccagtggatggtgttggatactatgtgtagcaatagatctcattgtaaaaccagtggatggtgttggatactacgagctcgagatgatgaggaaacaaatgagttcctggttggactcgactctctttacacgccatggggccttattgttcatagtaaatttatgttcagtttgtagtgtactttcattgttctttgtgaacactgttgtgtgttgtacttgggatggtcataggattacattgttcattatttcctggatgttctaaaaaggagaaaagtaattgtctgggggtggtggcaataaagaagagattgcctgcagttcttaagttctttcatcttactggcattagcccttctgtagataattgccatttctgttcacatggttttaccgtcaccctattgataatgtggttggggtctagttgtg

SEQ ID NO: 4629 - DNA, 1084 bp, Setaria italica
cctccactgacccacactcctccactcgctcgccccactccttcctgctcctttaacccccgcgccgcgccgcgccgggcgccggcgactcgcctctccactccaccggttccacgcccccacgctgctctccacgcgctgccgctcaatggcgggagccggggcgtcgtcggcgtggggcccgagcccggcgctggtgaccgcgctcgtggcgctgctggggctcggcctcgccgcctacatcgtgggcccgcagctctactggcacgccgcggaggcactcacggcggccggggcgtgccccgcatgcgactgcaactgcgacgcgcgcccgctcctcgacctcccggaagactgtgccaaacaattcaaaggggttaagagtcgtgcgactggtgaagaaacagaaaagagtttcacagagctacttatagaagaactgaggcagagagaagaggaggcaacacaagctcagcaagaggctgatgtaaagttgctcgaggccaaaaagttagcttcgcagtaccaaaaggaggctgacaaatgcagctccggtatggatacctgcgaagaagctagggagaaatcagcggaagcattggtcgaacaaaagaaactgacttctttgtgggagcaaagggctcgggaactaggatggaaacctgagaatacaaggcacacctaaagtagtaaatctaatacgctagcagatggcgctggatacatttgtgtagcaacaggcatcttgttgcaaatacggcccacaaagagcttgagttgctagaggaaactagtgggttccctgttggcagactcatgccacgggcttatttgtccatagtaaaactatattcagtctgtagtatatttcccttgctgtttgtgagcactgtgttaagatggtcataggattacactaatctgcatttaggccatgaaggtttcattagttattatctggatgttctaaaaaggaagagctattgtttgtggatggtgaaattgtctcgatgttaaaagaaaagaagaaaaaatattgcctgtgtatgatggtattgataaagaagttgtctgcagttttgtt

SEQ ID NO: 4630 - DNA, 1155 bp, Panicum virgatum
ccaccactccgaccactccctcactcgcccgccccactccttccagctcctttaacccccgcgccccgccgcgccggcgactcgcctctccaccggtccaacccccaacacgctgctctccacgcgcggctgctcaagcaatggcgggagccggggctccgtcggcgtggggcccgagaccggcgctggtgaccgcgctggtggcgctgctgggtctcggcctcgccgcctacatcgtggggccgcagctctactggcacgccgcggaggcgctcacggcggccggggcgtgccccgcctgcgactgcaactgcgacgcgcgcccgctcctcgacctcccggaagactgtgccaaacaattcaaaggggttaagagtcgtgcctccggtgaagaaacagaaaagagtttcacagagctgcttatagaagaactgaggcagagagaagaggaggcaacacaagctcagcaagaggctgatgtgaaattgctcgaggccaagaagttagcttcacagtatcaaaaggaagctgacaaatgcagctcaggtatggacacctgtgaagaagctagggagaaatcagcggaagcattggtcgaacaaaggaaactgacttctttgtgggagcaaagggctcgggaactaggatggaaacctgataatacaaggcacacatagagtagtaaatcaaatacactggcggatggccctggatacatttgtgtagcaacaggcatctcgttgcaaatacagcccacaaagagcttgagttactagaggtaacaaataggtttcttgttggcggactcatgccacgggtttacttgtccatagtaaatttatattatgtttgtaccatatttccgttgctgtttgtgagaactgtgttaagacggtcataggatgacactaatcattcaggtcattaaggtttgattagctattgtccggatgttctaaagaggaacctttactgtttgtggatggtgaaattgtttggatgatgaaagaagaagagttattctctttgtatgatgttagtaatgaagcagtagtttcatcttgctagcaagatagttgtatcaggcaagattgcattagctcctctgtgtacatgtttacgtcatgattgataatgtgactggatttagttgtg

SEQ ID NO: 4631 - DNA, 3724 bp, Oryza sativa
cacaactcacaactgcgttcgtccaggccggctgccgccgaacccaccaccatcccacgatcccatcccatctcatatcgtgttcgggcccgtctgcactctccacttccacactcccatcccacctccaccgaccgcgtccggtccatctccactccccccacactcctactcctttaacctccccgcgccgccgcctcccctccgccgagacacccaactgtataccagcagcagccatcctcgcgcgcgcgcgcggcgtcggcgatggcgggcggctcaacctcctcctcctcgtcgtggggccccagcccggctctggtgaccgcggtggtggcgctgctggggctcggcctcgccgcctacatcgtcggcccgcagctctactggcacgccagcgaggcgctcggccgctccacgggggcgtgtcccgcgtgcgactgcgactgcgacgcccgcccgctgctcgcgctccccgaagactgttccaaacaattcaaggatgttaagagccgtgcgtctggtgaagaaacagagaagagtttcacggagctactcatagaagaactgaagcagagagaagaagaggcaacacaagctcagcagcaagcagatgtaaaattgctggaggcgaaaaaattagcttcacaatatcaaaaggaggctgacaaatgcagttcaggtatggatacatgtgaagaagcccgggaaaaatcatcagaagcattggttgaacaaaggaaactgactgctttgtgggaagaaagagctcgtgaactaggatggaaacctgggaatatcaaaccacaccagacgtagtaacgagccctagcgggatcgcgagcagctcaagccacagagatctaattccacacatgctcctcaaagatatagtaaagtgaccgaggtaacaaaggtgcgaccttacctccgttttgcgctgcttcacaagcttttgtccatagttgatttatattcagattgtagtatacgtccatagctgtttgtgagcatatgttaaaatgatcataggatcagaatgctgctcatccacctgtatctgtatgtcttgaagggaatattggttgttgtgtatgatgatggtaataaaggaattgtagtccaagtgcatctatttctgttagattgagttaggattagctgcagctagctagtaattgaaacaagcaatcatatctgaagactgaatttgaaccttcgcctcacattctagatgatggagggttcagacttcagaggcacgaactatacctttgaacctttggcatttgagattccagaggagcaaatgaaatttcttgtgttttgtgattgtgagagtactaggcaggcagtatatgggccggaaacccctccacagctagtatggcccaactgcagatagtatatgggccggcttagcacaagcattagcgccatttcatgtggagtacaggaaaagggaaatttgcaaaggaaaaagtgcacccgagatccttaggttttaaacctagttttagtgagacccacatgggccccacatgtcagcgtgccacgtcatcatccttacctctttcccctcctctcccttcctccacgtcatcatccctatccagcggtaagtggcaaagccggccggcgggtggggaagaggtcgccggagcgacgtgggaaaggaggacgtccggcggccggcgacgtggcggcgagcgaagaggcggcggcggcggcggctgcggctgcgacgagggcggagcgggggaggagcagcgcggcgcggcgcgcgggcgggtgaggagcagcgcggcacgcgggcgggggaggagcggcgcggcgcggcgtgcagacgagggaggagcggcggcggcgacgcatgtcgacggcggcggctccgagcagggatagggtcgccgtcgccgtccgtcctcttctcctccacggcggcggcgtgagcgcgagactctcggcgcggcggtgctcatggtctcctcgtcggcgccaaggacggggcgaccacggcggcctcagtccgaagcggagaggctgggggagagtggaggccgccgccgccgccttgctcccccctccgccgcctacgccttgctcccggtcgccggactccacccgctcccaccgcctcatcctcggaacccacacctccgacgagaagcccaaccacctcttgcccgctcaggctccgctccgcttcctccatgcgtcggccaccaccgcctccacggggacctcgccgtgggcggcggccatcgtcgacctcgccgctcctcgccctgccaccgagcgccttatccattaccgctaccgtcgtcgccgccgccgccgcagcagcgagaacggtgccagccgtgcaggcacgcgcggccgagctcggcctcgaccgccgtccgcaatgggctcgtcgagctctacctcgcacacggcgagctcgcctccgcgtgggcgctcgtttcttgtacggccatggtgacaagccacgcgaggcacgggttcttgacgaggctgtggtgcttttcttcgccatggcggatgatagtggcgtgtgcatcgacatcgtcgccgccgccgccgtcgcgttctcggcgtgcacgcaaattggagaccttgcgctgggtcgggaggcgcaccggcgcgtcgcggaaaggaaggttgctctgggtttcgtcgcgtggaacgcgctggttgacatgtacacgaagtgcggcgacgcggcggcggcgcaccggtgcttcaggagggatgcccgtgcagaccagcttgttgaagatgttgaaatagatgttgaggaggtaccagacgaggatcatggctccgagctgcatcgtccgcgaaacgccgccggcgacggcgctgccgtccgccttcccgccaccttccgccggtggcgaggccgccgcggccgtcgccaccgccatcttcctcgtcgcggcgccgctgttccacagaagtgggggcgcgagcagcatgcgcccgccgcgaatgccgagcggcagcacgccggcgaccgtgcatcgattgagagacgacagagtcgtcgtcatcggggaagaagaacacgaggcgacatgccgccgccgcggggaggccacccaggctctagaagtggccgccaccacggcctacatctcgccacgccgcgttccacaaccacgcgtccacggtttcttggtcgcaacaatggcgtcgcctcaccggaccaaatcaaatcaatcgatcgaacgccgccctggactctcggaacgcgcgcgcggtggcaggaggacgagacgccatctgctacttgtggaggaggaggggtgcctgcggctgcggcgcgagtgggcggcgaggcgagggtcgggagtgaccggcaaaactagtctgccggcctacccagtccagagagaagagtgggggagagagagagagagagagggggggggggggggggggaggaggaaaggagaggaagaagggagaggctgccttgccgacgtggcatcctgacatgtgggaccaacgtgggtcctatgctgactcagccgccagataaaatcggtgtcaaaagacttagttcgtacggttttataagttgagggatgtgttgtatccggttttgcggtgtacttttttcatttgcaaaagataatcatccaatcttggggtaaatttaaactgtagtacctttcctgcacccttatcgaaattttcaggtcaattccaacgcaat

SEQ ID NO: 4632 - DNA, 1026 bp, Brachypodium distachyon
cttcgcgtccggccttccggtctatccccactcaccagtcatcactcccccaccccactcgccccccaccccctttaacccccatcaccgccgcgcccagccgccgacacaaaggcccgcctcccctcccctcgcctcggcccgcagcgtggccgaaccatccagccaccgtctgtgcgcgcggccatggccggtgggccgtcgtcgtggggcccgagccccgcggccgtgacggcgctggtggcgctggtggggctcggcctggccggctacatcgtcgggcccccgctctactggcacgtggccgaggcgctgggccgctcgccgggcgcctgccccgcctgcgcctgcgactgcgacgcgctcccgctgctctcgctacccgaagactgtggcaaacaattcaaggaggttagcagccgtgcttccggtgaagaaacagagaagagtttcacggagctactgatagaagaactgaagcagagagaggaggaggcgacgcaagctcagcaacaagctgatgtaaaattgctcgaggccaaaaagctcgcttcacagtatcaaaaggaggctgacaaatgcagttcaggcatggatacatgtgaagaagctagggagaagtcagcagactcactgctcgatcaaaagaaactgactgctttgtgggaggaaagggctcgggaactaggatggaaacccgggaacggcaaatcacatgggaatcagtaggcgatggatatggcatgccgagcaacagagatctcgttcacctctggtgacctctatatccctttctgctgccacgggcttccttgtccatagctaattttgtatccagcttgtactatacggccatagctgtttgtgagcgatatgttaaattggtatgaaactcgtcacctgtagatcttggaagtgattattggttgtctacgatggtggtaactgaggagttgatcttatttctaccaacctgacgaagtatgacttgtttacttcccaaatcaccgtcgtcacgttggcatt

SEQ ID NO: 4633 - DNA, 958 bp, Brachypodium distachyon
gtcatcactcccccaccccactcgccccccaccccctttaacccccatcaccgccgcgcccagccgccgacacaaaggcccgcctcccctcccctcgcctcggcccgcagcgtggccgaaccatccagccaccgtctgtgcgcgcggccatggccggtgggccgtcgtcgtggggcccgagccccgcggccgtgacggcgctggtggcgctggtggggctcggcctggccggctacatcgtcgggcccccgctctactggcacgtggccgaggcgctgggccgctcgccgggcgcctgccccgcctgcgcctgcgactgcgacgcgctcccgctgctctcgctacccgaagactgtggcaaacaattcaaggaggttagcagccgtgcttccggtgaagaaacagagaagagtttcacggagctactgatagaagaactgaagcagagagaggaggaggcgacgcaagctcagcaacaagctgatgtaaaattgctcgaggccaaaaagctcgcttcacagtatcaaaaggaggctgacaaatgcagttcaggcatggatacatgtgaagaagctagggagaagtcagcagactcactgctcgatcaaaagaaactgactgctttgtgggaggaaagggctcgggaactaggatggaaacccgggaacggcaaatcacatgggaatcagtaggcgatggatatggcatgccgagcaacagagatctcgttcacctctggtgacctctatatccctttctgctgccacgggcttccttgtccatagctaattttgtatccagcttgtactatacggccatagctgtttgtgagcgatatgttaaattggtatgaaactcgtcacctgtagatcttggaagtgattattggttgtctacgatggtggtaactgaggagttgatcttatttctaccaacctgacgaagtatgacttgttta

SEQ ID NO: 4634 - DNA, 1850 bp, Zea mays
gcctctacccactgctgcaaagcaaggacgacgtaaccactaccgttaccgcgggccttcttgagcggctccaagggatccaagtagcattatcgccaatcagtaagtaggctccaagagcaccgtccgtcaccacacaacaaagttagcaagtagcagtgaccacctgatccaaaagcaacaagtaggatcatggacgtggggaggcgcctttcgctggcccgcgtgccagcagtggccgcgctgatggttatgctgtcgctgagttcgtccttctgcgtgtcgtcgtcggcggcgagggcggtcgccaggcctggcgccgcggagcagctgcagcggcaccccgtggtgctgatcccgggagcgggcggcaaccagctggaggcgcggctgacggagggctacgagccgtccagcctggtgtgccgggtgtggccactcgtgcgcggccgcggtggctggttccgcctctggttcgacccctccgtgcttgtcgcgccgctcaccaggtgcttcgccgagcggatgacgctctcctatgacgccgacgccgacgactaccgcaacgcgcccggcgtcgagaccagggtctccgacttcggctccacctccaccctccgcggaggacctcgaccccaatctcaagctcctcacggggtacatgaacactctggcgagcacgctggaggaggccggctacgaggaaggccgcgacctgttcggcgcgccgtacgacttccggtacgggctggccgggccggggcacccgtcgcaggtgggcagcgcgtacctgcagcgcctcaggctgctggtggagtcggcgtgcgcggccagcggcgggaggcccgcgatcctggtggcgcacagcctgggcggcctcttcgcgctgcagctgctggcgcgcagcccgccgcagtggcgcgcggcgcacgtgcggcgcctcgtcacgctctccacgccgtggggcggctccgtgcaggagatgctcaccttcgcctccggcaacacgctcggggtgcccttcgtcgacccgtccctcatccgcgacgagcagcggaccgccgagagcaacctctggctgctgccgacgcccagcgtgttcggcaacaccacgctggtgctgtcgcgggcccacaaccgctcctactccgccaagaacatgacgcagttcctccgggacatcggcttcgaggaaggcgtggagccgtaccgcgcgcggatacggccgctcgtcgaggccctgccggagcccggcgtgcccctgacgtgcctcgtgggcaccggcgtcgacacggtggagagcctcgtgtacggcgaccgcggcttcgacgaggcccccgagaaggtggtctatggcgacggcgacgggacggtgaacctggccagcctcataggcccgatcaaggcgtggtcggactcgccggcgcaggtcgtcgaggtggtggagctgcccaaggtgtcgcattccggcatgctcagcgacaagagcgcgctggagcagatcataaggatcatcgattctatcaacctgaacgccacgagctatcatcattcctcttagaatgttttgctttagtagacaactaacgatgatttcttttcacttaaatcggcgacagcagctagttttttttatttggaaaaaagtttattgttttttctgtaaggattatcgggatttgctttagctggtgcctattagagttctctatgtatttcttaatcgttatgaataaatttttttgggaaaaagtacatttaaccagggttttaaagtagttatccaaatatactattctagatttctcgctaataaaaacagaaaataaaaatggttctctagagttgaa

SEQ ID NO: 4635 - DNA, 1773 bp, Setaria italica
ctacccactgcggccaggacgagacgtaaccactgccgttaccgtggcctttttgagcggctccaagcgatcctggtagcatcgccaatcagtgagctccgggaagcaccgtcaccaccacacaacacagtagcagggagcaccctaatcccaaaaagcaacaaggagacaaaagggaacaagcgtggaaggaagcatggaggggcgcccttcactggcccccgcgccagcagcggtgacggtgatggtcgttatgctgtcgacgctgagctgctcgtgctgcggcgcgtcgtcggcggcgagggcggtcgcggccgggcggcggccggtgatactgatcccgggcgcgggcggcaaccagctggaggcgcgcctgacggaggagtacaggccggcgagcctggcgtgccgggtgtggccgcccgtgcgcggccgcggcggctggttccgcctctggttcgacccctccgtcctcctcccgccgctcaccaggtgcttcgccgaccgcatgacgctctactacgacgccggcgccgacgactaccgcaacgcgcccggcgtcgagaccagggtctccgacttcggctccacctccaccctccgctacctcgatccaaacctcaagctgctgacggggtacatgaacaccctggcgagcacgctggagaaggccggctacgaggagggccgcgacctgttcggcgcgccgtacgacttccggtacgggctggcggggccggggcacccgtcgacggtgggcaccgcgtacctgcagcgcctccggctgctggtggagtcggcgtgcgcggccaacggcgggaggcccgccatcctgatggcgcacagcctcggcggcctcttcgcgctgcagctgctggcgcggagcccgctcccctggcgcgcggcgcacgtggcgcgcctcgtcacgctctcggcgccgtggggcgggtcggtgcaggagatgctcaccttcgcctccggcaacacgctgggggtgccgttcgtcgacgcctccctcatccgcgacgagcagcggagcgccgagagcaacctgtggctgctgccggcgccccgggtgttcggcaacaccacgctggtggtgtcgcggggccacggagacggcggcggcggcaaccgctcctactccgccaagaacatgacgcagttcctccgggacatcgggttcgagcagggcgtcgagccgtaccgcgcgcggatccggccgctcgtcgaggccctgccggagcccggcgtgcccgtgacgtgcctggtgggcaccggggtggacacggtggagagcctcgtgtacggggacggcggcttcgacgagccccccgaggaggtggtgtacggcgacggggacgggacggtgaacctggccagcctcgtggggccgatcaaggcgtggtccgactcgccggcgcaggtcgtggaggtcgtggagctccccaaggtgtcgcactccggcatcctcaacgacaggagcgcgctcgagcagatcatcaggatcgtcgactccatcaacctgaacgccacgagctatcagccgtcttgagatgctttgcattggtagacgactgattttaaaaattccacttcaaactttgagggttttttttttctagtttttttgttaattttatttacgagatgattgggatttgcttcgtagtagcttttagctgggactttgagggtgcatctttttgtgcacatcaataagtcatcttgttagaggcaaaaataaacaagagagttggatttagctttttg

SEQ ID NO: 4636 - DNA, 1374 bp, Setaria italica
ggaagcatggaggggcgcccttcactggcccccgcgccagcagcggtgacggtgatggtcgttatgctgtcgacgctgagctgctcgtgctgcggcgcgtcgtcggcggcgagggcggtcgcggccgggcggcggccggtgatactgatcccgggcgcgggcggcaaccagctggaggcgcgcctgacggaggagtacaggccggcgagcctggcgtgccgggtgtggccgcccgtgcgcggccgcggcggctggttccgcctctggttcgacccctccgtcctcctcccgccgctcaccaggtgcttcgccgaccgcatgacgctctactacgacgccggcgccgacgactaccgcaacgcgcccggcgtcgagaccagggtctccgacttcggctccacctccaccctccgctacctcgatccaaacgcgtgcgcaggctgctgacggggtacatgaacaccctggcgagcacgctggagaaggccggctacgaggagggccgcgacctgttcggcgcgccgtacgacttccggtacgggctggcggggccggggcacccgtcgacggtgggcaccgcgtacctgcagcgcctccggctgctggtggagtcggcgtgcgcggccaacggcgggaggcccgccatcctgatggcgcacagcctcggcggcctcttcgcgctgcagctgctggcgcggagcccgctcccctggcgcgcggcgcacgtggcgcgcctcgtcacgctctcggcgccgtggggcgggtcggtgcaggagatgctcaccttcgcctccggcaacacgctgggggtgccgttcgtcgacgcctccctcatccgcgacgagcagcggagcgccgagagcaacctgtggctgctgccggcgccccgggtgttcggcaacaccacgctggtggtgtcgcggggccacggagacggcggcggcggcaaccgctcctactccgccaagaacatgacgcagttcctccgggacatcgggttcgagcagggcgtcgagccgtaccgcgcgcggatccggccgctcgtcgaggccctgccggagcccggcgtgcccgtgacgtgcctggtgggcaccggggtggacacggtggagagcctcgtgtacggggacggcggcttcgacgagccccccgaggaggtggtgtacggcgacggggacgggacggtgaacctggccagcctcgtggggccgatcaaggcgtggtccgactcgccggcgcaggtcgtggaggtcgtggagctccccaaggtgtcgcactccggcatcctcaacgacaggagcgcgctcgagcagatcatcaggatcgtcgactccatcaacctgaacgccacgagctatcagccgtcttgagatg

SEQ ID NO: 4637 - DNA, 1684 bp, Brachypodium distachyon
caccacacaaagagcgacccaccaaatcccaactcaacgacgagacaaaacagagttaatcaatcgtatagaaccatggagagacgcccatcactagtagccatggtcgtggtggccatgctgtcgctgagctcgtgctgctgctgcgcgtcgtcgtccgcgggcggcgggcagcagctgcacccggtgatactgatcccggggtccggcggcaaccaactggaggcgaagctgacggaggagtacagcccgtcgagcctggcgtgccgggtgtggccgctggtgcgcggccggggcggctggttccgcctgtggttcgacccctccgtcctggttgcgcccctcacccggtgcttcgccgagcgcatgatgctctactacgacatcgccgccgacgactaccgcaacgcgccgggcgtcgagacccgggtctccgacttcggctccacctcctccctccgctacctcgacccaaacctcaagctgctgacggggtacatggacgcgctggcgagcacgctggagaaggcggcagggtacgaggaagggcgggacctgttcggcgcgccgtacgacttccgttacggtctcgccgcgccggggcacccgtcgcaggccggcagcgcgtacctggaacgcctcaggcttctggtagaatccgcgtgcgcggccaacggcggcaaacccgcgatcctgctagcgcacagcctgggcgggctctacgcgctgcagctcctagcgcgcagcccggccccctggcgggccgcgcacgtgaagcggctggtgacgctgtcggcgccctggggcggctccgtgcaggagatgctcaccttcgcgtccgggaacacgctgggcgtgccgttcgtggacgcgtccatcatccgcgacgagcagcggagctccgagagcaacctctggctgctgcccacgccgaaggtgttcggcaacacgacgctcgtggtgtccgagttccacaaccggtcctactcggccaagaacgtaacgcagttcctgcgggacatcgggttcgagggcggcgtggagccctacagggccaggatacggccgctcggggaagccctgccggagcccggggtgcccgtcacgtgcctcgtgggcaccggcgtggacaccgtggagagcctcgtgtttgggaaggaagggttcgaggccggcccggtgaaagtggcgtatggggatggggatgggacggtgaaccttgctagccttgtcgggccgatcaaggcgtgggctgactcgccggcgcaggtgctcgaggttgtggagctgcccggggtgtcgcactcgggcatcctcaaggacaagagcgcgctccagcagatcgtcaggattgtcgatgccatcaatctcaacaccacgggctcgaactatctgcggtcgttttaattggattttttttttcttcggcagtagtttttgctgggaagaaaatgttgaggtttgctaactagtagcggtttccactaatttggacttcgatctgatcagtgcatgttttcttgcacgttgacgaattgttgttttctaaaagaaaaataagagacattttgtatcggtgaaattaaaactttagagatgtgagttcattgcccaatgcttgtacaagttgatttacaacccgccacctccccaaccaaaaatagaaagttacatgctctgtttc

SEQ ID NO: 4638 - DNA, 1365 bp, Brachypodium distachyon
atggagagacgcccatcactagtagccatggtcgtggtggccatgctgtcgctgagctcgtgctgctgctgcgcgtcgtcgtccgcgggcggcgggcagcagctgcacccggtgatactgatcccggggtccggcggcaaccaactggaggcgaagctgacggaggagtacagcccgtcgagcctggcgtgccgggtgtggccgctggtgcgcggccggggcggctggttccgcctgtggttcgacccctccgtcctggttgcgcccctcacccggtgcttcgccgagcgcatgatgctctactacgacatcgccgccgacgactaccgcaacgcgccgggcgtcgagacccgggtctccgacttcggctccacctcctccctccgctacctcgacccaaacctcaagctgctgacggggtacatggacgcgctggcgagcacgctggagaaggcggcagggtacgaggaagggcgggacctgttcggcgcgccgtacgacttccgttacggtctcgccgcgccggggcacccgtcgcaggccggcagcgcgtacctggaacgcctcaggcttctggtagaatccgcgtgcgcggccaacggcggcaaacccgcgatcctgctagcgcacagcctgggcgggctctacgcgctgcagctcctagcgcgcagcccggccccctggcgggccgcgcacgtgaagcggctggtgacgctgtcggcgccctggggcggctccgtgcaggagatgctcaccttcgcgtccgggaacacgctgggcgtgccgttcgtggacgcgtccatcatccgcgacgagcagcggagctccgagagcaacctctggctgctgcccacgccgaaggtgttcggcaacacgacgctcgtggtgtccgagttccacaaccggtcctactcggccaagaacgtaacgcagttcctgcgggacatcgggttcgagggcggcgtggagccctacagggccaggatacggccgctcggggaagccctgccggagcccggggtgcccgtcacgtgcctcgtgggcaccggcgtggacaccgtggagagcctcgtgtttgggaaggaagggttcgaggccggcccggtgaaagtggcgtatggggatggggatgggacggtgaaccttgctagccttgtcgggccgatcaaggcgtgggctgactcgccggcgcaggtgctcgaggttgtggagctgcccggggtgtcgcactcgggcatcctcaaggacaagagcgcgctccagcagatcgtcaggattgtcgatgccatcaatctcaacaccacgggctcgaactatctgcggtcgttttaattggattttttttttcttcggcagtagtttttg

SEQ ID NO: 4639 - DNA, 9712 bp, Sorghum bicolor
gaaatgggcgcgcaggaggcggcagtggaggaggtgctgcgcgccgccgccgtcgaggtctcaacctcctcggcgaagcgccgcctccgcctcttccgccacaccctacctcctctcatcgcgaaggccacagagtcaccatcagatattgcattgttagttgatctcattttccagacattgccaatctatgacgatcgggcatcacgaaaagcagtagatgatatggttattcaggctcttggtgaacccaccttcatgaagccctttgctgcggtacttgtacaatctatggaaaagaatctaaaggtttcaaacccccttacaagcttcaagcttctcagatggtcacactatcttctgaaatggagtcaatttgccacactttcaaaaggtgcttttaccagactggccaacgcacaagcagtcttatgtcaagcccttatggacgggtccttccgtcggtgccggacttgcaaacagttattcgttcatcttttctctgagcctagtggaatatataagatgtacatagaggagctcagagatttaaggatttccatgagagattctcctgcatttttgaatctaatactggattttaccattacctctccatcattatccactgagtacaagtcggtgttccttgatttgtatgtcaaaaccatcttgagttcaaaagaccggccaccaaaagcagccactgaagcttttaagcctcttttcttggagattgggcatgaggattttaagaatactgttataccatcatgcataaagatgctgaaaagaaatcctgaaatcgtactacagtctattggatatcttcttaagacagtccgtttagacctaagcaagtattccatggagtttatgccagttgttctgcatcaggcccggcattcagatgaagagaggagggttaatgctttgagtattataggtacactaagtgagaagtcaagtgatccagatgctctaccttccatggtcaatgctatcaaagctgttttaggaggctcagaagggaaactatcacttccataccagagaattggaacaataaatgctttagagcagctatcaagatctcctccgaagcaaataggcagacttgctccctcagtatcaagtttccttctaacgtgttacagggatgatggtatcgaggaggtgaaattggcgattctatcagcaataggatcctgggctttggtatcagctgaagctgtccaaccagatgttgtttcatttattgctgcaggcttgaaagagaaagacactttaaggaaggggcatctaaaatttttacgagttatatgcaaaaactcggattctttaacaaaggttgcttctttattggatcatttgattcagttgtcaaaaactggcttcagcaaggcaacacagcggttggatggagtctatgcactctttgcagtatcgaggcttgctgctgttgatacaaaagcagatggtgccattctgaaggagaaactgtggacattgattgctcaaaatgaaccctcattgatctctttacagctgcttcccaaactagcagatgatgattgcttagccgtcctggatcttcttcaatcactgcttgtagaacatttcttcagggttcgagaatatttttcgatccagtcattgctgcagctgcaaatatatctactttgccatccaagctgggaagtgagaaaggtagcttctgatgttaccaagaaaatcttctcaagctccagtggtctagccgaagatatcctattcttattcacagattggttgtcactagttggagagagactgtcaatattgaaacaaggtgatatggatagctcttcggattcccagataccatttgttccatctactgaggtccttgtcaagtgcttgtttctgattgcaccttatgctgttgtgcatagtccgagatcatattctcgaattattttgtgctcccaccacccttgtctttccagctcctcaagcccagctggtgtatataagaggttgcaaaaaaggctgagacaagaacagattttctttgttgacttaattactcccaacatctccgttatctgcaagcacttcataggactccaggagcgcaccttgcacgattccttctctgagagtgatattaagatattctatactccagaggggcagttgtcaaccgagcaaggagtttacatcgccgaggctgttgcttccaaaaatacaaaacttgcaaaggggcgtttccgtgcatatgatgatcaagatgcacatacagctcggtctgttgtccctgcaaagaatgaaaagagagaatcctcaagcactggcaagcgagaaactgggaaatctacaaaaaagactgctcctatagacaaggctaagactgctaaagaggaggccagagaattgctcttgaaggaggaagcatctgtacgtatgaaggttgggcaagtgcagaagattctctccttaatgttggatgcccttggcgaattggctattgctaatcctatatttactcatggtcaactgccatcactggtaaattatgttgaacctttgctaagttctgcaatagtaagcgatgctgcattttgtacaatgttgaggctagctcgttgcacagcacctcctctttgcaattgggcgcctgagattgctgctgcaattcgtgtgatatctgttggtgattttgaaatggttttggatcttacacctgtgatcatggaagatgatagcaagaagaagccttcatctggcctctttgaacaaatagtaaatgggctgactattgcgtgcaaagcgggtcctcttccagcagattcatttacttttgtctttccggttctttatcatgtgctaagcactgttcctgcctatcatccttcagttgggcctatgctgaatgagctatgcctaggtctaagaagccatgagttagcacaggctcttgttggtgtatatgcaaaagaagtgcacgttaggcttgcctgcttaactgctataaaatgtgttcctgtgcactctgtgcaacgagatttgcaggtgtcaacaagcctctggattgctgcacatgatccggagaaggtggttgctgaattagcagaggagttatgggaccgctttggttttgatgtcatcactgattactctggtattttcgatgcactttcccataaaaattacaatgttcgtgctgcatctgctgaggctctggctgcggcattggatgaaaatcaagacaaaatgcaagatgcactttctacccttttctctctttacattcgtgatcttggccctggtgttgaatttggagatgcacactggcttggaagacagggcattgcattagcactccactctatcgctgatgttttggcctctaaagatcttcctgttgttatgacatttctcatctcacgtgctctggctgatccaaatgttgatgttcgtggtagaatgattaatgctggcatccttattattgataggcatggaaaggaaaatgttcctttgctatttcctatttttgagagctacttgaataaaagggcaagtactactttcctattaataattgtactagcatcagacgaggaaacatatgatcttgtgagggaaggtgttgttattttcactggtgctctggccaaacatctatcaaaggatgatcccaaagttcacagtgtcattgagaagttgctagatgtccttaacaccccatcagaggcagttcaacgtgctgtctcagattgtttgtccccacttatggtatccaaacaggaagagggtcaagctcttgtttctagactcttggatcggatgatgaaatgtgacaagtatggtgagcgacgtggtgcagcctttggccttgctggtgtggttaaaggatttggaatttcttccttgaaaaaatatggcattgctgcaacattgcagcaaaatttggaagacagaatctctgcaaaatctcgtgaaggagctttacttggatttgagtgcctgtgtgagaagctcggcaaactatttgagccgtatgtcattcaaatgcttccgttcctacttgtgtctttctctgatcaagtcctagcagtgcgtgaagctgctgagtgtgctgctcgggcaatgatgtctcagctcactggtcctggtgtgaagcttgtccttccttcacttcttaagggtctagaagataaagcatggcgtactaagcaaagcagcgttcaacttcttggtgccatggcatattgtgctcctcagcagctatctcagtgtcttccaaagattgttccaaagttaacagaggtactaacagacacacatcctaaagtccaagcggctggacagacagctctccaggaggttggaagtgtcataaagaatcctgaaatttctgcactagtccctattcttctgtcagctctgatggatccaaatgcccacactaaacactctcttgacatccttcttcagactacttttattaactctatagacgcaccatcgcttgcactgcttgtgcctattgtgcatagaggactgagggagaggggtgttgagactaaaaagaaagctgctcaaatagttggaaacatgtcttctttggttacggaaccaaaggatatgatcccatacattggtttgctcctaccagaagttaagaaggttctagtggatcctatacctgaagtcagggcagtggctgctcgagctctgggatctcttataagtggaatgggtgaagaaatcttcccagatcttgtgccatggttattggatactctgaaatcagataatagtaatgttgaacgatctggtgctgcccagggattgagtgaggttttagctgctcttggccaagattattttgaccatattcttcctgacatcatccggaactgttcacaccaaaaggcttccgttcgtgatggacatcttacacttttccggtatttgccaaggtccttgggtggcgttttccagaactatctgcaggctgttcttcctgctatattagatgggcttgctgatgagaacgaatctgttcgtgatgctgcactttctgctggtcatgtctttgtggagcattatgcaactacgtccttacctctgttgcttcctgctatcgaggatgggatcttcagtgataattggcgtatccggcaaagttctgttgaacttcttggggatctcttatttaaggtcgctggaacttctgggaaggcaatccttgagggtggaagtgatgatgaaggtgctagtacagaggctcaggggcgtgctattattgaagtacttggaagggagaaacgcaatgaagttcttgctgccatttatatggttcgttctgatgtcagcttgactgtccggcaggctgcattacatgtctggaagacaattgtagcaaatactccaagaactctgaaagagataatgccagtacttatggacacacttatttcatctcttgcatcatcttcctcagaaaggcgtcaggtcgctggaagatcacttggcgagcttgtaaggaagctgggtgaaagagttttgccctcgattattccaatcctgtcacaaggactcaaagacccaagtgctagcagaagacaaggagtttgcattggtttgagtgaggttatgggcagtgctgggaaacaccagctattaagttttatggatttacttattcctaccattcgtactgctctatgtgacagccatatctattgtaacagcacccaagaggtccgtgaatctgctgggttagcgtttagtactctgtacaagagtgctggactgcaagccattgatgagattgtccccacattgctacgggctttggaagatgacgatacatctgcaacagcccttgatggtctaaaacagattttaagttcatttaatgcacatgcattaggtgctctagcagaagttgccgggccaggtttgaattcacatattggaactgttctcccagcattgattcttgctatggatgatgaagatgtggatgtacaaaactcagccaggaaagctgctgaaactgttctgttggttattgatgaggaaggagttgaaactttgatacctgagcttctaagaggaatcaatgacagtcaggcatcaatgaggcggggttcagcctatctaattggtttcctctttaaaaacactaaattatatttggctgatgaggcttctgatatgatgtcaaccctcataattttgttgagcgatacagataaggctactgtatcagctgctttagaagcattttcaagagttgctacatctgttccaaaggaacagctcccgacgtatataaaactagtgcgcgatgctgtctctacggccagagataaagaacgtagaaggcgaaagggtgtgcctattcttgtgcctggcttatgtcttcctaaagcactgcagccttttcttcctatatttcagcagggtttaattagtgggtcggccgaaacaaaggagcaggcagctgaaggtttaggagagttaattgacgtaacaagtgagaagactcttaaggaagttgtagtgccaattacaggacctcttattcgcatccttggtgatcggtttccctggcaagttaagtcagctatcctatcaaccttgacaatcatcatcatgaaaggtggaattgcacttaagcccttccttccacaacttcaaactacatttatgaaatgtctacaggataacaataggtctctccggacgagggctgcagctgctctcggaaagcttagtgctcttagcacacgggtggattctttagttggcgaacttctgtccatgttgcagtcaggagatgaatctgtcgaagaaagtgtgctttctgctcttaaaggtgttatcaaacatgctggcaaaagtgtcagctctgcaataaggtcacgtggttgtgctcttcttgaagatctgctgcaggctcaagttgatgatgtccgcagttgtgctgcaaaagtgattggcacattgtctcagtacatggaggagacagagatttcagatttggtgcaaaccctattgaacgtgagcacctcgtcagactggtgtaccaggcatggtgctttgttagcattctcatccatatcaatgcattctccatcaaaattgtgtcatttggcatcctttccatctctggttgatcttctcaaagattctcttaaagacgacaagttccctgttcgtgaagttgctacaagaactctgggaaggattctctgtttcgagctacagtcagaagccagcaccttgcaacttgttcagttgcttgtcttggccttgcgtgatgattcaagtgaagttaggagaagatctttgtcgtgtatcaaagctgctgcaaaggtttatcattggagcctctttatctcaatataaatcattcagctcttgctacacatcactctgtattgggcccagcaattgctgatgctttgaaggactctagcatgcctgtacgcctagcagcagaacgctgcgcccttcatgttttccagttgactaaagggccagataatgttacatcagcacaaaagtacctaggcatgactggcttggaagtgaaaaaaattgcaaagcttaacgaggagagtgatggcagtgagagcagtgatgatgacaagaggacataaactccactcggcaatcttttataggttcagttgttattacgtttacatatagttagctacattgatagtggaaggtgggggtcatttttctgtctgacccattttgtgaacatccttttttacaaccaagtggcaaaggaagacacgtcggcatttgtcatattttgttgcggcaaaccgactatgtttacgcaaaccaacaaatagtgttgaagttattcgatcaaagaattatctttacccagtttttcccagagttcggacacgggacttgtattcacctcaatttgaatggacaaatttcaagaacacaacagttatattgcgatcaacggccggttcgttactttgagcacaacaccgctatctcagttctacgataaagcacgtcaatgtatatctatcatatcgtcgagcattgttccctaccatctctcgtctccctcccagttgtttttctccttgggcccggtcggcccttcttccctagacagctcgttgggcatcttgttcagcatgctctccgctctgcacttgagccggggaggcaggcgcccgaccatccactccatccgcttcctcgacttgtacaccaccgtcggaccccactcccgcatgaactgcagccactgcggctctacgacggcgccctcgcccagatactccgccgcaacgatgcggtacctggcgctggagtccacgaatagactgctccgagcggcgtcgttgcggatgccgatcccgagcgccgccgagccctgcaggtacacaccagggtacgcgtagctcgcgtgcccgttcctggacgagtacaccacgggccggttgccgtcgatgtactccagcgcggaggcgtccacccagtgcccgccgctgtgctgcgagtagtacacgcccatgagctcaccggtgaggttgctgacgcggaacgtggagtgctcccagtccccgacgtgccgcccggtcttgcccagtgggaggctgatcgggcccagcttgagcctcgccgggccgttgaacgggcagaacacccacatggccacgtcggtgcacgtgccgcccatggccggcttcacgtgcgcgtagagctccgcgctgtcgatgttgccgcggcacacggcgcggccccgctcgccgctgggaacgtcgatccagtactccccgtcgttgcaaccgccgccagggaggttagacccctcgccgtcgatctcctcgcccgcggcggtgtctccacctcgcttgtacaatgcggctccgttcttgaagaaccaggagacggacgacggcaggtagacctccttggggtggaagaacaacgtggggccgtagtgccggatcaccgcgtgcgcctgctccagcgtcggcatcgccgacaggtcgagctcgacgttgcccaggcacgccatgccgtgctcgcgtggcgggagcccgtcagcggcgcagcagaaggtgcccacgcacactcctttcctccacatccctctgcgcaccggacgcacgccctgcacggtgaagaacgacgacggccccggcagctgcaggcggagcagcgacccgtgcggctcgcactcgtccgtgaggtcctcgcggacgcatgccacctcctcgagaggtggactctgccgttccgtcgtcacgaggcacccgatcgcccagtatccctccggcggcacggggacccagaagtaggcgtcgcttcggccgtagccgtggccggcattggcacggctgccaccggcatggaattcccagatgagcgcgtagtccagcggctttgcaagcggcggcggctgaggcgtggcgccgggcgggcgctcccccgctctggcaacgaggacgtggccgtgcagcgggcggcagtttggctggcagtagtagcccaggagggagaaccccgccgggacgccgaccggccggtaaaaggtggcgctgccgccgccacgccgccgcgacgacagggtgcagatcttctggaacgcggtggccgcggcgagctccagctcccctccgccgatgcgtatcctcccctgcgcgaatccaccgcctgc

SEQ ID NO: 4640 - DNA, 9703 bp, Sorghum bicolor
attactttgttttacgtgcagagtcaccatcagatattgcattgttagttgatctcattttccagacattgccaatctatgacgatcgggcatcacgaaaagcagtagatgatatggttattcaggctcttggtgaacccaccttcatgaagccctttgctgcggtacttgtacaatctatggaaaagaatctaaaggtttcaaacccccttacaagcttcaagcttctcagatggtcacactatcttctgaaatggagtcaatttgccacactttcaaaaggtgcttttaccagactggccaacgcacaagcagtcttatgtcaagcccttatggacgggtccttccgtcggtgccggacttgcaaacagttattcgttcatcttttctctgagcctagtggaatatataagatgtacatagaggagctcagagatttaaggatttccatgagagattctcctgcatttttgaatctaatactggattttaccattacctctccatcattatccactgagtacaagtcggtgttccttgatttgtatgtcaaaaccatcttgagttcaaaagaccggccaccaaaagcagccactgaagcttttaagcctcttttcttggagattgggcatgaggattttaagaatactgttataccatcatgcataaagatgctgaaaagaaatcctgaaatcgtactacagtctattggatatcttcttaagacagtccgtttagacctaagcaagtattccatggagtttatgccagttgttctgcatcaggcccggcattcagatgaagagaggagggttaatgctttgagtattataggtacactaagtgagaagtcaagtgatccagatgctctaccttccatggtcaatgctatcaaagctgttttaggaggctcagaagggaaactatcacttccataccagagaattggaacaataaatgctttagagcagctatcaagatctcctccgaagcaaataggcagacttgctccctcagtatcaagtttccttctaacgtgttacagggatgatggtatcgaggaggtgaaattggcgattctatcagcaataggatcctgggctttggtatcagctgaagctgtccaaccagatgttgtttcatttattgctgcaggcttgaaagagaaagacactttaaggaaggggcatctaaaatttttacgagttatatgcaaaaactcggattctttaacaaaggttgcttctttattggatcatttgattcagttgtcaaaaactggcttcagcaaggcaacacagcggttggatggagtctatgcactctttgcagtatcgaggcttgctgctgttgatacaaaagcagatggtgccattctgaaggagaaactgtggacattgattgctcaaaatgaaccctcattgatctctttacagctgcttcccaaactagcagatgatgattgcttagccgtcctggatcttcttcaatcactgcttgtagaacatttcttcagaaatacttatatgggctgtagcatgtattgattcattgtccttttgtacagctgcaaatatatctactttgccatccaagctgggaagtgagaaaggtagcttctgatgttaccaagaaaatcttctcaagctccagtggtctagccgaagatatcctattcttattcacagattggttgtcactagttggagagagactgtcaatattgaaacaaggtgatatggatagctcttcggattcccagataccatttgttccatctactgaggtccttgtcaagtgcttgtttctgattgcaccttatgctgttgtgcatagtccgagatcatattctcgaattattttgtgctcccaccacccttgtctttccagctcctcaagcccagctggtgtatataagaggttgcaaaaaaggctgagacaagaacagattttctttgttgacttaattactcccaacatctccgttatctgcaagcacttcataggactccaggagcgcaccttgcacgattccttctctgagagtgatattaagatattctatactccagaggggcagttgtcaaccgagcaaggagtttacatcgccgaggctgttgcttccaaaaatacaaaacttgcaaaggggcgtttccgtgcatatgatgatcaagatgcacatacagctcggtctgttgtccctgcaaagaatgaaaagagagaatcctcaagcactggcaagcgagaaactgggaaatctacaaaaaagactgctcctatagacaaggctaagactgctaaagaggaggccagagaattgctcttgaaggaggaagcatctgtacgtatgaaggttgggcaagtgcagaagattctctccttaatgttggatgcccttggcgaattggctattgctaatcctatatttactcatggtcaactgccatcactggtaaattatgttgaacctttgctaagttctgcaatagtaagcgatgctgcattttgtacaatgttgaggctagctcgttgcacagcacctcctctttgcaattgggcgcctgagattgctgctgcaattcgtgtgatatctgttggtgattttgaaatggttttggatcttacacctgtgatcatggaagatgatagcaagaagaagccttcatctggcctctttgaacaaatagtaaatgggctgactattgcgtgcaaagcgggtcctcttccagcagattcatttacttttgtctttccgatcatggaaaggatccttctatcttcaaaaaagacgtgtcttcatgatgatgtggttcacatactatctttgcatatggatccaatactaccgcttcctcgtcctaggatgttatcagttctttatcatgtgctaagcactgttcctgcctatcatccttcagttgggcctatgctgaatgagctatgcctaggtctaagaagccatgagttagcacaggctcttgttggtgtatatgcaaaagaagtgcacgttaggcttgcctgcttaactgctataaaatgtgttcctgtgcactctgtgcaacgagatttgcaggtgtcaacaagcctctggattgctgcacatgatccggagaaggtggttgctgaattagcagaggagttatgggaccgctttggttttgatgtcatcactgattactctggtattttcgatgcactttcccataaaaattacaatgttcgtgctgcatctgctgaggctctggctgcggcattggatgaaaatcaagacaaaatgcaagatgcactttctacccttttctctctttacattcgtgatcttggccctggtgttgaatttggagatgcacactggcttggaagacagggcattgcattagcactccactctatcgctgatgttttggcctctaaagatcttcctgttgttatgacatttctcatctcacgtgctctggctgatccaaatgttgatgttcgtggtagaatgattaatgctggcatccttattattgataggcatggaaaggaaaatgttcctttgctatttcctatttttgagagctacttgaataaaagggcatcagacgaggaaacatatgatcttgtgagggaaggtgttgttattttcactggtgctctggccaaacatctatcaaaggatgatcccaaagttcacagtgtcattgagaagttgctagatgtccttaacaccccatcagaggcagttcaacgtgctgtctcagattgtttgtccccacttatggtatccaaacaggaagagggtcaagctcttgtttctagactcttggatcggatgatgaaatgtgacaagtatggtgagcgacgtggtgcagcctttggccttgctggtgtggttaaaggatttggaatttcttccttgaaaaaatatggcattgctgcaacattgcagcaaaatttggaagacagaatctctgcaaaatctcgtgaaggagctttacttggatttgagtgcctgtgtgagaagctcggcaaactatttgagccgtatgtcattcaaatgcttccgttcctacttgtgtctttctctgatcaagtcctagcagtgcgtgaagctgctgagtgtgctgctcgggcaatgatgtctcagctcactggtcctggtgtgaagcttgtccttccttcacttcttaagggtctagaagataaagcatggcgtactaagcaaagcagcgttcaacttcttggtgccatggcatattgtgctcctcagcagctatctcagtgtcttccaaagattgttccaaagttaacagaggtactaacagacacacatcctaaagtccaagcggctggacagacagctctccaggaggttggaagtgtcataaagaatcctgaaatttctgcactagtccctattcttctgtcagctctgatggatccaaatgcccacactaaacactctcttgacatccttcttcagactacttttattaactctatagacgcaccatcgcttgcactgcttgtgcctattgtgcatagaggactgagggagaggggtgttgagactaaaaagaaagctgctcaaatagttggaaacatgtcttctttggttacggaaccaaaggatatgatcccatacattggtttgctcctaccagaagttaagaaggttctagtggatcctatacctgaagtcagggcagtggctgctcgagctctgggatctcttataagtggaatgggtgaagaaatcttcccagatcttgtgccatggttattggatactctgaaatcagataatagtaatgttgaacgatctggtgctgcccagggattgagtgaggttttagctgctcttggccaagattattttgaccatattcttcctgacatcatccggaactgttcacaccaaaaggcttccgttcgtgatggacatcttacacttttccggtatttgccaaggtccttgggtggcgttttccagaactatctgcaggctgttcttcctgctatattagatgggcttgctgatgagaacgaatctgttcgtgatgctgcactttctgctggtcatgtctttgtggagcattatgcaactacgtccttacctctgttgcttcctgctatcgaggatgggatcttcagtgataattggcgtatccggcaaagttctgttgaacttcttggggatctcttatttaaggtcgctggaacttctgggaaggcaatccttgagggtggaagtgatgatgaaggtgctagtacagaggctcaggggcgtgctattattgaagtacttggaagggagaaacgcaatgaagttcttgctgccatttatatggttcgttctgatgtcagcttgactgtccggcaggctgcattacatgtctggaagacaattgtagcaaatactccaagaactctgaaagagataatgccagtacttatggacacacttatttcatctcttgcatcatcttcctcagaaaggcgtcaggtcgctggaagatcacttggcgagcttgtaaggaagctgggtgaaagagttttgccctcgattattccaatcctgtcacaaggactcaaagacccaagtgctagcagaagacaaggagtttgcattggtttgagtgaggttatgggcagtgctgggaaacaccagctattaagttttatggatttacttattcctaccattcgtactgctctatgtgacagcacccaagaggtccgtgaatctgctgggttagcgtttagtactctgtacaagagtgctggactgcaagccattgatgagattgtccccacattgctacgggctttggaagatgacgatacatctgcaacagcccttgatggtctaaaacagattttaagtgtcagaacagcagctgttttgccccatatattgcccaaattagtccagccccccctttcttcatttaatgcacatgcattaggtgctctagcagaagttgccgggccaggtttgaattcacatattggaactgttctcccagcattgattcttgctatggatgatgaagatgtggatgtacaaaactcagccaggaaagctgctgaaactgttctgttggttattgatgaggaaggagttgaaactttgatacctgagcttctaagaggaatcaatgacagtcaggcatcaatgaggcggggttcagcctatctaattggtttcctctttaaaaacactaaattatatttggctgatgaggcttctgatatgatgtcaaccctcataattttgttgagcgatacagataaggctactgtatcagctgctttagaagcattttcaagagttgctacatctgttccaaaggaacagctcccgacgtatataaaactagtgcgcgatgctgtctctacggccagagataaagaacgtagaaggcgaaagggtgtgcctattcttgtgcctggcttatgtcttcctaaagcactgcagccttttcttcctatatttcagcagggtttaattagtgggtcggccgaaacaaaggagcaggcagctgaaggtttaggagagttaattgacgtaacaagtgagaagactcttaaggaagttgtagtgccaattacaggacctcttattcgcatccttggtgatcggtttccctggcaagttaagtcagctatcctatcaaccttgacaatcatcatcatgaaaggtggaattgcacttaagcccttccttccacaacttcaaactacatttatgaaatgtctacaggataacaataggtctctccggacgagggctgcagctgctctcggaaagcttagtgctcttagcacacgggtggattctttagttggcgaacttctgtccatgttgcagtcaggagatgaatctgtcgaagaaagtgtgctttctgctcttaaaggtgttatcaaacatgctggcaaaagtgtcagctctgcaataaggtcacgtggttgtgctcttcttgaagatctgctgcaggctcaagttgatgatgtccgcagttgtgctgcaaaagtgattggcacattgtctcagtacatggaggagacagagatttcagatttggtgcaaaccctattgaacgtgagcacctcgtcagactggtgtaccaggcatggtgctttgttagcattctcatccatatcaatgcattctccatcaaaattgtgtcatttggcatcctttccatctctggttgatcttctcaaagattctcttaaagacgacaagttccctgttcgtgaagttgctacaagaactctgggaaggattctctgtttcgagctacagtcagaagccagcaccttgcaacttgttcagttgcttgtcttggccttgcgtgatgattcaagtgaagttaggagaagatctttgtcgtgtatcaaagctgctgcaaagataaatcattcagctcttgctacacatcactctgtattgggcccagcaattgctgatgctttgaaggactctagcatgcctgtacgcctagcagcagaacgctgcgcccttcatgttttccagttgactaaagggccagataatgttacatcagcacaaaagtacctaggcatgactggcttggaagtgaaaaaaattgcaaagcttaacgaggagagtgatggcagtgagagcagtgatgatgacaagaggacataaactccactcggcaatcttttataggttcagttgttattacgtttacatatagttagctacattgatagtggaaggtgggggtcatttttctgtctgacccattttgtgaacatccttttttacaaccaagtggcaaaggaagacacgtcggcatttgtcatattttgttgcggcaaaccgactatgtttacgcaaaccaacaaatagtgttgaagttattcgatcaaagaattatctttacccagtttttcccagagttcggacacgggacttgtattcacctcaatttgaatggacaaatttcaagaacacaacagttatattgcgatcaacggccggttcgttactttgagcacaacaccgctatctcagttctacgataaagcacgtcaatgtatatctatcatatcgtcgagcattgttccctaccatctctcgtctccctcccagttgtttttctccttgggcccggtcggcccttcttccctagacagctcgttgggcatcttgttcagcatgctctccgctctgcacttgagccggggaggcaggcgcccgaccatccactccatccgcttcctcgacttgtacaccaccgtcggaccccactcccgcatgaactgcagccactgcggctctacgacggcgccctcgcccagatactccgccgcaacgatgcggtacctggcgctggagtccacgaatagactgctccgagcggcgtcgttgcggatgccgatcccgagcgccgccgagccctgcaggtacacaccagggtacgcgtagctcgcgtgcccgttcctggacgagtacaccacgggccggttgccgtcgatgtactccagcgcggaggcgtccacccagtgcccgccgctgtgctgcgagtagtacacgcccatgagctcaccggtgaggttgctgacgcggaacgtggagtgctcccagtccccgacgtgccgcccggtcttgcccagtgggaggctgatcgggcccagcttgagcctcgccgggccgttgaacgggcagaacacccacatggccacgtcggtgcacgtgccgcccatggccggcttcacgtgcgcgtagagctccgcgctgtcgatgttgccgcggcacacggcgcggccccgctcgccgctgggaacgtcgatccagtactccccgtcgttgcaaccgccgccagggaggttagacccctcgccgtcgatctcctcgcccgcggcggtgtctccacctcgcttgtacaatgcggctccgttcttgaagaaccaggagacggacgacggcaggtagacctccttggggtggaagaacaacgtggggccgtagtgccggatcaccgcgtgcgcctgctccagcgtcggcatcgccgacaggtcgagctcgacgttgcccaggcacgccatgccgtgctcgcgtggcgggagcccgtcagcggcgcagcagaaggtgcccacgcacactcctttcctccacatccctctgcgcaccggacgcacgccctgcacggtgaagaacgacgacggccccggcagctgcaggcggagcagcgacccgtgcggctcgcactcgtccgtgaggtcctcgcggacgcatgccacctcctcgagaggtggactctgccgttccgtcgtcacgaggcacccgatcgcccagtatccctccggcggcacggggacccagaagtaggcgtcgcttcggccgtagccgtggccggcattggcacggctgccaccggcatggaattcccagatgagcgcgtagtccagcggctttgcaagcggcggcggctgaggcgtggcgccgggcgggcgctcccccgctctggcaacgaggacgtggccgtgcagcgggcggcagtttggctggcagtagtagcccaggagggagaaccccgccgggacgccgaccggccggtaaaaggtggcgctgccgccgccacgccgccgcgacgacagggtgcagatcttctggaacgcggtggccgcggcgagctccagctcccctccgccgatgcgtatcctcccctgcgcgaatcca

SEQ ID NO: 4641 - DNA, 2369 bp, Zea mays
attctcgggtcgagacggcaagcgtcagaccagtgacgaagcaaatctaccatgcgatgcgagcatgacaaataaataccctttacctcgtccttgccgccgcggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcagcgacgtccgcgtgggcgggcgcgtcccccccgaggagccggagccggaggtcttctccttcgccgagcccctcccgtcgtggcccacaggcgggggattcgcgcgggggaggatacgtatcggcggaggggagctggagctcgccgcggccaccgcgttccagaagatctgcaccctgtcgtcgcggcggcgtggcggcggcggcagcgccaccttttaccggccggtcggcgtcccagaggggttctcgctcctgggttactactgccagcctaactgccgcccgctccacggccacgtcctcgttgccagagcgggggagcgcccgtccggcgcctcacctcagccgccgccgccgccgctctgcaagccgctggactatacgctcatctgggaattccaagccagtggcgataccggctacggctacggtcgaagcgacgcctacttctggatccccgtgccgccggagaggtatcgggcgctcgggtgtctcgtgaccacggaaccacggagaccaccgctcgaggaggtggtatgcgtccgcgaggacctgacggacgagtgcgagccgcacggctcgctgctctgcctagagcagccgcggccgtcttcgttcttcaccgtgcggggcgttcgtccggtgcgccgagggatacgggagaaaggagtgtgcgtgggcaccttctgctgcgccgctgacgggctccccccgcgcgagcacggcatggcgtgcctgggcaacgtcgagctcgacctgtcggcgatgccaacgctggagcaggcgcacgcggtgatccggcactacggccccacgctgttcttccaccccaaggaggtctacctgccgtcgtccgtctcttggttcttcaagaacggcgccgcgttgtacaggcgagggggagacaccgcgggcgaggagatcgacggcgaggggtccaacctccctggtggcggttgcaacgacggggagttctggatcgacgttcccagcggcgagcggggccgcgccgtgtgccgcggcagcatcgacagcgcggagctctacgcgcacgtgaagccggccatgggcggcacgtgcaccgacgtggccatgtgggtgttctgcccgttcaacggcccggcgaggctcaagctgggcccgatcagcctcccgctgggcaagaccgggcggcacgtcggggactgggagcacttcacgttccgcgtcagcaacctcaccggtgagctcatgggcgtgtactactcgcagcacagcggcgggcactgggtggacgcctccgcattggagtacatcgacggcaaccggcctgtggtgtactcgtccaggaacgggcacgcgagctacgcgtaccctggcgtgtacctgcagggctcggcggcgctcggggtcggcatccgcaacgacgccgctcggagcagcctattcgtggactccagcgccaggtaccgcatcgttgcggcggggtatctgggcgagggcgccgtcgtcgagccgcagtggctgcagttcatgcgggagtggggtccgacggtggtgtacaagtggaggaagcggatggagtgggtgatcggccgcctacctccctggctcaggtgcagagcggagagcatgctgaacaagatgcccaacgagctgtccagggaagaagggccgaccgggcccaaggagaagaacaactgggagggagacgagagatggtaagactggtacgtaggaacagtgctcaacgatgtgattttataacatgtgtggcttaaattaaggggcgtgctatatttaggtgtttgaaaaacagcttcttcgcggaccatacactagtacaatttggctctataccagcggtacgctttttacatcacagacggttcggttagaaaaccgcctgtaatgtcccaggcggttcagtacgcctgtgatgtaatagtatcacaagcggtttttgtttaggaccgtctgtggtgctctatccttttcacaaacggaccctaagaaaaaaccgcctctgattgtaaaaatatttttaatttttaacagaaatatgcaaatacaatttaaatgaattaata

SEQ ID NO: 4642 - DNA, 2389 bp, Setaria italica
ctgtgacgaagcaaatccaccgtgcgggcataagaaaatgccctctctccgagccgttgcggaccgtggtgcttgccatcgctggtgagccgatgaggcgtgtctcccccgatcgttagcctgccggccgtctagcgcggagccccgtgcccccgtcccattcgtcggccaatccgggcaggcaagccagcgtgcgcgatgcggcagaggtggggcagctgcttctcgggcggcgacgtccgcgtgggcgcgccggccctcgaggagccggagccggaggtcttctccttcgccgaacccctcccgccgtggcccccaggtgggggattcgcgcgggggaggatgtccatcggcggaggggagctggagctcgccgcggccacgtcgttccagaagatctgcaccctgtcgccgcggcggtggggcgggggcggcagcagcgttaccttctaccggccggtcggcgtcccggaggggttctccctcctcgggcactactgccagcccaactgccgcccgctccacggccacctcctcgtcgcgagggcgggcgcgcgcccgcccggcgccccgcctcagccgctaccgccactccgcgcgccgcgggactattcgctcgtctgggagttccgcgccggcggcgtcgccaacggcagccgtggcaatgccggcaactgctacggcctccgcgacgcctacttctgggtccccgtgccgccggaggggtacaaggcgctcgggtgcctcgtcacgacggagctgcagaagccgccgctcgacgaggtggcctgcgtccgcgcggacctcacggacgagtgcgagccgcacggctccctgctccacctgcagctcgcgcggccgtcggcctcggagtcctgcgcggcggcggccttcgccgtgcggggcgtgaggccggtgcaccgggggatgtgggggaaaggagtgggcgcgggcaccttctgctgcgctgcggacgggagctccccgcgggagcagggcatggcgtgcctgagcaacgtcgagctcgacctgtcggcgatgccgacgctggagcaggcgcacgcggtgatccggcactacggccccacgctgttcttccaccccaaggaggtgtacctgccgtcgtccgtctcctggttcttcaagaacggcgccgcgctgtacaaacgcggcggggacgccgtgggggaggagatcgacggcgaggggtccaacctcccgggcggcgggtgcaacgacggggagtgctggatcgacgtccccagcggcgagcggggccgcgccgtgtgccgcggcgacatcgacagcgcggagctctacgcgcacgtgaagccggccatgggcggcgcgtgcaccgacgtggccatgtgggtgttctgcccgttcaacggcccggcgcggctcaagctcggcccggtcagcctcccgctgggcaagaccgggcggcacgtcggggactgggagcacttcacgctccgcgtcagcaacctcactggcgagctcatgggcgtgtactactcgcagcacagtggcgggcactgggtggacgcgtcggcgctcgagtacaccgacggcaaccgccccgtggtgtattcgtccaggaacgggcacgcgagctacgcgtaccccggcgtgtacctgcagggctcggcggcgctcgggatcggcatccgcaacgacgccgcccggagcaggttgttcgtggactccagcgccaagtaccgcatcgtggcggcggagtacctgggcgagggcgccgtcgccgagccgcagtggctgcacttcatgcgggagtggggcccgacggtggtgtacaagtcgaggaagcggatggagtggatgaccgggaagctacctctccggctcaagtgccgagcggagaagatgctgaacaagatgcccaacgagctgtccagggaggaagggccaaccgggcccaaggagaagaataactgggagggggacgagagatggtaggaacaaggaaagcccgaggatttacgtgtgtttacattggcgtgcattattgtagaactgagatgattgtgctagagctaaagaatcagattgtttgcaataaaaatgttgagtgcacaaaatttgcccgtccaattgaaatgaacaagttccgactcagaatgttccaagaaacacttggtagccagaattgtagattgaataccttcaacactataatagtgacgtaccataaacattgttggtttgtcgcaagaaatatgaacaatgccgatgtgttttcctctgctactctgttgtcaaaaaagatgtccacaacaagggtcagacagaaaaacgaccccatcttccactatcaatgtagcaactatatgtaaaggtcatatatatgactgaaactgagaatagggtt

SEQ ID NO: 4643 - DNA, 9753 bp, Setaria italica
attactttgttttacatgcagaatcaccatcagatactgcatccttagtcgatctcattttccagacattgcctatatatgatgatcgggcatcacgaaaagcagtagatgatatggttattcaggctcttggtgaacccaccttcatgaagccctttgctgcggcgcttgtacaatctatggaaaagaatctaaaggtcacaaacccccttacaagcttcaagcttctcagatggtcacactatcttctgaaatggagccagtttgccacactttcaaaaggcgccttttccagacttgccaatgcacaagctgtcttatgtcaagtccttatgaatgggtcctatcgtcggcgccggacttgcaaacagctattcattcatcttttctctgagcctagtggaatgtacaagatgtacatagaggaggtcagagatttaaggatttccatgagggattctcctgcattcttaaatctgatactggattttaccattacctctccatcattatctgctgagtacaagtcaatgttccttgatttgtatgccaaaatcgtcttgagttcaaaagaccggccaccaaaagcagccactgaagcttttaagcctcttttcgtggagattgggcatgaggattttaagaatactgttatgccgtcatgcataaagatgctgaaaagaaatcctgaaatcgtactacaatccattggatatcttctaaagacggtccgtttggacctaagcaagtattgcatggagtttatgccagttgttctgcatcaggctcggcattcagatgaagagaggaggatcaatgctttgagtattataggaacactaagtgagaagtcaagtgatccagacgctctaccttccatggtcaatgctatcaaagcaatcttaggaggctcagaggggaaactatcacttccataccagagaattggaatgataaatgctttagaacagctatcaagatctcctccaaagcaaataagcagacttgctccttcagtatctagtttccttctgaagtgttacaaggatgatggtattgaggaggtgaaattggcgattctgtcagcattagggtcctgggctttagtatcagctgaagctgttcaaccagatgttgtttcatttattgctgcaggcttgaaagagaaagacactttaaggaaggggcatctaaaattattacgacttgtatgtaaaaagtctgattctttgacaaaggttacttctttattggatcatttaattcagctgtcaaaagctggcttcagcaaggcaacacagcggttggatggaatctatgcactctttgcagtattgaggtttgctgctgttgatacgaaagcagatggtgctgttctgaaggagaaactgtggccactgattgctcaaaatgaaccctcgttgatctctttacagttgcttcccaaactagcagatgatgattgcttagctgccgtggatcttcttcaatcactgtttgtagaacatctcttcagaagtattcgctcatcacatatcggctatacggctgtagtgtgcactgattcattgtcttttggtacagctgttaatatatctagcttgccatccaagttgggaagtcaggaaggtagcttatgatgctatgaagaaagtcctctctagctccagtggtctggctgaagatactctattcttattcacagattggttgtcattagttggagagagactgtcaatgttgaaacaaggtgatatggataactcttcggattcacaactaccattcactccatctattgaggtccttgtcaagtgcttgtttttgattgcaccttatgctgttgtgcatagtctgagatcgtattctcgacttatattgtgctcccaccacccttgtctttccagctccgcaagcccagctggtgtatataagaggttgcaaagaaggttgagacaacaacagattgtctttgttgacttaattactcccaacatttctgttatctgcaagcacttcataggactcgaggagcgcactttgcacgattccttctcagagaatgatattaagatattctacactccagaggggcagttgtcaactgagcaaggagtttacgttgccgaggctgttgcttcaaaaaataccaaacttgcaaagggccgttttcgggcatatgatgatcaagacgcggacactgctcgctctgttgtccctgcaaaaactgagaagagagaatcctcaggcactggcaagcgagaaactgggaaatctacaaaaaagactgctcctgtcgataaagctaagaccgctaaagaggaggccagagagttgctcctgaaggaggaagcatctgtacgtatgaaggttgggcaagtgcagaagaatctctccttaatgttggatgctcttggcgaattggctattgctaatcctatatttactcacggtcaactgccatctctggtaaattatgttgatccattgctaagttctgcaatagtaagtgatgctgcatttcgtacaatgttgaggcttgctcgctgcacagcccctcccctttgcaattgggcgcctgagattgctgctgcaatccgtgtaatatctatcggtgattttgaaatggttttggatcttatgcctgtgatcgtggaagaagatagcaagaagaagccatcatctggtctctttgaacaaatagtaaatgggctgacaattgcatgcaaagcaggacctcttccagcagattcatttacttttatctttccgataatggaaaggatccttctgtcctctaaaaagacatgtcttcatgatgatgtgcttcacatactatctatgcatctggatccaatactaccacttcctcgtcctaggatgttatcagttctttatcatgtgttgagcactgtccctgcctatcatccttcagttgggcctatgctgaatgagttatgcctgggtttaagaagccatgaattagcacaggctcttggtggtgtatatgctaaagaagtgcatgttaggcttgcctgcttgaatgctataaaatgtgtccctatacactctgttcaacgggatctgcaagtgtcaacaagcctctggattgctgcacatgatccagagaaggtggttgctgaattagcagaagagttatgggaccgctttggttttgatgtaatcactgattactctggtattttcaatgcactctcccataaaaattacaatgttcgtgctgcatctgctgaggctctggctgcagcattggatgaaaatccagacaaaatgcaagatgcactttctaccctattctctttgtacattcgtgatcttggccctggtgttgaatttggagatacgcactggcttggaaggcagggtatagcattagcactccactctattgctgatgttttggcctctaaagatcttcctgttgtcatgacgtttctcatatcacgtgccctggctgatccaaatgttgatgttcgtggtagaatgattaatgctggcatccttattattgataggcatggaaaggaaaatgtgcctttgctatttcctatttttgagagctacttgaataagaaggcatcggatgaggaaacgtatgatcttgtgagggaaggtgttgttattttcactggtgctctggcgaaacatctatcaaaggatgatcctaaagttcacagtgttattgagaagttgttagatgtccttaacaccccatcagaggcagttcaacgtgctgtctcagattgtttgtctccacttatggtctccaaacaggaagagggtcaagctcttgtttctagactcttggatcggatgatgaaatgtgaaaagtatggcgagcgacgtggtgcagcctttggccttgctggggtagttaaaggatttggaatttcttccttgaaaaaatacggtattgctacaacattgcgacaaagtttggaagacagaatgtctgctaaatctcgtgaaggagctttacttggatttgagtgcctgtgtgagaagcttggcagactatttgagccgtatgtcattcaaatgctacccttgctacttgtggctttctctgatcaagtcctggcagtgcgtgaagctgctgagtgtgctgctcgggcaatgatgtctcagctcactggtcctggtgtgaagctcgtccttccttcacttcttaagggtctagaagataaagcatggcgtactaagcaaagcagtgttcaacttcttggtgccatggcatattgtgctcctcagcaactgtctcagtgtcttccgaagattgttccaaagttaacagaggtactaacagacacacatcccaaagtgcaagcggcgggacagacagctctccaggaggttggaagtgtcataaagaatccagaaatatctgcacttgttcctattcttctgtcagctctgatggatccaaatgaccacactaaacattctcttgacatccttcttcagactacttttattaattcgatagatgcaccatcgcttgcattgcttgtgcctattgtgcatagaggactgagggagaggggtgttgagactaaaaagaaagctgctcaaatagttggaaacatgtcttctttagttacagaaccaaaggatatgatcccatacattggtttgctcctaccagaagtgaagaaggttctagtggatcctatacctgaagtcagggcagtggcttctcgagctcttgggtctcttataagtggaatgggtgaagaaatcttcccagatcttgtgccatggttattagatactctaaaatcagatagtagtaatgttgaacgatctggtgctgcccaggggctgagtgaggttttagctgctcttggccaagattatttcgatcgtattcttcctgacatcatccggaactgttcccaccagaaggcttctgttcgtgatggacatcttacacttttccggtatttgccgaggtccttgggtggtgtattccagaactacctgcaggccgttcttcctgctatattagatgggcttgctgatgagaatgaatctgttcgtgatgctgcactttctgctggtcatgtctttgtggagcactatgccgcatcgtcgttacctctgttgcttcctgctattgaggacgggatcttcagtgataattggcgtatccgacaaagttctgttgaacttcttggagatctcttgtttaaggttgctggaacttctgggaaggcaatccttgagggtggaagcgatgatgaaggtgctagtacagaggctcaggggcatgcaattattgaagtactcggaagggagaaacgcaatgaagttcttgctgccatttatatggtccgttctgatgtcagtttgactgtccggcaggctgcactacacgtctggaagacaattgtagcaaatactccaagaactctaaaagaaataatgccagtacttatggacacactaatttcatctcttgcatcatcttcctcagaaaggcgtcaggttgctgggagatcacttggtgagcttgtaaggaagcttggtgagagagttttgccctctattattccaatcctgtcacagggactcaaagatccaaatgctagcagaagacaaggagtctgcattggtttgagtgaggttatgggcagcgctggaaaacatcagctattaagttttatggatgaacttatccctactattcgtactgctctatgtgacagcacccaagaggtccgtgaatctgctgggttagcgtttagtactctgtataagagtgctggattgcaagccattgatgagattgtccccacattgctacgggctttggaagatgatgatacatctgcaacagcccttgatggtctaaagcagattttaagcgtcagaactgcagctgttttgccccatatactgcccaaattagtccagccccccctctcttcattcaatgcacatgcattgggtgctctagcagaggttgctggaccaggtttgaattcacatattggaactgtcctcccagcattgattcttgctatggatgatgaagatgcggatgtacaaaactcagccaggaaagctgctgaaactgttttgttggtcattgatgaggaaggagttgaaactttgatacctgaacttctaagaggaatcaatgacagtcaggcatcaatgaggcggggctcagcctatctaattggtttcctctttaaaaatactaaattatatctggctgatgaggcttctgatatgatgtcaaccctaattattttgctgagtgataccgacaaagctactgtatcggctgctttggaagcattttcaagagttgttggctctattccaaaggaacagctcccgacacatataaaattagtgcgtgatgctgtctctactgccagagataaagagcgtagaaggcgaaagggtgcacctgttctcgtgcctggtttatgtcttcccaaagcactgcagcctttccttcctatatttcaacagggtttaattagtgggacggccgaaacaaaggaacaggcagctgaaggtcttggagagttaattgatgtgacaagcgagaaaactcttaaggaggttgttgtgccaattacaggacctcttattcgcatccttggtgatcggtttccatggcaagttaagtcagctatcctatcaacccttacaatcatcatcacgaaaggaggaattgcactcaagcccttccttccacaacttcagactacatttgtaaaatgtctacatgataccaataggtctgtccgtacgagggctgcagctgccctgggaaagcttagtgcacttagcacacgggtggatcctttagttagcgatcttctgtccatgttgcagtcaggagatgaatctgtcaaagaaagtgtgctttctgcgcttaaaggtgttatcaaacatgctggcaaaagtgttagcgctgcaattagatctcgcggatgtgatcttctcaaagatctgctgcaggctgatgctgatgatgtccgcagttgtgctgcaaaagtgattggcacattgtctctgtacatggaggagactgagatttcagatttggtgcaaatcctgttgaacatgagcacctcaccagactggtgtaccaggcatggtgctttgttaggattctcatctatatcaatgcattctccatcaaaattgtgtcatttggcatcctttccatctcttgttgatcttctgaaagattctcttaaagacgacaagttccctgttcgtgaagttgccacaagaactctgggtaggatactctgtttccagttacagttggaagccggtaccttgcaactggttcagttgcttgtcttagctttgcgtgatgattcaagcgaagttaggaggagatctttgtcgtgtatcaaagctgctgcaaagataaaccattcagctctcgctacacaccactcaatattgggctcggcaattgctgatgctttgaaggactctagcatgcctgtacgtctagcagcggaacgctgtgcccttcatgttttccaattgactaaagggccagataatgttacagctgcgcaaaaataccttggcatgactggcttggaagtaaagaaaattgcaaagcttaacgaggagagtgatggaagtgagagcagtgatgatgacaagagggcataaaccctattctcagtttcagtcatatatatgacctttacatatagttgctacattgatagtggaagatggggtcgtttttctgtctgacccttgttgtggacatcttttttgacaacagagtagcagaggaaaacacatcggcattgttcatatttcttgcgacaaaccaacaatgtttatggtacgtcactattatagtgttgaaggtattcaatctacaattctggctaccaagtgtttcttggaacattctgagtcggaacttgttcatttcaattggacgggcaaattttgtgcactcaacatttttattgcaaacaatctgattctttagctctagcacaatcatctcagttctacaataatgcacgccaatgtaaacacacgtaaatcctcgggctttccttgttcctaccatctctcgtccccctcccagttattcttctccttgggcccggttggcccttcctccctggacagctcgttgggcatcttgttcagcatcttctccgctcggcacttgagccggagaggtagcttcccggtcatccactccatccgcttcctcgacttgtacaccaccgtcgggccccactcccgcatgaagtgcagccactgcggctcggcgacggcgccctcgcccaggtactccgccgccacgatgcggtacttggcgctggagtccacgaacaacctgctccgggcggcgtcgttgcggatgccgatcccgagcgccgccgagccctgcaggtacacgccggggtacgcgtagctcgcgtgcccgttcctggacgaatacaccacggggcggttgccgtcggtgtactcgagcgccgacgcgtccacccagtgcccgccactgtgctgcgagtagtacacgcccatgagctcgccagtgaggttgctgacgcggagcgtgaagtgctcccagtccccgacgtgccgcccggtcttgcccagcgggaggctgaccgggccgagcttgagccgcgccgggccgttgaacgggcagaacacccacatggccacgtcggtgcacgcgccgcccatggccggcttcacgtgcgcgtagagctccgcgctgtcgatgtcgccgcggcacacggcgcggccccgctcgccgctggggacgtcgatccagcactccccgtcgttgcacccgccgcccgggaggttggacccctcgccgtcgatctcctcccccacggcgtccccgccgcgtttgtacagcgcggcgccgttcttgaagaaccaggagacggacgacggcaggtacacctccttggggtggaagaacagcgtggggccgtagtgccggatcaccgcgtgcgcctgctccagcgtcggcatcgccgacaggtcgagctcgacgttgctcaggcacgccatgccctgctcccgcggggagctcccgtccgcagcgcagcagaaggtgcccgcgcccactcctttcccccacatcccccggtgcaccggcctcacgccccgcacggcgaaggccgccgccgcgcaggactccgaggccgacggccgcgcgagctgcaggtggagcagggagccgtgcggctcgcactcgtccgtgaggtccgcgcggacgcaggccacctcgtcgagcggcggcttctgcagctccgtcgtgacgaggcacccgagcgccttgtacccctccggcggcacggggacccagaagtaggcgtcgcggaggccgtagcagttgccggcattgccacggctgccgttggcgacgccgccggcgcggaactcccagacgagcgaatagtcccgcggcgcgcggagtggcggtagcggctgaggcggggcgccgggcgggcgcgcgcccgccctcgcgacgaggaggtggccgtggagcgggcggcagttgggctggcagtagtgcccgaggagggagaacccctccgggacgccgaccggccggtagaaggtaacgctgctgccgcccccgccccaccgccgcggcgacagggtgcagatcttctggaacgacgtggccgcggcgagctccagctcccctccgccgatggacatcctcccccgcgcgaatcccccacctgc

SEQ ID NO: 4644 - DNA, 2183 bp, Zea mays
tttttttctctgactcgcgaactaaacgaacccaagaacgagctaaaagaagatgactatgtggctcgttaacacgagccgcaccctagcgctggctttgccgtagcccgtggttcctttgcgctttttggccatttcggcccaattctcgacggcttcccttcttagttcttccccttcatccgaaaccctcgcactctagcggcccgcacaaagccgccggagcgccgcgccaccatgtaccggcttttccgccgcagcttctccatggctgccgagggttccgccgccgccgcctcttcctctccacccccctccacctccatgtcctcgaccccgcggcaacatctgccggacgagctgtaccgccgcatcatgaatgtcgggcgcccaagcatcccgttatcccccgtcctggagcaatggaatcaagaaggccataccgccaagaagttcgtcatccaggccatcgtcaagaagctcgtcggcctccgccgcttcgcccacgcactcgagctgtcgttctggatgaccgaccgcaggcacctccacctttcggtcggtgacgtcgcgtaccggctggacctaatcagcaaggtgcacggccttgagaaagccgtcgagtacttcggcatggtaccgaagcagctgaggaagccgcagtgctacggctccctcctgaaatgctatgtggaggcgaaggccgtcgacaaggctgaggagcacttcgcgaagatgcaggagatggggatgacgagttcttacgcatacacttggatgatgaagctttacctacagactgggcagcttgaaagagtgcacgccatgttccaggacatggaagagaaaggtgtgaagcctgatactttcagtgtggaggctatgttagctgcgtacattgctgctgaagatgtccagggggttggtaaggtgctcgacaaggccaatccacacgagaagcttgtgacttggcatgggcatgcttcggcagcgagcttgttcatgaaatctgggatgcaggtgggggctgtcatggctctcgtggaagccgagaggcggatatctccaaagagcagtagaatcgcatacgctttcttactcaagacatatactgaactggggatgcatgctgaggccggacgcatttggagtgtctacaaatccaaagtgccgccgtgcaacacgatgtacatgtcgaggctaagcgcgttactcaggacgaacgacattgatggggcggaagcgacactgaaagagtgggaaacggtgcctcttcgctatcatgatttcagattaatcaacgtaatggtcgatgcctactgcagagaaggtctcgtggagaaggcagtagctctcgtggatggcgccatcaagaaagggaggacaccttacgctaatacctggtataagttggctggtgggtttttcaaaactggtcaggtaccagaagcagtggacatgacaaggaaggctcttgattccgcgactcctccatggagacctgacctcgcgaatgtgctgatgagcctgaaccactttgtggaccagaaggatgtaggagcagctgaggagatggtgagtacgctacagaagctggttcctttgactagggatgtttaccattgcttgctgaagacctatgtccgtgcgggaaagccgccgtccgatctgctggagcgtatgaaggaagacggccttgaggctgatgaggaaacagagagaatcctcgcgggagaatgcgagcgagtagacatgcacccgttgtcaatcactaaccatctgattggttagtcgcaccgtctcatcctgtatcagtgcatgcattgattttatttaagtctttgtttggttgcctgtatacttaaagcgtgagctgcatgagtggatgcaaactaatttattttgagaccgtttgactgcatctgctcatacgtcaaaatcttcggtttctagccggcctggatggcacgagcctggtttgtgaggcccaggcaaccaaacaggcagtaagtaatcacttttctctgttcatctgttcctttgttcttgaattcttctcattagttgaagccatggccactgcttacataaataagacagcacggtcctttcttgtgggctgcgtgcgtagttcctccacttgtgaggctgtgtgtccagcatgttatggatgtcgtcgcgta

SEQ ID NO: 4645 - DNA, 4436 bp, Sorghum bicolor
caagaacctgtgcgaggaagaaaagattgcgcgtcaccgccggcctacctggctttggtcgaatctacaagagaaacaccattacggccctgtccaacaaagattacgatagccaggcacgggcccaaatgcccaatacggagctggagacgatgatcttgtaaatgaaatgatggatcggtgaggctggcctgattcagaatggaggaacaactccacagaaatctctcatgctcccgcgttccaataaagggcttaacgttccgcagaaatcattattatcccaccatgctgcaccaatacgcagaccattttatgcacttgttcttgagcaccaacaccccgactcaatccaaacatttccaagacttcaccttggcagcacatgcacagatactaaatgtcagactcaactaagaaacaaaacaaagaaactcaagcagagattgattagaatgcaaatacctgtgccatgtatttccatgacacttgttcatgagatttttgcacatttgtcaccagaatttatgtctctggttcgttttacatatgccaggtcaaattcccgtagataaattgtggaagcaagagcactccttgtcgtaatcactgccattagcacctcaccattcctgaagtatagtacatcagccaacttagaccaagtgttagagccagatttcctccctgtatttatgggatcatctacaggagttactggttttctagaagactctgcagcaagcattcatcactaatttcacaaatttgaaaccacaaaagaaaagagtcactgtttcccactctttcaatgctttcttaacactgtcacacattaccactgccctgtgaggccaccacatacaagaaaggagtagtggccacgtgtcaagctaatgagaagagctcaagaacaaagaaggaacacatgaacagagaaaatggattatttagtgatcgacaacgggtgcaaatctactcgcattctctctgtttcctcgtcagcctcaaggccatctttcttcatacgctcgagcaaatcggacactggctttcccgcacggacataggtcttcagtaaacaatggtaaacctccttagtcaaaggacccagcttctgtagcatactcgcaatctcctcagctgcttctacatccttttgattcatgaagtgctccaggctcattagcacatttgttaggtcaggtttccatggaggagtcgcagattcaagagccttccttgtcatgtccactgcttttgatacctcaccggttttaaaaaacccaccagccaacttataccaagtattagcataaggtgtcctccctttcttgatggcgtcatccacaagagctactgccttctccacaagaccttctctgcaataagcatcaaccatcaagttgattaatctgaaatcatgataacgaagagacactgtttcccactctttcaatgttgcttccgccccatcaatgtcattcatcttgagtaacgcacttatcctcgacaagtacatcgtgttggatggtggcactttggatttgtagacactccaaattcgtccaacctcaggatacatccccagatcagtatatgtcttcagtaagaaagcgtatgcgatcctactactctttggggatatccgcctctcggcttccaggagagccatgacagctctcacctgcatcccagatttcatgaacaagctcgctgccaaagcttgtccatgccacttcacaagcttttcatgtggattggccttgtcgagcaccttaccaaccccctcgacatcttcagcagcaatgtacgcagctaacatactctccacactgaacgtatcaggtttcacacctttctcttccatgtcctggaacatggcgtgcctccggtcggtcatccagaacgacagctgcaagaacgcaacgaatcgcctgactcaaccagcggaatgtgcatgggaaatgagcaagaatctaaaaaaaaaggcaattcgaggagtaggtttagggggaggagggtttgcctgtgacctcgagtgcgtgggcgaagcggcggaggccgacgagcttcttgacgatggcctggatgacgaacttcttgacggtatggccttcttgatcccattgcttgaggacgggggatagcgggatggatgggcgcccgacattcatgatgcggcggtacaggttgtccggcagaggttgccgcagggtcggggacatggaggtggagggggatggagagggagagggagaaggagaggcggcggcggcaccctcggcagccgtggagaagcggcggaggagaagccggtacatggtggcgcggcgctccggcggctttgtgcgggctgcccgagagcgagggtttcgggggaaggggaagaagggaagccaacgagaattgggccgaaatggccaaaagcccaaagaccccacgggctacggcaaagccagcgccaaaccgccaagggccacgccattcgccatggcctctctcttcgccgcggggcgccgcctgctcagccttggccgccgcggagtactcctccccgtgccccgctctcgcgccgttgccacctcgtctcgcagcaacagcgaggaggagcgaccgccgcagagcctgcagtccacgctgtggccgctgggccacccgtgcacgctccttgtgccggagatcgaactgtgggcggcgcggcccagaaaccgcctccgagccgttgagctccaacgcatcgtcagggagctccgcaagcgccaccgccaccgccaggccctcgaggtctctgagtggatgaatctcaagggtcatgtcaaatttctgccaaaggatcatgctattcacctggatttaattggtcaagtccatggagttggagcagcagagacctacttcaataacctgtctgacaaagataagacagagaaaccctatggtgcacttctcaactgctacacacgagaactcttggttgacaaagcgttggcccattttcagaatatgaaagagctgggttttgtgttctccgcgctttcctacaataacctcatgggcctctataccaacatagggcagcatgagagggtccctatggtgatggcagaaatgaagagggatgggattgttcctgataattttagctacagaatatgcataaattcttatggcataagagctgacttttttgggttggagaacaccctggaggagatggaatgtgagcctcaaattgttgttgactggaatacatatgctgttgtggcaagcaactacattaagggttacctaagggagaaggcatactctgccttaaggaaagcagaggcaaaaatggataaaaaggatggtgatgcctatggccacttgatttccttgtatggccaccttggggacaaattagaagtcaagaggctatgggcgctgcacatgttgaactgtaagaggtatattaacaaggactacaccaatatgcttgccgtgcttgtgaagcttgatgagatcacggaagctgaagacttgctgaaagagtgggagtctagcaaaaatgcattcgacttccaagttccaaatgtcctgctcacagggtaccgccaaaagggcttgctggacaaggctgagacactgctcgacggcttcttgaaaaagggaaagacgcctacttcaaccagctggtggattgtggcaattggctatgcagagaaaggtgatgttgcgaaagcttatgagctgaccaaaaatgccctctctgtatttgcccccaattccggctggatccctaggccttcaataatcgagatgatacttaagtatcttggaaacgaaggggaggtcaaggatgtcgaagctttcgttaacctgctgaaagttgctgtgccaatgaactctgatatgaccgaggctttgtcgagggctcgtgcgagagaagaaaggaaagctgaagaggcaacagaagctcctcgcgaggatattattgcctgagctgattgtcaatgtgtttcaggactgatgtctcctcctatatactagtagtagaataaattagtagttagttacaacccttcgttactttgttgtttttattagctatcagttttatggtggtgtttggtttgccattttgtaacataattatcagatcaatgatgggaagcgatactgttttcactgcacaccaatctactccagtccacatgggttggaagatattggggtttagggttggattggggtgggtcgctgtgtatggttagttggaggcgacccgcaatgtgttaccatgtaatctgttactggccagttcaatttttaaggctccgttgcctccgtcttcccctgcaaccgcgtcattgttggttgttggcagaggaggagatcggactcaggtaaagtcaggttcatcttggataggccggtgccgtgctgtcgctgga

SEQ ID NO: 4646 - DNA, 1829 bp, Saccharum officinarum
aaaggtctcctctcccctgctccgtccgtccgcccctcaccgtcgcccaatctcacatggctcggcgtctccacggccaatccgacctcaccgacggcgcgcgcctccgtttctccacctccaactcgagctccagctcttcctccctgttcctcctcgccgcccccgccgacgacgcctccctctgtcggatccaccgctgaccgcgcgccgccacgtctgcgccggcctgatcaccggctggttcttggcctcttcgcttcctggacctcccaggcgtcgccatgggcaagagtaagaggaacaagggcggtcgaggtggtggtggtgccgatgaccagcttgacggcggcagcgatgctgatagcgtgacctccatgtccactgggctgtctgaccttcaactcgcgcaggccacagagaatgttagctcgcaggaattcgttcttgacaagtacatcgacgctctctacgagaagaggggatccacgagagaggaagcactgggcgctcttaccgatgcttttgaaagttttgtgcttcttggtttagtggaaaacaaatatgtcacactattgagccagttcaccaattcaattaaaaagggttctacaaaggaggtgtgtctagcttgtcgctgcattggcttactggcaattacactaggtgctggaagtagttcgcatgaaataatggatgagtcacatccacagcttttgagagttctccaaacttggcctgatgcaccaaagatgatctctgcacttgattgcttagcagttgtcacatttgttggtgcaactgatcttgctgaaacccagctatctctgaaagccatctgggatgtgatccatccaaaatcaggatcaaatgttggcattgtcagaaaaccgaagcctcctttgttagcagctgccgtatctgcatgggcatttcttttaacaactgttggttcatctagaagaaatactgattcttggaaagagccaattacatttctctgtagccttctagaagcagaggatcgtgctgtgcggattgctgctggtgaagcattagctctgtgttttgagctaaaactggttgatggttcatctaatgatgaagctgatgttgacagtgacactagagagaccagtggttctaagcatcaacttttcttgaatatgcaagcattgaaggccaaaatatctggtctagtctatagtctctctatggaggcagggggcagaggtgctgacaagaaaaatcttaatgatcagagagacttgttccaacgaatctcagattttattaagaatggtgagtgccctgaagaatcacttaggatttcaggcaagaatggcattttaagagttacatcatggcgtgaattaatacagttgaactatatgaggcggtttcttgggcgaggattcctgaagcattcacaggacaatgatttgctgcatgatatctttgacatcaaaattgatcgtactgaaaacatgtcaaccactaaaaagaaaatgtttagatctgaagaagagaaaggaagagctctgaagttaaataaagagcgtcgtctggctcaggagaggaaacagaatatcttgagcgagcaatatggatagtacttacccagaagagttttgtatagacgaactgttaccagataatgagtgctgtgtatatgacggtattgaattattgatgcattggtgaggtgttgcccggtattgatgggtactacaatacaatttcataccgaggaacatgtacagcgtcgtgtttaaaattgcttgctccaaacattgagttttctagaaaggatcatgttgacctgtaca

SEQ ID NO: 4647 - DNA, 2136 bp, Setaria italica
cacgagttccacgctgttttggtgggggtgccaaccgccaggccgagtcgtcgtccacctctcgtcgacaaggaaaacgaggcagaaaagtcccctcccccctgctcgccgcggttcgtccacccctcctccccgtcgcccgatttcacatggctcagcatctccacggccaatccgacctcaccgacggcgagtgcctccgcttctccctttccaattccagctccagctcttcctccctgttcctcctcgccgcccccgccgacgacggctcgctctgtagggcccgccgctgaccgctccttcgcccgcgcctgatctccgcggccggctctttggactcttcacttcttgcgctgcccggccgtcgtcatgggcaagagtaagaggaacaagggaggccgaggtggtggtggtggtggtggtgatgaccagcttgaaggcggtagcgatgccgatagcgtggcatcgatgtcgactgcgctgtctgaccttcaggtcgctcaggccaccgagcatgtcagctcgcaggaattcgttcttgacaagtacatcgatgacctctacgagaagaggggatccaccagagagaaagcactgggcgctcttgttgatgcttttgaaagttttatgcttcttggtttagtggaaaacaaatatgtcacactattgagccagttcaccaattcaattaaaaagggatctgcaaaggaggtgtgtcttgcttgtcgtgccattggcttactggcaattacactaggtgctggaagtagttcgcacgaaataatggatgagtcacatccgcagcttttgagaatcctacaaacttggcccgatgcaccaaagatgatctctgcacttgattgcctagctgttgtaacatttgtcagtgcaaatgatcttgctgaaacccagctatctttgaaagccatctgggatgtgatccatccaaaatcaggatcaaaggttggcattgtcagaaaaccaaaccctcctttattagcagctgctgtatctgcatgggcatttcttttaacaactgttggttcatctaggagaaattctgattcttggaaagagccaattacatttctctctagtcttctagaagcagaggatcgtgctgtgcggattgctgctggtgaagcattagctctgtgttttgagctaaagctgcttgatgtttcctctagtgaagaagctgatgttgacagtgacaccagagagaccagtggttctaagaaccaacttttcttgaatatgcaagcattgaaggccaaaatatctggtctagtctgtaatctctctatggaggctgggggcagaggtgctgacaagaaaaatcttaatgatcagagagacttgttccaacgaatctcagattttattaagagtggtgagtgccctgaagaatcacttaggatttcaggcaagaatggcattttaagagttacatcatggcgtgaatcaatacagttgaactatttgaggcggtttcttggacgaggattcctgaagcatgcacaggacaatgatttgctgcatgatatctttgatatcaaaattgatcaggttaaaaatatgtcaaccaccaaaaagaaaatctttagatctgaagaagagaaaggaagagctctaaagttgaataaagaacgtcgtcttgcccaggagaggaagcaaaacatcttgaacgagcaatacggatagaaccttcctgctgcctggagttttgtatagtcgaactatttaccagattgttgagtgttgtgtatatgccggtactgatgcattgagtgagtgtattgcccggtattgataggcattacaatacgatttcatactgagaaacacttgtatagcgtcatgtttgaaatggtttgcccaaaacagtcagtatagaaaggatcgtgtgccctgtcaaatacttcccttgcacgtggaaaggaggttgttcagtttcaagtcagaatcacaattctacaattcagctcggttcaaggttgatcgtgtagtgtggaatttgttgtttgtcagtaacatagaggtcttcactctccaagagtcgtttgtgaataattcagtcatttatgaactccacgcaaaaggttctttcagcaacacatttgcctctagccc

SEQ ID NO: 4648 - DNA, 2090 bp, Zea mays
caggtctctgttcctgtggcgggacggacgactctgctgcttctcgttgacaaatcacaaggaaaacaaggggggaagaaaaacaagccagaaaagtctcctcttccttgctccgttcatccgcccctcaccgtcgcccaatctcacatggctcggcgtctccacggccaatccgacctcaacgacggcgcgcgcctccgtttctccacctccaactccagctccagctcttcctcccggttcctcctcgccgccccctccgacgacgcctccctctgtcggatccaccgctgaccgcgcgccgctacgcctgcgcctgatcaccggctggttcttggcctcttcgcttcctggaccgcccagacgtctccatgggcaagagtaagaggaacaagggcggtcgaggtggtggtggtgccgatgacaagcttgacggtggtggcgatgccgatagcgtgacctccatgtccagtgggctgtctgaccttcagttcgcgcaggccacagagcatattagctcgcaggaattcgttcttgacaagtacgtcgacgctctctatgagaagaggggatccacaagagaggaagcattgggctctcttaccgatgcttttgaaagttttgtgcttcttggtttagtggaaaacaaatatgtcacactattgagccagttcatcaattcaattaaaaggggatctgtaaaagaggtgtgtctggcttgtcgctgcattggcttactggcaattacactaggtgctggaagtagttcgcacgaaataatggatgagtcacatccacatcttttgagagttctccaaacttggcctgacgcacaaaagatgatctctgcacttgattgcttagcagttgtcacatttgttggtgcaactgatcttgctgaaactcagctgtctctgaaagccatctgggatgtgatccatccaaaatcaggatcaaatgtcggcgtagtcagaaaaccgaagcctcctttgttagcagctgccgtatctgcatgggcatttcttttaacaactattggttcatctagaagaaatactgattcttggaaagagccaattacatttctctgtagccttctagaagcagaggaccgtgctgtgcggattgctgctggtgaagcattagctctgtgttttgagctaagaatgtttgatgtttcctctagtgacgaagctgatgttgacagttacactggagaggctggtggttctaagcatcaacttttcttgaatatgcaagcattgaaggccaaactatctggtctagtctatagtctatctatggaggcggggggcaggggtgctgacaagaaaaatcttaatgatcagagagacctgttccaacgaatctcagattttattaagagtggtgagtgccctgaagaatcacttaggatttcaggcaagaatggcattttaagagttacatcatggcgtgaatcaatacagttgaactatatgaggcggtttcttgggcggggattcctgaagcattcacaggacaacgatttgctgcatgaggtctttgacatcaaaattgatcgtactgaaaacatgtcagccaccgaaaagaaaatgttcagatctggagaagagaaaggaagagctctgaagttgaataaagagcgtcgtctagctcaggagaggaagcagcagaatatcttgaacgagcaatatggatagaacctacccggaagactggagttttgtacagtggaactgttaccagatggtgagtgctgtgtgtgtatgtgacggtattgatgcatttgaggtgtattgctccggtggcggtactacagcgacatgtttgaaattgctccgaaatactattgagttttgtagaaagtgccatgttccctgcactccctagtgtttcctctgcatgcgcaaaggagatcttgagttcagttaatcacaattgtacagttccatagggtagagatatgaggtgattgtgaataacacagaggtcgtctagcctaagggcaataattggcgaactcttcctctagccgcaataattggtctgcaagagatttcgaaatgcgttcgctctctttcgtcctg

SEQ ID NO: 4649 - DNA, 2573 bp, Oryza sativa
caggcctctagttgggaaggaaagggaagaaaaacgagcggataaagaaatctaagaaaagaaaagtcttcttcctcttcctcccctcctcccgtccccatcgcccaattcacatggctctgcgtctccacggccaattcgatccaacccgcgaagagagcccccgcttctccccatccaattccgccacctgctcgttctcccagttcctcctcgccgccccagctgacgacggccacctctgttcgatccaccgctgactggtcccccccgctcctggtttcgggggcggttcttcgattcttgagatcttagctccttcttcgacggcctcaccgctgccatgggcaagagtaagaaaaacaagggtggtcgaggaggcggcggcggtggtggagaggaccaatttgacggaggtagtgacgtggatagcgtgagttcggtgtcgacggcgctgtccgacctccagctcgcgcaggccaccgagcaagttagctcgcaggattttgttcttgacaaatacatcgacgatctctatgagaagaggggatccacaagagaggcagcattaggcgctcttgttgatgcttttgaaagttttgtgctacttgatttagtggaaaacaagtatgccacacttttgagccaatttatcaattcaataaaaaaaggatccataaaggaggtctgtctggcttgtcacaccactggcttactggccattacacttggtgctggaagtagttctcatgaaataatggatgaatcccgtctgcagcttctgagagtcctccaaacttggcctgatgcttcaaaaatgatatctgcacttgattgcttagctgttgtcacatttgttggtgcaactgatctatctgaaacccagctatctatgaaagccatctgggatgtgattcaccctaagtcaggatccaatgttggaattgtcagaaaaccaaagcctcccttgttagcagctgctgtgtctgcatgggcacttcttttgacaactattgtttcatcaaaaagaaacgttgactcttggaaagagtcaattacatttctttctgctcttctagaagcggaggaccgtgctgtgcggatggctgctggtgaagcattagcactgtgcttcgagttaaaactgcttgatgttttctccaatgaagaagttgaggtggacactgcagaagctagtggttctaagaaccaacttttcttgaatatgcaagcattgaaggccaaaatatctggtctagtctataatctctctatggaagcggggggaagaggtgctgacaagaaaaatctgaatgatcaaagagacttattccaacgaatctcagattttattaagactggtgagtgccttgaagaatcacttagaattgcaggcaagcatggtattttaagagttacatcatggcgtgaatcaatacagttgaactatttgaggcggttccttgggcgaggatttctgaagcatgcacaagacaatggattgctacatgatatctttgacatcaaaatggataaaactgaaaacatgtcaaccactgaaaagaaaatctataggtctggagaagagaaaggaagagctctaaagttgaataaggagcgtcgtttagcccaaatgaggaagcaaaatatcttaaacgagcaataaaggatagggatgttctattcttcctggaattttgtatagccgaaatcctatcagatattgagtgtgtttataggccaatgttaattcattcaagagcgttacaaacttaatacaatatacaatgtacttataaattagaacacaatgttactgaaaaaacacttctgaagaattatttgtaacttcctgctggtacagcagatttaaacacgcagttatagagttagaaagaaatggggtatgtctcatgggtcctgcggatatccgaatagcactgttcaccggatatccgaattattatccgtgtccgacggaaaccctgataccgtattcgtatccgggagaaaatatccgtattcgtatccgtatccgaaatatccgagaattatccgatccgaaagttgtctcttggttgggattgggtggtcatcgaaggccggcaggattattgaaccatcacgtcgaacgcggcggtacctcaacactctcaccgtcagacacatctagtggcagcagctcaacactctcaccgtcaaacaagggacaggaatcgaactggttgcagccaacatacgggaaagaagacgacgcggccacacatatggaccgctccgtcatgagatggaggcccgaggtagctgggctgccagcacaacctgctaaggaggaagatgaggataagcgggccattgggatggcaactgccaacaacggcaaccctccagctcattgtcattgttttctggccacggcagttcataattcccgccaggataactcaacagattgctcaccgacccagggtcgggggcggcaaggttatagtccagcaacattaggccataacgtgaggaggagagctcaacgttgtggtccggcaactacccggtgcatcataatccggtaa

SEQ ID NO: 4650 - DNA, 2054 bp, Setaria italica
aacatcgaagtccatttctgaaaaccggtatccaaatctacctcaacctccggctgatcccaatggagtaacactcgcgaccatccctgttcccttctcctgctccattgatcccattcccatggccgccaccggctttcgcgtccacccggccgccttcttctcagctcatccgcgcgaggcaggggccaagcagttgccgttccaccattgctcacctcacaggatccttgtcgcaagaaggacgtggcttctcagggcgaggtcctccaatgggcgcccgcagatcggtgcctcgttcagcaacagcaatgaggtgctagatgggaagccagccggagatgggccaccaaagcagggagggggcaccgtcagcatcaccgtcgtgggcgcctccggcgaccttgccaagaagaagattttcccggcgctcttcgccttgttctacgaggactgcctcccggagcattttacagtgtttggttatgcccgtagcaagatgagcgatgaagagcttaggaacatgattagcatgacactgacatgtcgaattgacaaaagggagaactgtggcgataagatggaggagtttctgcagaggtgcttctaccaatctgggcagtacaactcagaggaggggtttgctgaattagataggaagcttaaagaaaaagaggaaggcaaggtaccaaacaggctattctacttgtcgatcccgccaaacatattcgtcgatgtggtaagatctgctagccgcaccgcgtcttcttcaaccggatggactagatttatagtggaaaagccgttcggccgcgactcggagtcctcaggggagctcactcggtccctgaagaagtacttggccgaggagcagatattcaggattgaccattatttgggcaaggagcttgttgagaacctttcggtcctccgtttctccaacctcgtctttgagccgctgtggtcgaggaactacatcaggaacgtgcagctcatcttctctgaagatttcggcaccgagggtcgaggcggctacttcgacaactacgggatcatccgtgacatcatgcagaaccacctgcttcagatcctggccctgttcgccatggagaccccggtgagcctggacgccgaggacatccgcaacgagaaggtgaaggtgctgcggtcgatgcggccgctgaaggtggaggacgtggtggtggggcagtacaagggccacacccggggcggcaggtcattcccgggctacgccgacgaccccaccgtgcccaagggcagcgtcacgcccaccttcgccgccgccgctctcttcatcgacaacgcgcgctgggacggcgtgcccttcctcatgaaggccggcaaggcgctgcacacccggcgggcggagatccgggtgcagttccggagcgtgccggggaacctgtaccggcggagcgtcgggacggacccggacacggcgaccaacgagctggtgctccgggtgcagcccgacgaggccatctacctcaagatcaacaacaaggtgccggggctcgggatgcggctcgaccgcagcaacctcaacctgctctactccgagcgataccgccgggagatccccgacgcgtacgagcggctgctgctggacgccatcgagggggagcgccgcctcttcatccggagcgacgagctcgacgcggcatgggccatcttcacgcccgtgctcagggagctggaggacaggagggtggcgccggagctctacccgtacggcagcaggggacccgtcggcgcgcactacctcgccgcaaactacaacgtcaggtggggcgacgtcaccagcgacgacggctccttctagccaaaggtcgagccattggcgatgctctgcggttgtttgtgcattcttttgttggaaattgaaagaataaagaacctctcgcaggagaaagggaaagatgatggataaagcagctctgttcagtgttttcgttccatatatggccacatgttaaaactgcgcaaataccaaatagtgtgtgcctttaaatcagatccgagatgcgttcttc

SEQ ID NO: 4651 - DNA, 1965 bp, Triticum aestivum
tcgaagccccaatcgtcagagccaagcatccaaatcaatttctccacatcagattcagatggattgatagttcgacactcccaactattcttgtttccttccccgagccaatggccgccatcgacttacgcttccatctccatccagccgccttctcctctgtccacccgtccaattcaagcgccaaaccgcaccgccattgcccacctcagaggatccatgctgcaggaagaaggtgcctcctcagggcgaagtcttcaaacgggcacccgcagatcggggcctccttcagcgatggggtgctagatgctaagccgtctggagctggaggcccggcgccggagcagggagagcacaccgtcagcatcacagtcgtcggagcctccggggatcttgccaagaagaagatcttcccggcgctcttcgccttgttctacgaggactggctccccgagcattttacaatctttggttatgctcgtagcaaaatgagcgatgaagagctcaggaacatgattagcatgaccctaacctgccggattgatcagagggcgaactgcagtgagaagatggataaatttctgaagagatgcttctatcagtccggacagtacaactcagaggaaggattttgcgaattggatagaaagcttacagaaaaagaggctggaaagctaccaaacaggctgttctacttgtctatcccaccaaatatattcgtggacgtggtaagatctgccagccgtaccgcgtcattgccgagtgggagtggctggacgaggtttatagtggagaagccattcggccgcgattctgagtcctcgggggagcttacccgatccctgaagatgtatttagaggaggagcaaatcttcaggattgaccattatctgggcaaggagctggtggaaaacctgtcggtcctccgtttctccaaccttgtgttccagccactgtggtcgagggactacattcggaatgtgcagctcatattctccgaagacttcggcaccgagggtcgaggcggctacttcgacaactacgggatcatccgggacatcatgcagaaccacttgctgcagatactggccctgttcgccatggagactccggtcagcctcgccgccgaggacattcgcaacgagaaggtgaaagtgttgcgatcgatgaggaagctgaagctggaggacgtggtggtggggcagtacaaggggcacacgcggggcgggaagtcgttcccggcgtacgtggacgacccgacggtgcccaacgacagcgtgaccccgacgttcgcggcggcggcgctcttcatcgacaacgcgcggtgggacggggtgccgttcctgatgaaggccggcaaggcgctgcacacgcggcgcgcggagatcagggtgcagttccggcgcgtgcccgggaacctctaccgggggaacgtgggcacggacctggacatggccaccaacgagctggtgctccgggtgcagcccgacgaggccatctacctcaagatcaacaacaaggtgcccgggctcgggatgaggctcgacagcagcaacctcaacctcttctactcggagcggtaccagcgggagataccggacgcgtacgagcggctcctcctggacgccatggagggggagcgccggctcttcatccggagcgacgagctcgacgcggcctgggccatcttcacgcccgtgctcagggagctggaggagaagagggtggcgccggagctctacccgtacggcagccggggccccgtcggcgcgcactacctcgccgccaactacaacgtcaggtggggggacatcagcagcgacggatccttctagctagcaagctctgcctatctgctaaggcgccggttagcttgattacgagtttacgactgccatcaagtgacagccaatcttactcagactcaatcaatctgtgacgaacatgagaagctcatatatattg

SEQ ID NO: 4652 - DNA, 2242 bp, Triticum aestivum
atcttttggagtatttgaaggaattatttgtgaccacatgtgcttggaccactgcccccaatctcccagcccaactgtcaggaagcaattatcaagaacatcgaagccccaatcgtcagagccaagcatccaaatcaatttctccacatcagattcagatggattgatagttcgacactcccaactattcttgtttccttcctgacccaatggccgccatcgacttacgcttccatctccatccagccgccttctcctctgtccacccgtccaattcaagcgccaaaccgcaccgccattgcccacctcagaggatccatgctgcaggaagaaggtgcctcctcagggcgaagtcttcaaacgggcacccgcagatcggggcctccttcagcgatggggtgctagatgctaagccgtctggagctggaggcccggcgccggagcagggagagcacaccgtcagcatcacagtcgtcggagcctccggggatcttgccaagaagaagatcttcccggcgctcttcgccttgttctacgaggactggctccccgagcattttacaatctttggttatgctcgtagcaaaatgagcgatgaagagctcaggaacatgattagcatgaccctaacctgccggattgatcagagggcgaactgcagtgagaagatggataaatttctgaagagatgcttctatcagtccggacagtacaactcagaggaaggatttcgcgaattggatagaaagcttacagaaaaagaggctgggaagctaccaaacaggctgttctacttgtctatcccaccaaatatattcgtggacgtggtaagatctgccagccgcaccgcttcactgccgagtgggagtggctggacgaggtttatagtggagaagccattcggccgcgattctgagtcctcgggggagcttacccgatccctgaagatgtatttagaggaggagcaaatcttcaggattgaccattatctgggcaaggagctggtggaaaacctgtcggtcctccgtttctccaaccttgtgttccagccactctggtcgagggactacattcggaatgtgcagctcatattctccgaagacttcggcaccgagggtcgaggcggctacttcgacaactacgggatcatccgggacatcatgcagaaccacttgctgcagatactggccctgttcgccatggagactccggtcagcctcgccgccgaggacattcgcaacgagaaggtgaaagtgttgcgatcgatgaggaagctgaagctggaggacgtggtggtggggcagtacaaggggcacacgcggggcgggaagtcgttcccggcgtacgtggacgacccgacggtgcccaacgacagcgtgaccccgaccttcgcggcggcggcgctcttcatcgacaacgcgcggtgggacggggtgccgttcctgatgaaggccggcaaggcgctgcacacgcggcgcgcggagatcagggtgcagttccggcgcgtgcccgggaacctctaccgggggaacgtgggcacggacctggacatggccaccaacgagctggtgctccgggtgcagcccgacgaggccatctacctcaagatcaacaacaaggtgcccgggctcgggatgaggctcgacagcagcaacctcaacctcttctactcggagcggtaccagcgggagataccggacgcgtacgagcggctcctcctggacgccatggagggggagcgccggctcttcatccggagcgacgagctcgacgcggcctgggccatcttcacgcccgtgctcagggagctggaggagaagagggtggcgccggagctctacccgtacggcagccggggccccgtcggcgcgcactacctcgccgccaactacaacgtcaggtggggggacatcagcagcgacggatccttctagctagcaagctctgcctatctgctaaggcgccggttagcttgattacgagtttacgactgccatcaagtgacagccaatcttactcagactcctcagactcaatcaagccgtgaggaacaggagaagctcatattgcaatcgttttgtcttctgcctaatcgtacttgcattttccttacttatgcaagatacaaaatctgccacacaccgcaaaatcaaataatgccggatatggaaaatactcgaggtcagtttaacctcagcttactataagtcgggtgttgcacagctttacacttctcggctag

SEQ ID NO: 4653 - DNA, 2308 bp, Brachypodium distachyon
gatcttgatttttttgtgtgtggatttgaaggcattatccgtgaccacttatcgctggaccaccacttccagcatcacagcccaactgtcaagaagcaattatgaagaacatcaacccccatttcgtccaaaccaaatatctaaatctatttctgcacaccagattcagatggattgatagttcgatcttgatgcccccaactattcttgtttccttcttgctccaatggcaaccaccggcttactcttccatttacatccgaccgccttctcctcagctcgtccgcaaaatgcaacctccaggctccacagccattgcccacctcaggggatccatgccgcaggaagaaggtgccttctcagggcgaaatcctccaatggccatccacagatcggtgcctccttcagtgatggggtgctagatgggaaggtgcccggaggtgggccgccggagcaagaggggaacaccgtcagcatcactgtcgtcggcgcctccggcgacctcgccaagaagaagatcttcccggcgcttttcgccttgttctacgaggactggctccctaagcattttacagtttttggttatgcacgtagcaagatgagcgatgaagagctcaggaacatgattagcatgaccctaacatgccggattgatcagagggagaactgcagtgataagatggaacaatttctgcagaggtgcttctaccaatccgggcattacaactcagaagaaggattttctgaattggatagaaagcttacagaaaaagaggctggcaagctaccgaaccggttattctacttgtcaattccaccaaatatattcgtggatgtggtaagatctgccagccgcactgcttcatctccaagtggctggacgagattcatagtggagaagccatttggccgcgattacgagtcgtctggagagctcacccgatccctgaagatgtacttggccgaggagcaaatcttcaggattgaccattatctgggcaaggagctggtggaaaacctgtcggtgctccgtttttccaacctcgttttccagccgctgtggtcaagagattacattcgtaatgtgcagctcatattttcagaagactttggcacagagggtcgaggcgggtacttcgacaactacgggatcatccgggacatcatgcagaaccacctgctgcagatcctggcccttttcgccatggaaaccccggttagcctggccgccgaggacatccgcaacgagaaggtgaaggtgctgcggtcgatgcggcggctgaagctggaggacgtggtggtggggcagtacaagggccacacgcggggcggcaagtcgttcccggcctacgtggacgacccgacggtgcccagcgggagcgtgacgccgaccttcgcggccgcggcgctcttcatcgacaacgcgcgctgggacggggtgccgttcctgatgaaggccggcaaggcgctgcacacgcggcgcgccgagatcagggtgcagttcaggcgcgtccccgggaacctgtacaggggaaacgtgggcaccgacctggacatggccaccaacgagctggtgctccgcgtgcagcccgacgaggccatctacctcaagatcaacaacaaggtgccggggctcggcatgaggctcgacagcagcaacctcaacctcttctactccgagaggtaccagagggagatcccggacgcgtacgagcggctgctgctggacgccatcgaaggggagcgacgcctcttcatccggagcgacgagctcgacgccgcctgggccatattcacacccgtgctcaaggagctcgaggacaagagggtggcgccggagctctacccgtacggtagccggggcccggtcggcgcgcactacctcgctgccaactacaacgtcaggtggggggacatcagcagcgacggctccttctagctagtggtagcttcttcttcttttttttaactctgcatcatcagcatctccattgaactcagagcaaagaggcccgcattgattattggaattgtttacaccagctcctggattcatttcattgctctacccacatatgctcacgcgaaaacagacacgattagaattttgtgttttttacttttcttttagttttcactctcttacatatcctaaggcgccattgatgtgtgtgtgtgtgtgtattcatggcttagtccttggcttgtctaaagcaagtgtggaaatgctggagaccaagcttagaccctttgctttgagcttgatgaacatggtcatgtttataaagcgaggcatcgataatcaaac

SEQ ID NO: 4654 - DNA, 2143 bp, Brachypodium distachyon
gatcttgatttttttgtgtgtggatttgaaggcattatccgtgaccacttatcgctggaccaccacttccagcatcacagcccaactgtcaagaagcaattatgaagaacatcaacccccatttcgtccaaaccaaatatctaaatctatttctgcacaccagattcagatggattgatagttcgatcttgatgcccccaactattcttgtttccttcttgctccaatggcaaccaccggcttactcttccatttacatccgaccgccttctcctcagctcgtccgcaaaatgcaacctccaggctccacagccattgcccacctcaggggatccatgccgcaggaagaaggtgccttctcagggcgaaatcctccaatggccatccacagatcggtgcctccttcagtgatggggtgctagatgggaaggtgcccggaggtgggccgccggagcaagaggggaacaccgtcagcatcactgtcgtcggcgcctccggcgacctcgccaagaagaagatcttcccggcgcttttcgccttgttctacgaggactggctccctaagcattttacagtttttggttatgcacgtagcaagatgagcgatgaagagctcaggaacatgattagcatgaccctaacatgccggattgatcagagggagaactgcagtgataagatggaacaatttctgcagaggtgcttctaccaatccgggcattacaactcagaagaaggattttctgaattggatagaaagcttacagaaaaagaggctggcaagctaccgaaccggttattctacttgtcaattccaccaaatatattcgtggatgtggtaagatctgccagccgcactgcttcatctccaagtggctggacgagattcatagtggagaagccatttggccgcgattacgagtcgtctggagagctcacccgatccctgaagatgtacttggccgaggagcaaatcttcaggattgaccattatctgggcaaggagctggtggaaaacctgtcggtgctccgtttttccaacctcgttttccagccgctgtggtcaagagattacattcgtaatgtgcagctcatattttcagaagactttggcacagagggtcgaggcgggtacttcgacaactacgggatcatccgggacatcatgcagaaccacctgctgcagatcctggcccttttcgccatggaaaccccggttagcctggccgccgaggacatccgcaacgagaaggtgaaggtgctgcggtcgatgcggcggctgaagctggaggacgtggtggtggggcagtacaagggccacacgcggggcggcaagtcgttcccggcctacgtggacgacccgacggtgcccagcgggagcgtgacgccgaccttcgcggccgcggcgctcttcatcgacaacgcgcgctgggacggggtgccgttcctgatgaaggccggcaaggcgctgcacacgcggcgcgccgagatcagggtgcagttcaggcgcgtccccgggaacctgtacaggggaaacgtgggcaccgacctggacatggccaccaacgagctggtgctccgcgtgcagcccgacgaggccatctacctcaagatcaacaacaaggtgccggggctcggcatgaggctcgacagcagcaacctcaacctcttctactccgagaggtaccagagggagatcccggacgcgtacgagcggctgctgctggacgccatcgaaggggagcgacgcctcttcatccggagcgacgagctcgacgccgcctgggccatattcacacccgtgctcaaggagctcgaggacaagagggtggcgccggagctctacccgtacggtagccggggcccggtcggcgcgcactacctcgctgccaactacaacgtcaggtggggggacatcagcagcgacggctccttctagctagtggtagcttcttcttcttttttttaactctgcatcatcagcatctccattgaactcagagcaaagaggcccgcattgattattggaattgtttacaccagctcctggattcatttcattgctctacccacatatgctcacgcgaaaacagacacgattagaattttgtgttttttacttttcttttagttttcactctct

SEQ ID NO: 4655 - DNA, 2185 bp, Hordeum vulgare
gaatctctcagccccagtgtcaacaagcaattatcaagaacatcgaagccccattcgtcagagccaagcatccaaatcattttctccacatcagattcagatggattgatagtttgatactctcaactattcttgtttccttcttgacccaatggccgccatcgacttacgcttccatctccatcctgccgccttctcctctgtccacccgtccaatccaagcaccaaaccgcaccgccattgcccacctcagaggatccatgctgcaggaagaaggtgccttctcacggcgaagtcctcaaatgggcacccgcagatcggggcctccttcaacgatggggtgctagatgctaagccgtctggagctggaggcccggcgacggagcagggagggaacaccgtcagcatcacagtcgtcggagcctccggtgatcttgccaagaagaagatcttcccggcgctcttcgccttgttctacgaggactggctccccgagcattttacagtctttggttatgctcgtagcaaaatgagcgatgaagagctcaggaacatgattagcatgaccctaacctgtcggattgatcagagggcgaactgcagtgaaaagatggataaatttctgaagagatgcttctatcagtccggacagtacaactcagaggaaggatttcgcgaattagacagaaagcttacagaaaaagaggctgggaagctaccaaacaggttgttctacttgtctattccaccaaatatattcgtggacgtggtaagatctgccagccgcaccgcttcactgccgggtgggagtggctggacgaggtttatagtggagaagccattcggccgcgattctgagtcctcgggggagcttaccagatccctgaaaatgtatttagaggaggaacaaatcttcaggattgaccattatctgggcaaggagctggtcgaaaacctgtcggtcctccgtttctccaaccttgtgttccagccattgtggtcgagggactacattcggaatgtgcagctcatattctccgaagacttcggcactgagggtcgaggcggctacttcgacaactacgggatcatccgcgacatcatgcagaaccacttgctgcagatactggccctgttcgccatggagactccggtcagcctcgccgccgaggacatccgcaacgagaaggtgaaagtgttgcgatcgatgaggcagctgaagctggaggacgtggtggtggggcagtacaagggccacacgcgcggcggcaagtcgttcccggcctacgtggacgacccgatggtgcccaacgacagcgtgaccccgaccttcgcggcggcggcgctcttcatcgacaacgcgcggtgggacggggtgccgttcctgatgaaggccggcaaggcgctgcacacccggcgcgcggagatcagggtgcagttccggcgcgtgcccgggaacctctaccgcgggaacgtggggacggacctggacatggccaccaacgagctggtgctccgggtgcagcccgacgaggccatctacctcaagatcaacaacaaggtgcccgggctcgggatgaggctcgacagcagcaacctcaacctcttctactccgagaggtaccagcgggagataccggacgcgtacgagcggctcctcctggacgccatggagggggagcgccggctcttcatccggagcgacgagctcgacgcggcctgggccatcttcacgcccgtgctcagggagctcgaggacaagagggtggcgcccgagctctacccgtacggcagccggggtcctgtcggcgcgcactacctcgccgccaactacaacgtcaggtggggggacatcagcagcgacggatccttgtagcaagctctgcccattggctacggcctatgcactctactcaggctcaatcaagctgtgacgaacaattttttttgagagtaggcgacgtatcataattttacagaaaagaaagaacatataaaagagctttctagtgatgcgggcatcacagcaagcaatacaactcaacgtccacattcaaagaaactaggcctactttctcacaaaaagactgagaacatcaactcctagcactgcctctttccactcacgaacttccttcatcatacaattggattgcggttttgaattgatccgaacggttggaca

SEQ ID NO: 4656 - DNA, 2253 bp, Hordeum vulgare
ttgatggaattatttatgaccacacgtgcttggaccactgccctcaatctctcagccccagtgtcaacaagcaattatcaagaacatcgaagccccattcgtcagagccaagcatccaaatcattttctccacatcagattcagatggattgatagtttgatactctcaactattcttgtttccttcttgacccaatggccgccatcgacttacgcttccatctccatcctgccgccttctcctctgtccacccgtccaatccaagcaccaaaccgcaccgccattgcccacctcagaggatccatgctgcaggaagaaggtgccttctcacggcgaagtcctcaaatgggcacccgcagatcggggcctccttcaacgatggggtgctagatgctaagccgtctggagctggaggcccggcgacggagcagggagggaacaccgtcagcatcacagtcgtcggagcctccggtgatcttgccaagaagaagatcttcccggcgctcttcgccttgttctacgaggactggctccccgagcattttacagtctttggttatgctcgtagcaaaatgagcgatgaagagctcaggaacatgattagcatgaccctaacctgtcggattgatcagagggcgaactgcagtgaaaagatggataaatttctgaagagatgcttctatcagtccggacagtacaactcagaggaaggatttcgcgaattagacagaaagcttacagaaaaagaggctgggaagctaccaaacaggttgttctacttgtctattccaccaaatatattcgtggacgtggtaagatctgccagccgcaccgcttcactgccgggtgggagtggctggacgaggtttatagtggagaagccattcggccgcgattctgagtcctcgggggagcttaccagatccctgaaaatgtatttagaggaggaacaaatcttcaggattgaccattatctgggcaaggagctggtcgaaaacctgtcggtcctccgtttctccaaccttgtgttccagccattgtggtcgagggactacattcggaatgtgcagctcatattctccgaagacttcggcactgagggtcgaggcggctacttcgacaactacgggatcatccgcgacatcatgcagaaccacttgctgcagatactggccctgttcgccatggagactccggtcagcctcgccgccgaggacatccgcaacgagaaggtgaaagtgttgcgatcgatgaggcagctgaagctggaggacgtggtggtggggcagtacaagggccacacgcgcggcggcaagtcgttcccggcctacgtggacgacccgatggtgcccaacgacagcgtgaccccgaccttcgcggcggcggcgctcttcatcgacaacgcgcggtgggacggggtgccgttcctgatgaaggccggcaaggcgctgcacacccggcgcgcggagatcagggtgcagttccggcgcgtgcccgggaacctctaccgcgggaacgtggggacggacctggacatggccaccaacgagctggtgctccgggtgcagcccgacgaggccatctacctcaagatcaacaacaaggtgcccgggctcgggatgaggctcgacagcagcaacctcaacctcttctactccgagaggtaccagcgggagataccggacgcgtacgagcggctcctcctggacgccatggagggggagcgccggctcttcatccggagcgacgagctcgacgcggcctgggccatcttcacgcccgtgctcagggagctcgaggacaagagggtggcgcccgagctctacccgtacggcagccggggtcctgtcggcgcgcactacctcgccgccaactacaacgtcaggtggggggacatcagcagcgacggatccttgtagcaagctctgcccattggctacggcctatgcactctactcaggctcaatcaagctgtgacgaacaattttttttgagagtaggcgacgtatcataattttacagaaaagaaagaacatataaaagagctttctagtgatgcgggcatcacagcaagcaatacaactcaacgtccacattcaaagaaactaggcctactttctcacaaaaagactgagaacatcaactcctagcactgcctctttccactcacgaacttccttcatcatacaattggattgcggttttgaattgatccgaacggttggacacccttgggttcctttgtttccaaa

SEQ ID NO: 4657 - DNA, 1978 bp, Secale cereale
aaatcaatttctccacatcagattcagatggattgatagttcgatactcccaactattcttgtttccttcctgacccaatggccgccatcgacttacgcttccatctccatcctgccgccttctcctctgtccacccctccaattcaagcaccaaaccgcaccgccattgcccacctcagaggatccatgctgcaggaagaaggtgccttcccagggcgaagtcttcaaatgggcacccgcagatcggggcctccttcagcgatggggtgctagatgctaagccgtctggagctggaggcccggcgccggagcagggagagcacaccgtcagcatcacagtcgtcggagcctccggggatcttgccaagaagaagatcttcccggcgctctttgccttgttctacgaggactggctccccgagcattttacaatctttggttatgctcgtagcaaaatgagcgacgaagagctcaggaacatgattagcatgactctaacctgccggattgatcagagggcgaactgcagtgaaaagatggataaatttctgaagagatgcttctatcagtctggacagtacaactcagaggaaggatttctcgaattagatagaaagcttaccgaaaaagaggctgggaagctaccaaacaggttgttctacttgtctattccaccaaatatattcgtggacgtgataagatccgccagccgcacggcttcactgccgagtgggagtggctggacgaggtttatagtggagaagccattcggtcgcgactctgagtcctcggcggagcttacccgatccctgaagatgtatttagaggaggagcaaatcttcaggattgaccattatctgggcaaggagctggtcgaaaacctgtcggtcctccgtttctccaaccttgtgttccagccactgtggtcgagggactacattcggaatgtgcagctcatattctccgaagacttcggcaccgagggtcgcggcggctacttcgacaactacgggatcatccgggacatcatgcagaaccacttgctgcagatactggccctgttcgccatggagactccggtcagcctcgccgccgaggacattcgcaacgagaaggtgaaagtgctgcgatcgatgaggaagctgaagctggaggacgtggtggtggggcagtacaagggccacacgcgcggcgggaagtcgttcccggcgtacgtggacgacccgatggtgcccaacgacagcgtgaccccgaccttcgcggcggcggcgctcttcatcgacaacgcgcggtgggacggggtgccgttcctgatgaaggccggcaaggcgctgcacacgcggcgcgcggagatcagggtgcagttccggcgcgtgcccgggaacctctaccgggggaacgtcggcacggacctggacatggccaccaacgagctggtgctccgggtgcagcccgacgaggccatctacctcaagatcaacaacaaggtgcccgggctcgggatgaggctcgacagcggcaacctcaacctcttctactccgagcggtaccagcgggagataccggacgcgtacgagcggctcctcctggacgccatggagggggagcgccggctcttcatccggagcgacgagctcgacgcggcctgggccatcttcacgcccgtgctcagggagctggaggaaaagagggtggcgccggagctctacccgtacggcagcggggccccgtcggcgcgcactacctcgccgccaactacaacgtcagtggggggacatcagcagcgacggatccttctagcaagctctgtctctgtctgtctgctacgacctatgcactctctgtctctactcaaggcgccggttggcttgattacgagtttacgactgccatcaagtgacagccaattttactcagactcaatcaagctgtgaccaacatgcgaagctgatattgcaattgttttgtcttctgcca

SEQ ID NO: 4658 - DNA, 2054 bp, Oryza sativa
ccacaacctccaacctccaaggccaactgtcagggaaagccattatcaacaagaacatcaaggcttatcctcccttcctgcaagccaaaattctgaatcgaaatccagctgattcccatggattaatactgatcccaacagttctttgtcttctccctccttgctccaaatggccggcaccggcttacgattccggcagggcgccatcttcttctcaggagctcatgctgctgctcatccaagaacaaggactcctcaccaccattgctcacctcagaggacgcacgatgcgagaggaaggtgccgcctcacggctaagtccgcaaatggacgcccacagatcagtgcctccttcagagatgtggcgatagatggggcacagtctgaagatggggcgccagagcagggaggatccaccgtcagcatcaccgtcgtcggcgcctccggcgatctcgccaagaagaagatctttcccgcgcttttcgccctgtactacgaggactgcctcccggagcattttacagtttttggttatgctcgtagcaagatgagcgatgaagagctcaggaacatgattagcttgactctgacatgccggattgatcagagggagaactgcagtgacaagatggaacagtttctgaagagatgcttttatcaatctgggcagtacaattcagaggaagggttttctgaactggacagaaagctaaaagaaaaggaggctggcaaggtaccaaacaggctcttttacctgtcgattccaccgaacatatttgtcgatgtggtgagatctgctagtcgcacagcatcatctcaagacggatggacaaggttcatagtggagaagccattcggccgcgattccgagtcgtcaggggagctcactcgaaacttgaagaagtacttggccgaggagcagatattcaggattgaccattatttggggaaggagctggttgagaacctctcggtgctccgtttctccaatctcgtcttcgagccactgtggtcgaggaactacatcaggaatgtgcagctcatattttctgaagatttcggcacggagggtcgaggcggctacttcgacaactacgggatcatcagggacataatgcagaaccacctgctgcagatcctggccctgttcgccatggagactccggtcagcctcgacgccgaggacatccgcaacgagaaggtgaaagtgctgaggtcgatgaggcagctgaggctggaggacgtggtggtgggtcagtacaaggggcacagcaagggcgggaagacgtacccggcgtacgtggacgacccgacggtgccgagcggcagcatcacgccgacgttcgccgccgccgccctcttcatcgacaacgcccgctgggacggcgtccccttcctcatgaaggccggcaaggccctgcacacgcgacgggcggagatcagggtgcagttccggcgggtgccggggaacctgtacgggcggcggagccggagcgtgggcggcggcgggacgacagcgacgagggagctggagaaggcgacgaacgagctggtgctgcgggtgcagcccgacgaggcgatctacctcaagatcaacagcaaggtgcccgggctggggatgaggctggacagcagcgacctcaacctgctctactccgagcgctaccccgccgagatccccgacgcctacgagcgcctgctgctcgacgccatcgagggcgagcgccgcctcttcatccgcagcgacgagctcgacgccgcctgggccatcttcacccccgtcctcgccgacctcgaggccaacaaggtggcacccgagctctacccgtacggcagccggggacccgtcggagcgcactacctcgccgccaaccacaacgtccgctggggtgacattagctagctcagaaaatgaaaagatcgatcggagtcgctgttaccgtgcttgctataatcttcatttaccatttgcattgatgaattctttattggactgctcagggacgaaattaataaaacaaagctctagtcattcgaaattgttttgtttcgca

SEQ ID NO: 4659 - DNA, 1951 bp, Avena sativa
caagcatccaaatctatctgtccacagcagattcagatggatcgatagtttggtactcccaacttttcttgtttctttcctgcgacaatggcaagcatcagcttgcgcttccatctccaacctgccgccgctttctcggctcagccgttcaatgcgagcaccaaacctcaccgccattgcccacctcagaagatccatgctgctgcccgaagaaggtgccttcttagggtcaagtcctcaaatggccacccacagatcggtgcctccttcagtgatgttgttgcaggggtgctagatggtatgtcgtctggagctggagccgtgttgccggagcaggaagagaacaccgtcagtatcacggtggtcggagcctcgggcgaccttgcgaagaagaagatcttcccggctcttttcgccttgttctatgaggactggctccccaagcattttacagtttttggttatgctcgtagcaagatgagcgatcaggagctcaggaacatgattagcatgaccctgacttgccggattgatcagagggagaactgtagtgataagatggagcaatttctgaagaggtgcttctatcagtctggacagtacaactcagaggaaggattttgcgagttagatagaaagcttacagaaaaggaggctgggaagcaaccaaacaggttgttttacctgtcgattccaccaaacatatttgtggatgtggtgagatctgctagccggaccgcttcatctccgggtgggtggacgagattcatagtggaaaagccatttggccgcgattacgagtcttcaggggagctcacacgatccctgaagatgtacttagaggaggagcagatcttcaggattgaccattatctgggcaaggagctggtggaaaacctgtctgtactccgtttctccaaccttgtcttccagccactgtggtcgagagactacattcggaatgtgcagctcatattctcggaagacttcggcaccgagggtcgaggcggctacttcgacaactacgggatcatccgggacatcatgcagaaccacttgctgcagatactggccctgtttgccatggaaacccctgtcagcctcgccgccgaggacatccgcaacgagaaggtgaaagttctgcgatcgatgaggaagctgaagcttgaggacgtggtggtgggtcagtacaagggccacacgcgcggcggcaagtctttcccggcctacgtggacgacccgacggtgcccaacggcagcgtcaccccgaccttcgcggcggcggcgctcttcatcgacaacgcgcggtgggacggcgtgccgttcctgatgaaagccggcaaggctctgcacacccggcgcgcggagatcagggtgcagttcaggcgcgtccccgggaacctgtacagcaggggcaacaacgtcggcggcggcacgcacctggacatggccaccaacgagctggtgctccgggttcagcccgacgaggccatctacctcaagatcaacaacaaggtgcccggcctcgggatgaggctcgacagcagcaacctcaacctcttctactccgagaggtaccatagggagataccggacgcatacgagcgcctgctcctggacgccatcgagggggagcgacgcctcttcatccggagcgacgagctggacgcggcctgggccatcttcacgcccgtgctcagggagctagaggaaaacagggtggcccccgaactgtacccgtacggcagccggggccctgtcggcgcgcactacctcgcctccaaatacaacgtcaggtggggggacatcagctagcaccgacggatccttctagctagttcaaactagggttctgctgcaacttcttgattccatcttttgattccatctgtacctgacagcacttttgatattccatcttttcattgaagcacttgaaatgtttatttac

SEQ ID NO: 4660 - DNA, 646 bp, Triticum aestivum
aggtcctcttccccgtgcaagccgtcgctagagcctgccgccggcgaagcttctgcgggtcctcgtcgtcggccaggtgctggatccgtggcagcggcggccatggacaagagcatgctcggcgacctggacggcctccccgaggaggacaagatgcggatggccggcatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatagtcccatgctggtttcattgcacctgccaagtttctaaccttggggattttgttagcacagatttgtaatccaaaaatgatttcggcacttcactacctgagatatgtgaccgaccgagttaggttgtgtcttgaaccaaatgctgggtatctgaataaaattgccttgagtcgggttagatgcttcgtatcgtggactcgtggttgatcatgtatcattgatagcttttcaggaagtgttgtacttcgattcatacttg

SEQ ID NO: 4661 - DNA, 723 bp, Setaria italica
tacacacaccgtctcgccttctctccccttccttcctcaccgagtctccaaaacctagctattctcttcctcgagcagcggcggcggccatggacaagagcatgctcggcgacctggacggcctccccgaggaggacaagatgcgcatggccgccatgatcgaccagctccagatccgtgacagtctgagaatgtacaattccctggtggagagatgcttcacggactgcgtggacacgttccgccgcaagaccctggacaaacaagaggagtcgtgcgtccgccgctgtgccgagaagttcctgaagcactccatgagggttggcatgagatttgctgagcttaaccagggtgtggccacacctgactaaacgtgctggtttgttgcccctgccaagtttctaaccttggggattttgtcagcatcgatttgtaatcctaaaaagattttagcactcgttgagatatgcaactcagttaggttgcctcttgaaccaactgctgctgggtatgaaattgaataaaattaccttgaatcattgaccaatggcacatcgtgcttaactctatccattgatacatgatagctgccgagaggagtttggattcttgtttcatactagaatcatctgattttgagccacacaaacacaagtgcatattatcgttgctatagtcaggtgttgtctagtgtgtgcagcatggtgcaagatctatagaggc

SEQ ID NO: 4662 - DNA, 588 bp, Pennisetum glaucum
ctcaccaccgagtccaaaacctaagctattctcttcctcgagcagcggcggcggcggcggccatggacaagagcatgctcggcgacctggacggcctcccggaggaggacaagatgcgcatggccgccatgatcgatcagctccagatccgcgacagtctgagaatgtataattccctggtggagagatgcttcaccgactgtgtggatacattccgccgcaagaccttggacaaacaagaggagtcgtgtgtccgccgctgtgccgagaagttcctgaagcactccatgagggttggcatgagatttgctgagcttaaccagggtgtggccacacctgactaaatgtgttggtttgatgcccctgccaagtttttaaccttggggattttgttagcatcgatttgtaatcctaagaagattttagcacagcttgagattcgcaactcagttaggttgcctcttgaatcaactgctgatgggtatgaaattgaataaaattacctagaatcattgtatccaatggcatattgtggttaactctgaatccattgatacgtgatggatgccgagaggagtttggatggca

SEQ ID NO: 4663 - DNA, 849 bp, Saccharum officinarum
caaaaacaataaaggtaaagaatgagtcaaggttaacggaaacataaaagagtcccctaagaaaataactggaaccccagctcggcccgcaacggggggcgacaaacgcgtccgctcacccctctgtcttctagccgtcgccagcgcctgccgccggcgaagcttctgcgggtcctcgtcgtcggccaggtgctggatccgtggcagcggcggccatggacaagagcatgctcggcgacctggacggcctccccgaggaggacaagatgcggatggccgccatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatcgtggcggtttcgttgcgcctgccaagtttctaaccttggggattttgttagcacagatttgtaatcctaaaaagatttcggcacttcactacctgagacatgcggccgagttaggttgcgtcttgaaccaaatgctggttatcagattgaataaaattgccttgagtcactgtatccaagggttagatgctgcatatcgtggttgattctgtatccactgatagctacatagaagtgtacttcgtttcatacttgagtcaccaggtttttgagccacataagtgcgtattattgcttgtatggtcagatattcttggtggtgaggcctcatgatgcaagattgtcgaggc

SEQ ID NO: 4664 - DNA, 513 bp, Eragrostis curvula
ttgttttcgcccatcttgtcaaaacctagctttcttcttcctccatcggcggcggcggcgctgcggccaccatggacaagagcatgctcggagacctggacggcctcccggaggaggacaagatgcgcatggccgccatggtcgaccagcttcagatccgcgacagtttaagaatgtacaattccctggtggagagatgcttcacggactgtgttgacacattccgccggaagaccttggacaagcaagaggagtcctgtgttcgccgctgcgctgaaaagttcctcaagcactccatgagggttgggatgagattcgctgagctgaaccagggtgttgccactcctgactaattggataggtttccttaccccatcaaatttctaccttggggaccttctcaacttcaatttgtaacccttcaaagatttgagcacttcttgagatggaaattataatacctcttaaaccgagtgctggatgtcagatcgaataaaactatgttacttattg

SEQ ID NO: 4665 - DNA, 674 bp, Zea mays
aaacaccagtatctaacccacacggcccacctgcaccgagcggttgccgccgttaaaccctaccgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggtgtggccacgccggactaagaaacacgctgccgctggctggctgctctcgttgcgcgcccgccgccaggtttctggctttcgctggcacagatttgtagccgacaaaaggatttcagcacttcccctgcctgagatatatgcgttttagagccgaacgctgggtgtcagattgaataaaaactgccttgagaagtgttgtatttcgtttc

SEQ ID NO: 4666 - DNA, 1024 bp, Oryza sativa
aatttcccgaggttttagatctcgcttcctctcctctcttcctccaaaaccctagccttcctcctcctctcccggcggcggcggcggcgatggacaagagcatgctcggcgacctcgacggtctcccggaggaggacaagatgcgcatggcggccatggtcgaccagctccagatccgcgatagtttgagaatgtacaactccctcgtggaacgatgcttcacagactgcgtggacactttccgccggaagaccctcgacaagcaagaggaatcctgcgtccgccgctgcgctgagaagttcctgaagcactccatgagggttggcatgagatttgctgagcttaaccagggtgttgccacacctgactaatcaattgggtttggtttctaacgttggcaattttgtcagcataaaatctgtaatccttaaatatttgagtacttgaggatacgagagacatcatgttttcctcttaaaccgatgggcgactgctgggtatcaagttgaataaatttatattaaattcccatattggtagctattgagaagagccatatttctgaatatttttatggtatatcgtgtaatctaattctgttatgtctaatttcatatcctgaggttacaggaaccttaagtacatttttttaccattgctgtgttcaatggtcttgattcacatataatagtatccaccatctgtaaaggcaccttttcccttgccctctctctagacatctgctttgattgagagcaaagaatataggaccatgcacatgaactcatcatgccatcagcaccaccaaactgcaagatctctcactgttctttctctacaaattattgatgtatcagctatcatgtcatgtcctttttcatcagtattacaatattggctagtgaattgctgcacatgtaacctccttgtagagcacaaccgctttgccaccatacttgcaatcctccatcaaccctcttcaccttgtcaatgaacttagacctgcttcagtatagtactaacc

SEQ ID NO: 4667 - DNA, 1136 bp, Panicum virgatum
ctccctttcctccccgaggctccaaaacctagctcttcccttttcctcgggcggcggcggccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacattccgccgcaagaccctggacaagcaagaggagtcatgtgtccgccgctgcgctgagaagttcctgaagcactccatgagggttggcatgagatttgctgagcttaaccagggtgtggccacacctgactaaactttgttgcccttgccaagttccccccgtggggatttttgtcagcatctatttgtaatcctaaaaaagattttagcaccctttgagaaatgcaactcggtaaggttgcccttgaaccaactgctgggtatgacattgaataaaattacctagattcattttatccaaaaaaaaaaaaaaaagggcggccgcgtccaaggagagcagcgacgtgcggagctcggcgagcctgtgccgccgccgccgcgggaccggcagcgggaaggccgaggaggaggaggaggacgaggcgtccgcgcccggcccaccgcctaccgccaggtcccctccgcttgccgccctgctcgacgcggtcgcggccatgctcggccccgtgctgcagcggctgcacgagcacgaaggcgaggaggctgccgcgtaccggggcacgatcaggcgccacgtggacctggagacggtgcggcgccggctggacacggcggcgggcagctcgcgcggcggcggcggcgacgacgtccactgccccgcgcacgagctctaccgcgacctgctgctgctctgcacaaacgccgtggtcttcttcccgcgcggcagccccgagcacgccgcggcagccgaggcccgcacgctcgtgaccgggcacgcgtcggctccggcgaagcaggaccgcgcggctgttccggcgccggcgccggccccggccccggcgggcgctgacatcgtcgggtcgctgatcgagaaggggaagccgctgatcgtgtgccgcaagcggagctccatcgcgaaggctgc

SEQ ID NO: 4668 - DNA, 545 bp, Panicum virgatum
catctctccctttcctccccgaggctccaaaacctagctcttcccttttcctcgggcggcggcggcggcggcggcggcagccatggacaagagcatgctcggcgacctggacggcctccccgaggaggacaagatgcgcatggcctccatgatcgagcagctccagatccgtgacagtctgagaatgtacaattccctggtggagagatgcttcacggactgcgtggacacgttccgccgcaagaccctggacaagcaagaggagtcatgcgtccgccgctgtgctgagaagttcctgaagcactccatgagggttggcatgagatttgctgagcttaaccagggtgtggccacacctgactaaactttgttgcccttgccaagttccccccgtggggatttttgtcagcatctatttgtaatcctaaaaaagattttagcaccccttgagaaatgcaactcggtaaggttgcctcttgaaccaactgctgggtatgacattgaataaaattacctagaatcattttatccaatggtacattttc

SEQ ID NO: 4669 - DNA, 794 bp, Sorghum bicolor
ccataacggcccggcccaatccgcatgtccagtacaccagattaacgatgcaattatgcaacaagtaaaaagaacgaaaatattggatctcgtcacctctcccctttcctctccgaggctccaaaaccctagcgttcttgttccctgggcggcggcggccatggacaagagcatgctgggcgacctggacggcctccccgaggaggacaagatgcgcatggccgccatggtcgagcagctccagatccgagacagtctaagaatgtacaattccctggtggagaggtgcttcacagactgtgtggacacgttccgccgcaagaccctggacaagcaagaggagtcatgtgtccgccgctgcgccgagaagttcctgaagcactccatgagggttggcatgagattcgctgagcttaaccagggcgtggccacgcctgactaatcgtgacggtttcattgctcctgcaaagtatctaaccttggggattttgtcagcaccaatttgtagtagtcctaaaagtattttagcactttctgagatatgcggccaaagttaggttgctttgctcttatatcgaataattcaccttgaatcattgtatccatgggtacgtgctgcgtatattgttgctaattctgtatccatccattgatcggttggtgagaagtgtttgttccatactcaatccagcagtttttttttagccacatgaagtgcaaactattgctgctatgttcagatattctttgtagtgtactagacatcatgttacaagatctgtaaaggcaccttt

SEQ ID NO: 4670 - DNA, 1534 bp, Sorghum bicolor
ccataacggcccggcccaatccgcatgtccagtacaccagattaacgatgcaattatgcaacaagtaaaaagaacgaaaatattggatctcgtcacctctcccctttcctctccgaggctccaaaaccctagcgttcttgttccctgggcggcggcggccatggacaagagcatgctgggcgacctggacggcctccccgaggaggacaagatgcgcatggccgccatggtcgagcagctccagatccgagacagtctaagaatgtacaattccctggtggagaggtgcttcacagactgtgtggacacgttccgccgcaagaccctggacaagcaagaggagtcatgtgtccgccgctgcgccgagaagttcctgaagcactccatgagggttggcatgagattcgctgagcttaaccagggcgtggccacgcctgactaatcgtgacggtttcattgctcctgcaaagtatctaaccttggggattttgtcagcaccaatttgtagtagtcctaaaagtattttagcactttctgagatatgcggccaaagttaggttgctttgctcttatatcgaataattcaccttgaatcattgtatccatgggtacgtgctgcgtatattgttgctaattctgtatccatccattgatcggttggtgagaagtgtttgttccatactcaatccagcagtttttttttagccacatgaagtgcaaactattgctgctatgttcagatattctttgtagtgtactagacatcatgttacaagatctgtaaaggcacctttcttcatgccgtctcttgatacatctgctttctttgacagcaaagaatgcaggaccattgcacatgagctcatcatgccatgaactgatgcactttgaattggaatttaggaagcccaaaagggagctgtggatccagcacatgtgtctacaccagattgcgctccgggatggcacacgggctggctctgctgcctaacccaagcagctggaggttgaagatggttgcgggagtttgggcatgatcagcttggcatttggtggtttggagcttgtccatggggcaatgtgggcaggttggcccttgtgcccaccacctgctgtgctctccccaagttgccgtgttgttttctcatgtgggggttggacagacatggcctggcttgttgttttctcttgtgggtacagactacagtggcgccgtggtgccatggagaagctgcagcacggcggcagatctcgggctgctgcatggcatgtcggtgctgtagcgctgtagcctaacctgctgaagccgcacggtgccgatgcgtcagccgtcagtacttgtttggggccgtcatgatgtgtacagggagcagcatcttaagctctctttactggtacttctacttcttttggctctttgattgatcactagtgttggcatcaagaatcagaggctgtcacgaactagaatcccattctcatggctgtaaagtacagctcatcttgaagcaatgataggagttcagctccccac

SEQ ID NO: 4671 - DNA, 569 bp, Saccharum officinarum
ccataacggcccggctcaatccgcatgtccagtacaccaagaaaatagagaggaaaattggatctcgtcttctctcccctttcctctccgaggctccaaaaccctagcgttcttgttccccgggcggcggcggcggcggccatggacaagagcatgctgggcgacctggacagccttcccgaggaggacaagatgcgcatggccgccatggtcgaccagctccagatccgcgacagtctaagaatgtacaattccctggtggagaggtgcttcacagactgcgtggacacgttccgccgcaagaccctggacaagcaagaggagtcatgtgtccgccgctgtgcagagaagttcctgaagcactccatgagggttggtatgaggttcgctgagcttaaccagggcgtggccacgcctgactaaccgtgtgggtttcattgcccctgccaagtatctaaccttggggattttgtcagcaccaatttgtagtagtcctaaaagcattgtagcactttctgagatatgcggccaagttaggttgccgaatcgaataaaattaccttgaatca

SEQ ID NO: 4672 - DNA, 639 bp, Panicum virgatum
ctctcccattcctccccgaggctccaaaacctagctctcctcttcctcgggcggcggcggcggcggcggccatggacaagagcatgctcggcgacctggatggcctccccgaggaggacaagatgcgcatggccgccatgatcgagcagctccagatccgtgacagtctgagaatgtacaataacctggtggagagatgcttcacggactgcgtggacacgttccgccgcaagaccctggacaagcaagaggagtcatgcgtccgccgctgcgctgaaaagttcctgaagcactccatgagggttggcatgagatttgctgagcttaaccagggtgtggccacacctgactaaacatgctggttttgttgcccttgccaagttcctaactgtggcgattttgtcagcatctatttgtaatcctaaaaagcttttagcactccttgagaaatgcaactcggtaaggttgcctattgaaccaactgccaggtatgacaatgaataaaattacctagaatcattgtatccaatggtacattcttcatatcgtggttaacgctgtatccattgatacctgatagctgctgagaagagtttggattctcgtttcgtacttgaatcagcagattttgagccacat

SEQ ID NO: 4673 - DNA, 505 bp, Cynodon dactylon
ttcgttcccatccgctccagaccctagctttcttcctccggcggcggcggtagcggcagccaccatggacaagagcatgctcggagacctggatggtctcccggaggaggacaagatgcgcatggccgccatggtcgaccagctccagatccgtgacagttaagaatgtacaattcgctggtggagagatgcttcacggactgcgttgacacattccgtcggaagacgctcgacaagcaagaggagtcctgtgtccgccgatgtgctgaaaagtttctgaagcactccatgagggttggcatgagattcgctgagctcaaccagggcgttgccacacctgactaatttgaataggtttctttgccccgtcaagtttcacattgggcatatttctctgcgtcaatttgtaactcttaaaagatttgagcacttcttgggatgggaatgaacctcttaaaccgtcaactggtatcaaattgaataaacttgttacttattgtcttcc

SEQ ID NO: 4674 - DNA, 610 bp, Setaria italica
gtaaaagaaaaaaaatggatctcaccttcttctctccccttcctctccgagactccaaaacctctccctcttcctcgggcggcggcggcggcggcgcggcggccatggacaagagcttgctcggcgacctggacggcctcccggaggaggacaagatgcgcatggccgccatggtagaccagctccagatccgtgacagtctgagaatgtacaattccctggtggagaggtgctttacagactgcgtggacacgttccgccgcaagaccctggacaagcaagaggagtcgtgcgtccaccgctgcgccgagaagttcctgaagcactccatgagggtcggcatgaggtttgccgagcttaaccagggcgtggccacccccgattaatcgtgtgggtttcatcgcccctaccaagtttctaaccttgaggattttgtcagcattgatttgtgtaatcctaaaaagatttcagcactccttgagatacacaactcggtgtcagctaggttgcttcttgaaccagctgctgggtaaggaattgaataaacttacagatcttgagccacataggtgcatattatctcgttgctatattcaggtattgtttgtag

SEQ ID NO: 4675 - DNA, 491 bp, Lolium multiflorum
ggcccgtcctatcttcctcccccaaaccctagctttcctcgccgtgcggcggcggcggcggcagccatggacaagagtatgctcggcgacctcgacaacctccccgaggaggacaagatgcgcatggccgtcatggtcgaccagctccaagtccgcgacagtctacggatgtacaacaacctggtggagaggtgcttcaccgactgcgttgagacattccgccgcaagaccctggacaagcaagaggagtcatgtgtccgccgctgcgctgagaagttcctgaagcactccatgagggtcggcatgcgattcgctgagcttaaccagggcgttgccacacccgactaaccgaatgatgtgtccttgtccttcaagtttctaacattggacatttggtcaggaccagtttgtaatccttgaaaggttttcaagtactttatgaacccactgctgctggttatcaagttaaataaagtttatcttgaatcaaa

SEQ ID NO: 4676 - DNA, 673 bp, Tabernaemontana elegans
tagacttctgtggaagggctctagcgctccagtgaagaacaagaagaagaaagaagaaaaaaagatggataagagcatgcttggagacttggattcgctcccggaggaggataaggtcagaatgtcggccatgattgatcagctccaaatccgcgacagtttaaggatgtataattcactggtggaaagatgttttactgattgtgtggacactttccgccggaaaactctggataaacaagaggagacgtgtgtacgtcgttgtgcagagaagttccttaagcattcaatgcgggttggaatgagatttgcagagctcaaccaaggtgcagctacaccagattaagaagcctctaaatgtgtattgctattagtttaacttgatgcaagaaagctgttttatgacattctactagttcattcttacttggaatgccttaatttggccgaggatttcaatgaagttttgttgtggatgatttatttaataatagcgccatctatatctttgcttcatctcatttgtacatgaatgaggttgcctagcgatttggtggaaaggttagttgggatgaaaacaatagaaatgcaccacctcttctagaatactttgccttgttacaaaaggaaactagaaagggggaaaggcatatgttcaagtgcctttgaacat

SEQ ID NO: 4677 - DNA, 519 bp, Valeriana officinalis
ctcccaaaactctaagatggacaagagcatgctcggagacttggataatcttcccgaggaagataaaatcagaatgtccaccatgattgaccagctccaaattcgtgacagtttaaggatgtacaactctcttgttgaaagatgtttcacggattgtgtggacacgttcaggcgtaaaaccctagataaacaagaagagacctgtgttcgccgttgtgccgagaagttcttgaagcactccatgcgtgttggaatgagattcgccgagcttaaccaaggcgctgctacaccagattaatatttctccctctcctagtagtttgctaatcatgctttcattcttggaacagagcagatgatactacattatcttttcatgtaataaaatggatcaaaatacctcttttcttttcaagtatctctatctcacattcactatacaagattttttatttatataatgttatacactaaacagttggtggtattttaatcttatgaatattctttataaaaaaa

SEQ ID NO: 4678 - DNA, 422 bp, Vinca minor
gaagaaagatggataagagcatgcttggagatttggacaatcttccggaagaggataagatcagaatgtctactatgattgatcagctccaaatccgtgacagtttaaggatgtataattcgctggtggaaagatgttttactgattgtgttgacaccttccgccggaaaactttggataaacaagaggagacttgtgtacgccgttgtgcagagaagttcctgaagcattcaatgagggtcggaatgagatttgcggaactcaaccaaggtgcagctacaccagactaagaagcctttaaatgtgtactgctattagtttaacttgatgccaaaaatttgttttttgttacattcttatagagtcattcatactttaaatgccttaatttggccaagtatttctatcaagttttgatgtgg

SEQ ID NO: 4679 - DNA, 867 bp, Brachypodium distachyon
aacaataacaaagaagcgaatccccatcccccgaggttttagatctcgtcgtctccccttcctctccaaagccctagctttcctctcctcccccctccttgtgcggcggcggcggcagccatggacaagggcatgggcatgctcggcgacctcgacaacctcccggatgaggacaagatgcgcatggcctccatggtcgaccagctccagatccgtgacagtttgagaatgtacaattccctggtcgagaggtgcttcacggactgcgtggacacattccgtcggaagaccttggacaagcaagaggagtcctgcgtccgtcgctgtgccgagaagttcctgaagcactctatgagggttggcatgcgattcgctgagcttaaccagggcgttgccacacccgactaatcaaaagatgtctccttgccccgtcaagtttctaacattgcgtgttcgatcagcatcagtttgtaatccttgaaagtttccagtacttatgaacccatagccggttgtcaagttgaataaaatcacgttgaattattgtatccaaggtttattcctgtcttgctatatggtttgacacacctttgatatctcaaagagaagagttgatatatccgtaccatttcatcatgttgtgttgaatacctgaagttccatgaatcttaataactatcttcgctgtttctttgtagtgcagaaacagcatagtacaatatgtgtaaaggaacctttttccttgccatgtcctcaggtatctgctttgtttggaagagcaaagaattataggaccatacacatcaatagcaccatgcctggaggtttcctttggcctgggcatgatcacatttgccctttggcatc

SEQ ID NO: 4680 - DNA, 542 bp, Brachypodium distachyon
aacaaagaagcgaatccccatcccccgaggttttagatctcgtcgtctccccttcctctccaaagccctagctttcctctcctcccccctccttgtgcggcggcggcggcagccatggacaagggcatgggcatgctcggcgacctcgacaacctcccggatgaggacaagatgcgcatggcctccatggtcgaccagctccagatccgtgacagtttgagaatgtacaattccctggtcgagaggtgcttcacggactgcgtggacacattccgtcggaagaccttggacaagcaagaggagtcctgcgtccgtcgctgtgccgagaagttcctgaagcactctatgagggttggcatgcgattcgctgagcttaaccagggcgttgccacacccgactaatcaaaagatgtctccttgccccgtcaagtttctaacattgcgtgttcgatcagcatcagtttgtaatccttgaaagtttccagtacttatgaacccatagccggttgtcaagttgaataaaatcacgttgaattattgta

SEQ ID NO: 4681 - DNA, 569 bp, Antirrhinum majus
gagcagtatcctaaaacaaaccatacgattcagaatttagaggtgtaccttgtgcatcaccggcggtaccttcagcacagaatctttgaaaatggacaagagcatgctcggagatttggacgcgcttccggaggaagataagcagcgaatggccgccatgatcgaccagcttcaagttcgcgatagtttaaggatgtataattcactggtggaaagatgtttcacggattgtgtggacacatttcgtcgcaagactctggacaagcaagaggagacatgcgttcgcagatgtgcagagaagttcctgaagcactcgatgcgtgtaggcatgaggttcgctgagttgaaccaaggcgccccaacaccagattaaaatgcattttattgaaccaatgtgctgctatttatttaaaaagatgccttttccaatggcatttgtttgtcgtttagcgcttttattgttgttcttatgggagtaatttccaaatacaaagtacttggaatttttgtgatattttatagttttacctaataatttcatggaaattcttattgcctctttcgtttgg

SEQ ID NO: 4682 - DNA, 479 bp, Fraxinus spp
gagtcgaagatggacaagagcatgctcggagacttggactctctgcccgaggaagataagctccgaatgtcctccatgattgaccagctccaaatccgtgacagtttaaggatgtataactcacttgtggaaagatgtttcactgattgtgtagacacctttagacgcaaatctctagacaagcaagaggagacttgtgtacgccgctgtgctgagaagtttttgaagcactcgatgcgtgttggtatgagatttgctgagctcaaccaaggtgcagctacaccagattaagatgcctgagatttacattggcaatcatgttccggcacatccaattgtgtttttatgaaagtaatttccagttatgacttatgatccatttcagactatgatatgctccagtcttagaaagttcctttttaagttttaaagatttgcattgctagtttgggggaaagaataagatgaataatgatttt

SEQ ID NO: 4683 - DNA, 563 bp, Fraxinus spp
cggccggggggagccaagtcttggcccaaatcggcctagaagtttccgctggcgcaggccatccgtactttcgttctcatctatgtcaattatcgccgacaaacctaattagggtttagagagctgactttacatcagtagtactttgagcataacaattcgtacaatcaactgaagatggacaagagcatgcttggagacttggatcccctgcccgaggaagataagctacggatgtcctctatgattgaccagctccaaatccgtgacagtttgaggatgtataattcactggtggaaagatgtttcactgattgtgtagacacctttcgacgcaaatctctagacaagcaagaggagacttgtgtacgccgctgtgctgagaagttcctgaagcactcaatgcgtgttggcatgagatttgccgagctcaaccaaggtgctgctacaccagattaagatgcctctaattacattggcaatcatgttttggcacatctaatcgtgtttttatgaaagtaatatccagttataacttatgatttatttcataatatatgatt

SEQ ID NO: 4684 - DNA, 563 bp, Avena sativa
ttttagatctcgccgtctcccctttcctcccccaaacctgtctcccccttcctaccccaaaccctagctttcctcgccgtgcggcggcggcggcagccatggacaagagtatgctcggcgacctcgacaacctccccgaggaggacaagatgcgcatggccgtcatggtcgaccagctccaagtccgcgacagtctgcggatgtacaataacctggtggagaggtgcttcacggactgcgttgagacgttccgccgcaagaccctggacaagcaagaggagtcatgcgtcaaacgctgcgccgagaagttcctgaagcactccatgagggtcggcatgcgatttgccgagcttaaccagggcgtcgccacacccgactaatcggatgatgtgtttcaagtttctaacattgcgcatttgtcaggatcactttgtaatccttgaaaggttttcagtacctcgtgaacccactgctggctatcaagttaaataaagttttgtcttgaattattgtatgcaaggcttattcctgttactttgctgttgcttaatagattgatatat

SEQ ID NO: 4685 - DNA, 603 bp, Lippia dulcis
gggaagcaagaaaaataaaacatgggaccaagctctgtttttattctgtgattttagggttttagaagcagtagtctccaaacccaagcgaagttgtactctcttgctcttcggttgtacgttcaagaaattcatcaacaatggacaaaagcatgcttggagatttggacgctcttcccgaggaggacaagctccgaatggcgtccatgatcgaccagctccaaatccgcgacagtttaaggatgtataatacactggtggagagatgtttcaccgactgtgtagacacattccggcgcaaaactctagataagcaagaagagacttgtgttcgcagatgtgcagaaaagttcctgaagcactctatgcgtgtcggcatgagattcgcagagctgaaccaaggtgctgccacacaagactgagatggccctcgcaatgatgttccttcctacctctgaagtcgaggggattccctttaatagattttgaagatttgtttttgttaggacttgctattgctgctactttgtttggacacaataaggtaaggtatcacctcccttaacattaatgaaactcatcattttttagttacaaaaagaa

SEQ ID NO: 4686 - DNA, 525 bp, Salvia sclarea
gcacgagggtagtctccaaaccctcgcagggttgtactccgtgaagcttcggttgtacgttcaagaaactcatcgacaatggacaagagcatgcttggagatctggacgctcttcccgaggaggataagctccgaatgtcttccatgatcgaccagctccaaatccgcgacagtttaaggatgtataatacactggtggaaagatgtttcaccgactgtgtcgacacattcaggcgcaaaactctagataagcaagaagagacttgtgtccgcagatgtgcggagaaattcttaaagcactctatgcgtgtcggcatgagatttgccgagctaaaccaaggagctgccacaccagattaagatgcagtcacagacctttcccgttggtaggcgttgttcctacttgtgaactttgagggcattccattacattaatagtttttgaagatttgctttggttaggacttattactaatgctacttattttggacgcaataaggtaagatatcgtttcttgtaacgtt

SEQ ID NO: 4687 - DNA, 597 bp, Salvia sclarea
ctactagaccttggctgtcactcaggaggagaggagaggagcaccgtttggagtcgttttgtgtttctagggttttagaagcagtagtctctcaaaccatcgcagagtcgtactcagtgaagctctggttgtacgttcacgaaactcatcgacaatggacaaaagcatgcttggagatttggacgctcttccggaggaagacaagctccgaatgtcttccatgatcgaccagctccaaatccgcgacagtttaaggatgtataatacactggtggagagatgtttcaccgactgtgtagacacattccggcgcaaaactctagataagcaagaagagacttgcgtccgcagatgtgcagagaagttcctgaagcactctatgcgcgtcggcatgagatttgccgagttgaaccaaggtgctgccacaccagactaagatttgctgcaccccttttccttttggtaggcaccgttgctacttgtgaacttgagggcattccattactttaatagtttttgaagatttgtttgtgctaggacttgttactattactactttatttagacgcaataaggtaagatattatatccctcagg

SEQ ID NO: 4688 - DNA, 679 bp, Triphysaria pusilla
atttagagtcaaccctttgctttgcattagggtttaagagaacagtgagaaccttttccagagttgtatcgttcagttacctagttgtaccttcaacaataacaacaaaagaatcgtctcgaaatggacaaaagcatgctcggggatttggatgctcttccagaagaagataagcagcgaatgtcagccatgatagatcagctccaaatccgtgacagtttgagaatgtataattcactggtagaaagatgtttcacggattgcgtagatacatttcggcgtaaaactctggataagcaagaagagacgtgtgtccgtagatgtgctgagaagttcttgaagcattcgatgcgtgttggcatgagatttgctgagctgaaccaaggagctcctacacccgactaatatgtcattttgatgtattgatgttacatcatcacataaagaggcctttttcatgttccttgtttcagaacacgcaaaactcttttgcatttctcttcacatatatttctttaacttggtgatgtatcattattttagtttctaataatttccttggagtttttaacttttgttcgtgtgtttggagaaaacaaggtaagatgattattggtttgcttgcatatttatatggagttattattttgtttcttaacaaaaaaaaaaaaaaaaaaag

SEQ ID NO: 4689 - DNA, 713 bp, Vaccinium corymbosum
tatttacggtccgggggttcttaggggtttcctaaagtagcgtagtcgaaagctccaggggcttagcaaagaacttgtaacctcccagttcatacgttttactagggttttagagagagactagaatttgagcagcagttgcggtttagcccccaagaaaaccctaaaacccttgaaagctattggaatcgaagatggacaagagcatgctcggtgacctcgactcgcttcccgaggctgacaagcagaaaatggccgccatgatcgaccagctccagatccgcgacagtttaaggatgtataattcactcgtggagagatgtttcactgattgtgtggacacattccggcgcaaatcacttgacaaacaagaggagacctgtgttcgtcggtgtgccgagaagttcctgaagcactcgatgcgtgttggcatgagatttgcagagctcaaccaaggtgcagctacacccgattaaggtgtacctattgcttttttatggcaaactttgtaaccctggaatctgtttatggttttaatattttccttttggatttgagatattgtccaaattgggatatgcccttatttttgaagtaggagattttcagtctctgacaatttctgctatttacacaaaatctaataagttggctcatagttttttgtgttaatgtactgcagatgaaaacagatgttatgcttgccaaattga

SEQ ID NO: 4690 - DNA, 581 bp, Actinidia deliciosa
  misc_feature (394)..(394): n is a, c, g, or t
  misc_feature (422)..(422): n is a, c, g, or t
  misc_feature (482)..(482): n is a, c, g, or t
  misc_feature (506)..(506): n is a, c, g, or t
cgatagttgtttggccgtgaagctgaagctgaaacccaaaaccctgaatcgaagatggacaagagcatgctgggagacctcgactctcttcccgaggaagataagctcaggatgtccaccatgatcgaccagctccagatccgcgacagtttaaggatgtataattcactcgtggagagatgtttcaatgattgcgtggacaccttcaggcgcaaatccctcgacaaacaagaggagacctgtgtccgtcggtgtgccgagaagttcttgaagcactcgatgcgtgtcggcatgagattcgcagagctcaaccaaggtgcagccacaccagattaagctgtactattaccagtagtaaagtttgtaactcctggaaatggttttcgacgggaantttttcctttcacatttgaattattttncaaattgtgttatgctctcatctacatgtaggaaacattttggtctcttatgatttcggnagttcacaagagatataataagtnggagcatcctagtttatttgtttgctgtactctggatgaaaatgggtttgtttaatattcccaagaattgatgag

SEQ ID NO: 4691 - DNA, 561 bp, Olea europaea
gcaatcaaagatggacaagagcatgcttggagacttggattctctgcccgaggaagataagctacggatgtcctctatgattgaccagctccaaatccgtgacagtttgaggatgtataattcactggtggaaagatgtttcactgattgtgtagacacctttcgacgcaaatctctagacaagcaagaggagacttgtgtgcgccgctgtgctgagaagttcctgaaagcactcaatgcgtgttggcatgagatttgccgagctcaaccaaggtgctggtacaccagattaagaaagcctctaattgcattggcaatcatgttttggcacatctaatcgtgttttatgatagtaatttccagttataaattatgatttattgcagaatttgtgacgtgcttttattcaatcaacaatgactacgaggttcctttggagttttaaagattttgtattactagttgggttaaatccacctatggacactcaactttatatttagtgttactatggccactcagtttgaattagtttaattatggccatccaaatttatatct

SEQ ID NO: 4692 - DNA, 1122 bp, Lippia dulcis
cgatttagtcattttacgaaacaagaaaagcaaaacagaggatttcgcttctagggtttttagaagtacttgcagagttgtactcggtggctcttcggttgtacgttgaataaactcatcgacaatggacaaaagtatgcttggagatttggacgctcttcccgatgaagacaagctccgaatgtcttccatgatcgaccagctccaaatccgagacagtttaaggatgtataatacactggtggaaagatgcttcaccgactgtgtggacacattccgacgcaaaactctggataagcaagaagagacgtgtgttcgcagatgtgcagagaagttcttgaagcactctatgcgcgtcggcatgagattcgcagagctgaaccaaggtgctgcaacgccagactaagatgcgcttcccacctgtgaagccgagggcattccctttaatagttttgaagatttgtttttgttaggacttgttactgatgctactttatttggacacaatagggtaagatatcgtttccctttacaagactccctgcggcataatcttttctgttttggttttgtcaaatattaccatgtaaaattttctatatttgaaatgagttgcaactaaaaaattcgttattattgataataaacaacaaatgcatatttaaatagtgcctttaagtaatggatataaacttgagctttttttcatactactattattatagtttgaagttaaagttaaatctcatgtgattttgtgcagtgatatttagcaatgtaacgaatcccaagtttcatttatgtaaattgaaatgaattgcaattaaaacatcattattattgacaaggtaaatctttaattaatacagcattaatgaattatacttaaatcttctatcttttctatcgatgtagtagcattttacttttcatagatgtttcaagactcagaaaaagacttcacactacacacaagtaattgtctacatttagtttttactaagtactagtaatattttttcgaaatggattatatatttcattaatttattgtattcatttttttattataaaattatatttccagtatacttataaaaagtagaatccatatttttacta

SEQ ID NO: 4693 - DNA, 669 bp, Sarracenia psittacina
tcgggggacaagaataatatctcgtctcggcggagaagaacgtgcgagacacgaccccgacagtaataccattcacgcgatcacttgggcgattactagggttttggtggaagtgagcaagcggttggtattttctcccccataaccaaaaccctaacgattattgaatcgaagatggacaagaacatgctcggagacctcgattcccttccagaggaagacaagttgaggatgtcctccatgatcgaccagctccagatccgcgacagtttacggatgtataattcgctggtggagagatgttttactgattgcgtggacaccttcaggcgcaaatcccttgacaagcaagaggagacctgtgtccgtcggtgtgctgagaagttcttgaagcactcaatgcgtgttggcatgcgatttgccgagctgaaccaaggtgcagctacaccagattaaggtgtgttcctattaggctattgacaaaagagttatgccaagtattttctgttggatatgaattattgtctgatttgtctttacttccctcattttatgccattgacaaaagagaataatttggactatattagtttttgtttgtttgtttgtttgtttttgttccctgttaatgaactatggaagaaaaccaattcatgttcccaattgatt

SEQ ID NO: 4694 - DNA, 664 bp, Sarracenia psittacina
gacacgaccccgacagtaataccattcacgcgatcactagggcgattactagggttttgggggaagtgagcaagcggttggtattttctcccccataaccaaaaccctaacgattattgaatcgaagatggacaagaacatgctcggagacctcgattcccttccagaggaagacaagttgaggatgtcctccatgatcgaccagctccagatccgcgacagtttacggatgtataattcgctggtggagagatgttttactgattgcgtggacaccttcaggcgcaaatcccttgacaagcaagaggagacctgtgtccgtcggtgtgctgagaagttcttgaagcactcaatgcgtgttggcatgcgatttgccgagctgaaccaaggtgcagctacaccggattgaggtgtgttcctattaggctattgacaaaagagttatgccaagtattttctgttggatatgaattattgtctgatttgtctttacttccctcattttatgccattgacaaaagagaataatttggactatattagtttttgtttgtttgtttttgttccctgttaatgaactatggaagaaaaccaattcatgttcccaattgattgctacttgggttttgtttagttctcaaggattgctgggagtatgtggggc

SEQ ID NO: 4695 - DNA, 482 bp, Scabiosa columbaria
attagaagggggagtgaagaactataaaattctgcccaaatttcacgttattaaactagggtttcatttaaattcaacagaggtttgtcctaactttgagagacgccattatcgatttgctgctaaaaccctaactgaaaatggacaagagcatgctcggcgacttggattcgcttgccgaggaagataaaatccgaatgtccaccatgatcgaccagctccaaattcgtgacagtttaaggatgtacaactcacttgtggagagatgtttcactgattgtgtggatacttttcgacgcaaaaccctagataaacaagaagagacatgtgttcgccgctgtgcagagaagttcttgaagcactccatgcgcgtgggtatgaggtttgctgagcttaaccaaggttcagctacacaagattaatgagcttaactgctctttgattctattttagagatatttattttcattttgggtacttag

SEQ ID NO: 4696 - DNA, 390 bp, Vinca minor
aaagatggataagagcatgcttggagatttggattccctaccggaagaggataagatcagaatgtctactttgattgatcagctccaaatccgtgacagtttaaggatgtacaactcgctcgtggaaagatgctttactgattgtgttgataccttccgccggaaaactttggataaacaagaggagacttgtgtacgccgctgtgcagagaagttccttaagcattcgatgagggtcgaatgagatttgcagagctcaaccaaggtgcagctacaccagactaataagaagccctaaatgtgtatttttcattagtttaacttgatgctaaaaaatggtttagtgacattcttatatagtcattctatacttccttggaatgtccttaa

SEQ ID NO: 4697 - DNA, 493 bp, Utricularia gibba
ttgggattgtaggcggtggtttggtttttgagtagttgaaaatggacaagagcatgctcggggatgtcgacgcgctgccggaggaagataagcagcggatgacggccatgatcgaccagcttcagatacgggacagcttaaggatgtataactcgctggtggaaagatgcttcaccgactgcgtggattccttcaggcgcaagaccctggacaagcaggaagagacctgcatccgcagatgtgctgagaagtttctgaagcactcgatgcgggtgggggatgagatttgccgagctgaatcagggcgccgccacaccggacggtgcagattccaccctgtaatgcagaggccacgagtttccaaaaaccaggagcagacaccaattgattctatgccgtgttagaagctcattgtggttcgtatttttgcaataataaagtgattttatttaatcaattttctatttatgtatttaaattctggggaaaaaag

SEQ ID NO: 4698 - DNA, 649 bp, Secale cereale
ccctagtttccctcttcgtgcggcggcggcaaccatggacaagagcatgctcggcgacctcgacaacctccccgacgaggacaagatgcgcatgtccgccatgatcgaacagctccagatgcgtgacagtctacggatgtacaatgcactggtggagacgtgcttcaaggactgtgttgacacattccggaggaagactctggacaagcaagaggagtcgtgtgtccgccgctgcgctgagaagttcctgaagcactccatgagggttggcatgcgatttgctgagcttaaccaaggcgttgccacacctgactaatcaaatgatgtgttcctgccccttcaagtttctaacattgcccatctggtcaggatcaatttgtaatccttgaaagttttctgtacttcatgaacccctactgcttatcatgttataaataaaattacttgaactattgtatcgagcccttccccccgttaagtgccacattgtgctacttaatagatcgaaatatatccttcctttgatatctcgtctagtagagtcggtatttctaaatttttattttggtcaaattcatggatctcaacttctttagtagactttctggtattgccgtgtaatgctgaaacatcatagttcaaaaaaaaa

SEQ ID NO: 4699 - DNA, 962 bp, Persea americana
gtaggaaacgtagaaggggcactgtcatcttcctggcttttggcatacaacgaaagcagcaagttgtgcacaccaggatcctcatttagcaaacgatggacacaggattccaaatatttgatcacctcatgcgtttcattctttgcatgaggttcacttgaatagcgcatcattgcgggaatcaatcgccttggattcaggttgctggtagtcatccatgactcaaccgtctcgtatggcatcaagcattataagatctggggcaaatttgtactgcaaatcaataggaacgttaggtttactgaagcacttccaatgctttctttgtttcaccttgctgaatgtaatggtgaatgacaatctcatattgtccctttaaactagcaaaatagaccagggtttttgtgcgaaggagggttttgggtggccgaagaagagaagcacgtcgatcgaccgatcaagcgcagccatggacaagagcatgctcggagatctggaatctcttccggaagaagacaagctcaaaatggcctccatgatcgaccagcttcagatccgagacagtctgaggatgtacaattcactggtagagagatgcttttctgactgcgtggacacattccggcgtaagtcgctagacaagcaagaggagacatgtgtccgccgctgtgctgagaagttcctaaagcattccatgcgtgttggaatgagatttgcagagctcaaccaaggcactgccaccccggactaagtttttgatgatcaaagggattttaccagtctgaataattaagtaacttgacttcttgttttggtcattctccgcaatttaatgtttcagaagaggggatgtagggttttttgttcttccaatatgatgaatccttgatgataaagagcttctttgtaagttcgaataactttaagatgaagtttttggatttttatttctaaattaaatt

SEQ ID NO: 4700 - DNA, 657 bp, Mimulus guttatus
ccttgttcatcaattcttccacacaaaacctctgcaaaaatggacaagagcatgcttggagatctggacgctcttccagaggaagataagctccgtatgtccgccatgatcgaccagcttcaagttcgcgacagtttaaggatgtataattcattggtggaaagatgtttcactgattgtgtggactcgttccggcgcaaatctctcgataagcaagaggagacttgtgttcgtagatgtgctgagaagttcctgaagcattccatgcgtgttggcatgagatttgcagagctcaaccaaggtgctgctacaccagattaacgagatttgtcataatcttattcttcaatagcatttgcattgaaaagttgaagttgaaacaaaacactattttttgggttttttggtattattttctttttttttttgggagaaaaaaataagatgaaaacggtcctcttgttttgttttttttccgtggcaaaaaaatgcattgctatttgctagtgcttttatagcttatgcttactgagattgaagttgcaacagacatcaacgatgttgtactgatcaatttttttcttaacctaacagctgtatgtagttgaagtaatgttctgctttttcgcctttatacaagtgctaaataccctgatt

SEQ ID NO: 4701 - DNA, 664 bp, Elaeis guineensis
agccgccagtctccgtcgccccaaaaccctagagccccaggaaggtagagagcgaactgaggaggacaggatggacaagagcatgctgggagatctggactcgcttcccgaggaggacaagatcaggatgtccgccatgatcgatcagctccagatccgcgacagtttaagaatgtataattcactggtagagagatgcttctctgattgtgtggacacctttcggcgcaagtctcttgataagcaggaagagacgtgtgtccgtcggtgcgcggagaagttcctgaagcactctatgagggttggaatgagatttgcagagctcaaccagggtgctgccacacaggattagtccccatgcaatttcaaaagaagcgaagtcactgtgattctgtggtttttttttgagaaatcacttcggtcctaatacagtgctccttttttttctgtagtagatttatttctcagctcaatggttgtacccttgctgaaaggggatgaaggaatttttatttgttttggtgagaagatttgagtgttaacaaaacttgcaacaagtttttgacttggcggttgtctgacatagctattgttgtgtttggcaccaatagcatttctaaactgtttgtcatcagcaggagcagcgaataatatgaactattgt

SEQ ID NO: 4702 - DNA, 688 bp, Orobanche aegyptiaca
gagttaattacttatcagccgccagatcctattaatcttgctcgttcgtactcttcaatcttacccgtccattcactcactcaaaacagttgcctctcttgccattagggtttcagagagcagtggaagcctttgcagaatcgtactcgttttcaaaagtaaaaaaggaaaaaaaaatactttgaaaatggacaaaaacatgctcggagatttggacgctcttccggaagaagataagcagcgaatgtccgccatgatcgagcagctccaaatccgtgacagtttgaggatgtataattcactggtggaaagatgtttcacggactgcgtggacacgtttcggcgtaagactctcgataaacaagaagagacatgcgtgcgtagatgtgccgagaagtttttgaagcattcaatgcgcgttggcttgagatttgccgagctaaatcaaggagctgcaacacctgattaatatgtagatgtatttgaaccagggtgacgctatatagcttcctaaagacgtcttttccatgcttaggccttttttcggaacacataatatttcgcttttctagtcacgtatacttttggaactttggtgatgttcctgttattttagtttctaaagatatgtttggtgttgtgtttggagagtgtaagatgaattgaaaattggattttaattctcttt

SEQ ID NO: 4703 - DNA, 653 bp, Phalaenopsis aphrodite
cggcaatcgaacggttcgtgctaaagaaggatctaaatccttcgtctcgctcgcgtcgatctaaaaccctagaacaaggaaagaagcgaaggaaagtcccaaaagatggacaagagcatgctcggcgatctggataacctcccagaggaggacaaagctcgaatgtccacgatgattgatcagctccagatacgggacagtttgagaatgtacaattcacttgtggagagatgcttcaatgactgtgtggacagctttcgacgcaagactctcgacaagcaagaagaaacatgtgttcgacgatgcgctgagaaatttttgaagcattccatgagggttggaatgagattcgctgaacttaatcagggagctgcaacacaagattaaagatattcttattcatcttgaatgattgtgactgtttattttttgctgaattaaattttgcttcaatgcattaatgcatcatttgtagcaacttagtttatctatgcgggtttcattgctttctaaggatggaattagtttaattgattgatgctgattgactgtgattgactgatatcctacacctgattcagtctctgcgattagttggcatggttgatctatcaattgatgtcaggtgacttcatggtcaattgaagtttggt

SEQ ID NO: 4704 - DNA, 618 bp, Platanus occidentalis
gattgagtgaaaaacctggtcccccaaaaccctagtctgcttgatcgaactcgaagaagatggacaagagtatgcttggagatctggattccctacctgaagaagataagctgaaaatggcggccatgatcgaccagcttcagatccgtgacagtctaaggatgtataattcactggtggagagatgtttcactgactgcgtggacagtttccggcgcaagtccctagacaagcaagaggagacatgcgttagccggtgtgctgagaagttcttgaagcactcaatgcgggttggcatgagatttgcagagctcaaccaaggaacagccacaccagattagtttccctgaatgtcttttaagggggaacttagctgcctgaaatggtttaataacagaggatttatttactttgatgaaaaattgttgatcctattcttcacttgttcttttgctccagatgggaaaaatagtatctactggggtgcaaggttttctgcttttgttttagtgaaacctcgagcatcaagggttcttaataaattcatgctaggcataagagttattttcatgttttgcaggaacagaatgaataattgtatttaaatgcctctccatg

SEQ ID NO: 4705 - DNA, 548 bp, Secale cereale
  misc_feature (494)..(494): n is a, c, g, or t
ccacgcgtccggacgtctcccctctccccctctccgagaaccctagtttccctcttcgtgcggcggcggcaaccatggacaagagcatgctcggcgacctcgacaacctccccgacgaggacaagatgcgcatgtccgccatgatcgaacagctccagatgcgtgacagtctacggatgtacaatgcactggtggagacgtgcttcaaggactgtgttgacacattccggaggaagactctggacaagcaagaggagtcgtgtgtccgccgctgcgctgagaagttcctgaagcactccatgagggttggcatgcgatttgctgagcttaaccaaggcgttgccacacctgactaatcaaatgatgtgttcctgccccttcaagtttctaacattgcccatctggtcaggatcaatttgtaatccttgaaagttttctgtacttcatgaacccactgcttatcatgttataaataaaattacttgaactattgnatcgagcccttccccccgttaagtgccacattgtgctacttaatagatcgaaat

SEQ ID NO: 4706 - DNA, 571 bp, Triticum aestivum
tcgccgtctcccctctcccctctccgagaaccctagagtttcccccttcgtgcggcggcggcaaccatggacaagagcatgctcggcgacctcgacaacctccccgatgaggacaagatgcgcatgtccgccatgatcgaacagctgcagatgcgtgacagtctacggatgtacaatgcgctggtggagacgtgcttcaaggactgtgttgacacattccggaggaagacgctggacaagcaagaggagtcgtgtgtccgccgctgcgccgagaagttcctgaagcactccatgagggttggcatgcgatttgctgagcttaaccaaggcgttgccacacctgactaatctaatgatgtgttccagccccttcaagtttctaacattccccatctgatcaggatcagtttgtaatccttgaaagttttcagtgcttgatgaacccactgctgcttatcatgttataaataaaattacttgaactactgtatcgaatccttcctcctgttaagggccacattgtgctacttaatagatcgaaatatatccttcctttgataaaaaaaaaaaa

SEQ ID NO: 4707 - DNA, 596 bp, Triticum aestivum
agtccctcgaggttttagatctcgccgtctcgccgtctcccctctcccctctccgagaaccctagtttccctcttcgtgcggcggcggcaaccatggacaagagcatgctcggcgacctcgacaacctccccgacgaggacaagatgcgcatgtccgccatgatcgaacagctccagatgcgtgacagtctacggatgtacaatgcgctggtggagacgtgcttcaaggactgtgttgacacattccggaggaagacgctggacaagcaagaggagtcatgtgtccgccgctgcgccgagaagttcctgaagcactccatgagggtcggcatgcgatttgctgagcttaaccaaggcgttgccacacccgactaatcaaatgatgtgttcctgccccttcaagtttctaacattgcccatctggtcaggatcagtttgtaatccttgaaagttttcagtacttcatgaacccactgctgcttatcatgttaaaaataaaattacttgaactattgtatcgaatccttcctcccgttaagtgccacattgtgctacttaatagatcgaaatatatccttcctttgataaaaaaaaaa

SEQ ID NO: 4708 - DNA, 816 bp, Triticum aestivum
aggcggactgccgtgtcggtcgcaatccgggtcgaccacgcgtcggattcgccgtctcccctctcccctctccgagaaccctagtttccctcttcgtgcggcggcggcaaccatggacaagagcatgctcggcgacctcgacaacctccccgacgaggacaagatgcgcatgtccgccatgatcgaacagctccagatgcgtgacagtctacggatgtacaatgcgctggtggagacgtgcttcaaggactgtgttgacacattccggaggaagacgctggacaagcaagaggagtcatgtgtccgccgctgcgccgagaagttcctgaagcactccatgagggtcggcatgcgatttgctgagcttaaccaaggcgttgccacacccgactaatcaaatgatgtgttcctgccccttcaagtttctaacattgcccatctggtcaggatcagtttgtaatccttgaaagttttcagtacttcatgaacccactgctgcttatcatgttaaaaataaattacttgaactattgtatcgaatccttcctcccgttaagggccacattgtgctacttaatagatcgaaatatatccttcctttgatatctcgtctagtagagtttgtatttctgaattttattttggtcaaattcatggatctcaacttctttagtagactttctggtattgctgtgtaatgcggaaacatcatagtgcaagatctgtaaaggcgccttttgccttgccctttgttgtggcatctacttttgtttgagatcaaagaatataggacgatgcacatgaacgagatcggaa

SEQ ID NO: 4709 - DNA, 1212 bp, Lippia dulcis
tggcagcaaaagcatgctcacctcacgtcatccgagccatggctgcgcagaagcccactcccgccgccacaaaaaccgtcgcctccaaaaagggcacaacctccggccagtcggtgaagctgttgacgcgggtggagcagctgcggctgctgaccaaggcggaaaaggccggcttattatcggcggcggagaaagccggcttctctctgtcgacaatagagaggcttgggcttctctctaaggcggaagaattgggggttctttcggcggcgacggatccagggacggcgtcgggtcttctgagcttgagcttggcgttgctggcgttgggacctgtttgtgtgtacttggtgccggaagattacccttgggaaattgggttgcaggttgtggttgctctgctggccgtagtcggtggctccgccgcttttgctgcttcgaatcttgtttccactttgcagaaatctaattagggtcttgaggaattggttgcagagtgaattatgggcttgtttggtttgagtttttgtggataaagtttagaatttctcaagagaattgttggtatgccttctgatatatagaggggtaatatattgttcgatttaataattcgtgacaagattttgatctgatatttcagtgctaataatataaatctgtcatgccctaacaaatgtctggcaaatgaaatatatgatcgacaaagaaagaggagcaatattcatcttattctacagtattcaagaaacaaagtaactacttgaatgttggaacttcaaaacggtgtaaaataatgggaacagctttaagtatgctttaacacgaaagctgaggtaagtaaaaagcaagttaatccggcgttggagcaccttggttcagctcggcaaatctcatgccaacacgcattgaatgcttcaggaacttctcagcacatctgcggacgcaagtttcctcttgtttgtccagagttttgcgccgaaaactgtccacgcaatcggtgaaacatctttccaccaatgtattatacatccttagactgtcgcggatctggagctgttcgatcatggcggacattcgttgcttgtcttcctcaggaagagcgtccaaatctcccagcatgctcttgtccatcttcaaagattttgtcgacaactattctacgactcccactccaaaaccctaactatttcgaacaagacttaaaacctg

SEQ ID NO: 4710 - DNA, 781 bp, Musa acuminata
cggacgattcctcagcaaagtttcgccccgtcggcctccaaaaccctagcgagagcgatggacaagagcatgctcggagatctcgactctctcccggaggaggacaagatcaggatgtccgccatgatagaccagctccagatccgggacagcttaagaatgtataataccctggtggagaggtgcttctctgattgcgtggacaccttccggcgcaaatctcttgataagcaagaagaaacatgtgttcgccggtgtgccgagaaatttctaaagcactcaatgagggttggcatgagatttgctgagctgaatcagggcgctcccactcctgactaaacagtagctcagctgatcagaagcccacttcagtcactctattcttagctgacgatggaaccattgctaagtgcatgacaaacgattttgacgtacttgatatttgttttacttctgtggcagctttgtagcattagccttccaccttcttatcgtcatcactgaataaatcttacatccgctaccgtgccaatgtttttcatgctgttgtcagatgcttagaaacggtgattgctcaatggtagcctgcgagtaatacagaccatttcctctgttattggtgaacactcctgagaacgcttaagatctaaaaggttggtggtcttatgtttaatctttataatccaaatatttgtatgattctcaagtttggttcgcattgcccgatttcttgtctactttctgtatacaattgaaatgatgagttattggatggttacat

SEQ ID NO: 4711 - DNA, 561 bp, Vaccinium corymbosum
gcgccgcaacatttcctcactggctctatggaattgctagggtttttaagaggaagactagttttcgaagaagaaagaaaatccgaagaaacctcccgacgattgtggaagatggacaagagcatgctgggagacctggactctcttccagaagcagataagttgaagatggccgccatgatcgagcagctccagatccgcgacagtttaaggatgtataattcacttgtggagagatgtttcaccgattgcgtagacaccttcaggcgcaaatcacttgacaagcaagaggagacctgcgtccaacggtgtgctgagaagttcttgaagcactcaatgcgagtaggcatgcgattcgcagagctcaaccaaggtgcagctacaccagattaaggtgttcctatcagttttttgtaatggtgcttgtcttacctcctaatggtttatgaagtggaatttttcttcagatttgaaataggtctgatttgtcttgtaatgtcctcattttctgagtacagatttttggtctgtgataagttgtgaagttcgcaacagaaatac

SEQ ID NO: 4712 - DNA, 736 bp, Hordeum vulgare
tttagatctcgccgtctctcctctcccctctcccagaaccctagcttcctcgccgtgcggcggcggcggcggcaaccatggacaagagcatgctcggcgacatcgacaacctccccgacgaggacaagatgcgcatgtccgccatgatcgagcagctccagatgcgtgacagtctacggatgtacaatgcgctggtggagacatgcttcaaggactgtgttgacacattccggaggaagacgctggacaagcaagaggagtcatgtgtccgccgctgcgccgagaagttcctgaagcactccatgagggttggcatgcgatttgctgagctcaaccaaggtgttgccacacccgactaataagatgatgtgttcctgccccttccaagtttctaacactgccatctggtcaggatcagtttgtaatcctggaaagttttaagtgcttcatgaacccactgctggttatcctgttaaataaaattacttgaactattgtatcgaaccccttcctaccgttaagtgccagattgctactacttaatagatcgatatatatgtcctttgatatcttgtcgagaagagttggcatttctgaatcttaccctgttcctggcttcatatcttggtaaattcatggatctcaacttctttagtaggcttcctggtattgctgtgtaatgatgaaacatccttttgcaagatctgtaaaggtgccttttgccttgccctttgtt

SEQ ID NO: 4713 - DNA, 772 bp, Hordeum vulgare
aaagaaaaggaaaacgcgtccctcgaggttttagatctcgccgtctctcctctcccctctcccagaaccctagcttcctcgccgtgcggcggcggcggcggcaaccatggacaagagcatgctcggcgacatcgacaacctccccgacgaggacaagatgcgcatgtccgccatgatcgagcagctccagatgcgtgacagtctacggatgtacaatgcgctggtggagacatgcttcaaggactgtgttgacacattccggaggaagacgctggacaagcaagaggagtcatgtgtccgccgctgcgccgagaagttcctgaagcactccatgagggttggcatgcgatttgctgagctcaaccaaggtgttgccacacccgactaataagatgatgtgttcctgccccttccaagtttctaacactgccatctggtcaggatcagtttgtaatcctggaaagttttaagtgcttcatgaacccactgctggttatcctgttaaataaaattacttgaactattgtatcgaaccccttcctaccgttaagtgccagattgctactacttaatagatcgatatatatgtcctttgatatcttgtcgagaagagttggcatttctgaatcttaccctgttcctggcttcatatcttggtaaattcatggatctcaacttctttagtaggcttcctggtattgctgtgtaatgatgaaacatccttttgcaagatctgtaaaggtgccttttgccttgccctttgttgatgcaa

SEQ ID NO: 4714 - DNA, 547 bp, Beta vulgaris
gcggcgcttagggttttagctggcgaaggatatagcgaactacagacgagagggttttcgcgaaagactaaagcagaggaataggacggcgagattcaaagatggataagaacatgctcggagatcttgacaatcttcccgaagaagataagatgaaaatggctgccatgatcgaccagcttcagattcgagacagtctaaggatgtacaattctctggtggagagatgcttcactgactgcgtcgactccttcagacgtaaaactcttgacaaacaggaggagacatgtgtcaaacggtgtgctgagaaattcttgaaacactcaatgcgtgttggtctgagatttgcagagctcaaccagggcgctcccacccctgattaagttgctgcataactaaatgtcaagttaaaagcttttcataccgtattatttctaccttttattggaccattagtaagctcgattagctctcattattctagtatgatgatgtattgattgaagtacgtatgtcaaatgcaattttcagtgttttcacaaaaaaa

SEQ ID NO: 4715 - DNA, 642 bp, Catharanthus roseus
ccaaagaattcggcacgaggttttagagttcagtgtaaggaagggcttaagcaatcagaagtgtagaagaagaagagagatggataagagcatgctgggagaccttgattctcttcctgaagaggataaggtcagattgtcagttatggttgatcagctccaagtccgggacagtctgaggatgtataattcactggtggaaagatgttttactgattgtgtggacaccttccgccggaaaactttggataagcaagaagagacctgtgtacgtcgttgtgcagagaagttccttaagcattcaatgcgggttggaatgagatttcaagagctcaaccaaggtgcagccacacctgactaagaagcctttgaatcccttgctattattcgtttaacttgatgcgaaaaaaagttttttatttttatgacattctaacaggtcatttatatttggaatgccttcatttggctgattatttctatgaagttttattttggatgaaatatttaagaatggcaccatctctatatttgcttcatctcatttgttgaggataataagaaaaagtacacttggctcctcttgttggttaggagtctttggcatgaaaaagactatttagaattagttgaatgacgatc

SEQ ID NO: 4716 - DNA, 607 bp, Cichorium intybus
cagtccgagagaatagtcgaaaatggacaaaagtatgctcggagatctgggcaatcttccagcggaagatcaggctcgtatggccaccatgatcgaccagcttcaaatccgtgacagtctgaggatgtataacacgcttgtggagagatgctttacggattgtgtggatacattcagacgcaaaacgttagacaagcaagaggagacgtgtgtgagaagatgtgctgaaaagttcttgaagcattcaatgcgtgttggattgagatttgctgaactcaaccaaggggcagctacaccagactaatccagggttgtatggcatggcaggcagcctctttttgaggtagggttagtatctgcacttttgcagtctaatagagttgctttagtctttcaagtaaacaccataaacatgtgtacattgtcaacagatatgtgcgctttcttgagtttcataaatgactttccattaatgattgtttatctccaagctccggatctttcacttattatctacttcttgacgcaagttgcatgactttatatgattcataagatagttttttttttctatccagttgaataaaggtttttgataactaaaaaa

SEQ ID NO: 4717 - DNA, 758 bp, Taraxacum officinale
cggggatgcagacctttagccgttcgatttatttgccctacactctggcttcgacgttggatgcgacagaaatagaaaagaggttactccttcgctgtcttcttcaaagttcttaccttcctcatcgttgaaacctccgcctaatcggattctacgtgcagtgttccttcagtgttttggactctcgtggctctaaatcggcatcataaggcttgtcgacctcttcagcttgccgagatctaaagcgaaatcgtcggctcttgaagcagcaaatcgaaataacagtcgaagatggacaaaagtatgcttggagatctggggagtcttccaccggaggatcaggctcgtatggccaccatgatcgaccagcttcaaatccgtgacagcttgaggatgtacaacacgcttgtggaaagatgctttacagactgtgtggatacattcagacgcaaaacgttagataagcaggaggagacgtgtgtaagaagatgtgctgagaagtttttgaagcattcaatgcgagttggattgagatttgcagagctcaaccaaggcgcagcaacaccagactaatgaagcatcaatggcagcctaggttagtatctgcagcacttttgcagtctaatatagttcctttagtctttcaattgaacaccataaacatgtgtacattgtcaagagatatttccctttttttgaccattttatgtcattgttattctctctgcttttggttagttgtttatctttatttaaac

SEQ ID NO: 4718 - DNA, 770 bp, Vitis vinifera
gtgaaacttcatacctataaatgtctgcggtgtgaattgtgtcaaaacccctaaaccctaaccctaatttgagatcagtcaatcatggacaagagcatgctaggagatctggactctcttcctgaggaagataagcttcgaatgtctgtcatgatcgaccagcttcagatccgcgacagtcttagaatgtataattcactggtggagagatgttttagtgactgtgtggagagcttcaggcgcaaatcccttgacaagcaagaagagacctgcgtccggcgatgtgctgagaagttcttgaagcattcgatgcgtgtgggtatgagatttgcagagctcaaccaagggacagcaacaccagattaaaagcccttaagcaaccatgggtgcaaaacatgttcaaacttgccccaggaggatttagtggttgttacaaaaatggaaatgtttctgttcttagtttacatacgtttcttcccccagtgcagtacaatgggtgcaactacaggaatttcctcgttaggaataagcctcaagcaaattatacccctgtagctttccagaagattgatgaatgactttcagtaactgaattttgattcatgcagattttggatatttgagcattttaaccttgcaccttattataaggtggagccacaatgctaagatatttttgagtggccattctatcactaaccctgattgtataatgcaaatctgaataccatgtttactgaaagaaagcagataaataggtagatctttac

SEQ ID NO: 4719 - DNA, 527 bp, Lactuca sativa
aatctcgagagaatagtcgaaaatggacaaaagtatgctcggagatctggggaatcttccagcggaggatcaggctcgaatggccaccatgatcgaccagcttcaaatccgtgacagtttgagaatgtataacacgcttgtggagagatgctttacagattgtgtggatacattcagacgcaaaacgctagataagcaagaggagacgtgtgtgaggagatgtgctgagaagttcttgaagcattccatgcgtgttggattgagatttgcagaactcaaccaaggtgcagctacaccagactaatcctgcatctatggaggtcacttttgcagtctaatagagttgctttagtctttcaagtaaacgccataaacataaagagatatgtatgctttccattaacgattgcttttctccatgctctatatcttctccctttttttgtacttgtttgcacaagttgcatgacttggtaaggtatttgaaaacatgctaatgctataaattttcttgtgcccttcttctg

SEQ ID NO: 4720 - DNA, 506 bp, Lactuca sativa
acagaagaagcaaatctccagagaatagtcgaaaatggacaaaagtatgctcggagatctggggaatcttccagcggaggatcaggctcgaatggccaccatgatcgaccagcttcaaatccgtgacagtttgagaatgtataacacgcttgtggagagatgctttacagattgtgtggatacattcagacgcaaaacgttggataagcaagaggagacgtgtgtgaggagatgtgctgagaaattcttgaagcattcaatgcgtgttggattgagatttgcagaactcaaccaaggtgcagctacaccagactaatacaagtatacaacatctatggaggtcacttttgcagtctaatagagttgctttagtctttcaagtaaacaccataaacataaagagatatgtatgctttccattaacgattgcttttctcccccttttttttgtacttgtttgcacaagttgaatgacttgataaggtatttgaaaacatgctgatgct

SEQ ID NO: 4721 - DNA, 583 bp, Liriodendron tulipifera
ggtttttgaagcttccttctctcgtcttcaccaaaacccgaaccctagccctaattttcggtcttggatcaagatggacaagagcatgcttggagatctcgaatctcttcctgaagaagataagatcagaatgtccgtcatgatcgaccagctccagatccgcgacagtctgaggatgtataattcactggttgagagatgcttcaatgattgtgtggactccttccgaaggaagtccctagacaaacaagaggagacatgtgtccgtcggtgtgctgagaagttcttgaagcactccatgcgggtgggaatgagatttgcagagctcaaccaagggacggccacacccgattagttcctcacaatttcagaggaaacctggttgctgatgtttaacaatgaaggaatccatttatatgggattaagtcactcttgttctagtgtttgttttattatgttttactcttactcctgattgggagtctccggcaatacaatccccagaatttttgttttgaactgatgacatgatgagcataaggagccctatgccgttgggaactttttgaggaattcgacaaa

SEQ ID NO: 4722 - DNA, 723 bp, Mimulus guttatus
tagtagtataggggtgcaatttatttttaaccctagttttatcaaatgttaatttcttgcgactcgagaaaggatccgaaccgttaatcaccagtattgaatctatagctagggttttagggttcttcgttgagatacagtgtttgattttgtttccgttgcagcactttggcgaaaacattgaaaatggacaagagcatgcttggagatctcgattctcttcccgaggaagataagctccgtatgtccgccatgatcgaccagcttcaagtccgcgacagtttaaggatgtacaattcattggtggagagatgtttcaccgactgtgtggaaagtttccggcgcaaaaccctagacaagcaagaggagacttgtgtccgtcgatgtgctgagaagtttctgaagcattcgatgcgtgttggcatgagatttgcagagctcaaccaaggtgccccaaccccagattaagtcgttttttttccacctatatgaagcaatcttcggtcaatgtgattccattcctcagaagttcgattttttattcggattttaggagaaactgaaaaataagatgaaagatgctcctcttcttgttaaatcagatatttacttttcctagacgaaaaatgcatttattttatttcttatcgagattgaaggtgcagttggaggtttgttaaaagacaacaacattgtgctgatcaaatttgtcttcacagctac

SEQ ID NO: 4723 - DNA, 620 bp, Lippia dulcis
gggttttagagatttagagagcagtaagaaacccttgccgagaattgtacctccttcattactagttgtacgtccaacaaaatcgttggaaatggacaaaagcatgcttggagatttggacgctcttccagaggaagataagctccgaatgtcttccatgatcgagcagctccaaatccgtgacagtttgaggatgtataatacactggtggaaagatgtttcacagactgcgtagacacgttccggcgcaaaacgctggataagcaagaagagacttgcattcgaaggtgtgccgagaagttcttgaagcactcaatgcgtgttggcatgagatttgctgagctgaaccaaggcgcagcaacacaagattaacactcccttcagttcagatatgtgtacccttgattttggtcttatttccattaagtttaggctttagctgtgggctgcctcatattctttcttgtgtttggtggtgaagagcgaagaatgttgattcttggctatatcattctttcctcttgaaataaatttagctttatcccctttctcttggattatataattgtcggggcgagttaaagggatattaatcataatttcatcctccaaaaaaaag

SEQ ID NO: 4724 - DNA, 615 bp, Beta vulgaris
gcttagggttttagctggggaaggatatagcgaactacagacgagagggttttcgcgaaagactaaagcagaggaataggacggcgagattcaaagatggataagaacatgctcggagatcttgacaatcttcccgaagaagataagatgaaaatggctgccatgatcgaccagcttcagattcgagacagtctaaggatgtacaattctctggtggagagatgcttcactgactgcgtcgagtccttcagacgtaaaactcttgacaaacaagaggagacatgtgtcaaacggtgtgctgagaaattcttgaaacactcaatgcgtgttggtctgagatttgcagagctcaaccagggcgctcccacccctgattaagttgctgcataactaaatgtcaagttcaaagcttttcaaaccgtattatttctaccttttattggaccattagtaagctcgattagctctcattattctagtatgatgatgtattgattgaagtacgtatgtcaaatgcaattttcagtgttttcacacagatgatacgatattttgattcggaaaatgtggtcacaatgaaatttctattctttaacggctgaatatgatatgagg

SEQ ID NO: 4725 - DNA, 703 bp, Malus domestica
ggctaagaagacaaagtagctaaacggtgccgttacacgattctggtattcttcttgacggagtctagggttttacctcactataaagacagagatctgttgccctgttccataaaccctaacctcacttcgtcatttttccagagtgagtgaggcagttaagctgaaatcggagaaattcgatacaatccgggatggataagagcatgataggagatctggattcgcttccagaggaagataagatgagaatggccaccatgatcgaccagctccagatccgcgacagtttgagaatgtataactcacttgttgagagatgcttcaatgattgtgtcgacacctttaagcacaaatcactgcagaagcaagaggaaacctgtgtcaggcgatgtgccgagaagttcctaaagcattccatgcgtgttggcatgaggtttgcagagctcaaccagggcgctgcgacacaagattagtcatcaaatcagcaaaggagtagatagcgcgccttcattcccgtcttagcctgttgttgccttgttttttcctggagaatctccccccctttctttacatataaaaactgactagtggtcatatgaagtatgaactgccaacacgcacaaggtgatgaatgtcgacaataaagataacaattctacataagatgatgcaaagtatcttcacaaatgtaaaaaacaac

SEQ ID NO: 4726 - DNA, 594 bp, Cirsium arvense
aagaagagaaggagcgaatcaagagaataaccaaaaatggacaaaagtatgctcggagatctgggaactcttccaccggaagatcaggctcgtatgtccaccatgatcgaccagctccaaatccgtgacagcctgaggatgtataacacacttgtggaacgatgctttacagattgtgtggacacattcagacgtaaaactttagataagcaagaggaaacgtgtgttcgtaggtgtgctgagaagttcttgaagcattcaatgcgtgttggattaagatttgctgaacttaaccaaggggccgctactccagactaaaaactagctcgtaattcgctggccggcctcctttcgttttgaggtagttggtaaagtatttgcagctttttaattagtcttcaagtaaacgccataaggatgtgtatatcgtcaagcgatatatgtgcttgctaagttttataaacgtatttccgttaattatcgcacacatctgttttttttggtacctcttgacgtacgattttggctttattggttcatcatatacaatcttgttccttttcataatacacacttgtaagggtatttgacaaa

SEQ ID NO: 4727 - DNA, 674 bp, Taraxacum officinale
aagcagcaaatcgaaataacagtcgaagatggacaaaagtatgctcggagatctggggagtcttccaccggaggatcaggctcgtatggccaccatgatcgaccagcttcaaatccgtgacagtctgagaatgtacaacacgcctgtggaaagatgctttacagactgtgtggatacattcagacgcaaaacgttagataagcaagaggagacgtgtgtgagaagatgtgcggagaagtttttgaagcattcaatgcgagttggattgagatttgcagagctcaaccaaggtgccgctacaccagactaatgaagcatccatggcagcgtccttttgaaggtagggatagagtatctgcagcacttttgcagtctaatatagttcctttagtctttcaattgaacaccataaacatgtgtacattgtcaagagatatgtgcgctcataaacatatttccctttttttgaccattttatggcattgttattctctctgcttttggttagttgtttatctttattttcttcatgtttcacattcattcacttctcttgtacaatttaggttcagatcgttgcagcatctgaacttaatgatccaacaactattatggcgtgtcattctatattttaataaacgatatatgttctaccaaaaaaaaaaaaaaaaaaa

SEQ ID NO: 4728 - DNA, 612 bp, Solanum melongena
tcaaattttgcgttgaatcaaattaaggaatcaagatggataagagtatgattggagatttggattcacttcctgaagcagataagctcagaatggccgctatgattgaccagctccaagttcgtgacagcttgagaatgtataattccctggtcgaaagatgtttcacagattgtgtagacactttcaaacgcaaaactttagacaaacaggaggagacctgtgtccgtcgatgtgccgagaagttcttgaagcattctatgcgtgttggtctgagatttgcagagcttaaccaaggtgcacccacaccagactaagacgcttctgctatgtgcctgcaattcaatttctcgacttgcaggttaaccaaggaggacaagaagtggtgttccttattctggaatgtcaacaacaatcgatagaatgtacttttacagtgaaattattagaaacttgaatagtagaacgggatcctatagctaagattgcaggccacttgctgttactatagcattctttttgttgcggcgttctggaaaataatgtggtattcaatttcatcaagaatacatatctgttgcctctttttggtataatgacaattttatgaac

SEQ ID NO: 4729 - DNA, 843 bp, Vitis vinifera
aaataatgatgagtcccgatgggcaacgatttcgttgagagttggcttgtgtatatgaagaagcatggcctggtagttggttggactgttgtaagtcagtagggttttagggtttggggttttgggaaagaggaggaggaggagtccaaaacctcattgttccataaggcggtgaagatggataaaagcatgctaggagacttggactctcttcccgaggaagctaagctccgaatgtctgctatgatcgaccagctccagatccgcgacagtctaaggatgtacaattcattggtggagagatgtttcaccgattgtgttgatagcttcccgcggaaatccctagacaagcaggaagaaacatgtgttcgcaggtgtgctgagaagttcctgaagcactcaatgcgtgttggcatgagatttgcagagcttaaccaaggaacagctacacaggattaagtgttagctcatcaactttttgcaatggaaaaccaatcggaaaatgttgaaatggtttatcattggagtatgggtttaggatgggttttgttattttgttatacgtctgcatttgtgattaaatctgataaccttgtttaaggtagcattatatactgggacggaaatgaattaaaaacttcattttgagtgtcttgtttctcattgaaaggattagggagacttgttgtcatgattaatttgtcatgacttatgaatcttgatagatgttgtagaaacatcatggttagccattttttgtaatggagacgaggcagaatatggggcaagttgagaatgtcatgagttggggcaataccattttgagtggtttttttggtggct

SEQ ID NO: 4730 - DNA, 603 bp, Prunus persica
atagcatgctcaaatccaacggccactatcatcttaatacgactcagaggacagagctaacaaacggcgccgttacaagcatatgatgatatccgcctcctcgaaatctagggttttaactcggtataaaggggaagcgatctgctacacgatcttggtccataaaccccaactttgtgattttccagagagagtaactaatttagcaaaaatcctgaaatagttgataaatccaagtatggacaagagcatgataggagatctggattcccttccagaggaagacaagctcagaatggccactatgatcgatcagctccagatccgcgacagtttgaggatgtataactcacttgtcgagagatgcttcactgattgcgtcgataccttcaagcacaaatcgttgcagaagcaagaggaaacctgtgtcaggcgatgtgctgagaagttcctaaagcattcaatgcgtgttggcatgaggtttgcagagctcaaccagggagctgcaacacaagattagtcatcaaatcaccagagggtgcgatcacgccatcttggcctttcctttctttgtttttcttggagaatctccccccttttctt

SEQ ID NO: 4731 - DNA, 598 bp, Helianthus annuus
acttcctatcgttgaacctccgcctaatcggattctacgtgcagtgttccttcagtgttttggactctcgtggctctaaatcggcatcataaggcttgtcgacctcttcagcttgccgagatctaaagcgaaatcgtcggctcttggtttctgagaaactcaaagttttcaaatctatcactcgaagatggacaaaagtatgcttggagatctggggagtcttccaccggaggatcaggctcgtatggccaccatgatcgaccagcttcaaatccgtgacagcttgaggatgtacaacacgcttgtggaaagatgctttacagactgtgtggatacattcagacgcaaaacgttagataagcaggaggagacgtgtgtaagaagatgtgctgacaagtttttgaagcattcaatgcgagttggattgagatttgcagagctcaaccaaggcgcagcaacaccagactaatgaagcactcttgcagtctaatatagttcctttagtctttcaattgaacaccataaacatgtgtacattgtcaagagataacatatttccctttttttgaccattttatggcattgttattctctctgg

SEQ ID NO: 4732 - DNA, 398 bp, Tragopogon dubius
aaatggacaaaagtatgcttggagatctggggaatcttccagctgaagatcaggcacgtatggccaccatgatcgaccagcttcaaatccgtgacagtttgaggatgtacaacacgcttgtggagagatgctttacagattgtgtggatacattcagacgcaaaacattggataagcaagaggagacatgtgtaaggagatgtgctgagaagttcttgaagcattcaatgcgagttggattaagatttgcagaactcaatcaaggggcagctactcaagattgattaaaccactctcctttaaggtattcttagtatcttttgcaatctactagagttggttgctttagtcttcaaagtaaacaccatgaacttttgcagtctaatagagctgattta

SEQ ID NO: 4733 - DNA, 585 bp, Zostera marina
aaactatcgcaacgacaaatcgacaccggcgaaattgagagaagatggacaagagtttattgggtgatttggattctttaccggagggtgataagattcggatgtcgcagatgattgaccaacttcagatccgagacagtttgaggatgtacaattcactggtcgaaagatgtttcactgactgcgtagacacttttcgaagaaaaaccctagataagcaggaggatacttgtgttcgccgatgcgcagagaaatttttgaagcattccatgagagttggtttgagattcgccgagctcaatcaaggagcaccgacaccagattaaactatttcccatgtttcctccacagaaggaagcagtctcatgtgttggcataaactacattcaattcaggctgttaattttggtttcattgagatactttttttttgctttcaactttttccagtttattattatggctctaaataatatctgtactcaaccttgttgactgaacaatccatgctgtgtgttattatctctgattattcatggcatgaaattcaaataaaatctttaaccaaagcagcatgtaaaatcc

SEQ ID NO: 4734 - DNA, 394 bp, Flaveria ramosissima
aaaccttgagaacaatcgaaaatggacaaaagtatgctcggagatctggcttctcttccaccggaagatcaagctcgtatgtctaccatgattgatcagctccaaattcgtgacagtctaaggatgtacaacacgcttgtggaacgatgctttacggattgcgtagacacatttaggcgcaaaactttagacaaacaagaggaaacatgtgtgaagagatgtgctgagaaattcttaaagcattctatgagggtggggatgagattcgctgaactgaaccaaggggctgccactccagatgaataaataataaaccaaggtttcattgttttttcggttttggaagcttcctttgagataattttgctttagttattttcagtgaactgtataa

SEQ ID NO: 4735 - DNA, 470 bp, Flaveria ramosissima
gtttcaggggaacaacagtagcagtaaaccttgagaacaatcgaaaatggacaaaagtatgctcggagatctggcttctcttccaccggaagatcaagctcgtatgtccaccatgatcgatcagctccaaattcgagacagtttaaggatgtacaacacacttgtggaacgatgctttacggattgtgtagacacattcaggcgtaaaactttagacaaacaagaggaaacatgtgtgaagagatgtgctgagaagttcttgaagcattcgatgcgggtcgggatgagattcgctgaactgaaccaaggggccgccactccagatgaataaataataaaccaaggtttcatgttttttcggtttggaatctttctttgagattaattttgcttttagtttttcttcagtgaacagtataattgtcaagtgatgtatgcacttgcttagttcatgaatgtatttgtcttta

SEQ ID NO: 4736 - DNA, 473 bp, Flaveria ramosissima
gtttcaggggaacaacagtagcagtgaaccttgagaacaatcgaaaatggacaaaagtatgctcggagatctggcttctcttccaccggaagatcaagctcgtatgtccaccatgatcgatcagctccaaattcgtgacagtctaaggatgtacaacacacttgtggaaagatgctttacagattgtgtagacacatttaggcgcaaaactttagataaacaagaggaaacatgtgtgaagagatgtgctgagaaattcttaaagcattctatgcgggtggggatgagattcgccgaactgaaccaaggggccgccactccagatgaataaataataaaccaaggtttcatgtttttacggtttttaaaagcttcctttgtagataattttgctttagtttttctttcagtgaacagtataattgtcaagtgatgtatgcacttgcttagtttcatgaatgtatttgtgttta

SEQ ID NO: 4737 - DNA, 565 bp, Flaveria ramosissima
ttgggggaacaaaagaagcagcaaaccttgtgaacaatcgaaaatggacaaaagtatgctcggagatctggcttctcttccaccggaagatcaagctcgtatgtctaccatgatcgatcagctccaaattcgtgacagtctaaggatgtacaacacacttgtggaacgatgctttacggattgtgtagacacatttaggcgcaaaactttagacaaacaagaggaaacatgtgtgaagagatgcgcggagaaattcttaaagcattctatgagggtggggatgagattcgctgaactgaaccaaggggccgccactccagatgaataaataataaaccaaggtttcatgttttattggttttggaagattcctttgatataactttgtctttagtttttctagtgaacagtataattgtcaagtgatgtatgcacttgcttagtttcatgaatgtatttgtgtttaatgttttcagggtactaagatgttttcacatcaatcttgtattctgtaatgctcaaatagtttctacattggaacgttagatgccccgcacgagcacaa

SEQ ID NO: 4738 - DNA, 625 bp, Musa acuminata
tttttagaccaaacggtcgctcgctcgactagggtttttctcgccaagctcccgtccgtcggcccctaaacctctggagtgagggctggaagaagaggcgacgcgcagcgatggacaagagcatgctcggagatctcgagtctctccctgaggaggacaagatcaggatgtccgccatgatagatcagctccagattcgggacagtttaagaatgtacaatacactagtggagaggtgcttttccgaatgcgtggacaccttccgtcgcaaatctcttgataagcaagaagaaacatgcgttcgcaggtgtgccgagaaatttctgaagcattcgatgagggtcggcatgagatttgcagagctgaatcagggcgctcccactccagattaagcgttctagaacccgtcacaactcagttcagccactgaattcaagatcagttagcatcaattctattatttgctgatgattgaaccctctaaatgcgtggtaaacaatttcgacttgctttgcttctagcattagctttccgcttgcatcatgtcattgccaaataaatttggtcatatgtaacaaattatgattacattatgtgatatctgagtattgttgtgttcacttca

SEQ ID NO: 4739 - DNA, 475 bp, Bupleurum chinense
agagatggacaaaaatatgctaggagatcttgcttctcttcctcaggaagaccaagcgaaaatggcttctatgatcgaccagctccagatccgtgacagtcttcggatgtataattccttggtggagagatgttttactgattgcgtggacactttcagacgcaaaaccttagacaagcaagaggacacttgtgtcaggcgatgtgcagagaagtttttaaagcattccatgagagtcgggatgcgatttgcagaactcaatcaaggggctgccacatcagattaatcgctgcagcagtaccttttttctaatattaaacttagtcctaaggggcaggtcttatcactgtttctttacttgtactaagcttttgaaagtgaatcttgaaacaactcagatttaccttgttctttgtgttttgatggaacacattgcacttccaaacatgttagtgttgaataagagcattctcag

SEQ ID NO: 4740 - DNA, 651 bp, Allium cepa
ttgttctagggttttaagatctcatcatccagctctcaaaaatttgaaacatcaaaatcaaatttgactgagatatttcgaatttatatcatataaataattttgaagtaaaatggacaaaagtatgcttggagacatggggaatctccctgaagaggaccagatgcgtatggcttccatgatcgagcagctacaaattcgcgacagtttgagaatgtacaattcgttggtggagagatgctttgctgattgcgtcgactccttcaaacgtaaaacacttgataaacaggaagagacgtgtgtacgcagatgtgctgagaaattcttgaaacattcgatgagagttgggatgaggtttgctgaactcaatcagggtgctgccacttccgattaattttcccttcctgcttatgaattttactttctttctttcacatggattatgaccctagtatttcaattgcaactcggattatcgactgtagcaacctcacttgaaaagaggtttatgactgaattttgtgagtctatattattatacttcattaaaaagtgttgtaataaacagaggaatttgatattttgtgagcgattgagttaaaattatcatcattcttttgatcagtttgaattcaaaagggttcaattgtg

SEQ ID NO: 4741 - DNA, 635 bp, Rosa hybrid cultivar
ggttccataaagagactgagaaattaagcccaaaagaacctgaaattggatttgtgggcagtgtttgagattcaattaagatggataagagcatgataggagatctggattcgcttccagaggaagataagctcagaatggccaccatgatcgaccagctccaaatccgcgacagtttaaggatgtacaactcacttgtcgagagatgcttcaatgattgtgttgacactttcaagcacaaatcactgcagaagcaagaggaaacctgtgttcggcgatgtgctgagaagtttctcaagcattcgatgcgcgttggcatgaggtttgcagagcttaaccagggagctgcaacccaggactagagtcattgagctgccaagggtagagggctcgggcagtttactccatatttgctttgctgtccttttttgttttgtttcaaaagaagaaatggtgttgttgttgtacccatcttcatgcttttgttgtctatgggagaaacagcaaattgtattctgtagatacatgggatctgaagttgctgtgataagagattctattttcactaattcaagcagcagtccacttttgaatgtgatgaataaaatgctttgcttttgtagaaaaaaaaaaaa

SEQ ID NO: 4742 - DNA, 638 bp, Fagopyrum esculentum
ccaaagagtgacctgaattcacagtatatcgcctcttcaaaaccctaaaccgccgcaacagagagagaggaaggagctgtctgaaaaaatggacaagagcatgctgggcgatctcgataatcttcctgaggaagataagcttcgaatggcctccatggtcgaccaacaacagatgcgtgacagcttgaggatgtacaattcattggtggagagatgcttcaatgattgcgtggacaacttcaggcgcaaaaccctagacaagcaagaggagacatgcgtccgaaggtgtgccgagaagtttttgaagcactcaatgcgcgttggtctgagattcgcagagctcaaccagggtgcagctacaactgattaaaacactatctcattaccaatgctttcggaccttgaaatagtcgaaaacattgggattttgttgttattttcagtttttcacaatgcaattgtttcattgccatctttgccaatgaagctttagtatgccatgaggtttaattgtcagattatgcaggtgatgaaattagtcagaacaggtcctttttattcatatatctgtataagtgtgtgtttttggttactgctaagcaaccaagaaaacattgtaccgcacttgaaatgaaatg

SEQ ID NO: 4743 - DNA, 429 bp, Gerbera hybrid cultivar
gcgaatcgtgcaggatggacaaaagtatgcttggagatctggggactcttccgccggaagaccaggcccgaatgtcgaccatgatcgaccagctccaaatccgtgacagtcttcggatgtataacacgcttgtggagagatgttttacggattgtgtggacagtttcagacgcaaaacgctagacaagcaagaggagacgtgtgtgaggagatgtgctgaaaagttcttgaagcattccatgcgtgtaggcttgagatttgcggaactcaaccaaggtgccgcaactcctgattaaatttaaaacggttagtatttgccatgatgtatacattttgggcacttgttattttataacatgaacacaatctctgttgaactttattaatacacggtttttagaataggtcacgaagcattttagattgacc

SEQ ID NO: 4744 - DNA, 509 bp, Carpinus betulus
ctgttaaacccctgaacctcgaaaattgttgaatcaacgaagatggacaagaccatgctggcagacttggactctcttcccgaagaagataaggcacgaatgtctaccatgatcgatcagcttcagatccgcgacagtctaaggatgtataattcattggtggagagatgttttacggactgtgtggacaccttccagcgcaaatccctgaccaagcaagaggagacttgtgtgcgaaggtgtgctgagaagttcttaaagcactctatgcgtgttggcatgagatttgcagagctaaaccaaggagcggctacatcagattaaggcgtttcttaataatttcggtgcatggaactcttgtaacacacagatatggttttattacaagttcgattctttagtctgggaactagaaatatgttttatgtgttacttcttcatgacaagaagactgatttgttcgtttatcccccaccagttttgcaatcaacaggatataaatggattgg

SEQ ID NO: 4745 - DNA, 538 bp, Carpinus betulus
tcaacatggacaagagcatgctaggagatctggataatcttccagaggaagataagctcagaatgtcctccatgatcgaccagctccagattcgtgatagcctgaggatgtataattcactagtggagagatgctttaatgattgtgtggacaccttcaagcacaaatccttgcaaaagcaagaggaaacctgcgtgcggcgatgtgctgagaagtttctaaagcattcgatgcgtgttggcatgaggtttgccgagctcaaccaaggagcagccacacaagattgaactatttaactacctagggtggagaaaccattgcttttttaagtgtagacgagcattcctttgttcctctatttgtatttcccctttgcttgtatccaatgacaatctgaacattgtagatacatgcaggagaacttgttattaataatttcaagcaagagatcgagcctgctaagtgctaaacccctgagcggttttgtagaaattttatgagtgaatatatttattctatgctgctttcttatacaaag

SEQ ID NO: 4746 - DNA, 608 bp, Nicotiana benthamiana
  misc_feature (2)..(2): n is a, c, g, or t
  misc_feature (4)..(4): n is a, c, g, or t
cntnacggccgggaaggtaaaaacaactgctgtttttggttatagttcagccctagcagaaataaagagctcaaaaaatggataaaagcatgttaggtgatttggataatcttcctgaagcagacaagcttaaaatggcttctatgattgaccagctccaaatccgtgacagcttgagaatgtataattccctggtggaaagatgtttcacgggatgtgtagacactttcaaacgtaaaactttagacaaacaagaggagacctgtattacgcgatgtgctgagaagttcttgaagcattcaatgcgtgttggtatgaggttcgcagagcttaaccaaggtgcagcaacacaagattaagatgatgcaatccaaattcttcattacctcaagtatttatcttctttaaagagtttcttgacaaggaacaagagcagaagttcctaacacaacctttatttttttatatttaacacatttcctagcaaagaggtattactgaaatgttcttttgtttctcaaatccaggaattctggagttagaatgagtttttagtaacttgaatttagtctcgtgtccatattgaagagtacttgcgaattgcgatc

SEQ ID NO: 4747 - DNA, 640 bp, Rosa hybrid cultivar
ggttccataaagagactgagaaattaagcccaaaagaacctgaaattggatttgtgggcagtgtttgagattcaattaagatggataagagcatgataggagatctggattcgcttccagaggaagataagctcagaatggccaccatgatcgaccagctccaaatccgcgacagtttaaggatgtacaactcacttgtcgagagatgcttcaatgattgtgttgacactttcaagcacaaatcactgcagaagcaagaggaaacctgtgttcggcgatgtgctgagaagtttctcaagcattcgatgcgcgttggcatgaggtttgcagagcttaaccagggagctgcaacccaggactagagtcatcgagctgccaagggtagagggctcaggggcagtttacgccatatttgctttgctgtcctgtttttgttttgtttcaaaagaagaaatggtgttgtagttgtacccatcttcatgcttttgttgtctatgggagaaacaacaaattgtattctgtagatacatgggatctgaagttgctgtgtgataagagattctattttcactaattcaagcagcagtccacttttgaatgtgatgaataaaatgctttgcttttgtagaaaaaaaaaaaa

SEQ ID NO: 4748 - DNA, 480 bp, Carthamus tinctorius
gagagcgaatcagagaatagccgaaaatggacaagaatatgctcggagatttgggaaatcttccaccggaagatcaggctaggatggccaccatgatcgaccagctccaaatccgcgacagcctgaggatgtacaacactcttgtggagcgatgctttacagattgtgtggacacattcagacgcaaaacgttagataagcgagaggagacgtgtgtgcgcagatgtgctgaaaagttcttgaagcattcaatgcgcgttggattgagatttgctgaactcaaccaaggtgctgctactccagactaaaatcaggtttaatagaatcgcttaaactggccgccctcttttgctttgaggtacttgctataatagaatcgctttagtctttcaggtaaacgccataaatatgtttagatgcgattgctagtttttttatgaacgccttttcgttaacgactgcacgcatctttcgcttcgc

SEQ ID NO: 4749 - DNA, 618 bp, Helianthus annuus
agaggaggaactggcggtttgggtcgggttaaaccggtttactggtgcaaatcgagtcgggttttgttttcctttatcaggtgaaataaaggcccattacaagcccaaaaaaccatcttgcctactacgtataaaccgtagatcaaaaccctagtttcagctgaaccgacacaaccaccaatcgcagtcgaaaatggacaaaagtatgctcggagatttgggcactcttccgccggaagatcaagctcgcatgtccaccatgatcgatcagctccaaattcgtgacagtctaaggatgtacaacacacttgtggaacgctgctttacggactgcgtggacaccttcaggcgcaaaactttagacaaacaagaggaaacatgtgtgaagagatgtgctgagaagttcttgaagcattcgatgcgggtcgggatgagatttgctgaactcaaccaaggggctgccactcaagacgaatagtgattagaccaaggttatattttccgtttttgttatcgaagcttcttctcagataatttttgctttaggttttttatttaacagtataattatcaagtgatgtatgcgcttgctaatattcataaatgtatttttggtta

SEQ ID NO: 4750 - DNA, 1102 bp, Flaveria ramosissima
tggttccatgatctattaacctcttatttatatgcttcaatttgttcggatctgatttgggtacagtacatgaagcatcatgatcaatcaatgcttcctgatgcgaattcttaaatttattgaccgaaattcatgttattgctatagctagtcactacctgatgaaatattttatatgtttttgtttctggacatatataatgcatgatcttgctctttaatgctcacatgtaaatatattattggtaatttagctcttaatcggtggattttgtgttttgtgagtttgtggtttgaagtatacgagttttacaactcatttagagttttaaccttgaacgatattagggttttaccagagttataggatttttgatacagttttggtttccttatttcatgtaatttgctgtctcctgtgagaggtttcagcagaattagttatgaatcaagtaatctgcacaaattttgctaattcaaattgttgttagagaactgtttaaacatggataagagcatgcttggagatttggggactcttcctccagaagatcaagctagaatgtctaccatgattgatcagcttcaaattcgtgacagtctaaggatgtataacacgcttgtggagagatgctttacagattgcgtagatactttcaggcgcaaaacactagataaacaagaagaaacatgtgtgaagagatgtgctgagaagtttctgaagcattcaatgcgggttgggttgagatttgctgaactcaaccaaggtgctgcaactccagacccataaataatggttttgtgtgagtatatgcagtttaatagaattttggtttagttttttaagtaaacagtatagctgtcaagtgatatgattggggcattgggcttttgcttataaaggctctgagaccaaaactacaagaatttttaaaccgaggaccaggctggttaggtcttggtcggttccagtcaggaccagttttgtttgggcggttcattgatcggaccggttttaagattcgtatcttgcaaataaaaagaaacagtgtgaatctgatctgatttagtcttgctacacctggttgttatttttttttct

SEQ ID NO: 4751 - DNA, 652 bp, Guizotia abyssinica
ggagagaaaatggacaaaagtatgctcggagatctgggtactcttccgccggaagatcaagctcgaatgtctaccatgatcgaccagctccaaattcgagacagtctgcggatgtacaacacgcttgtggaaagatgctttacggattgcgtggacacattcaggcgcaaaactttagataaacaagaggagacatgtgtgaggaggtgtgctgaaaagttcttgaagcattccatgcgggtgggcctgagatttgctgaactcaaccaaggggctgccactcaggatgaataaataacctttcctttttcctttgagatgttttgattcaggtataattgtcaagtgaagtatgcgcttgctgaatttcatcaatgcatttgtgtttattaaagatcgtttccaaattcttgatatcaaagaaaccatagcctaacctaggcaagctcaaatcggttttatcagcaactcgaaccggtttattcaacgaaaagtgttcgaccttaaacctgtttgttgtagataaaaacctgtattgaactggtctaggaccggtttgtatattaaactgggtttatagataaaaacctaaacttattgaaccggttcaggaaccgtttgtatattaaaacggtttgtctttttttttttt

SEQ ID NO: 4752 - DNA, 617 bp, Prunus persica
aaattgttggaatcaaagacgaagatggacaaaggcatgctggcagcggacttggagggtcttcctgaagaagataagcatagaatggccaccttgatcgaccagcttcagattcgtgacagcctgaggatgtataattcattggtggagagatgctttactgactgtgtagacacctttcagcgcaaagccctgaccaagcaagaggattcttgtgttcgtaggtgcgccgaaaagttccttaagcattcgatgcgcgttggcatgagatttgcagagcttaaccaaggagcagcaactcaagattaagctaagctccgtatgaatcatctttggcatggaaatcttataaaccttttgaattggtttatgacaggtgcaattggtttacccttggttttagaattatgcttcttacattgattggatttgtacccttataaagaagaaacttcttgtcaggttttacagtttagctggatatgaatcagttgctaacttattacatataaattttgttccatttccatatgttcttggaaaggcatgaacaaaaacttttgccccttttccatatcagattgtgtgactttacaataagagaagctgggtaacta

SEQ ID NO: 4753 - DNA, 472 bp, Helianthus annuus
ccgacacaaccaccaatcgcagtcgaaaatggacaaaagtatgctcggagatttgggcactcttccgccggaagatcaagctcgcatgtctaccatgatcgatcagctccaaattcgtgacagtctaaggatgtacaacacacttgtggaacgctgctttacggactgcgtggacaccttcaggcgcaaaactttagacaaacaagaggaaacatgtgtgaagagatgtgctgagaagttcttgaagcattcaatgcgggtcgggatgagatttgctgaactcaaccaaggggctgccactcaagacgaatagtgattagaccaaggttatattttccgtttttgttatcgaagcttcttctcagataatttttgctttaggttttttatttaacagtataattatcaagtgatgtatgcgcttgctaatattcataaatgtatttttggttatcaaatattttgtcgaaag

SEQ ID NO: 4754 - DNA, 280 bp, Cucumis sativus
atggacaagaacatgcttgctgatttggatgggcttcctgaagaagacaagatcaaaatggccaccatgatcgaccagcttcagatccgagacagtctgagaatgtacaactcattggttgagagatgcttcacagattgtatcgataacttccagcgaaaatccttgaccaagcaagaggaaacatgtgtacgtaggtgtgccgagaagttcttgaagcactcaatgcgcgttggaatgagatttgctgagctcaaccaaggagccgctacctcagatt

SEQ ID NO: 4755 - DNA, 576 bp, Cynara scolymus
  misc_feature (22)..(22): n is a, c, g, or t
  misc_feature (52)..(52): n is a, c, g, or t
  misc_feature (92)..(92): n is a, c, g, or t
  misc_feature (336)..(336): n is a, c, g, or t
gcggggaagacgaagagcgatnaaagaatagcaaaaatggacaaaagtatgntcggagatctgggaactcttccaccggaagatcaggctcnaatgtccaccatgatcgaccagctccaaatccgcgacagcctgaggatgtataacacacttgtggagcggtgctttacagattgtgtggatacattcagacgcaaaactttagataagcaagaggagacgtgtgttcgtaggtgtgctgagaagtttttgaagcattcaatgcgtgttggattgagatttgctgaactcaaccaaggggccgctactccagactaaaccagctcataactcgcnggccggcctcgtttgttttgaggtagttagtaagtatctgcagcttttagtcttcaagtaaacaccataaggatgtgtatatcgtcaagcgatatatgtgcttgctaagttttataaacatttttccgttaatgatcgcacacatctctgttcgcttctcccccctttttgtaccaagattttggctttattggtttaattatatacaatcttgttgcttttcatacaaaaaaaaaaaag

SEQ ID NO: 4756 - DNA, 540 bp, Fagopyrum esculentum
aaaaatggacaagagcatgctgggcgatctcgagaatattcctgaggaagataagcttcgaatggccgccatggtcgaccaacaacagatccgtgacagcttgaggatgtacaattccttggtggagagatgcttcggtgattgtgtggacaacttcaggcgtaaaaccctagacaagcaagaggagacatgcgtccgaaggtgtgccgagaagttcttgaagcactcaatgcgcgttggtttgagattcgcagagctcaaccagggtgcagccacaactgattaagacataatctccctaacaaccattgatgatgatgttttcggaccttaaaatagtcgaaaacatcaggatttttatattttgttttcacagttcaggtgtttcattgcctgctattgtcctagccaaatttgtcaatgaagctctagtatgccatgaggttttaggtgaagaaattaggccagagcaggtcgttttatccatttctgttttggtggacagatgatattacaataatgtttcgatacaatatgaag

SEQ ID NO: 4757 - DNA, 648 bp, Fagopyrum esculentum
cctcaaaaaccctaaaccgccgcaacagagagagaggaaggagctgtctgcaaacatggacaagagcatgctgggcgacctcgagaatcttcctgaggaagataagcttcgaatggcctccatggtcgaccaacaacagatgcgtgacagcttgaggatgtacaattcattggtggagcgatgcttcaatgattgcgttgacaacttcaggcgcaaaaccctagacaagcaagaggagacgtgcgtccgaagatgtgccgagaagttcttgaagcactctatgcgcgttggtctgagattcgcagagctcaaccagggtgcagccacaactgattaaaaattcatcttccctgcaatgctttctgaccttgaaatagtcgaaaacattgagttgtttttttgttattttcagtttttcacaatgcaattgttccattgccatctaatatcctaggctatacttatcaacgaagctctagtatgccatgaggtttaatcctcagattatgcaggtgatgaaattagtcagagttatatccgtatctgtctaagtgtttgtttactgtaaacgctaagcaaccttgaaaataagaacagctgtgaggatctttattttatggaaattaagctgttaagatttgttttatg

SEQ ID NO: 4758 - DNA, 794 bp, Mesembryanthemum crystallinum
  misc_feature (1)..(1): n is a, c, g, or t
nggctagccctagagcgatcgcggccgcgtcgccacaaaacaaacagagaccgagggttttgcgaaagaggtagctgctacaccgaaaaaaatggacaagaatatgcttggagacctcgacaatcttcccgaggaagacaaattgaaaatggcctccatgatcgagcagcttcagatccgtgacagtctgaggatgtacaataatctggtggagaggtgcttcactgactgcgtggactccttcagacgtaaaactcttgacaagcaggaggagacatgtgtaaagcggtgtgctgaaaaattcctgaagcattcaatgcgtgtgggtctgagatttgcagagcttaaccagggtgctgctacgacagattaagcatgcatgattactgcagaactgaaagacgaaaaagcactatattcaagtgtcttccattatcttgagacttcctcatttttgaagctcaaataaaccaaaccagttttgttatcctcatttttgtaggatgataatgtatcaaagcatgcaaatgttatatgattttgatgatttggttgagaattgatagtaatgtttttaaaagttaaagcagaatatattacttgtaaccccctgctcctttggaacctttttcgttttccttttgcttggtgttatgaatactgagatgtgaagatagattgaccacagggttcaagaggtgatttgtcatgttcaggactttactggaacttttgttcattccatgagcggatgttaatgcccgtgtttatacctgaaagcttgaaggataatg

SEQ ID NO: 4759 - DNA, 716 bp, Cucumis melo
actttcttcaacctaccgttctaattttttagctattataggcggcgatacaaaaaaagaaaccagagaagttaaaccctaaaccctttgcttttattggacttgaagatggacaagaacatgcttgctgatttggatgggcttcccgaagaagataagatcaaaatggccaccatgatcgaccagcttcagatccgagacagtctgagaatgtacaactcattggtcgagagatgcttcacagattgtatcgataactttcagcgaaaatccttgaccaaacaagaggaaacatgtgtacgtaggtgtgccgagaagttcttgaagcactcaatgcgcgttggaatgagatttgctgagctcaaccaaggagccgctacctcagattaacgttgcatgaggacactctggacatattcttgagaccttcagttcggattttagtatgtttcttccatatcctcgagaccttcagttcttttacctctggaattgtagtatgtgtgttcttattcttgaaaccttcacctctgaatttatagtatgtttctacattatgtgttacaactgggattaagttgtaatttcatttgacttatgaattaaagttttagtagcagacttcgaataaatgtttgaggttccatatccatcaggatgataacatatatttactcaagcttgtaacaatcgaagctgttagttttttttaaaaa

SEQ ID NO: 4760 - DNA, 722 bp, Capsicum annuum
tcagcatagtagtgcttacttgtatagtgtgattgaggaatcaagacaagatggataagagtatgattggagatttggattcacttcctgaagctgataaacttagaatggctgccatgattgagcagctccaagtccgtgacagcttgagaatgtataattccctagttgaaagatgtttcacagactgtgtggacagtttcaaacgcaaaactttagacaaacaggaggaaacctgtgtccgacgatgtgctgagaagttcctgaagcattctatgcgtgtgggtctgagatttgcggagcttaaccaaggtgcaccaacaccagactaaggcgcttcagctacgtgcctgcaattcaatttctcattacttgggcagtgtttattgcgggttaatctaggacaatagttggatgttccttaattttgaatgtcaacagcattcctcgtcagagtaattggtaaaatgtacttttgcagcttttcttctcaatagttggaatggtatatcaggagtgaaaaattagaaacttgaatggtaatactggatcctgtaactagattgcaggccactttatgttaccatagcattcttttgttgcagacttccagaaaataatgtggtattcaatttcatcaagaatacatatctgttgtcttcgcttttctgtaactgaaaaatccctgatcgtcaatgacactattgacactgttcgaaatt

SEQ ID NO: 4761 - DNA, 692 bp, Capsicum annuum
gattgaggaatcaagacaagatggataagagtatgattggagatttggattcacttcctgaagctgataaacttagaatggctgccatgattgagcagctccaagtccgtgacagcttgagaatgtataattccctagttgaaagatgtttcacagactgtgtggacagtttcaaacgcaaaactttagacaaacaggaggaaacctgtgtccgacgatgtgctgagaagttcctgaagcattctatgcgtgtgggtctgagatttgcggagcttaaccaaggtgcaccaacaccagactaaggcgcttcagctacgtgcctgcaattcaatttctcattacttgggcagtgtttattgcgggttaatctaggacaatagttggatgttccttaattttgaatgtcaacagcattcctcgtcagagtaattggtaaaatgtacttttgcagcttttcttctcaatagttggaatggtatatcaggagtgaaaaattagaaacttgaatggtaatactggatcctgtaactagattgcaggccactttatgttaccatagcattcttttgttgcagacttccagaaaataatgtggtattcaatttcatcaagaatacatatctgttgtcttcgcttttctgtaactgaaaaatccctgatcgtcaatgacactattgacactgttcgaaatt

SEQ ID NO: 4762 - DNA, 710 bp, Petunia hybrida
acataaagctatatattttccgcttataagagatagtaggagttgcatatttttgtggcgggtggatcagagtaatagcaaagatggacaagaatatgattggagatttggattcacttcctgaagctgataaacttaaaatggctgctatgattgatcagctccaagtccgtgacagcttgagaatgtataattccctggtcgaaagatgtttcacagactgcgtagacaatttcagacgcaaaactttagacaaacaggaggagacctgtatcaggagatgtgctgagaagttcttgaagcattcgatgcgtgtgggtatgagatttgcagagcttaaccaaggtgcaccaacaccagattaagaggcttctactatatgcctgcaattcgatttctcattccttgagcattgtcaattgcgggttattctaggaggagtggaagttccttagatatccttatttttggacatcaacagctttcctcgacagcgtaattggtaaaaatgtaatattgcttctcaatcacaggaatatttggagtgaattaatacgaacttgaacactagagctaaatctttgactagattgaaggcaatttgctattgagatagcatttttttgtggcagctttcaagaaaataatatggtattcaactttatcagaatacatttctgtactttttgtgctttgaaggcaatttatta

SEQ ID NO: 4763 - DNA, 662 bp, Solanum tuberosum
acacaaccaaagttgcatactgtggtgaatcaaattgaggaatcaagatggataagagtatgattggagatttggattcacttcctgaagcagataagcttagaatggccgccatgattgagcagctccaagttcgtgacagcttgagaatgtataattctctggtcgaaagatgtttcacggactgtgtagacagtttcaaacgcaaaacattagacaaacaagaggagacctgtgtccgacgatgtgctgagaagttcttgaagcattctatgcgtgtaggactgagatttgccgagcttaaccaaggagcaccaacaccagactaagacgcttctgctatgtgcctgcaattcaatttttcattattgtttattgtgggttaatcaacaaggacaagtagtggaagttccttattttggaatgtcaacagctctcctcgtcgttattggtaaaatgtacttctacagtgaaattattagaaacttgaatagtagaactggatcctgcaactgattgcaggccacttgctgttacgatagcattcttttgttgtgacgttctagcaaaataatgtggtattcaacttcatcaaggagagacatatctgttgccttttctggtatgatgaccattttatgaacttgaagttgaaaaatgga

SEQ ID NO: 4764 - DNA, 670 bp, Solanum phureja
agggttttagatataaggcaccattttcccctataaccagtggctgcttatacctctgttcttcccccaaacacaaccaaagttgcataccgtggtgaatcaaattgaggaatcaagatggataagagtatgattggagatttggattcacttcctgaagcagataagcttagaatggccgccatgattgagcagctccaagttcgtgacagcttgagaatgtataattctctggttgaaagatgttttacagactgtgtagacagtttcaaacgcaaaaccttagacaaacaggaggagacctgtgtccgacgatgtgctgagaagttcttgaagcattctatgcgtgtaggactgagatttgccgagcttaaccaaggagcaccaacaccagactaagacgcttctgctatgtgcctgcaattcaatttttcattattgtttattgtgggataatcaacaaggacaagtagtggaagttccttattttggaatgtcaacagctctcctcgtcattattggtaaaatgtacttctacagtgaaattattagaaacttgaatagtagaactggatcctgcaactgattgcaggccacttgctgttacgatagcattcttttgttgtgacgttctagcaaaataatgtggtattcaacttcatcaaggaga

SEQ ID NO: 4765 - DNA, 661 bp, Solanum lycopersicum
agggttttagatataagaatcccattttcccctataacagtggctgcttatacctctgttcttccccaattacaaccaaagttgctgaatcaaattgaggaatcaagatggataagagtatgatcggagacttggattcacttcctgaagcagataagatcagaatggcagccatgattgagcagctccaagttcgtgacagcttgagaatgtataattctctggtcgaaagatgtttcacggactgtgtagacagtttcaaacgcaaaactttagacaaacaagaggagacctgtgtccgacgatgtgctgagaagttcttgaagcattctatgcgtgtaggactgagatttgcagagcttaaccaaggtgcaccaacaccagactaagacgcttctgttatgtgcctgcaattcaatttctcattattgtttattgtgggttaatcaacaaggacaagtagtggaagttccttattttggaaagtcaacagctctcctcgtcgttattggtaaaatgtacttctacagttaaattattagaaacttgaatagtagaactggatcctgtaactgattgcaggccacttgctgttacgatagcattcttttgttgtgacgttctagtaaaataatgtggtattcaacttcatcaaggagat

SEQ ID NO: 4766 - DNA, 471 bp, Utricularia gibba
tgaaaatggacaagagtatgctagcagatgtggatgcgctgccggaggaagataagctgcggatgaccgccatgatcgaccagctccaaatccgcgacagtctgcggatgtacaactcgctggtggagagatgcttcaccgattgcatcgactccttcagacgcaagacccttgacaagcaggaagagacctgcatccgcagatgtgctgagaagttcctgaagcactcgatgcgggtgggaatgaggtttgctgagctgaatcagggcgccgccaccccggattctgctctgtaacgcagaagccacaggtctgggaacagcatgaatcaaccaaccccaaattgattccagtagttcttaatcttcatgctctgtagaagctctctgtgtttgatggatacgaagaaaccaatgccttcaagaaaaaggccgcagtatgtcttcttgtcgatccattacaaatatgaac

SEQ ID NO: 4767 - DNA, 632 bp, Primula obconica
agaggttcagtgtagagagaaagagaaaagtctgccgccatgaacaacggaccgatgggagatctaagctcactgccggaggaagaccaggtgcgtatggccaccatgatcgaccagcttcagatccgcgacagtttgaggatgtataattcacttgtggagagatgttttaccgactgtgtggacaacttcaggcgcaaaacgcttgacaaacaagaagagacctgtgtacgtaggtgtgctgagaagttcttgaagcattcaatgcgtgttggcatgagatttgccgagctcaaccaaggcgccgccaccccagatgaatgaacttgtctcgtttacttcttttgactcgagcatgataaaacttaattgttattgttcatttctgttatttatccattttgaagttgagcaaaggttttagccttcgtttggtgaataggatttcacgttgaaaaacacagaaaagaaaatgtttatcttagatccaagttttcttttccattacattttccattgagaaatctttgcaccggacggagtttagtatcttatagtgattttttttgcagctgaatggatgtttagtaagacctgattaatgtaccaaggatacttcttgttgccctaaa

SEQ ID NO: 4768 - DNA, 529 bp, Musa acuminata
agatcgagaggcgaggaggagaagcgatggacaagagcctgcttggcgatctcgattcgctccctaagaggacaaagtccggatgtccgccatgatcgagcagctccagatccgggacagtttaagaatgtacaatacactagtggagaggtgcttttccgaatgcgtggacaccttccgtcgcaaatctcttgataagcaagaagaaacatgcgttcgcaggtgtgccgagaaatttctgaagcattcgatgagggtcggcatgagatttgcagagctgaatcagggtgctcccactccagattaagcgttctagaacccgtcacaactcagttcagccactgaattcaagatcagttagcatcaattctattatttgctgatgattgaaccctctaaatgcgtggtaaacaatttcgacttgctttgcttctagcattagctttccgcttgcatcatgtcattgccaaataaatttggtcatatgtaacaaattatgattacattatgtgatatctgagtattgttg

SEQ ID NO: 4769 - DNA, 415 bp, Epimedium sagittatum
tagcgggaagagaggattagctcttgttgctccgctctatacacaaaaaccctaaaaccgtacaacagtagagaggaagaagaagatggaccaaatatgcttggaaatcttgattccttacctgaagcagataaggttagaatggcgaatatgattgatcagcttcagatccgtgacagtctaaggatgtataattctctggtggagagatgcttcacggactgtgttgacagcttcaggcgcaagtcattagataaacaagaggaaacgtgtgtccgcaggtgtgcagagaagttcttgaagcactcaatgagagtcgggatgagatttgctgaactcaaccaaggtgcggccacatctgattaagtccctgaaatgggctacatggctatgcaggtttcgttttgatttcaat

SEQ ID NO: 4770 - DNA, 597 bp, Acacia harpophylla
ggggtcaaatagtcaaatcatcccgataccgaacgggcccaaatcaagcacccagccgccgttatccctgttactccagtattcagccgtcatccccatcctcgccggcgttgctgcctaccgttctcatccttcacccgtctctcctttctcgtaccgcttgtttgatcaatttacccttttcagggccattcgtcagttgttcaaacatggacaagagcatgttaggagatctggacaaccttccagaggaagataagctcaaaatggctgccatgatcgatcagctccaaatccgagacagtcttagaatgtacaatgcactggtggagagatgcttcaatgattgtgttgacacgttcaagcataaatccctgcaaaagcaaggggaaagctgtgttcgaagatgtgcagagaggtttttgaagcactccatgcgtgttgggatgaggttcgcagagctcaatcaaggagcagccacacaagattgagaactgtaattagctagcatcttatcagacatggatcacattcacaggcccctttgaatttaccaaaagttagaaactcagccttgcctgtgatatgctcttttat

SEQ ID NO: 4771 - DNA, 752 bp, Artemisia annua
aaagaaagaaagatggacaaaagcatgatgggagatctgggtagtcttccagctgaagatcaagctcgtatggccaccatgattgaccagcttcaagttcgtgacagtctgagaatgtataacaatcttgtagagagatgctttacagattgtgtggactcattcagacgcaagacgttagataagcaagaggagtcatgtgtgaagagatgtgctgagaagttcttgaagcattcgatgcgtgttggattaaggtttgctgaactcaaccaaggggctgctactcaagactaaaccagtcgttgatatccttatgatcaatgcgagcctgttttgagctaggtagtatcttctccttgaaagttcaatagagaattgctttagtattcgaagtaaaacaccataagcatgtgtacattgtcaagcgttctatgcgcttgccgaattgcataaacgtctttcccttaatgattctttttttgtacctctcgactcaaattttgcacgacttatggtttataagacatgttctttttccaattgtgtgaacatgcagtatttaaatatgtgctcttttttctcgtatgccattattgatccacttggtttttggggcataaagagtaccatcaaaactctcatgtaacatgtcaagccttgagattgtatgatttcactgtcgtgacagtagatggtttctttaaaggtctttttcttcttgatataaaggtgcgtcttctttattaggaata

SEQ ID NO: 4772 - DNA, 569 bp, Centaurea maculosa
ggcgggggagacagaaggagatcgaaatcaaagaatagccgaaaatggacaaaaatatgctcggggatttgggaaatcttccagcggaagatcaggctcgaatggccaccatgatcgatcagctccaagtccgcgacagcctgaggatgtacaacacacttgtggagcgatgctttacagattgtgtggacacattcagacgcaaaacgttagataagcaagaggagacgtgtgtgcgcagatgtgctgagaagttcttgaagcattcaatgcgcgttgggttgagatttgctgaactcaaccaaaatgccgctacttctgactaaaatcgtgtttttacacctattatgcttaaaatggccaccctctttgttttgaggtaatagaattgctttagtcttcaagtaaacaccataaatatgtctagatgcgattgctagtttaaaaaacgtattttcgttaacgattgcatgcatctttcgcttctcctcctttttgtagcttttgacaaaaacacttgattttactggtttattatatatgattgatatcttttttcatagaattgg

SEQ ID NO: 4773 - DNA, 505 bp, Eschscholzia californica
agggaggttaaaaagaacgagttacttttccgtgagggccgaaaccctaagttgcgaattcgaagatggacaaaaatatgctccaagaacttggttctcttcctgaggaagatcagatgagaatgtctcagatgatcgaacaactccagctccgtgacagtttgaggatgtataattctctagtggagagatgcttcaccgactgtgtagacaaatttacccgcaaatcacttgacaaacaagaagaatcctgtgtgcgtcgttgtgcggagaagtttctgaagcactccatgcgtgtcggaatgagatttgcagagctcaaccaaggagcggctacacctgattaattcactgatcaattccctacggaagaagttagttcccgagagatttgttttctgttcttagataaagagaaaaaatgtttgatattttggtactattattatgttcttggttggttttgaataatgaattaaaactttgagctgtatgaaaggtgttt

SEQ ID NO: 4774 - DNA, 494 bp, Gerbera hybrid cultivar
taatttcaccggaacagtcacaatcgtcgaaaatggacaagagtatgctaggagatctgggttctcttccaccggaagatcaagctcgtatgtcttccatgatcgatcagctccaaatccgcgatagtctgaggatgtacaatgcacttgtggagagatgttttacggattgcgtggaaagttttagacgcaaaacgttagacaaacaggaggaaacgtgcgttaggagatgcgcagagaagttcttgaagcattcaatgcgtgtcggtttgagatttgcagaactcaacgcaggagcagcaactccggactaagttttaattttatatttttacaaatgaatatgcttcttttgtcatctcaagatacaagtttattctttaagttgttgagggcaattgggttgctggtggttattttgataatatgaacacaatttgagtttttaatgtaggcactgcctttcttcaagtaataaaaaaaaaaaaaaaaaa

SEQ ID NO: 4775 - DNA, 527 bp, Lotus japonicus
ggaattagggtttatctccaaccgcacaacaccagatcgcaattccgaaaacccttaccagcaatcaacaatggacaagagcatgttagcagacatggattcgcttggcgaagccgataagcaaagaatgtctaccatgatcgatcagctccaaatccgtgacagtctgagaatgtataattccctggtggagagatgctttactgattgtgttgacacattcaagcataaatccctgcaaaagcaagaggaaagctgtgttcgaagatgcgcagagaaatttctgaagcactctatgcgtgttggcatgaggtttgccgagctcaaccaaggagctgcaacgcaagattgatgtctgttaacattagagaacttttgattttttttgtttcattatatttttgcttttacaaaatgagaaattgtagagacttcctttcttagtagttgctatgagtgcacaatatttcattgctaaataaatttgtgatgtgatgatgatgcaatcactctgctttagagtccct

SEQ ID NO: 4776 - DNA, 908 bp, Quercus alba
tcgggggtcttattaaaagttaattagttgaattcagagctattgaagagagcttgttcataaaccctaacaaaaacttagttgtgttgggaagttgaaaaacctgagagactctgagagtgagatagataggatcaagtatggacaagagcatgctagcagatctggacactcttcctgaggaagataagatcagaatgtccacaatgatcgaccagctccagatccgtgacagcttgaggatgtacaattcacttgtggagagatgctttaatgactgcgtggacacctttaagcacaaatccttgcaaaagcaagaggaaacctgtgtgcgtcgatgtgctgagaagtttctaaaacattcaatgcgtgttggcctgaggtttgcagaactcaaccaaggagcagccacacaagattgaagattttcacaatcaagggtggaaacccaggattttttttttctttaatcgatttgctgtgtctttcaagtttctgattagctgtgccttgttcctatatttgcatatctgcgatttcaagtttctgtagaggagactgcagtgcttgttcttccaatggaatgctacagggaatccatgattgctgtctgcaggagaacctgttattaattgaatgtatttgttctatggtgttgtgtactagttttttcaaacagtaccattaacaaatgcacgccaagggctgtagcctacttttttttgttttttaatgtatcaagattcacatgataatcaacctccatctctattgttgtgatgaaataagtatggctagtaagaaataagtatgagctgctgtgttaactaattagggcatgtttggtagactgtaatagtcattataatgtaataattattcctatggtttagttattctttagtttg

SEQ ID NO: 4777 - DNA, 1031 bp, Cajanus cajan
atgtatcagttggaaatatccactattaaagacgtacggttatttttaaaagacagaaaagggcctaaagcaaaacgcaaacatagtaccggtgcaatgatgcgtttagtgggaagtggtgtgaggtatatatacgatcatcttcttcaaaccactgttgagtttagggtttacttccaaacgctgaacaaaatcgcagttccttccgtacattctcggaaaaccctcgacgcccactaatccgcggatcaagtatggacaagagcatgttagcggatttggactcgcttcccgaggcagataagcaacgaatgtctgccatgatcgatcagctccaaatccgtgacagtttgagaatgtataattcactggttgagaggtgctttaatgattgtgtggacacgtttaagcataaatctctgcaaaagcaagaggaaacctgtgttcgaagatgtgcagagaagtttctgaagcactctatgcgggttggcatgaggtttgcggagctcaaccaaggagctgcaacacaagattgatgtttgttagcatgttccattggaaaactgttaattcagtattattactttgattgctgttcgattactcacatttttggtcttgaaaaatgagatcttggaaagaatactaatttgctattttaatacacaataatccttgctaaataaattactgctgctgcaatcactgtgctaatcctgttgcttgattgattgggtttatttgctacctaaaattgtttatcctttatggagatcatcaccgttgcgaactacccctctccttgtattaggtccattccactcccagatattgcttcattctgttttgtgaaaggaggcaaattgaagcagaaagctttgatcatcagctgatttggattagtggtattcaaatatggtagagttgttataccttgtaaaatgtgtccgttgatctccatttaaaaagtaattggtttgcaaatcaaacagattaatttgagccatagcatgattactggatgatatgca

SEQ ID NO: 4778 - DNA, 679 bp, Glycine max
gatacgtgcaacgatgcgtttaatttagatctcaaaccctgaatattggttaagtggcaactggtggtgtgacctatatataccatcttgttcaactacagaattagggtttggtttcaaccgcagaacaaaatcacagtttctggcaaaacccttttcgaaggtgaccaatcggtggatcaaacatggacaagagcatgttagcggatttggattcgcttcctgaggctgataagcaaagaatgactgtcatgatcgatcagctccaaattcgtgacagtctgagaatgtataattcactggttgagagatgcttcagtgattgtgttgacacatttaagcataaatccctgcaaaagcaagaggaaacctgtgttcgaagatgtgcagagaaatttctgaagcattctatgcgggttggcatgaggtttgccgagctcaaccaaggagctgcaacacaagattgatttctgttaacttcttccaaaagaaaactgtcaatttattgttgttattattttgaatacagttcgtttacttacatttttggccttgaaaaatgagacactgtagagaatactaatttgctatgggtacgcaataattcgcgctaaataaattcatgatgatgcaatcacactgaatcctgattgggtggtttatttgctacctaaggtcc

SEQ ID NO: 4779 - DNA, 597 bp, Glycine max
cacttccgagttagggtttggtttctaccgcatatcgcagtttcttccttcatttcatactctctggcaaaaccctcgtcgacggtgaccaatcggtggatcaaacatggacaagagcatgctagcggatttggattcgctccctgaggctgataagcaaagaatgactgtcatgatcgatcagctccaaatccgtgacagtctgagaatgtataattcactggttgagagatgctttaatgattgtgttgacacatttaagcataaatccctgcaaaagcaagaggaaacctgtgttcgaagatgtgcagagaaatttctcaagcattctatgcgggttggcatgaggtttgccgagctcaaccaaggagctgctacacaagattaatttctgtttaacttcttccaatggaaaactgttaatttattattgttattattttgaatgcagttcgtttacttgcatttttgatcctgaaaaatgagactgtagagaattctaatttgctattggtacacaataatttgtgctaaataatttcatcattatgcaataacagtgtttctgaatcctgatttgattgagtttatttgcta

SEQ ID NO: 4780 - DNA, 580 bp, Juglans hindsii x Juglans regia
gggggcagagagaagccatttcgtttcgtacactgatattcgtagtcgtaaggtagcggattggtaatcgagtatggacaagagcatgctaggagatctggacaatcttccagaggaagataagatcagaatgtcctccatgatcgaccagctccagattcgtgacagcttgaggatgtataattcactcgtggagagatgcttcaatgattgcgtagataattttaagcacaagtcattgcaaaagcaagaggaaacctgtgtgcagcggtgtgctgagaagtttctaaagcattcaatgcgcgttggcatgaggtttgcggagctcaaccaaggagcagctacccaagattgaagtcttttaatggccaaggatggaaaacccacgatgcagagatgggcagcagtactgccttcctatttgttatacttctgcttactcttcttatttaattggaaaccgaacatcctagatgcatcatacatgggacccatgattggtgtctagaacagtaactgttactaataatttgaggcaagagaatccgtgttgtagacatatataatgagcatttgtttc

SEQ ID NO: 4781 - DNA, 775 bp, Citrullus lanatus
ctttcttcaacctacaatactaatttagctaatagcggcgatacaagaaaaaaaaccagagaagttaaaccctaaaccctttgctttaattggaatcgaagatggacaagaacatgcttgctgatttggagggtcttcctgaagaagacaagctcaaaatggctaccatgatcgaccagctgcagatccgagacagcctgagaatgtacaactcattggtggagagatgcttcacagattgtatagacaactttcagcgaaaatccttaaccaagcaagaggaaacatgtgtacgtaggtgtgccgagaagttcttgaagcactcaatgcgcgttggaatgagatttgccgagctcaaccaaggagccgctacctcggattaatgttgcatcagaggacaccccggacatattctcgagaccttaagttctttcacttctggatttgtagtatgtttcctccatattattgagaccttcagttctttcttccgtattcttgaaacctttcgttcttttacctctgaatttatagtgtgtttcttcattatatgtgttgcagctgggattaagttgtaatttgatttgacttatgaattaaagttttagtagcacactttcaataaatgttagattccatatcccccaggatgataacatatatttactcaagcttgtagccgtacaaccgaagctggtgtagcttaagttttttgcttcttgttggtaatatgccattttcttcatcctcataaccgatttgttagaaatgattg

SEQ ID NO: 4782 - DNA, 715 bp, Linum usitatissimum
atacaagtttcagtgattgtcgacctccaaccgaaggcgaagctcttcttccgatacttcacctggaggcgcctacgtacatccttcagaaatggacaagaacatgctcgccggcctggaaggtatgcctgaagaagacaagctgagaatggcctccatgatcgaccagctccaaatccgcgacagtttgaggatgtacaattctcttgtggagaggtgctttacggattgcgtagacgacttcagccgcaagtctctgaagaagcaagaggagacttgtgttcagagatgtgcagagaagttcttgaagcattctatgcgcgttgggatgaggtttgcggagctcaaccaaggagcagccacccctgataactaaaccctattgggaggggggtttgcagttgcactaaaactcttttgctacaggagatgaattaggaggtactgcagttgttttgtttgctctcttttccagtttctcccagcgacaacaagaacagagtatacgaacgagggtcgttttagctacgtcagtgaaattttctgcataaaaagcagcccaaacaatactctgggtaaagattgtatggagattggattcagatatgacattagtggaaagcttctttttaaccttttgattgatagtgttcagtctgataacgatggatgttctgctttggcatatgaattcattaattcctaaatgttaaac

SEQ ID NO: 4783 - DNA, 478 bp, Humulus lupulus
cgagaaaggcttgagcgaaaaaagagaagagaaggcgagaaagaaatcatcgaccatggacaagagtatgctcggaggagatatgcctcagctttctgaggaagataatgtcaggatgtccaccatgattgaccagctccaaatccgtgatagtttgaggatgtacaattcacttgttgagagatgttttactgactgcgtggacaccttcaagcacaagtccctgcagaagcaagaggaaagctgtgtccggcgatgtgcagagaagtttcttaagcattcgatgcgtgttggcatgagatttgcagagctgaaccaaggtgcagccacacaagattaaacaagttaatcttaataaatttggaggaacctaatttttatttgttcttaattgcttccatgatttgattgtgtgtatctgtataacaaactccataccatttttgatgccttgctagaggcgaataacgtgcatgtt

SEQ ID NO: 4784 - DNA, 765 bp, Amorphophallus konjac
aaaaaccctagaaagcttccgagggaggatcgaagggaaaacagagatggacaagagcatgcagggggacctggagaatcttcccgaggaagataagatcaagatggcccaaatgatcgaccggctccaggtcagcgacagtttgaggatgtacaattcactggtggagagatgctttattgagtgcgtggacacattccggcggaagtctcttgacaaacaagaagagacctgtgttcgacggtgtgctgaaaagtttttgaagcattccatgagggttggtatgagatttgcagaactaaatcaaggtgcacctactcctgattaatcttgagaatcagagagaattcattgactcttattattgttggtacaatttggcatggaggtacaatttgacctgtgttcgacggaagtctcttgacaaacaagaattttccaaaccccagaatggtacaattcgccttcatggtgctgtattttcgcaagcttttcgcccagcagaacgatcatacagggttttgtgcttttgttccttcagtttaaataagtattctttttatttgcaccgaagcttaaatttctagcaggcgttatgagaataatgcctctggagacttggcggaagcagaatttgggaacattcaaaatcatgccctccgtttattgtgaaccagggagtaacctctttgaaattacttttcttagtttggctgagaaatggggccaaaagttcaagcggaaagaatcctctcaatactgtag

SEQ ID NO: 4785 - DNA, 503 bp, Artemisia annua
aaagaaagaaagatggacaaaagtatgatgggagatctgggcagtcttccagctgaagatcaagctcgtatggctaccatgattgaccagcttcaagtcagagacagcctgaggatgtataacaatcttgtggagagatgctttactgattgtgtggactctttcagacgcaagacgttagataaacaagaggagacatgtgtgaagagatgtgctgagaagttcttgaagcattcaatgcgtgttggattgaggtttgctgaactcaaccaaggggccgctactcaagactaaaccagtggttcatgacattaaattcaacgccggcctgttttgatagtatctgctctttgagactttaataggaagttgctttagtatttgaagtaaaacaccataaacatgtgtacattgtcaagagctatatgcgattgctgaattacataaacatctttccattaatgagttcttttgtacctcttgacgcaaattttgcatgactt

SEQ ID NO: 4786 - DNA, 612 bp, Fagus grandifolia
atggacaagagcatgctagcagatctggacagtcttccagaggcagataagctcagaatgtccacaatgatcgaccagctccaaatccgtgacagcttgaggatgtataattcacttgtggagagatgctttaatgactgtgtggacacctttaagcacaaatcattgcaaaagcaagaagaaacctgtgtgcggcgttgtgctgagaagtttctaaagcattcaatgcgtgttggcatgaggtttgcagagctcacccaaggagcagccacacaggattgaagattttaacaaccaagggtggagaacccaaaatcaagaaattttttttatcgatacttgctgtctttcaagtttcagattagttgtgctttgttcctattttgtatttccgtgatcttttccattctcttatccaatggaaagctacacggaatccataattgctgtctgcaggagaaactgtcgttagtgaatgtatttgttacatgttgctttgttcctacttatgtatgtctgccctgctcttagccaatagaaagctacatggaatccatgattgccgtctgcaggagagcctgttagtaattgaatgtatttgttctgtgttgt

SEQ ID NO: 4787 - DNA, 673 bp, Cucurbita pepo
ggtctcataatgggttccttgattgaatgcactgaacatgaaaagaaaaggtgtataatttcagagaaagctgaagcagatgggcgatacagagaagggagaagaaaccagagaagttgaaccctaaaccctttgctttctttggaatcgaagatggacaagaacatgcttgctgatttggagggtcttcctgaagaagacaagctcaaaatggccaccatgatcgaccagctccagattcgagacagtctgagaatgtacaactcattggtcgagagatgctttgcggattgcatagacaactttcagcgaaagtccctaacgaagcaagaggaaacatgtgtacgtaggtgtgccgagaagttcttgaagcactcaatgcgcgttggaatgagatttgctgagctcaaccaaggagccgctacctcagattagtgtagcatcagaggacacccagacatattcttgagaccttcagttctttcacctctggaattatagtatgtttcttccatattcttgaaaccttcagtgctttcacctctggatttataatagcacgtcttccataaatgttgcaactgggattaagtggtgatttgatttgacttatatattaaagttttagtagcagactttcaataaatgtttgagatttgatatccattaggat

SEQ ID NO: 4788 - DNA, 898 bp, Eucalyptus grandis
acgccggggacagtgaaaaagcgaagccaggaaccctacctctcttctaaacccacagcctccgcctctctctctctcttctctcctctgcctcacaccgcaccgtcgcactctcgagccgccgccgcccccgccggaactatctcgttttccgacgcccgcgcgaacccatctccgcggcgattaaaagagggagcttggcatacctcagttttggcgagatggacaagagcatgatgggcgacctggacaatcttccggaggaagacaagcttagaatgtcctccatgatcgaccagctccagatccgcgacagtttgagaatgtacaactcccttgtcgagagatgctttaacgattgtgtggactccttcaagcacaagaacttgcaaaagcaagaggagacctgcgtcaaccgatgtgctgagaagtttctaaagcattcaatgagggttggcatgcggttcgcagagctgaaccaaggagcagcaacccaagattgatattctcgtttgccttgtttaaaaaacataagatcaaaacagaccacctgacccagggggtttttgttctgcactcatgcagtagtcaattattgatccagtcatgtccgtttaaatttttggtatctagagcacaatgtcctatttgttacttgagatgaggaaaatgcattctactaataatttgaggtaagatgacacgacttgttctgtcaaaaaaaatggttcatgtcccctttgggcgtcataaaggtggcttgccgggggtcccaagctgtagggccctggacctgatgtaaaagaagaaagttttggcctgaacctgtaagaatcggttttggcttgggctactccttagtggaaagcagaggagatgatgccaactcattgcttgg

SEQ ID NO: 4789 - DNA, 1959 bp, Cirsium arvense
cagactcactacaacccaacacacgaacctattagtggctcaaatctcaaccataatgtcaaagctcatggttcaacctcaatctcaacctcacttcctcttgctaacctttccagcccaaggccacattaaccctgctctccagttcgctaaacgtctcctccgcctaggcgtcaaggtcaccttggccacctgcatctccgccgacggccccacgaccaaagctagtgagcatattccagagtctttgaactttgcagttttctccgatgggtttgatgacggctatgatgtcaatgactacacttcctttatgagtcaattgaaaacccggagatcacatagcgtgaaagaaaccattctttcgttcgccaaggatggcaccccggtcacttgtttggtttacaccctcctcctcccatgggtggccaaggtggcgggtggccttaacttgccatccgcacttctttggattcaaccggcgtctgtatttcgtatctactactattacttcaaagggtacgataaactcattggagaaggttgcgatgaaccttcatggacgatcgaattaccaggggtacccttgctcaaaagtcgcgatctcccctccttttgtctcccttccaacgtcaacaactttgctctacctttattcaagggacagctacaagcgctggatgcggaagacaagcctaaaatactcgtgaacaccttcgatgcgttggaagaagaggccttgaaggagatcgacgacaagatgaagttgatcgctgtagggccgttgattccatccgctttcttggatgaaaaggattcatccgacacatcttttggtggagatctcattgagtcatcaaaagactatatcgaatggatgaacacaaagccaaaaaggtcaatcgtttacatatcttttggtagcatcataatgtcgtcaaagaaacaaaaggaagcgatggcccacgctttgttagcgagcaggaggccgtttttgtggttgttgaaaaataaagatgaggcagaagaagaagaagaaaaaagaaaaaatatgctcggagatttgggaaatcttccagcggaagatcaggctcgaatggccaccatgatcgaccagctccaagtccgagacagcctgaggatgtacaacaaccttgtggagcgatgctttacagattgtgtggacacattcagacgcaaaacgttagataagcaagaggagacgtgtgtgcgcagatgtgctgagaagttcttgaagcattcaatgcgcgttggattgagatttgctgaactcaaccaaggtgccgctacccaagactaaaatcagttttttacaactaatatgcttaaaatggctgccctcttttgctttgaggtaatagaattgctttagtcttcaagtaaacaccataaatatgtttagatgcgattgctagtttttttatataaacgtcttttcgttaacgattgcacgcatctttggcttctcccctgttttgtagctcttgacacaagtactcgaaatttactggtttattatatatgatgttatcttttttctttttttcttaagtttattacgtcagtctgatactctgattgacaggctttctaaaagagatgaacgaaatagtaatcacaacagaagtaacgaaaacatagaaaccaataaaggataacaaaagtgttatggcaatattatagttttcgtaggaaacttaaaatgaacatgaataatgctattgtttatgttatttagtatttagcgtccagaaatggcaagtagagttaatattacataggaaaaaattaaacatatatagagatctatgataaggaagttcttggaatcaattttttaatgacgatgggatgatatttttgttggtcaaacctgcttctcacgtattgttcttgacacccttatgtcagttttcatatttggctttctagtcattt

SEQ ID NO: 4790 - DNA, 373 bp, Flaveria ramosissima
gtatgctcggagatctggcttctcttccactggaagatcaagctcgtatgtccaccatgatcgatcagctccaaattcgtgacagtctaaggatgtacaacacacttgtggaaagatgctttacggattgtgtagacacatttaggcgcaaaactttagataaacaagaggaaacgtgtgtgaagagatgtgctgagaaattcttaaagcattctatgagggtggggatgagattcgccgaactgaaccaaggggccgccactccagatgaataaataataaaccaaggtttcatgttttatggttttgaaagcttcctttgagataattttgctttagtttttctttcagtgaacagtataattgtcaagtg

SEQ ID NO: 4791 - DNA, 680 bp, Fragaria vesca
aacaccagctcggtccatagacccttttcaggaactgagaaattaagccaaaacagtctgatattcgatttgtggggcagtgaatttgagattcagttaatatggataagagcatgctaggagatctgaattcacttccagctgaagatcagcagagaatggcctccatgatcgaccagctccaaatccgcgacagtttaaggatgtacaactcacttgttgagagatgcttcaatgattgtgttgacactttcaagcacaaatcactgcagaagcaagaggaaacctgtgttaaacgatgtgctgagaagtttctcaagcattcaatgcgcgtcggtatgagatttgcagagctcaaccagggagctgcaacccaggacgaatagcccaagggtagagagcttagaagccattacgcttgtgtttgcttttctgttttgtttcaaaagaagacatgatgttgtagttgtaccgatttcatttcatgcttttcttgtctatgggagaaacagcaaacagtattctgtagatacaatgcaatcaaaagtgtgttaagagattccattcttacaaatttcagtcagcagtccacttttgaatatgaggaataaatgtttttgtagaatttgcttctttacctgtatggaacgtacttgcgtttgtcagatttgtttttgcaa

SEQ ID NO: 4792 - DNA, 723 bp, Tropaeolum majus
ggctaggatctacagtaaacagtgaagaagtaacagcgttaactctaagggagagaaatcaattgagcaatttgatttcggtagacaggattaatcatggacaagaacatgttagcaggactcgatggactcccggaggaagacaaggcacgaatggagcgtccatgatcgatcagttacagcttcgtgacagcttaaagatgtataactcacttgtggaaagatgcttcaccgattgcgtcgacacttttacacgtaaatcccttcagaagcaagaggagagttgcgtcatgcgatgtgcagagaagttcttgaagaattcaatgcgtgtaggcatgaggtttgccgaactcaaccaacaagcacccacacaagattaaaacttaaaaagaggctaatagctattttaatcaaccattgtactcttcaagataaataggggtgctggtcttcaatttgtatcaatcaaaaatcaaaacaaacctactgctccataattcttttctatctgcatgatagtttgtctacaacagatttatttgttttcagttcgaagaacagaaaccctactccccttgaatttttgtttactggttcaagattagtgctttagttactcaaattatttgttttcacttcaatgactatgattagggttaggttacccacttatcctaaatccttaggtaccaaactaaataaaggggaaatagattttttaag

SEQ ID NO: 4793 - DNA, 518 bp, Senecio madagascariensis
  misc_feature (16)..(16): n is a, c, g, or t
gcgggaaaggaaaaanaaaaaataggacaaaaatatgctcggagatctcggcagtcttccaccagaggatcaagctcgtatggctaccatgatcgatcagcttcaaattcgtgacagtttgaggatgtataacacgcttgtggagagatgctttacggattgtgtggactcattcagacgtaaaacactagataaacaagaggaaacttgtgtgaggagatgtgctgagaagtttttgaagcattcaatgcgtgtcggtttgaggtttgctgaactcaaccaaggcgctgctactcaagactaattagagttagttatctgcatttgtgcagtttaatagagttgctttagtatttatcaagtaaacttatcataaacatatgtacattgtcaagcgatttattcgcttgttgaggttcataaacgcctttttgcttaatcttgcctgattccctttattgtatgcgagctaagtgactttatatgattttataagattatcttcttttgctgtcttt

SEQ ID NO: 4794 - DNA, 476 bp, Sequoia sempervirens
atcggaaagaaaacgaggaaaagttattgatttgcagattgtagaaatggacaagagcatgcttggagatttggccaacatgccagaggaggatcaacagagaatgtccaacatgatcgatcagcttcaaattagagacagtttgaggatgtataattcattggtggaaagatgcttcaataattgtgttgatagttttcgacgcaagactttggacaaacaggaagaaacatgtgttcaacggtgtgcagagaaatatttgaaacattctatgagggtcagtatgaggtttgctgagcttaatcaaggaagcccaactcctgactagttgtttatttaagattgtaaacaattggtgcaacttaactgccaaagtattttcatggatttttgaactgctgaatttttgaaccaaactctttcgttcacctgaccagttagcatggagctccaattttattcatgttgggatgttg

SEQ ID NO: 4795 - DNA, 526 bp, Silene vulgaris
atccatcattatctttctcctcttgcacattcaacagaagaaaaaaagggcagctaaacatggacaaaagcatgctggaaaacctggaaaacttacctgaacaagacaagatgaagatgggtgccatgatcgagcaacttcagatccgtgacagtctaaggatgtacaattctctggtggagagatgcttcaccgactgcgttgacaccttcaaacgtaaaaccctagacaagcatgaggagacttgcgttaagcggtgcgcagaaaagttcttgaagcactcaatgcgtgtgggcttgaggtttgctgagctgaaccagggtgctgctactcaagattaagctagctagctttattacataataagcaaaaacacaatcgtcattacttcatcaggaatttactcctattcggagctctaatatgctcgataagtttttttccctcctttttgtaggattcctgtaccaaacccggcagtttgaacatcaaaccattctagttcttccagacgtatattcgtgtc

SEQ ID NO: 4796 - DNA, 477 bp, Camellia sinensis
ctcgattctcttcccgaggaagacaagttaaggatgtcctccatgatcgaccagcttcagatccgtgacagtttaaggatgtacaatccactggtggagagatgtttcactgattgtgtggacaccttcaggcgcaaatcccttgataaacaagaggagacctgtgtccgccggtgtgctgagaagttcctgaagcactctatgcgtgttggcatgagatttgcggagctcaaccaaggtgcggccacaccagattaaggtctatccaatacttttggtagcaaactttgtaacacccggaaatggttcatgcggagaatattccttttagatagtgaattattgtccagattgtgttatgccctcatttcagaagtataagatttttggtatctgataagttctgcagtttacaagagatctaataagtttggatcgtcataccttcttgtttaatgtacctcggccgcgaccacg

SEQ ID NO: 4797 - DNA, 648 bp, Ambrosia trifida
ccttaacgtcaactaacaagtttgactttttaattaagcatattcgataacaaaatacatttatgaatattagcaagcggatacatcacttgataattgtacgcggggattccaaaacccagtttcaataaaacaacacaaacagaacaaccaaccaaaaatggcaaaagtatgctcggagatttaggcactcttccgccggaagaccaagcccgcatgtccaccatgatcgaccaacttcaaatccgtgacagtctaaggatgtacaacacgcttgtggaaagatgctttacggattgtgtggacacattcaggcgcaaaactttagacaaacaagaggaaacatgtgtgaagagatgtgctgagaagttcttgaagcattcaatgcgggtcgggatgagatttgctgagctcaaccaaggggctgccactcaagatgaatagatagtaaaccaaggttatattttctgtttttgctatggcagcttttatttgagataattttgctttaggtttttcttacaccagtacaattatcaagtgatgtatctgcttgctaatattcataaatgtatttttgtttatcgaaaaaagaaaacaaaagtggttataaatcgagagcaggagaagttttgccgttgaatgaaa

SEQ ID NO: 4798 - DNA, 386 bp, Triticum aestivum
agaccctaccgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaagagcgtgcgtccgccggtgcgcggagaattcctgaagcactccatgagggtcggcatga

SEQ ID NO: 4799 - DNA, 599 bp, Medicago truncatula
attatggccggggagggtttatctttacggcagaaaaaaacccaatctcaaacccctaaatcactgcgtttaatcgttcgattcaaaatggacaaaagcatgattgctgatatggaaaatcttccagaggcagataaacaaagaatggctaccatgatcgatcagctccaaatccgtgacagcctgagaatgtataataacctggtggagagatgctttcatgattgtgtggatacgtttaagcataaatccctgcaaaagcaagaagaaacctgtgttcgaagatgtgcagagaaatttctgaagcactctatgcgtgttggcatgaggtttgctgagctgaaccaaggtgctgcaactcaagattgaagtctattaacattggaaaactgtttttttttgttaatcttgaatacagttttgtttaattgtacttttgctattttaaagcgaggcactgtagaacatgtatttctttagttgctaagattgcacaaaattgatgcagaaatctaaataagttcgtaaagatgtgctgtattcattatgctatagaaccgtcattcttgattgccattatttagtaatattagtatcac

SEQ ID NO: 4800 - DNA, 482 bp, Cicer arietinum
aaaacccaatctccaaaaccctagacggcgattaatcgttcgatccaaaatggacaaaagcatgattgcggatatggaatcccttccagaagcagataagctaagaatggctggcatgatcgaacagctccaaatccgtgacagtctgagaatgtataattccctggtggagaaatgctttaatgattgtgttgatacatttaagcataaatcccttcaaaagcaagaggagacctgtgttcgaagatgtgctgagaaatttctgaagcattctatgcgtgttggtatgaggtttgctgagctcaaccaaggagctgcaactcaagattgaagtttgctaacattggaaaactgttctttttgtcttgaatacaatttgtttaaattatatttttctatttaaaagtgagatactgtagaggcatgaatttcttcagctgctttgaatgcacaaatggatgctaatatactaaataaattca

SEQ ID NO: 4801 - DNA, 652 bp, Vigna unguiculata
gacagtgttagggttttgtctccattgcggtttcttcttccgtaatttctcgcaaaaccctcgacggtgactgatcagtggatcaattatggacaaaagcatgttagcggatctggaatcgctccctgaggcagataggcaaagaatgtctgccatgatggaacagctgcaaatccgtgacagtctgagaatgtataattcacttgttgagagatgctttactgattgtgttgacacttttaagcataaatctctgcaaaagcaagaggaaacttgtgtccgaagatgtgcagagaaatttctgaagcattctatgagggttggcatgagatttgccgagctcaaccaaggagctgcaacacaagattgatatctgtcaacttctttaaatgaaaaactgtttatggttattctgaatgcactttgcttacttacatttttgggtcttgagaaatgagattactgtagagaacactaatttgcaattagtacgcaacaatccttgttaaataaatttgtggtgatacaatcacagtgctttggaatcctgacacttgtttgaatgagtttttagtgtaactactctttatccattgtgaagatcattgctgttaaggagttacctccttccattcaataaggtccatatcac

SEQ ID NO: 4802 - DNA, 712 bp, Vigna unguiculata
ggaagtggaaactggtggtgcgacctatatataccttcatcctcttcttcttctttccccacagtgttagggttttgtctccattgcggtttcttcttccgtaatttctcgcaaaaccctcgacggtgactgatcagtggatcaattatggacaaaagcatgttagcggatctggaatcgctccctgaggcagataggcaaagaatgtctgccatgatggaacagctgcaaatccgtgacagtctgagaatgtataattcacttgttgagagatgctttactgattgtgttgacacttttaagcataaatctctgcaaaagcaagaggaaacttgtgtccgaagatgtgcagagaaatttctgaagcattctatgagggttggcatgagatttgccgagctcaaccaaggagctgcaacacaagattgatatctgtcaacttctttaaatgaaaaactgtttatggttattctgaatgcactttgcttacttacatttttgggtcttgagaaatgagattactgtagagaacactaatttgcaattagtacgcaacaatccttgttaaataaatttgtggtgatacaatcacagtgctttggaatcctgacacttgtttgaatgagtttttagtgtaactactctttatccattgtgaagatcattgctgttaaggagttacctccttccattcaataaggtccatatcaca

SEQ ID NO: 4803 - DNA, 660 bp, Cryptomeria japonica
gagaaatgcgatctgaaaagagaacgataagtattgatttgcagggattattgtagcgcagaaaaaaagaggaacgcgatcttcaaaaggaaacgagaagtcattgatttgcaaattgtagaaatggacaagagcatgcttggagatttggccaacatgccagaggaagatcaacagagaatgtccaacatgattgatcagcttcaaattagagacagtttgaggatgtataattcgttggtggaaaggtgcttcaataattgtgttgatagttttcgacgcaagactttggacaaacaggaagaaacatgtgttcagcggtgtgcagagaaatatttgaaacattctatgagggtcagtctgaggtttgctgagcttaatcaaggaagcccaactcctgactaattgtttatttaagattacaaacaattggcgtaacttgactgtcaaagtacttttcatggatttctgaactgctgagttttggaatcaaactctttcatttacctgatcagttagcatgaagctccaatattcgatgatttcttttttggttattagaatttttattcatgttgtaatgttgacacaacattgagggtattctattgtttggggggcaagcagaaaatgaattatctgcaccttccattttttttt

SEQ ID NO: 4804 - DNA, 607 bp, Euonymus alatus
ctatctatgacgctgtcagatcctgtgcagtaaatatattggaggcggcattcagctggaacgccatttctttctattaacgagagagtagaagatcctaaacaaaaaacgtttgattgtttggatagtgtaggagctgcaatcctatggataagaacgtgctagcaggacttgagggtctacctgaggaagataaggtccgaatggcagccatgatcgaccagctacaaatgcgagacagtctgaggatgtataattcagttgtggagagatgtttcaatgactgtattgacaacttttcacgtaaaactctccaaaagcaagaggagtcttgtgtgatgcgatgtgctgaaaagtttttgaagcattcgatgcgtgttggcatgaggtttgcagagctcaaccaaggcgcagctactcaagattagtgagtagacacaacattgggatgccatacatcagtttctttattttctgttctgtattttgccccgaattttatcgggaaggatatcggttatctttttgattttctggagaacttgaatttggtatgttatgttcttcacttgctttagtaagagttactcaaggcatgttgatgttc

SEQ ID NO: 4805 - DNA, 411 bp, Glycyrrhiza uralensis
ggagttagggtttgcttcctacggcagaacacaatcgcaatctccaccgtactctctcgtaaaacccttgacggcgattattcggtggatccactatggacaagagcatgttagctgatatggagtcgctcggcgaggcagataagcaaagaatgtctgtcatgatcgatcagctccaaatccgtgacagtctgagaatgtataattccctggtggagagatgctttaatgattgtgtcgatacatttaagcataaatcgctgcaaaagcaagaggaaacatgtgttcgaagatgcgccgagaaatttctgaagcattcgatgcgtgttggcatgaggtttgcggagctcaaccaaggagctgcaacgcaagattgaagcctgttaacattggaaaactgtttattttttg

SEQ ID NO: 4806 - DNA, 472 bp, Taxus baccata
gttattcagtcacactctgtaaaaatggacaaaaatatgctcggagatttgggcaatatgccagaggaagatcagcagagaatgtccaatatgattgaccagctgcagatcagagacagtttgaggatgtataattcattggtggaaaggtgcttcaatcattgtgttgatagttttcgccgcaagactttggacaaacaggaagaaacatgtgttcaacgctgtgcagaaaaatatttgaaacattctatgcgggtgagtatgaggtttgctgagcttaatcaaggaagcccaactcctgattagctgtgtcttgaaggatgcaaacaattagtatacttgactgccacagaattccatttctgagctgctggatttttgtagcaaagctccagtatatttagacttccatttatttttatttttgtaatcttatttactattgtgtatcttgatgtgacaagggtactct

SEQ ID NO: 4807 - DNA, 578 bp, Tripterygium wilfordii
gccatttctttctgttaacgagagagtagaagatcctaaacattttgattgcttggattgtgtaggagctgcaatccctatggataagaacgtgctagcgggactcgatggtctacccgaggaagacaaggtccgaatggcaaccatgattgaccagctacagatgcgcgacagtctgaggatgtataattcagtcgtggagagatgtttcaatgactgtgtggacaatttttcacgtaaatctctccaaaagcaagaggagacatgtgtgatgcgatgtgctgaaaagttcttgaagcattcgatgcgcgtaggcatgaggtttgcagagctcaaccaaggcgcagctacgcaagattagtgagtggacacaacattgggatgccatacatcattttgtttcactgtagaatttgcttatgggcaaatacaggttatcaccttctttttatcttctgttctttattttgccctgatttttatcaagaaggatactgttgattcttttcttttttttttaattttctggtagaacttgaatttggcatgttacgttcttcacttggtttaataagagt

SEQ ID NO: 4808 - DNA, 498 bp, Sesamum indicum
ctcttccagaggcggataagcaacggatgtccgccatgatcgaccagctccaaatccgcgacagtttaaggatgtataattccctggtggaaagatgcttcactgattgtgtggacacttttcggcgcaaaactctagacaaacaagaggagacgtgcgttcggagatgtgctgagaagttcctgaagcattcgatgcgtgttggcatgagatttgcagagctgaaccaaggtgctgcaacacaagattaacttgcatttcacctacaacagcattctaggagacttaattatgctcttgtgggagcaatcttcagttttgtgatgttcactctgtgatattaccattatttagggatcctttgaagttcaagattttatttggtttttgtattgcagactgaaaaataagatgaatattgctcctttctactcttttggccatgcttatatataagatcttttaagttcattccacatgtgtaaggtgttaaatttt

SEQ ID NO: 4809 - DNA, 546 bp, Cleome gynandra
tagggttttgctatcgccacacaaactgagcagttctcagctatccaagagaaaaagaagtgtctcgaagaatggatgcgaacatgttagctgggttagatggtcttcccgaggaagacaaagctagaatgggttccatgatcgaccagcttcaacttcgtgacagtttgaggatgtacaattcgttggtggagaggtgtttcgtggactgtgtggacaacttcacgcgcaaaacacttcagaaacaagaggagacgtgtgtgatgaggtgcgctgagaagttcctcaagcacaccatgcgcgtcggcatgaggttcgccgagctcaaccaaaaccaagcaacacaggactgagctcctgtccagttcggtttggtttaaaaatgtgtccggaataaaccggtggttagtggtttaggtaattctgtatgccctttaaaaataccaaagaaatagggttcagggtttgaagctcattctacatcttacatttcttgtttccaattgataataagtttgaattctcatgatcctatatgattatttt

SEQ ID NO: 4810 - DNA, 560 bp, Cleome spinosa
ggccgcgaccagagcagttctcagttatcaggaagaaggagaagaagggtttcgaagaatggatgcgaacatgttagcaggtttagatggtcttcctgaggaagacaaagcgagaatgggttccatgattgaccagcttcaacttcgtgatagtttgaggatgtacaattcgttggtggagaggtgtttcaacgactgtgtggacaacttcacacggaaaacgctgcagaaacaggaggagacgtgcgtgatgaggtgtgccgagaagttcctcaagcacaccatgcgcgtcggcatgcggtttgccgagctcaaccaaaaccaagctacccaggactgattctcccctgttcggttcggttcggttttatatctctaaaccggtcggttattggtttataggtaactctattgtcataatcatggtgaaaatcttttgttcaggggagtaatgaataagctcattcattgaaccggtttcataacttttttgttcgaggggcatttttggttctgccgaatgttacttgtaccgagaaagagattattatatcattatc

SEQ ID NO: 4811 - DNA, 462 bp, Humulus lupulus
ttcattgtactctgttttgaagttatcacttggcagcaaagctaagcggaacgaaactagttcattcaatttgaatcgaagatggacaagaacatgatggcagacatggattctctccctgaagaagacaagttgagaatgtctgccacgattgatcagcttcagattcgagatagtttgaggatgtacaatgccttagtggagaggtgttttacagactgtgtagataccttccagcgcaaatcgctgaccaagcaagaagatacatgcgttcgcaggtgtgctgagaagttcctcaagcactctatgcgcgttggcatgagattcgccgagctcaaccaaggagcagctacatcagagtaaagatattcttgggtcattttttgttggaggactctaccagtaggtgatccgaaatattatgaagcaagatcactccttttgctggagaaaataaagaga

SEQ ID NO: 4812 - DNA, 621 bp, Tropaeolum majus
tctccgactcagcggccgggggcaataagcacttgtaaatcttcagtgaaaggtgaagcagaaacatctttttgggtgacaagtgtgtcggagagtgctttgaattcagtatggacaagaacatgctagctggactggatgggctacctgaggaggacaaagcacgaatgggcgccatgatcgaccaactccagcttcgcgacagccttaagatgtataattcacttgtggagagatgcttcactgattgtgtcgacaactttacgcgaaagagtctacagaagcaagaggagagttgcgtgatgcgatgcgctgagaagttcttgaaaaattcaatgcgcgtaggcatgagatttgcagaactcaaccagcaagcacccacacaggactagattaacaggagcgattagccgtcgatcaatctttttacccttccgaacactatgattgtcgatcataacagtttttgttgttacagtccaaggaaggccagttattgagtttgtgcaattaatgaggggtgtatcttttgttctcttattgttacggcaagaaataatgctttggaattttttagtacctcttactaattatttaagattttaagagaaattattcttt

SEQ ID NO: 4813 - DNA, 766 bp, Quercus alba
tatctaaaagccgcgaaagcagagctcttaaaccctaaggcctaaacctccgaagaattattgaatcgaagatggacaagaacatgatagcagacttggagtctcttcctgaatcagataaggctcgaatgtctactctgatcgaacagcttcagattcgcgacagtctaaggatgtataattcattggtggagagatgttttacggactgtgtggatacttttcaacgcaaatccctaaccaagcaagaggagacgtgtgtgcgtaggtgtgctgagaagttcctgaagcactcaatgcgtgttggcatgagatttgcagagctaaaccaaggagcacctacaactgattaagttgtttctgaataacttaggcgtacaactcttgtaagaccctgatatggtcttcttaaaagttcagtttttgttgctcattaatgttactccctttccatgataagaagactgattagtctgttcatgcccactgggtttggcaatcaacaggatatgaacagattttatacatatatatttatatatgttccatataatctgggaaaggaatgaatcaaaacttaatttgagtgcctcccaattttgctgattaagaggattgtagtgtctagttccattttaccagctcgttgtttagctttattgaaatagctgcttcagcagtctgttgaaggcttgcaagttaagcatttaatattatgtagttcctgtgattgataaattaaattcggctaattcaaattttttgg

SEQ ID NO: 4814 - DNA, 667 bp, Carica papaya
atctttttgcattcaaagtcagacagaaaccctagtgaagtttgattgaagtgggtaggttacagtatggacaagggcatcttagcaggactcgatggccttcccgaggaagacaaggcccgaatgagcgccatgatcgaccacctccagcttcgtgatagtctgagaatgtataattctcttgtagaaagatgcttcactgattgtgttgacaacttcacaaggaaaaccctacagaaacaagaagagacttgcgtcatgagatgtgctgagaagtttttgaagcattctatgcgtgttgggatgagatttgctgaactcaactcgcaagcagccacacaagattgatttaaaaccttttacaaaagaccatggatgtatgtggctgaaaccaaccattttgtgaccttgtagtgctttcccttttaacttggctaggtcttatattttattttgatttcctgttgctccaattgaatacaaaaatatcaccttgccaatcaagatttttgtccgcagaatagcatttatttgtatttgagtatgatgaaccaaccctgtgggtcgtcaataaaactctgctttttgattattgtataaaataacccattttggatcattatattatagcttggactgaataagaatttctcagacgattgaattt

SEQ ID NO: 4815 - DNA, 462 bp, Podocarpus macrophillus
agaaagaaatcgagtaaaaatggataagaacatgcttggagatctgagtaatatgcctgtcgaagaccagcagagaatgaccaatatgattgatcagcttcaaatacgagatagtttgaggatgtataattcattggtggagaggtgcttctcacattgtgttgatagttttcgccgcaagactttggacaaacaagaagaaacatgtgttcaacgctgtgcagagaaatatctgaaacattcaatgagggtgagtatgaggtttgcagagcttaatcaaggaagcccaactcctgactagttgattcttgaaaaatacaaataatttgtgtacttgactcctaaagcatttataagtagcttgatttttggacaaagctttttagttagcatgaagttcttattttctatgcgtttatgttttgtattgactggaatcttattctaccttctgatattgac

SEQ ID NO: 4816 - DNA, 604 bp, Eutrema parvulum
actagggtttaagatgaatgaagaagaataaacaggaggcgacgaagaagtgcttctgtgttctgtctgatctagaggaagaaagcgaaaatggacgcgagcatgatggctggactcgatggtcttcctgaagaagacaaagcgaaaatggcctccatgatcgatcaacttcagctgcgtgatagcttgaggatgtacaattcgctggtcgagaggtgttttgtggactgtgtcgatacatttacgcgcaaaactttgcagaaacaagaagagacttgtgttatgcggtgtgctgagaagttcctcaagcatacaatgcgtgttggtatgcggtttgccgagctcaatcagaacgcaccaactcaagactgaagcctactagtttggtttttggtccggtttatgagttccgaaacaagaataaaccggtttttagtggttcaaacaattctgatactgttctttgaaattgttactagtgtattttgaaattgttttgtctaactatatccgattttgaatattgaaatgatttgtatttcaataggggtctatgaataatcatttcatatcgatatacattaatgtcggcttttgtttatag

SEQ ID NO: 4817 - DNA, 675 bp, Papaver somniferum
gtttttggtttgcgaacaacaacaaactaagcttgtgtgagagggtaaagctaaagaggcagaagtaagtgtttcgcgagcaaaaccctaattcacagtaaagatggacaagagtatgatgggcgatatcgatgctatgcctgaagaagacaagatgagaatgtctactatgattgatcagctccaagttagggacagtctgaggatgtacaattctttggtagagagatgcttcgttgactgtgtggacactttccgccgcaagtcccttgacaaacaagaggagtcttgcatccgtcgatgcgcagagaagtttctcaaacactctatgcgtgtgggcatgagatttgcagagctcaaccaagggacagctacacctgacacccaactaatatccacaacacaaaactaggagggaaaactagttaccacatgaaaactgctgtattcctgaaggaatttatacaaaactctgagataaaaagtggtttctgtttacattaaatagaatattagcagcacgtagattgctgcaaattgctttgtttttatttaaccaagtgaaagctacattttaattggttattaattggtgtaagttgctaaacctgaccaaagtttttgaataacttctggaagtaagatatttttggtccatgtttttcattgcgtgtt

SEQ ID NO: 4818 - DNA, 1512 bp, Zea mays
cgttcacactcaactccctcgattagtaataacaggaaaaccatccgccggaggccggagggcagattctccaccaccgcctccaccccgccctcacgacgcgaatctgcggcgaacccccctctcgtattccttctcgccgccctgccccgagcgcaccgtttagaggccgccaggctccggcacccccgcccgcccgggctcgcctggggtcgggatgccctgctgcccgccgtcgctgctcggagtcggcccacggctgcgctccttcctccgcgactacgacgcgctccagtccctcgccctcgtactcatctacctccagattggttgtgcactgatcggatcacttggggcattgttcaatggggttcttgtgatcaacctggtgattggtctatttgctgttgttgcaattgagagcagtagccagagacttggtcggacatatgctgtccttctcttctttgctgtcgtccttgacgttgcttggtttatactcttctcacatgctatctggactattaatcctgatgataagtatggtcaactgtttgttttctcactcagacttgcattgtggatgcaaatcattgggttttcagtcaggtttttgtcttcgttcttatggattcagatgtatagattagggccttctttcaccacgccaacatattttgaaaccaaccatgaagcaagaactagtttcttgagccctagatctgattcagttagacggaattccatggcagatgatatattagggggttcaatctatgatccttcttactactcgtcactgttcgaggatgttcgaaacaatgcatgcaatcatcagggtgataaacaaagtggtagtaatgacagtggttcaacatccgcgggccagtcaccacgacttaaatcttttgcttgtagatctcttctggctaatgatgtggaaagtggactaagaagaccgttgaactcctaggataaaacagcgggctcatgttgaaggtggaccatattttggtaacctaaatcctgtagccatctttctcttaaacatagaggcttacacaccgcagcagttcatttctcggaccagtgggagggggctgtccagcgaaaggagcttggcaaatactgtaactgtgacttcatgtgggcatccacagcagtcttggcgccattttggagcaccgttcgtactcagcgagctttgagttaagccggatgtttctgcaaagagctgttcaatgttggtgttgcatatcggtttatgtcatgcgatatgtttactgctcatcacggtccaatttttctgacctgccttcctgtttcttttagctaccaaggaaaatgaagcaggtagttcattagttatttagtaaattggctattttttttctagccgtagcttgccagctgcttctcttcgagcattttggtcattgttcatagtgctgtcatgacaaggagcacatctctagatcagtaaaggaaagaaatgtaaatctcattcgtttc

SEQ ID NO: 4819 - DNA, 1468 bp, Setaria italica
catcactccctcgattagccgagaaaaaccaaaccatccgccggagcccggagggcagcagattcctcctcctccccagcccgcccgacgcgaatccgcggcggaatccctcctcgccgccctcgagacgccaccgggctccgtcgcgcgcgccttctccccgcccgcccgggctcgccggggggttccgggatgccctgctgcccgccgctgctgctcggagtcgggccgcggctgcgctccttcctccgcgactacgacgcgctccagtccctcgccctcgcgctcatctacctccagattggttgtgcacttatcggatcacttggggcattgttcaatggggttcttgtcatcaacctggtgattggtctatttgctgttgttgcgattgagagcagtagccagagacttggccggacatatgctgtccttctcttcttcgctgtcgtccttgatgttgcttggtttatactcttctcacatgctatctggactattactcctgatgagaagtatggcgaactttttgttttctcactcagattagcattatggatgcaaatcattgggttttcagtcaggttcttgtcttcattcatatggatccagatgtataggttaggggcctcttccagcacaccaacatattttgacgcaaatcatgaagtacgaaatagtttcttaagcccaagatctgattcagttagacggagttccatggcagacgatatattgggaggttcaatttatgatccttcttattactcgtcactctttgaggatggtcgaaacaatgcatgcaatcatcagggtgataaacaaagtggtagtaatgacagtggttcaacatcggcgggacaatctccacgacttaaatctttctcttgtagatctcttctgactaatgatgtggaaagtggactaagaagacccctgaacccctagggctcacgttgaagacagattattttgcaaaccaaagtcctgtagctatcgttctttttgaagcatagagatttgtacagcgcaaagttcatttgtcaaaccagggggggtggcccgacaaaaggagatcggcacagtaacagtgatggcctgtgttgctgggtgtccactatccacaagactacaagagtcttggtgccattgtggagcgccatttctgttaggcgtacttgagccggattggtttcagaaagagcagttgagtgttgatgttgcacatctgtttatgccatgggacttgttttcctgctcagtatggtccatttttcagacctctggcctgcctcatttctctgagctgtcaaagaaaacgaagttggtagttcattagttctttagtcacttggttctactctagctttaggctggcagttgcttcttccctagcattttggtcattgttcatagtgtttatcttgacaaggtgcacatctggatcagtaaaggaaaagaaaagtga

SEQ ID NO: 4820 - DNA, 1483 bp, Zea mays
accgttcagactctcaaactccctcgattgtaataacagagaaaaaaaccatccgccggaggccggagggcagattctccaccatcgcctccactccaccctcactacgcgaatccgcggcgaacccccctctcggattccttctctcctccccgccccgatcgcgtcgtccagagaccgccaggctccggcgcccccgcccgcccgggctcgccgggggtcgggatgccctgctgctcgccgtcgctgctcggagtcgggccgcgggtgcgctcctttctccgcgactacgacgccctccagtccctcgccctcgcactcatctacctccagattggttgtgcgctgattgggtcacttggggcattgttcaatggggttcttgtgatcaacctagtgattggtctatttgctgttgttgcaatcgagagcagcagccagagacttggccggacatatgctgtccttctcttctttgctgtcgtccttgacgttgcttggtttatactcttctcccatgctatctggactattaatcctgatgagaagtatggtgaactttttgttttctcactcagactagcattgtggatgcaaataattgggttttcagttaggtttttgtcttcattcttatggattcaaatgtatagattaggggcttcttccagcacgccaacatattttgaaaccaaccatgaagcaagaattagtttcttaagccctagatctgattcagttagacggagtcctacggcagatgatatattgggaggttcgatctatgatccttcttactactcgtcactgttcgaggatgtccgaaacaatgcatgcaatcatcagggtgataaacaaagtggtagtaatgacagtggttcaacatctgcaggccagacaccacgacttaaatcttttgctaatgatgtggaaggtggactaaaaagaccgttgaactcctagggataaaacaacgggctcatcttgggaacctaaatcctgtagccaccgttctctttgaagcatagaggtttgcacaccgcagcagtttatttctcagaccagcgggaagggggtgtccaacgaaaggagcttggcaaatactgtaacggcgactgcctgtgttgccgagcatccacagcagcatcggtgccattttggagcaccgttcgtactcagcgagcttgagccggatgtttctgcaaatagctgtccaatgttggtgttgcatatcgacctatgccatgcgatatgtttactgcccatcatgtcccatttttcagacctctcttcctgtttcttttaactaccaaggaaaatgaagcaagtagttcgttagttctttagtcacttagttattttctagctgtaggctggcagttgcttctcttctagcattttggtcattgttcatagcatttgtgttgacaaggaacagatctctagatcagtgaaaggaaacaaatgtaagtttcattctgtt

SEQ ID NO: 4821 - DNA, 1861 bp, Brachypodium distachyon
tctccggtcactcacgaataataaatcgagcagccaagaaaccatcggccgaaggccaccccaatcgcacgcccgtgaaatctacgagagaatccttccgattccctgacctccccgtcgatcgcgctcctaggaggccgaagaactgcgcggcgaggaatcggctccccgctcgcctccggagaggccccccagatttgcatgtccggagctcgcctgagtcggaatgccctggtgccccggattcgggccgcgggtgcgctccttcctgcgtgactacgacgcgctccagtccctcgccctcgccctcatctacctccagattgggtgtgcgctgattggatcgcttggggctctgttcaatggtgttcttgtgataaaccttgtgatagggctatttgctgttgttgctattgagagtagtagccagagacttggccggacatatgctgtccttctcttcttcgctatcgtccttgatgttgcatggtttatactcttctcacatgctatatggaatactacccctgatgagaattatggtgaactttttgtattttcactcagactagcattgtggatgcaaattatagggttttcagtgaggtttttgtcttcattcgtatggatccagatgtatagattaggggtctcatcaagcacgccaacatattatgaagcaaatgatgcaagaaacagtttcttgagccccagatctaattcagttagacggagttccatggctgatgatatattgggtggttcaatttatgatccatcttactattcttctctcttcgaggatgttcgaaacagtgcatgtaatcatcagggtgataaacaaagtggtagtaacgatagtgggtcaacatctgctggccaatctcctcgacttaaaacttttggtactagatcttttctgtctaatgatgtggaagctggattaagaaaaccgttgaactcatgcaccgtggagacaagttgaagatggaacttccttttgccaagatgagtactctttgaagctcccaaaactgtcgctcctgttaaatggcagagaggtttgtacagtgcaaaagttcatgtctcggaccagtggtttcccattaaaacgagatcaggaagatgctataagacgacggctgcatgtgttgttgtgcattcttgaacttccacgagagttttggtgccaatcaggagccatcatatttgcttcgaaagtgagctcgagttggatgcctgatcccactgacctttcacgacgtgtggtatcttgtgctgctccgtatggtccatttttctgacatatgtattgcatgcttctcttagctgtcgaggaaatgaggctgcctagttctcttagtctatgtttcttcttccctagcgttttggtggtttgttcatatcactattttgacaatgcacgtcttcagattcaaaaggaaagaaatgtaaatttcactctggtctccagcaaattgaatttgaattggcgatggcctgcagctgttctggaacagtggaacgtccatttgcagtggtactgcagtgcatcgatgtgctgcgaacggtggaggcaaaggggtggcaatgatgagaacagggtggaaccgtggaagctgagtgtgccctctggattacctccctatgtatattctccctcctgtcatctcgctcaaaaaatttctttggaaaaaaaattcatgaatgttacaatgccatatggttacactgggaaattttggtgctgaaatatgacgagatgtgctctgcacagaaagaacgaactgtgcttggtttaatagaataatgttcattgcttaagttatacagcatgattatttgtaagaacacatatggt

SEQ ID NO: 4822 - DNA, 1680 bp, Brachypodium distachyon
gaaggccaccccaatcgcacgcccgtgaaatctacgagagaatccttccgattccctgacctccccgtcgatcgcgctcctaggaggccgaagaactgcgcggcgaggaatcggctccccgctcgcctccggagaggccccccagatttgcatgtccggagctcgcctgagtcggaatgccctggtgccccggattcgggccgcgggtgcgctccttcctgcgtgactacgacgcgctccagtccctcgccctcgccctcatctacctccagattgggtgtgcgctgattggatcgcttggggctctgttcaatggtgttcttgtgataaaccttgtgatagggctatttgctgttgttgctattgagagtagtagccagagacttggccggacatatgctgtccttctcttcttcgctatcgtccttgatgttgcatggtttatactcttctcacatgctatatggaatactacccctgatgagaattatggtgaactttttgtattttcactcagactagcattgtggatgcaaattatagggttttcagtgaggtttttgtcttcattcgtatggatccagatgtatagattaggggtctcatcaagcacgccaacatattatgaagcaaatgatgcaagaaacagtttcttgagccccagatctaattcagttagacggagttccatggctgatgatatattgggtggttcaatttatgatccatcttactattcttctctcttcgaggatgttcgaaacagtgcatgtaatcatcagggtgataaacaaagtggtagtaacgatagtgggtcaacatctgctggccaatctcctcgacttaaaacttttggtactagatcttttctgtctaatgatgtggaagctggattaagaaaaccgttgaactcatgcaccgtggagacaagttgaagatggaacttccttttgccaagatgagtactctttgaagctcccaaaactgtcgctcctgttaaatggcagagaggtttgtacagtgcaaaagttcatgtctcggaccagtggtttcccattaaaacgagatcaggaagatgctataagacgacggctgcatgtgttgttgtgcattcttgaacttccacgagagttttggtgccaatcaggagccatcatatttgcttcgaaagtgagctcgagttggatgcctgatcccactgacctttcacgacgtgtggtatcttgtgctgctccgtatggtccatttttctgacatatgtattgcatgcttctcttagctgtcgaggaaatgaggctgcctagttctcttagtctatgtttcttcttccctagcgttttggtggtttgttcatatcactattttgacaatgcacgtcttcagattcaaaaggaaagaaatgtaaatttcactctggtctccagcaaattgaatttgaattggcgatggcctgcagctgttctggaacagtggaacgtccatttgcagtggtactgcagtgcatcgatgtgctgcgaacggtggaggcaaaggggtggcaatgatgagaacagggtggaaccgtggaagctgagtgtgccctctggattacctccctatgtatattctccctcctgtcatctcgctcaaaaaatttctttggaaaaaaaattcatgaatgttacaatgccatatggttac

SEQ ID NO: 4823 - DNA, 1422 bp, Triticum aestivum
tgggggcggccccagttgcacgaacgcacgcacccacccaacgcacccacccaacgcacgcgcgcgggtgaaatctaggacggaatccgttccagtccccgtcgatcacgccccgagaggcggaagagctttcgtggcgaggaatccgccggaggctccccgatttgcatgtccggggctcgctggaatcggaatgcactggtgccccggaatcgggccgcgggtgcgctccttcctgcgtgactacgacgcgctccagtccctcgccctcgccctcatatacctccagattggttgtgcgctgattggatcgcttggtgcgctgttcaatggggttcttgtgataaaccttgtgatagggctatttgctgttgttgcgattgaaagtagtagccaaagacttggccggacttatgctgtcctgctcttctttgctatcgtccttgacgttgcatggtttatactcttctcacatgctatatggaatagtacccctgatgagaagtatggtcaactttttgtcttctcactcagacttgcattgtggatgcaaactattgggttttcagtgaggtttttgtcttcatttatatggatccagatgtacaggttaggggtctcatcaagcacgccaacatattatgaagcaaatgatgcaagaaatagtttcttgagccccagatctaattcagttagacggggttcaatggctgatgatatattgggtggttcaatttacgatccttcttactactcttctctcttcgaagatgttcgaaataatgcatgcaatcatcagggtgataaacaaagtggtagtaatgatagcgggtcaacatctgcaggccaatctccacggcttaaatcttttggtagtagatcttttctttctaatgatgtggaggctggactaagaaagccgctgaactcatgctcagtggagacaagttgaagatggaacttatttttgccaacctgactacccgagcactctttgtttggtcctccttgagccagtaactcttgttgatttaacatagagatttgtacagtgcaaatgttcatgcctcggaacagcggctccccagtaaaacaagagcagcaagatagtacaacgatgatggactgtgttgctacgcaattcttgagcttgtgcaagagtttcggtgccaatctggcagctcgtttttgcctggagtacacttgagttggattgtttcacaggggcagacgctgaccagttggcaacatgtggaatactagtagtactttgctgcccagtatggtccattttccagacacgtgtatggcctgtttctcctcttggttgtcacggaaatgaggctgatagttgcctactccgctatagttaaatcggccattccgagccggatcgttcggttggtgttgtcaaaaaaaaaa

SEQ ID NO: 4824 - DNA, 1605 bp, Triticum aestivum
cggtgagtcactgtcctaataaatctagcagccaggaaaccatcggcaggagggcggccccagttgcacgaacgcacgcacccacccaacgcacccacccaacgcacgcgcgcgggtgaaatctaggacggaatccgttccagtccccgtcgatcacgccccgagaggcggaagagctttcgtggcgaggaatccgccggaggctccccgatttgcatgtccggggctcgctggaatcggaatgcactggtgccccggaatcgggccgcgggtgcgctccttcctgcgtgactacgacgcgctccagtccctcgccctcgccctcatatacctccagattggttgtgcgctgattggatcgcttggtgcgctgttcaatggggttcttgtgataaaccttgtgatagggctatttgctgttgttgcgattgaaagtagtagccaaagacttggccggacttatgctgtcctgctcttctttgctatcgtccttgacgttgcatggtttatactcttctcacatgctatatggaatagtacccctgatgagaagtatggtcaactttttgtcttctcactcagacttgcattgtggatgcaaactattgggttttcagtgaggtttttgtcttcatttatatggatccagatgtacaggttaggggtctcatcaagcacgccaacatattatgaagcaaatgatgcaagaaatagtttcttgagccccagatctaattcagttagacggggttcaatggctgatgatatattgggtggttcaatttacgatccttcttactactcttctctcttcgaagatgttcgaaataatgcatgcaatcatcagggtgataaacaaagtggtagtaatgatagcgggtcaacatctgcaggccaatctccacggcttaaatcttttggtagtagatcttttctttctaatgatgtggaggctggactaagaaagccgctgaactcatgctcagtggagacaagttgaagatggaacttatttttgccaacctgactacccgagcactctttgtttggtcctccttgagccagtaactcttgttgatttaacatagagatttgtacagtgcaaatgttcatgcctcggaacagcggctccccagtaaaacaagagcagcaagatagtacaacgatgatggcctgtgttgctacgcaattcttgagcttgtgcaagagtttcggtgccaatctggcagctcgtttttgcctggagtacactttgagttggattgtttcacaggggcagacgctgaccagttggcaacatgtggaatactagtagtactttgctgcccagtatggtccattttccagacacgtgtatggcctgtttctcctcttggttgtcacggaaatgaggctgatagttgcctactccgctatagttaaatcggccattccgaaccggatcgttcggttggtgttgtcaacatcactcacttttttgacaatgcacatctttggagcaactccaacgcgccgacacatttcgttcatatgtgtccgtttagtcaaaatggacacaaaagtcggccagccgggcgacccattcctggtccaaatttgggcctc

SEQ ID NO: 4825 - DNA, 1817 bp, Oryza sativa
ccttagttcccaaacaaatctggcaacgcaacgcaaacgtcttcttgcccctccttcgccgtcaccgaattaattaattaaagcacccaaaaaataataataaaaaaaaccatcggccgccggagggcaagccgaagcaggcgaaatctcctcgcctcccttccccctcgccgcgaatcctccccgccgatcacgccgctcgccgctcgccaccgccggaggaggaggaggaggaggaggaggaagcagccgcgccaccccccaaacgcaccaccgcccgcgaggttttgcatgtccgggctcggcgtggtgccgggatgcgctcctgctgctgctgctgcccctgcccggcggcgctcgggatcgggatcgggccgcggctgcgctccttcctccgcgactacgacgcgctccagtcgctcgccctcgccctcatctacctccagattggttgtgcgctgattgggtcacttggagcattgttcaatggcgttcttgtgatcaacctggtaattgggctctttgctgttgttgcaattgagagtagcagccagacacttggtcggacatatgcagtccttctgttcttcgctattgttcttgatgttgcttggtttattctcttctcacatgctatatggaatattactcctgaagagaagtatggtcaacttttcgttttatcactcaaactagcgttgtggatgcaaattattgggttttcagtaaggtttttgtcttccttcatatggatccagatgtataggctgggggtttcatcaagcaccccaacatatcatgaagtaaactatgatggaagaaatagtttcttgagcccaagatcaagttcagttagacgaaattccatggctgatgatatattgggtggttctatttatgatcctgcctactattcttctcttttcgcggatgtccgaaacaacacatgcactcatcagggtgataaacaaagtggtagtaatgatagtggatcaacatctgcgggtcaatctccacgacttaaatcttttgccagtagatcttttgtggccaatgatgtggaagctgggctaagaagacccctgaactcttaatctgactcaagttatagacagaacttatgttgccagcataagaataccgggaaccttctgcaggccatcgttatagttgaatcataatcatttgtacagaacttatgtcgcagactggagggttttcttagtaggggcattcagcaaaatactgtggtaatgatcgcagttgttgcagtgcattcttgaacttctgcgggattcttggtgccatttgagcattttttttggtcagccacttgagctgggtggttgaagaagcggtcgaacctttcggtttctcagattggtttacacatttgagatgttctgacatttgaggtgttcttccgcacggggcagtccagttttcagtcctgcgaattgcttgtttcctcggctgctatgaggatgcagctactactctagttctgtagtcacttggtctcttactacaatctatcaaggcagttttagcactaggttgacatcttcttcgccatgtggcgttttggtcactgtttataacttcatattgttattttttacaagttgctcatctctgaatcggtaaatgtttataacttcacattgttatttttgacaagctgctcatctctgaatcggtaaaggagaaaagcgaattgtaaatttcgtttgttcttgagtttttttttgtcgaaatgttcatgagtaaatttttaactgtggttgaattgaactgaatttaatcagtgctataca

SEQ ID NO: 4826 - DNA, 1177 bp, Hordeum vulgare
gagggtggccccagtcgcacgcacgcacgcacccactcgacgcacgcacgcacgcacgcacccactcgacgcacgcacgcggctgaaatctgcgacggaatccgaggaatccgccggaaatcaacccccacccccgcccccgcccccgcccgatctgcatgtccggagctcgctggcatcggaatgcactggtgccccggaatcgggccgcgggtgcgctccttcctgcgtgactacgacgcgctccagtccctcgccctcgccctcatatacctccagattggttgtgcgctgattggatcgcttgctgcgctgttcaatggggttcttgtgataaaccttgtgatagggctatttgctgttgttgcgattgaaagtagtagtcaaagacttggccggacttacgctctcctgctcttctttgctatcgtccttgatgttgcatggtttatactcttctcacatgctatatggaatagtacccctgatgagaagtatggtcaactttttgtcttctcactcagacttgcattgtggatgcaaactattgggttttcagtgaggtttttgtcttcatttatatggatccagatgtacaggttaggggtctcatcaagcacgccaacgtattatgaagcaaatgatgcaagaaatagtttcttgagccccagatctaattcagttagacggggttcagtggctgatgatatattgggtggttctatttatgatccttcttactactcttctctctttgaagatgttcgaaataatgcatgcaatcatcagggtgataaacaaagtggtagtaatgatagcgggtcaacatctgcaggacaatctccacggcttaaatcttttggtagtagatcttttctttctaatgatgtaagtcacgttcaattatttgaaattagaatatagcatgtttattcttagattctcctttcttctatcacgtcactaccttcagtgacaatcttatttcactgtctcatttaagttggattttgatctatgaacgcatgaagaaatatcttgatcacacctattcattatggtggtatgagagttcattttggtgatatggtgggaccatgaatgcaacttatgtactgctggagtatatgacaaattctgctctatctgtaataataagagctgatttaaactgccc

SEQ ID NO: 4827 - DNA, 1401 bp, Panicum virgatum
  misc_feature (551)..(551): n is a, c, g, or t
  misc_feature (664)..(664): n is a, c, g, or t
  misc_feature (735)..(735): n is a, c, g, or t
cgcggcgagattcctcccaggattcctcctcgcctccccgccgccgccccgcgagaggccacccgaccaggctccgacgcgcgccccccgcccgggctcgccggggggttcgtgatgccctgctgcccgccgccgctgctcggagtcgggccgcggctgcgatccttcctccgcgactacgacgcgctccagtccctcgccctcgcgctcatctacctccagattggctgtgcactgatcggatcacttggggcattgttcaatggggttcttgtcatcaacctggtgattggtctatttgctgttgttgcaatcgagagcagtagccagagacttggtcggacatatgctgtccttctcttcttcgctgtcgtccttgatgttgcttggtttatactcttctcacatgctatctggactattactcctgatgagaagtatggccaactttttgttttctcactgagactagcattgtggatgcaaatagttgggttttcagtcaggtttttgtcttcgttcatatggatccagatgtataggttaggggnctcgtccagctcgccaacatatttcgatgcaaatcatgaagtaagaaatagtttcttaagccctagatctgattcagttagacggagttccatggcagacgatatactggcangttcaatttatgatccttcttactactcgtcactcttcgaggatttccggaacaatccatgcaatcatcanggtgataaacaaagtggtagtaatgacagtggttcaacatctgcggccaatctccacgactaaatcttttgcttgtagatctcttctggctaatgatgtggaaagtggactaagaagacccatgaactcctagagctcacgttgaagatggagcttattttgggaacctaagccctgtagctatcgttctttttgaagcatagagatttgtacagcacaagttcatttctcagaccaggtggtgttccaatgaaaagtgatcggcaaatactttaacagtgacacacctgtatttctgggtatccaaaagtcttggtgctattgtggagcgccatttctgtttggcatacttgagccggatggtttgggaaagagcagttgcgtgttgatgttgcacatcggtttatgccatgtgacttgttttactgcccaatatggtccatttttgagacctctgtcctggtgtttctctgaactatcaaggaaaatgaagctggtagttctttagacactttggttctattctagctgtaggctggcagttacttctgccctagtattttggttgttcatagtgttatgttgacaagttgcacatctgtggatcagtaaaggaaaagaaatgtaaatttgatttggttattcaaagaattctgttccgggatc

SEQ ID NO: 4828 - DNA, 1483 bp, Zea mays
gaaaacaattgccaagtgccaaccaagctcggtggctgaatagaaaaattgtgcccggcagcgagccagcgatggccagattcacgctgttctgctccggcatgtcagcatgtgacgaggacgccaccatcctctgcacctcaaaagtgagagcgagagcccccccctcaacatcactgacaccaccaaagcacgggaaagcagaggaagcggagcagagctttgtgggagcgtcaatggcaggaacttgggtgaagatggagcagaagggcgccggtccgggagcacggagctcccacgccatcacgctgctcgggggcacggcctactcgttcggcggcgagctcaccccgcgcgtcccggttgacagcaccatgtacgccttcgacctcaacacccagacgtggtcggcgctggacgcgacgggcgacgtgccgccgccgcgcgtgggcgtgaccatggcggccgcgggcggcacggtgttcacgttcggcgggcgcgacctggagcacaaggagctgaacgagctctacgccttcgacgcggcgacgcgggcgtggacgctgctgtcgtccggcgccgacggcccgccgcaccgcagctaccactccatggcggcggacgcgggcgcggggcgggtgtacgtgttcggcgggtgcggcgacgccggccgcctcaacgacctgtgggcgtacgacgtggcggcggggcaatgggagcagctgccgccgccgggggaggcgtgccagccgcgcggcgggcccgggctggtcgtcgccggcgggaaggtgtgggtggtgtacgggttctcgggcgaggagctggacgacgtgcactgctacgacccggccacccgggagtgggccgcggtccagaccacgggcgacaggcccagcccccggagcgtgttctgcgccgccgggttcgggaggcacgtggtgctgttcggcggcgaggtggaccccagtgacctcggccacctcggcgccggcaagttctcggccgaggcgttcgcgctggacacggagaccggcgcgtggacgcggctggacgacagggcggaggccgagcaccacccggggcctcgcgggtggtgtgcgttcacggcgggggagaaggacggccagcgagggctgctggtgtatggcggcaactcgccgacgaacgaccggctcggcgacatctacttcttcacgcccgttcttgaggccgcaagctagcgcgtgtgacgaactggctggcaatgtgtagcagttcaatctgcatgtgcagggcttgtatgttgtgaattgtgatcatcgtcttgtgtcgtagttgagtttcctggtttgtttttcttaacttccgtcgttttttggatttttatatgctgtgtgatttgagaataattatggcaaaaattaaatcccacccatgtatctgtgtttttatttggagtgtaattggattgaatagatacatcgaatactgacgggtatcacta

SEQ ID NO: 4829 - DNA, 1498 bp, Panicum virgatum
agcccagcaaaagcagaggaagcggacgactccgcgctgtgggtggcaatggctgctggcacctgggtaaagctggagcagaaggggaccgggccaggagcaaggagctcccacgccatcaccctcgtcggcgacacggcctacgcgttcggcggcgagctcaccccgcgcgtgccggtggacaacaccatgtacgccttcgacctccagacccagacctggtcgccggtcgccgccacgggcgacgtgccgccgccgcgcgtcggcgtgaccatggcggccgtcggcggcacggtgtacatgttcggcgggcgcgaccaggaccacaaggagctcaacgagctctactccttcgacacggcggcgggcgcgtgggccctcctctcctccggggccgacggcccgccgcaccggagctaccactccatggcggccgacgccgccgctggccgggtgtacgtcttcggcgggtgcggcgccgccggccgcctgaacgacctgtgggggtacgacgtggccgccgggcggtgggagcagctgccgccgccgggggaggcggcgtgccgcccgcgcggcggggccgggctggccgtcgccggcgggaagctgtgggtggtgtacggcttcggcggggaggagctcgacgacgtgcactgctacgacccggcgaccgggcggtggtcggcggtggagaccgccggcgacaagccgagcccccgcagcgtgttctgcgccgtcgggatcggggcgcgcgtcgtcgtgttcggcggcgaggtggaccccagcgacctgggccacctcggcgccggcaagttctcggccgaggcgttcgcgctggacacggggaccggcgcgtggacgcgcctggacgacggcgccgccggggccggggccgagcaccacccggggcctcgcgggtggtgcgcgttcgcggcgggggagaaggacggccggcgagggctgctggtctacggcggcaactcgccgaccaacgaccggctcgatgacatctacttcttcgcgcccgctctagaggccgcgagctaggcactggcatgtatgtgttcatgcagtggccggcggcgagctctcttcttctctccgtgtgtgcatctgcaataatgtatagcagggcaatctgcaggcttgttgtgatggcggctgtgttgtgttgttgtaaatcttgcttccttcgcttctgtctgtgctagtactcccttagtatgctgtgtgatgctctgattatattgtagaacaatgacgctggctttgcatttgcattgcagctgtagtagtggttcagacaccgccgcccgggctgctcctcctcttgtggttgagcgtgtgagtccttggcctgatgctttgctcggcctcccggcgctaggtcgtgagcgctcggtgattcgttctgtgtggttggggtctcggcttgatggcggccgatgtaacttgtttgcctcatgtttgcgctgtgaaccctgtcctgtttcgtgct

SEQ ID NO: 4830 - DNA, 1362 bp, Setaria italica
tctcaattgtccaaaaactcacgtagccacttaataatcacacagttggagcagaagggagccgggccaggagcaagaagctcccacgccatcaccctcgtcggcgacatggcctacgcgttcggcggcgagttcaccccacgcgtgccggtggacaagaccatgtacgccttcgacctcaagagccacacctggtcggcggtcggcgccacgggtgacgtgccgccgccgcgcgtcggcgtgaccatggcggccgtcggcggcacggtgtatatgttcggcgggcgcgatcaggagcacaaggagctcaacgagctctactccttcgacacgtcgacgggcacgtgggccctcctgtcctccggcgccgacggcccgccgcaccggagctaccactccatggtggctgacgccgtcggcggccgggtgtacgtcttcggtgggtgcggcgacgccggccgcctgaacgacctgtggggctacgacgtggctgccgggcggtgggaacggctgccgtcgcccggggaggcttgtcgcccccgcggcgggcccggactggccgttgccggcgggaagctgtgggtggtgtatggcttcggcggggaggagctcgacgacgtgcactgctacgacccggccacaggacggtggtccgcggtcgagacctccggcgacaagccgagcccgcggagcgtgttctgcgtcaccgggatcgggaggcacgtcctcgtgttcggcggcgaggtggaccccagcgacctgggccacctcggcgccggcaagttctcggccgaggcgttcgctctggacacggagaccggcgcgtggacacgcctggacgacgacgccgaggccgagcccgagcaccacccggggcctcgcgggtggtgcgcgttcgcagcaggggagaaggaggggcgacgagggctgctggtgtacggcggcaactcgccgacgaacgaccggctcgacgacatctacttcttcgcgcctgtccttgaggccgcacgctaggcatgggctgcgtgctctctccgtgtgtgcatccgcaatgtattgcagtgcaatctacaggcttgttgcgatggttgttgttttttttttgtctggttgtttttctttcgttcattttctgtgctacatcatgctgtgtgagtagagaataatgatgctggacggatgtacttgtgtttgaccatcgctttgcattgcagctgtagtagtgtcatgtttgtctttggatcaagttctagcttggcataagagttaaggatcaattgggcacccaactgttggcaagtactccgtactcagcagatacttacgagttacgagtatacaaactgtaattaagaaggaaat

SEQ ID NO: 4831 - DNA, 1118 bp, Zea mays
atttcctttccagcgaccggcgagcgcacagccacacgcacagaggggtgttgccgtgtagcagagcagctcgcgccatgtccctgtccgtcggcggcgcgcggacctctctcctcccttcttcgttcaccgcctcttcatcccgcccgcgcttcctcgcgctccctctccaccgccgctcgcacggctccctcacctcgctgccggccgcgtgcaggcggcggctccgggtgcgcatggcccggacggagtccaccggcgtcaccatcggcttccgcgcgccggatttcgagctccctgagccactgactggaaagctctggacgttggatgacttcgagggcaactctgcactgcttgttatgttcatatgcaaccactgtccatttgtaaaacatctgaaaaaggacatcagcaagctcgcctctttctatgtggagaaaggacttggtgctgttgccatatcgtccaactcagttaggacgcatccccaggatggcccagatcgcatggctgaagaagcagagctgttcaaatatcctttcccatatctttacgatgagtctcaagaggtagccaaggcttttggagcggtctgcacgccagagttctacttgttcaaaaaggatggccggaggccttttgaacttttctaccatggacagttcgatgactcaagacccagtaacaacgtgcctgtaaccggaagggacctaagccgcgcgattgactgtgcgctcagtggccaagaactgccctttgtgcaaaagccaagtgtcggctgcagcatcaaatggcacccatgaggtgcccaccttgttcggcatttgattcggcccaggctcacaggggctgaagatgagacagatctgtgggggagaaacagaaacatgggaacttctcttgtgtgacggcgaaatagtgtagcgctagcgcagcaaccagcaaaaggctcatgtaaagaattgttcacgaaacagaagagcttcacttctaccttctgtaggacatggtcatcgcaaaaggcgttggtattgtttcctgctggaagtaatttctgccgggatggatattcattttcaggatgaattttttttaaaaaaaaataaggtcaaaaa

SEQ ID NO: 4832 - DNA, 1159 bp, Setaria italica
gtcgccacacagcgagtccgcagccgcacaggcacacagcctacagcgccgtagcagagcagcgcgcgccatgtccctggccgtcgccggcgcgcgggcctcactcctcccctcccccctcgcggcctcctcgtcccgcgcgcggctcctcgcgctcccgccccgccaccgccgcccgcacggctccctcgcctcgccgccggccgcgggcaggcgccggctccgggtgcgcatggccaggacggagaccaccggcgtcgccgtcggcttccgcgcgccggagttcgagctcccggagccactgacggggaagctctggacattggatgattttgagggcaaccctgcactgctggttatgttcatatgcaatcactgtccatttgtaaaacatctgaaaaaggatattgcaaaactcacctctttctacatggagaaaggacttggtgctgttgccatatcgtcgaactcaataaggacacatccccaggatggtccagaacgcatggctgaagaagcaaaattgttcaaatatcctttcccatatctttatgatgagtctcaagaagtagctaaagcttttggagcagtctgcacgccagagttttacttgtttaaaaaggatggacgaaggccttttgaacttttctaccatggacagtttgatgattcgagacccagtaacaatgtgccagtaactggaagggatctaagccgtgcaattgactgtgcgctcagtggccaagaattgcctttcgtagaaaaacctagtgttggatgcagcatcaagtggcacccatgaaaacctcggcgtggtgagaaatatacaggttgtttttttttttcactttcagaacaaaggcgttgaacatttgattgaggtgggtccaactccattgttcgcatctctgtgtccctaggctgttgagactcacttgaaaatcagctccttagtacagaattgtgtggaaaaaatatgtgaaagttttccttgtataacagagacatcaaagcaatactgtagcgttagcgtagagaaaggcccgtgtaatgtgtaaacaagcatgtacaaaaaacaagtgctttacttgtactcttttgtacgaggtccttttaatgcgataatctgaaaatgaagtgacattaccctatcatttcc

SEQ ID NO: 4833 - DNA, 1159 bp, Setaria italica
ccgcagccacacagcctacaggctacagggccgtagcagagcagcgcgcgccatgtcccttgccgccgccggcgcgcgggcctcccttctcccctcccccctcgcggcctcctcgtccctcccgcggctcctcgcgctcccgccccgccaccgccgcccgcacggctccctcgcctcgccgccggccgcgggcaggcggcgccggctccgggtgcgcatggccaggacagagtccaccggcgtcgccgtcggcttccgcgcgccggagttcgagctcccggagccactgacggggaagctctggacattggatgattttgagggcaaccccgcactgctggttatgttcatatgcaatcactgtccatttgtaaaacatctgaaaaaggatattgcaaagctcacctctttctatatggaaaaaggacttggtgctgttgccatatcgtcgaactcaataaggacacatccccaggatggtccagaatgcatggctgaagaagcaaaattgttcaaatatcctttcccatatctttatgatgagtctcaagaagtagctaaagctttcagagcagtctgcacgccagagttttacttgtttaaaaaggatggacgaaggttttttgaacttttctaccatggacagttcgatgattcgagacccagtaacaatgtgccagtaactggaagggatctaagccgtgcaattgactgtgcgctcagtggccaagaattgccttttgtagaaaaaccttgtgttggatgcagcatcaagtggcacccatgaaaacctcataacattgggggcgtggtgagaaatatacgggttgtcttttttttttcactttcagaaatatacgggcttcgaacatttgattgaggtgggtccagctccattgttcgcatctctatgtccctaggctgtcgagactcacttgaaaatcagctccttggtacagaattatgcgggagaaatatgtgaaagttttcattgtataacatgagcatcaaagcaatagtgtagcgctagcgtagagaaaggcccgtgtaatgtgtaagcaagcatgtacaaaaaacaagttctttacttgtactcttttgtaggaggtcctcttaacgcggtaatatgaaatatgaaaaggaagtgacattacctatc

SEQ ID NO: 4834 - DNA, 1763 bp, Oryza sativa
aagaaaacgagagccaacacggtgcatctctcagccacacagccccacccgcgccatgtcactcgccaccgccgccgccggagcgcaaccgttcgtccgctcctcctcctccgccgccgcggcgtcctcgtcgcggcccctgctcgccgtcgccgccgcccgccaccgccgcccgcatggatctctcgccgccgccgccgccgcggcaaggcggcgtcgtcgtcgtccgctcctccaggtgcgcgcggcaaggacggagtccacgggcgtctccgtcgggttccgcgcgccccagttcgagctcccggagccactgacggggaagctctggacattggatgacttcgaaggcaaccccgcgctgctggttatgtttgtatgtaatcactgtccattcgtaaagcatctcaaaaaagatattgcgaagctcacctcattctacatggagaaagggcttgctgctgttgccatatcctcgaactcaattgtgacacacccacaggatggtcctgattacatagctgaggaagcaaaattgtataaatactctttcccgtatctatatgatgagtctcaagaagttgctaaagcttttcgagccgtctgcacgccagagttttacttgttcaaaaaggatggacgaaggccatttgagcttttctaccatgggcagtttgacgattcaagaccgagtaacaacgtgccagttaccggaagggatttaagtcgtgcgattgattgtgcacttagtggacaagagctaccttttgtgccaaaacccagtgtcgggtgcagcatcaaatggcacccatgaagagcgtattgcattgtcatgtgctggaatatagatgtttttcccccttaaattgaaggttgaacatggggattgaggtgagccatgctctctactactagaagtatggaagcacacacatagtagatttatgatagctaatttcacatagtagatttatgatagctaatttataatgtaatttttaagggaaatagatgcagttgaggccttgtggagctgattcttaacgttgtgggggctgttcaacttgagagttgcaaaactagacatgaatggcgtggatagtgttatgttgtgtgctggtgtctcatcttggccggaaaaagaaaaactgatggatgtaactggtatttgtgcaacaatgggataatgcacacaagtacaataacccattattatggctaacacaacacccacgggtgaaaattaaagatgagggctatcgagttctcctccccactgcttccatttgtatccatgtctcggctcgcctatggacgctgcttagctctggatagcattggcggatctagagggtgatcccaactccagaggcattcgcacggtacgctgggcgactgggcgtccagcaaccgtgctgaacaaagaagagatggagagcactgcacagcagagatagctcccagcccagcaaccgcctgaaagacgtcttgttgataaccgaaggagagcacggaataaggatgtgtttagttccacgctaaaattagaagtttgactaaaattgaaagtttgaagaaaaaagttgaaagtttatttgtgtagtgaagttttgatgtgatggaaaagttgaaagtttaaagaaaaagttaggaactaaacaagggctaaagcagagtctatgcactttctactgcatgcactgcagtagaacaccttgggcgtccgctggttagacgcgtgtctaccatgcatacaaaaccac

SEQ ID NO: 4835 - DNA, 1277 bp, Triticum aestivum
tagcagcagcagagaagggaagggaagagcagagcgcgccatgtccctggtcgccgcgtgcgccgccggagcgcgcgcctccctgctttcctcctccccgtcgtcctcgtcccgcccatgcccggctctcgcccaccacagccgcgcgtataggtcccttgtctcgccggcggcgagcaggggaggccgccgcagtacgcgtctccgggtgcgcgcagccaggctggagtccaccggcgtctccgtgggcttccgtgcaccccaatttgagctcccggagcccctgacggggaaaatctggacactggatgacttcgagggtagccctgctttgctggttatgttcatatgcaatcactgtccatttgtaaaacatctgaaaaaagatattgcaaagctcacttcattctatatggagaaaggacttgcttctgtcgccatatcctcaaattcaattgtgacacatccccaggatggccccgagtacatggcggaggaggcaaaattgtttaaatacccttttccttatttgtatgatgagtctcaagaagttgctaagggttttcgagcagtctgcacaccagagttctacttgttcaaaaaggatgggcgaaggccatttgaacttttttaccatgggcaatttgatgattcaagacccagtaacaatgtgccagtcaccggaagagatttaagccgtgcaatcgactgtgcacttagtggccaagaattgcctttcgaccaaaaaccaagtgtcgggtgcagcatcaagtggcacaagtgaagagcttgttccgttgacgacaagcagatgatttttgtttttctccctcgaattgaaacacgcgatcaagtgctgacgtttctgttggcgcttggtggagcggacttatgcgccggtggtgattgttggggatcagaattgcggataaacagattgttggcgtcggaggttgttttgttgtgtattacagacaaagtagcagtgcagagcctggcagcccaaattctacccgtagctctctgaggggcttaattagaactgctgtgataaacatacacaaggaaatagtaccaactgttgatgtatcagtacttcaaacctatgtggaccactgccctactgctatatggtttgtagatgacaaactaaccagcatataaacagagagcatcagctaaagaagatctgtattggttcaattctgtaatgaaataaacactaccacatgcaaatctttcttaagacatcaaattatgaaacacaagtcacttta

SEQ ID NO: 4836 - DNA, 820 bp, Saccharum officinarum
aaccctttcgcccacacgacagcaccgcagccggaggaggtgggaaaggcggcgggggcggcggcggcggcggcggcagcggcggcggcagcggcagcggctaggaaaccgtggaagctagagccatggtggtacggatccggcttgcacggttcgggtgccggaaccggcccttctaccgggtgatggccgccgacagccgctccccgcgcgacggcaagcacctcgaggtcctcggctactacaacccgctcccagggaaggatggaggcaagaggatgggcctgaaattcgaccgggtgaagtattggctgtcagttggggcacagccatcagatcctgtgcagagcattctctttcgtgccggacttctgccaccacctccaatgctagctatgtcacggaagggtgggccacgtgataggcgcccggttcatccaatgactgggcgtcccttggatcttgagggcgtcacaattgtcgatgactccaatgctcctgaaggcgatgctgaagatcctacagatgaggtggcttcataagccttttatattagcatatgaaaatatgatgtattttctatttagtatatgtagtggtgctgcaaaagaaaacttgtttgttgtgcttctgataagattttgagtactagtacaatatggcaaacttttagacaggtaatctttcatccaattttcttctaaaaaatggcagtgccattgtttgttctcctagaaaatgtaaaaccaatgccattgtgtgcatctgtagctcttgttctgcagcaccatcagcttgtggtctctaatattctctgcac

SEQ ID NO: 4837 - DNA, 730 bp, Panicum virgatum
  misc_feature (645)..(645): n is a, c, g, or t
  misc_feature (650)..(650): n is a, c, g, or t
  misc_feature (680)..(680): n is a, c, g, or t
  misc_feature (694)..(694): n is a, c, g, or t
  misc_feature (715)..(715): n is a, c, g, or t
agaatctcgcttgcacacgacacgcgacgaccgcagcgccgccggaggtgggaagaaggcggcgccggcgccggcgaggaattcaaggaagactaagccatggtggtccggatccggctggcgcggttcgggtgccggaaccggcctttctaccgcgtgatggccgccgacagccgctccccgcgcgacggcaagcacctcgaggtcctcggctactacaacccgctcccagggcaggatggtggcaagaggatgggtctgaaattcgaccgggtgaagtattggctctcagttggggcacaaccatctgatcctgttcagcgtattctgtttcgggctggacttcttcctccacctccaatgctagccatggcacgtaagggtgggccccgtgataggcgccccatccatccaatgaccgggaaacccttggatcttgagggcgtcacaatagttgatgactccaatgctcctggaggcgatgctgaagaacctaaagatgaggtggcttcataagtcttttgctttagcatgtgaaaatgatgctagattttgtatcttagcatatgcagtgatgctgcaagagaaaacaaacatgtttgttgttgctctgacaaacctgagtactcgtatgatgtggcaaanttttngacatgtattgtttcatccattttgttctncaaaatgacagtantgttgttttcctcctaaatanaatgccgtttctgtg

SEQ ID NO: 4838 - DNA, 744 bp, Cenchrus ciliaris
gagaaggcggcggcgccggcaaggaaatcggaagccaaagccatggtggtccggatccgtcttgcgcggtttgggtgccggaaccggcccttctaccgcgtgatggccgccgacagccgctccccgcgcgacggcaagcacctcgaggtcctcggctactacaacccgctgccagggcaggacggtggcaagaggatgggtctgaaattcgaccgggtgaagtattggctgtcagttggagcacaaccgtcagatccagttcaacgtattctctttcgggctggactccttcccccgcctccaatgcttgccatggcccgtaagggtgggcctcgggataggcgccccattcatccaatgactggaaaacccttggatcttgagggtgtcacaatagttgactccgatgctcctgagggtgatgatgaagaacctaaagatgaagtggcttcataaatcttttgttttagcatattgaaattatgctaaatttccattttagcatttaagtagtggtgtgctggaagagaaaacttgtttgttgtactcgtatgatgcggcaaacttttagaaatgtaatgtttcatccattttgttcgaaaaatgttaataccgttgtttttcctccaaaatacaatgctattgtgtagcacgtctgtagctctcattccgatgtaccatcctggatttgcctaataaggtttgcctctgcaatggaatatgtgcaacttgatgatttttgta

SEQ ID NO: 4839 - DNA, 701 bp, Zea mays
tattgaagtccattctgttggcatcgtcccatctcccttgaaccctttcgcccacaccacagcaccgctgccgaaggtgggaaagaaggcggcggcggaggcaccggcaccggcaccgcctaggaaaggaaaccgaggaaactacagccatggtggtacggatccgtctggcgcggttcgggtgccggaatcggcccttctaccgggtgatggccgccgatagccgctcccctcgagacggcaagcacctcgaggtcctcggctactataacccgctcccagggaaggatggaggcaagaggatgggcctgaaattcgaccgggtgaagtattggctgtcagttggggcacagccatcagatcctgtgcagagtattctctttcgtgccggacttctgccaccacctccattgctagctatggcacggaagggtgggccacgtgataggcgccccattcatccaatgactgggcgccctctggatctcgagggtgtcgcaattattgataattccaatgctcctgaaggcgatactgaagtgcctacagatgaggtggctcaataagccttttgtattagcatagcatatgtagcggtgctgcaaaagaaaacttgtttgatgtgcttgtggcaagactttgggtactcgtacaatgtggcaaacttttaaacaggtaactttcatccatttctcttctta

SEQ ID NO: 4840 - DNA, 793 bp, Pennisetum glaucum
ccttgaacccttgcgcccaccatacgacgaccagcagcgcagccgtagagggtgagaaggcggcgcgccggcaccggcgaggaaatcaaggaagccgaagccatggtggtacggatccggctggcgcgcttcgggtgccggaaccggcccttctaccgcgtgatggccgccgacagccgctccccgcgcgacggcaagcacctcgaggtcctcggctactacaacccgctgccagggaaggatggtggcaagaggatgggtctgaaattcgaccgggtgaagtattggctgtcagttggggcacaaccgtcagatccagttcagcgtattctctttcgggctggactccttcccccacctcctatgcttgccatggcccgtaagggtgggcctcgtgatagacgccccattcatccaatgactggaaaacccttggattttgagaatgtcacaatagtgaactccgatgctcctgagggtgatggtgaagaacctaaagatgaagtggcttcataaatcttatgttttagcatatggaaactatgctaaatttctattttaacattcatgtagtggtgtgctgcaagagaaaacttgtttgttgtgcttctgacaagactgagtactcgtatgtcgtatgatgcagcaaacttttagacatgtaatgtttcatccattttgttctaaaaaatggcaataccgttgttttccctccaaaatacaatgctattgtgtagtatgtctgtagctctcattctgttgtaccatcctgcatttgccaaataaggctcgc

SEQ ID NO: 4841 - DNA, 823 bp, Oryza sativa
ccaaaacccttgctcccacaggagtgaacacgacgcgacccgagccggagaaggggaagggaaggcggcggcggcggcggcggaggaggaggaggcgcgaggggaggcgagcatggtggtgcggatccggctggcgcggttcggctgccggaaccggccgttctaccgggtgatggccgccgacagccgctccccgcgcgacggcaagcacctcgaggtcctcggctactacaacccgctccccgggaaggatggtggcaagaggatggggctgaaattcgacagggtcaagtactggctgtctgttggtgctcagccatcagatcctgtgcagcgcatcctttttcgagctgggcttctgcctccacctccaatgctagctatggctcgaaagggtggacctcgtgataggcgcccaattcatccgatgactgggcgccccttggatcttgagggtgtcacggttgttgatgactccaatgttcccgaaggtggtgctgaggaacctgtgtcagaggagtgatgctgcagtaggtctccacttgtttgttgtgcctctgataagatcatgagtactgtacaatatggaaacttcctaatcatgtaatcttccattgttttctaataatttacaaggtcgtagtgctgcactatgagttagctgttctcaaccctttctgaaatggatttttttctgagttctcatggactagcttacagttcacacatgttttgttcagtcaagggtatcttgaaaggtaggcaatatacagagagctaccataagcgtcacaattccagcttgattattcctttttgtgca

SEQ ID NO: 4842 - DNA, 805 bp, Setaria italica
ctcgctcgcactctctcatcccctcccttgaacccttgcgcccacacgacgacccgcagcgcagccgtaggaggtgagaaggcggcggcgccggcgccggcgaggaaatcaaggaagccgaaaccatggtggtccggatccggctggcgcggttcgggtgccggaaccggcccttctaccgagtgatggccgccgacagccgctccccgcgcgacggcaagcacctcgaggtcctcggctactacaacccgctgccagggcaggatggtggcaagaggatgggtctgaaattcgaccgggtgaagtattggctgtcagttggggcacaaccatcagatccagttcagcgcattctctttcgggctggactccttcccccacctccaatgcttgccatgactcctaagggtgggcctcgtgataggcgccccattcatccaatgactggaaaacccttagatcttgagggtatcacaatagttgactccgatgctcctgagggcgatgctgaagaacataaagatgaagtggcttcataaatcttatcttttagcatttgaaaatgatgctaaatttctattttagcatttatgtagtggtactgcaagagaaaacttgtttgttgtgcttctgacaagactgagtactcctatgatgtggcaaacttttagacatgtaatgtttcatccattttgttctaaaaaaatggcaggaccgttgtttttcctcctaaatacagtgctattgtgtgcatctgtagctctcatcctgttgtaccatcctgcatttgctaaacaaggttcgc

SEQ ID NO: 4843 - DNA, 771 bp, Pseudoroegneria spicata
  misc_feature (72)..(72): n is a, c, g, or t
  misc_feature (102)..(102): n is a, c, g, or t
  misc_feature (114)..(114): n is a, c, g, or t
  misc_feature (120)..(120): n is a, c, g, or t
  misc_feature (123)..(123): n is a, c, g, or t
  misc_feature (135)..(135): n is a, c, g, or t
  misc_feature (222)..(222): n is a, c, g, or t
  misc_feature (276)..(276): n is a, c, g, or t
  misc_feature (300)..(300): n is a, c, g, or t
  misc_feature (303)..(303): n is a, c, g, or t
  misc_feature (324)..(324): n is a, c, g, or t
  misc_feature (351)..(351): n is a, c, g, or t
  misc_feature (369)..(369): n is a, c, g, or t
  misc_feature (378)..(378): n is a, c, g, or t
  misc_feature (390)..(390): n is a, c, g, or t
  misc_feature (393)..(393): n is a, c, g, or t
ccgttgctgtcgccggagaaccgcaggccggcggcgaggaagaagaagaagaaagcgtcgatcatggtggtncggatccggctcgcgcggttcggctgccgnaaccggcccttntaccgngtnatggccgccganagccgctccccgcgcgacggcaagcacctcgaggtcctcggctactacaacccgctccccgggaaggatggtggcaagaggatgggnctcaagttcgaccgggtcaagtactggctatctgttggggcacagccatcagancccgtgcagcgtatcctcttccgngcnggtgttctgcctccacctccnttgctagctatgggccggaagggtggncctcgtgacaggaacccnattcatccnatgactggccgnccnttggatcttgagggtgtcacaattgttgatgatcccagtgctgctgaaggtgatgctgaagaaccttcattggaggcgtgatagtttttctgttgtggaatatggaggtgtgctgcaagacagaagaatttgtttgttgtgctcctgataagactatgactatatggcaacactttagtcatgtaactcatggtttgttagcctttgctgcaccatgagttagccagcccagcccttttgaatggattgtggatggtataaattgcacctcgaatggatttctgcattcctttgggatgctcaagttgtgacatattgcttgattattatgtatctaaaaaggtgacatatattgtcttgtgtgatcctttccttgca

SEQ ID NO: 4844 - DNA, 896 bp, Brachypodium distachyon
cgggaggggaaaccggaaaacacacactgaaatccccaacctaaaacccttcttccagacgacctcaccccggagaaagcgaaggcgaaggcggcgagggtgaagaaagcatcatggtggtgcggatccggctcgcgcggttcggctgccggaaccggccgttctaccgggtgatggccgctgacagccgctccccgcgcgacggcaagcacctcgaggtcctcggctactacaacccgctccccgggaaggatggtggcaagagaatggggctgaaattcgaccgagtcaagtactggctgtctgttggggctcagccatcagatcctgtgcagcgcatcctcttccgtgctggggttctacctccacctccattgctagctatgggccggaagggtggacctcgtgataggaaccccattcatccgatgactgggcgtcccttgaatctggagggtgtcacaattgttgatgatcccaatgctactgaaggggatgctgaagaatctacagaacctacgttggaggcgtgattgattttctgttatgccatatagattggtgctgcaagacaaaagaacttgtttgttgtgcttctgataagattatgagcgacattttagttatgtaactctccactgtctgcctttctagaaatgctgcaccatgagttctactctgttgtctcctaatatgcttccttttgaatggattatgcatggtataaattgcaccttcaatgagttcctgtgagttgttaatggatgctcagtttcacaaataatcgttctgtaaagcacacaacaacaatttgggaagaatcaacatatgcttgacaattccaatatgtgatccaatcagatcttatgctttatctgatctagttgcaaaggcca

SEQ ID NO: 4845 - DNA, 849 bp, Triticum aestivum
aacccaaaacccttctcccccacacgacccctcacccggagaaccgcaggccggcggcgaggaagggaagaagaaagcgtcgaccatggtggtccggatccggctcgcgcggttcggctgccgcaaccggcccttctaccgggtgatggccgccgacagccgctccccgcgcgacggcaagcacctcgaggtcctcggctactacaacccgctccccgggaaggatggtggcaagaggatggggctcaagttcgaccgggtcaagtactggctatctgttggggcacagccatcagatcccgtgcagcgtatcctcttccgtgccggtgttctgccgccgcctccgttgctagctatgggccggaagggtggacatcgtgacaggaaccccattcatccgatgactggccgtcccttggatcttgagggtgtcacgattgtcgatgatcccaatgctgctgaaggtgatgctgaagcacctacagaaccttcgttggaggcgtgatagattctgttctggcatattgagtggtgctgcaagacaaaagaatttgtttgttgtgcttctgttaagattatgagcacgtagtgtatgatcttcaacaatttcgtcatgtaactctgctttgttagcctttgctgcaccatgggttagccagccgtctccagtctactacgccgtgtcctaatatggttccttttgaatggattatgcaatttctgcattccttttggatgctcaagttgacaaataataattcaagtaaagtgctggactgggtgccccataatcatgtgcgcaacatatgcttgatagccatgtatgattattcctgctgtgtgatccaa

SEQ ID NO: 4846 - DNA, 857 bp, Brachypodium distachyon
ggaaaacacacactgaaatccccaacctaaaacccttcttccagacgacctcaccccggagaaagcgaaggcgaaggcggcgagggtgaagaaagcatcatggtggtgcggatccggctcgcgcggttcggctgccggaaccggccgttctaccgggtgatggccgctgacagccgctccccgcgcgacggcaagcacctcgaggtcctcggctactacaacccgctccccgggaaggatggtggcaagagaatggggctgaaattcgaccgagtcaagtactggctgtctgttggggctcagccatcagatcctgtgcagcgcatcctcttccgtgctggggttctacctccacctccattgctagctatgggccggaagggtggacctcgtgataggaaccccattcatccgatgactgggcgtcccttgaatctggagggtgtcacaattgttgatgatcccaatgctactgaaggggatgctgaagaatctacagaacctacgttggaggcgtgattgattttctgttatgccatatagattggtgctgcaagacaaaagaacttgtttgttgtgcttctgataagattatgagcgacattttagttatgtaactctccactgtctgcctttctagaaatgctgcaccatgagttctactctgttgtctcctaatatgcttccttttgaatggattatgcatggtataaattgcaccttcaatgagttcctgtgagttgttaatggatgctcagtttcacaaataatcgttctgtaaagcacacaacaacaatttgggaagaatcaacatatgcttgacaattccaatatgtgatccaatcagatcttatgct

SEQ ID NO: 4847 - DNA, 917 bp, Triticum aestivum
ccggcggcgaggaagggaagaagaaagcgtcgaccatggtggtccggatccggctcgcgcggttcggctgccgcaaccggcccttctaccgggtgatggccgccgacagccgctccccgcgcgacggcaagcacctcgaggtcctcggctactacaacccgctccccgggaaggatggtggcaagaggatggggctcaagttcgaccgggtcaagtactggctatctgttggggcacagccatcagatcccgtgcagcgtatcctcttccgtgccggtgttctgccgccgcctccgttgctagctatgggccggaagggtggacatcgtgacaggaaccccattcatccgatgactggccgtcccttggatcttgagggtgtcacgattgtcgatgatcccaatgctgctgaaggtgatgctgaagcacctacagaaccttcgttggaggcgtgatagattctgttctggcatattgagtggtgctgcaagacaaaagaatttgtttgttgtgcttctgttaagatcatgagcacgtagtgtatgatcttcaacaatttcgtcatgtaactctgctttgttagcctttgctgcaccatgggttagccagccgtctccagtctactacgccgtgtcctaatatggttccttttgaatggattatgcaatttctgcattccttttggatgctcaagttgacaaataataattcaagtaaagtgctggactgggtgccccataatcatgtgcgcaacatatgcttgatagccatgtatgattattcctgctgtgtgatccaatcgatgctttatctgatgtggttgcaaaggtgacatatattgcttgattgtgtagcttaaaaaggtgcatcttgtcttgtggcatcctcgtggataccctgtgacgtttgtttgtgtt

SEQ ID NO: 4848 - DNA, 874 bp, Hordeum vulgare
cacgacctcacccggagaaccgcaggccggcggcgaggaagaagaaaaagaagaaagcatcaccatggtggtccggatccggctcgcgcggttcggctgccgcaaccggccgttctaccgggtgatggccgccgacagccgctcgccgcgcgacggcaagcacctcgaggtcctcggctactacaacccgctccccgggaaggatggcggcaagaggatggggctcaagttcgaccgggtcaagtactggctatctgttggggcacagccatcagaccccgtgcagcgtatactcttccgtgccggtgttctgccaccaccaccgttgctagccatgggccggaagggtggacatcgtgacaggaaccccattcatccgatgactggccgtcccttggaccttgagggtgtcacgattgtcgatgatcctaatgctgctgaaggtgatgctgaagcatctacagaaccttcgttggaggcgtgatagattttctgttctggcctatggagtgctgctgcaagataaaataatttgtttgttgtgcttctgataagattatgaacacgtagtgtacgatatgcaacaatcttgtcatgtaactctgctttgttaggctttgctgcaccatgggttatccggccgtctccagtctactatgtcgtgtcctaatatgattccttttgaatggattatgcaatttgcgtcttgaatgaatttctgcattccttttggatgctgaagttgacaaataaaataaaaaaaacaaatatatattctactttttctttctccccctaagactagctcttcctctcatctctccttcctgcctccaccctccgtccctgtcttgtagctcgcgtcgtggggggc

SEQ ID NO: 4849 - DNA, 774 bp, Hordeum vulgare
aacccaaaacccttctttccccacgacctcacccggagaaccgcaggccggcggcgaggaagaagaaaaagaagaaagcatcaccatggtggtccggatccggctcgcgcggttcggctgccgcaaccggccgttctaccgggtgatggccgccgacagccgctcgccgcgcgacggcaagcacctcgaggtcctcggctactacaacccgctccccgggaaggatggcggcaagaggatggggctcaagttcgaccgggtcaagtactggctatctgttggggcacagccatcagaccccgtgcagcgtatactcttccgtgccggtgttctgccaccaccaccgttgctagccatgggccggaagggtggacatcgtgacaggaaccccattcatccgatgactggccgtcccttggaccttgagggtgtcacgattgtcgatgatcctaatgctgctgacggtgatgctgaagcatctacagaaccttcgttggaggcgtgatagattttctgttctggcctatggagtgctgctgcaagataaaataatttgtttgttgtgcttctgataagattatgaacacgtagtgtacgatatgcaacaatcttgtcatgtaactctgctttgttaggctttgctgcaccatgggttatccggccgtctccagtctactatgtcgtgtcctaatatgattccttttgaatggattatgcaatttgcgtcttgaatgaatttctgcattccttttggatgctgaagttgacaaataa

SEQ ID NO: 4850 - DNA, 2265 bp, Secale cereale
tctgattcatcagatgttgaagatcgttcagttgataagggctaccctggcaatgatactacgtcaccaaatgtggaggcagggacagatgtcagagaaacacaaagcattctgttagagagaatcgcaagcgagatgaaccgactcaaattttacatcagccatgcacagaaccttccttttatcgagaacatggagaagagggttcaaggtgctacaaaactacttgatggtagcttggagcgttgctttgtggttggtctagaacatcgcgacgcaaaagtaatatacaactgtttgcgcgcttatgctgccattgacaacacatcttcagctgaagagcttttccgtacaacagtggtctccccgttgattcagaaaattgtccctcaaaactatgcaaaagctgtttctggggtatcttctgatgacctggaggatgactatgagcagataatgcaatgtgtagaaaaagattgcaaatttattttggaaatatcttcatcagcaaactctggacttcatatttttgattttctggccaattcaatactcaaggaagtccattctgcaatcatgaagggaaagcctggggcctgttctcctggaaaacctaaagacttcctgagaaactacaaagcgagcttaaagtttcttgactttcttgaaggctactgtccttccaagtctgctgtaacaaagttccgctctgagcctgcttacacagatttcatgcgactgtggcatgttaatgtctacttttcactgagattccaggaaattgctggtggtcttgatggtgctcttacagccacaattagccctgtcggagtgaatgagaaccaaatgaagcagaagacattattgttgaagcaaagtattaagctactagaaagtttgcagtcctgctggagtgatgatgttcttgttttctctcactctgataaattcctcagattgtccttgcagcttatttcaaggtatacaacatggctttcttctggtctggctgcgcgtaatgcttctgatgggagctcgagttctcctgcagattctgagtgggcactctctgtacccgtggaggatttcatatatgtaattcatgatgtaaatgctgtaattggcgagctttcagaatcaagcgactttgtcggacgtgtgaatcaattgctagcatcatgccccattgaagtacttgcccttgtgaaacaaagtatattgcaagctgttgagcctttgaaggagttgttgcctagcgtaatggatgtcattattggggtcgatagttaaaaggtactaatgaggatctgaaacacctgaagggaataacagccacatataggatgaccaataaacttcctgtgaggcattctccgtatgtgtctgggattttgcatccacttaaggtgtttcttgaaggaggcaacccaaaacccttctccccccacgacctcacccggagaagcgaaggccggcggcgaggaagaaatcatggtggtccggatccggctcgcgcggttcggctgccggaaccggcccttctaccgggtgatggccgccgatagccgctccccgcgcgacggcaagcacctcgaggtcctcggctactacaacccgctccccgggaaggatggtggcaagaggatggggctcaagttcgaccgggtcaagtactggctatctgttggggcacagccatcagatcctgtgcagcgtatcctcttccgcgccggtgttctgcctccacctccgttgctagccatgggccggaagggtggagctcgtgacaggaaccctattcatccgatgactggccgtcccttggatcttgacaatgtcacaattgttgatgatcccaatgctactgaaggtgatactgcagaaggtgatgctgcagaaccttcattggaggcgtgatatattctccgttgtggcgtatggagttgtgctgcaagataaaataatttgtttgttgtgcttctgataagattatgggcacgtagtgtacgatgtgcaacaatttagtcatgtaactctgctttgttagcctttgctgcaccatgggttagccagccgtctccagtctactacgttgtgtcctaatatgaccccttttgaatggattatgcaatcgcagctcgaatgaattacagattactgcattccttttagatgctcaagtttacaaataatcttcaagtaaagtgttgaactggtgccccataatcatccgaagagaaccaacatatgcttgatagttatgta

SEQ ID NO: 4851 - DNA, 1428 bp, Oryza sativa
agatgaacaagtccaacaatgaaaagagaactgaataaaaaccagagtataaagaggtactagaaggaaaaataggacttgatcggcagggattgctgttgtagcaattgaactgcttcagccagcatagagaatttcttccatcctcttctctctcactcttcttctctctggggctccgggcaggacggcgccgccggccgatgggtggggaggaagccggtgacggggaagcaaggcaacctcctctctgtgctcgccgacgaggaggagcggcgggcgaccgcggcggcggagctggagccacacgcgcggcaggcggaggtcagtgagctccttccaagtccaaatacggcgatgaggcgggaggaacgcggcgagaatagctggagtgagaccaacgaggcccatctctctaaaaaagcccattacggcccacacaacaaaagtaacaagcccattaccgaccatctcgctaaaaagcccaacaagccctatcttgctaagaggcccacctctctaaaatcatggaccaacttgctaaaaaaagcccaaaaaaggcccatatacctgccctttcgtctacctccagttcctctctctctctctcctctcctaaaaccctcgcctttttctgagactcagagcggcggcgagcgccggccggtcgccggcggaggagttggtgtggagagggcggggagatggttgtccggatcaggctggcgcggttcggctgccggaacaggcccttctaccggctcatggccgccgacagccgctccccgcgcgacggcaagcacctcgaggtcctcggctactacgacccgctccccgggaaggatggtggcaagagaatggggttaaaattcgaccgggtgaagtattggctatcagttggagcacagccatcggatcctgtggagcgcatcctctaccgtgctggaattctacctccacctccaatgctagctatggcccacaagggtgggcctcgcgacagacgtcctattgatcccatgactgggcgccccttagaccttgagggtgtcacagttgttgatgattctcatactcccaagagtggtgatggagcacctaacgaggagacagcatagatgaggcatgatgatatatctgttttagcatattgtgtggttttgcaagattaaaaagtactgtttgtggcctttctgatgggtgtttgagcctgtgactagtatgttgtgacctttcttgctgaccggctttattgatctatgctcctgtcatctattctcaggaacacgaacctggaaacatgagttgttctttttgataaaatttgtatgttgtgttccaatgaattttacaaacttgcatgcattatatttctctcggtctttattcacttgttggcttcttcaagggacaagggtagagtaaggc

SEQ ID NO: 4852 - DNA, 446 bp, Triticum aestivum
gggaaagaaggcggcggcggaggcaccggcaccggcaccgcctaggaaaggaaaccgaggaaactacagccatggtggtacggatccgtctggcgcggttcgggtgccggaatcggcccttctaccgggtgatggccgccgatagccgctcccctcgagacggcaagcacctcgaggtcctcggctactataacccgctcccagggaaggatggaggcaagaggatgggcctgaaattcgaccgggtgaagtattggctgtcagttggggcacagccatcagatcctgtgcagagtatctctttcgtgccggacttctgccaccacctccattgctaactatggaacggaagggtgggcacgtgataggcccccattcatccaatgactgggcccctctgggttcgaaggtgtcgcaattattgataatccaatgctcctgaaggc

SEQ ID NO: 4853 - DNA, 819 bp, Cenchrus ciliaris
  misc_feature (91)..(91): n is a, c, g, or t
  misc_feature (147)..(147): n is a, c, g, or t
  misc_feature (192)..(192): n is a, c, g, or t
  misc_feature (219)..(219): n is a, c, g, or t
  misc_feature (246)..(246): n is a, c, g, or t
  misc_feature (267)..(267): n is a, c, g, or t
  misc_feature (270)..(270): n is a, c, g, or t
  misc_feature (332)..(332): n is a, c, g, or t
  misc_feature (334)..(334): n is a, c, g, or t
  misc_feature (339)..(339): n is a, c, g, or t
  misc_feature (429)..(429): n is a, c, g, or t
  misc_feature (459)..(459): n is a, c, g, or t
  misc_feature (601)..(601): n is a, c, g, or t
  misc_feature (603)..(603): n is a, c, g, or t
  misc_feature (615)..(615): n is a, c, g, or t
  misc_feature (677)..(677): n is a, c, g, or t
ctccgcctcattctccatcccatccctctcggctcccccgaaaccctcggccttcccccaccacaacaacagctccgcaaaggcgaagggngcgaggagggagcggagatggtagttcggatccggcttgcccggttcggatgccgnaacaggcccttctaccggctgatggccgccgacagccgctccccncgcgacggcaagcacctcgaggtcctnggatactacaatccgctccccgggaangatggtggcaagaggatgggnttnaaatttgaccgggtgaagtattggttgtcagttggggcacagccttcagatcctgtggagcncntactntttcgtgcaggaattcttcctccacctccaatgctagctatggcacacaagggcgggcctcgggacagacgtcctattgatcctatgacnggacgccctttggacattgaaggcctcacnattgttgatgatcctaatattcaggatggtgaaaatggagtatctgttgaggagacggcttgagtgaggaatgataagtttatgctttggtataactatgctagataaaagttgttttagcatatgtgccctttagtttggntngggaacttgttnctgtttcacaatgtgagaacttttcgtgctaagtaacttctgaatgatcattactttatggntccaaagtttagttctcagtatgcttctaattttgctttttcttaaatattcttcaccatatctctgtggaatttgaacctgaaactgcacagatttatctttgttgactatttattcataggttgtatgttggatttttaa

SEQ ID NO: 4854 - DNA, 820 bp, Setaria italica
atgctttgctcctccccaaacggagctagcaacgaacagcgaaccaacgggacgaatgaaacgggggtgccggcttgcttacttgaactgttgaacaagacgatgccagggacgaaggcgcgccgctctgctccgcctccgtgttccctccattccattccatccctctcccgaaaccctcgccttcccccaccacaaaaacagctacgcaaaggcgaagggggcgaggagggagcggagatggtggtgcggatccggctggcccggttcggatgccggaacaggcccttctaccggctgatggccgccgacagccgctacccgcgcgacggcaagcaccttgaggtcctcggatactacaacccgctccccgggaaggatggtggcaagaggatggggttaaaatttgaccgggtgaagtattggttgtccgttggggcacagccttcagatcctgtggagcgcatgctctttcgtgcaggaattcttcctccacctccaatgctagctatggaacacaagggcgggcctcgggacagacgtcctattgatcctatgactggatgccctttggacattgaaggcctcacaattgttgatgatcctaatactctggatggtgaaaatggagcatcggttgaggagacggcttgaatgaggcatgaaaattttatgctttagtataactatgctagataagagttgttttaccacttgtgccctttagttgggtcaggagcttgttactgtttcacaatgtgagaagctttttgctaagtaacttctgaacgatcattactttatgcatccaaaagtttag

SEQ ID NO: 4855 - DNA, 786 bp, Panicum virgatum
gggactccatttcaataaaaaaaaagaaaacatttccatccctctgaccctctcccaaaaccctcgtcttcccccactggccaccgcatcaacagctccgaaaaggcgaagggacgaggagggagcggggatggtcgtgcggatccggctggcccggtttggatgccggaacaggcccttctaccggctgatggccgccgacagccgctccccgcgcgacggcaagcacctcgaggtgctcggatactacaacccgctccccgggaaggatggtggcaagaggatggggttaaaatttgaccgtgtgaagtattggttgtcggttggggcacagccaacagatcctgttgagcgcatactctttcgtgcaggaattctacctccacctccaatgttagctatggcacacaagggcgggcctcgggacagacaacttattgatccgatgactggacaccctttggacattgatggtctcgcaattgttgatgaccctaatgctccagatggtgaaaatggagcatcgattgagaagacggcttgaatgggcatgataatattatgcattagtataactatgctacatatgagttgttttagcatttatgccctgcaggttggtttggtagcttgttactgttgcacaatgtgagaactttttgccaagtgacttctgaacaataattactttatgcaactgaagtttagccctgaaaaagcttctattttgctttttcttgaatattcttcaccatacctctatggaacgtggacctgatactgcac

SEQ ID NO: 4856 - DNA, 710 bp, Panicum virgatum
ccctctcccaaaaccttcttcccccaccggccaccgcatcaacagctccgaaaaggcgaaggacgagaagggagcggggatggtcgtgcggatccggctggcccggttcggatgccggaacaggcccttctaccggctgatggccgccgacagccgctcccggcgcgacggcaagcacctcgaggtgctcggatactacgacccgctccccgggaaggatggtggcaagaggatggggttaaaatttgaccgactcaagtattggttgtcggttggggcacagccatcagatcctgtcgagcgcatactctttcgtgcaggaattctacctccacctccaatgttagctatggcacacaagggcggccctcgggacagacagcttattgatccgatgactggacaccctttggacattgaaggtctctcaattgttgatgatccgaatgctccggatggtgaaaatggagcatctattgagaagacggcttgaatgggcatgataatattctgctttagtataactatgctagatatgagttgttttagcatttatgccctgtagattggtttggtagcttgttactgttgcacaatgtgagaactttttgccaagtgacttctgaacaataattactttatgcatctgaagtttagttctgaaaaagcttctactttgctttttcttgaatattcttcaccatacctct

SEQ ID NO: 4857 - DNA, 3221 bp, Zea mays
ctgccctgtcgccgagccattcgattcctctccgctgcccccaagcgagtcgccgccatttcgccgattcccggccgctgcctagggttttggtgccagcgcggtcggagggttgtgcctgtgggtcgcgttcccagtgtcgcgcgcggtggccgaaggtggagggaggagcggttctccggagaggaggtggaggtggtggctgcggagtgcggtctccacggagcgagtctaccagatgccgccgcggtctttgaggaggtagtgtggccgtgtggagtgaataggtggtggtggtggtggcggcggcggcagcgggactggcggaggcagccatgtttttcagcaggctcgatgactcgcccatgttcaggaagcagatgcaatcacttgaagaaggtgctgaattgctacgagagagatgtttaaagtttcacaaaggttgtcgaaaatacacggaaggactaggggaagcatatgatggagatattgcattcgcaagctcacttgaaacatttggaggggggcataatgatccaatcagtgtcacatttggagggcctgtcatgaccaaatttacaattgctttaagagaaattggaacatacaaggaagtattgcgctcccaggttgagcacatgctaaatgacaagctgctccagtttgtggacattgatttacatgaaatgaaggatgctaggaaacgttttgacaaggctacccttctttatgaccaggcacgtgaaaagtatttgtccttgaagaaaggtacaaggactgacgtagcaactgcagtagaggatgagcttcacagtgctaggtctttatttgagcaagctcgtttcaatctggtgactgcactttcaaatatcgaggctaagaaaaggtttgaatttttggaggctgttagtgggacaatggatgctcatcttcgttatttcaaacaaggatatgaactactacatcagatggaaccgtatatcaatcaagttcttgcttttgcacaacaatcaagagaaaggtctaactatgagcaggctgctcttcttgagaggatgcaagagttcaaacgacaaattgatcgtgaaagtcggtggtcaccaaatggaatgaatgattctcctaacggtgatggaatacaaacaataggtagaagttcacataagatgattgaggaagcaatgcagtcagcttcaaagggcaaggttcagaccattcgccaaggctatctatctaagagatcttcaaacttgagaggtgattggaaaaggaggttctttgtcctcgacagtcgaggaatgttgtactattatcgcaagcagaacagtagaccatctagtggatattctaaccaaagaactagcattccctcagaacatggttctgggttgctcagcagatggttctcttctcattatcatggaggcgtgcatgatgagaaatcggttgcacgtcatactgtaaacttgctaacatcgaccattaaagttgatgcagaccaatcagatctgcggttctgcttcagaataatttctcccacaaagaactacacgttgcaggcagagagtgcaatggatcagatggattggattgaaaaaattaccggcgtcattgcttctttgctgagctcccagtctcctgaacgacatcttatatcaagtcctaagggcagcagtcatcatcgaactgccagctcaagcagttcattcagtagctcaacagaacttgaacattcaataagtgaagattgtatgctggaaaaaaactcaggaagtggttatttcgagcattctgcaagagttgcacagcatcaccgaacaagcatgatgaaacctgacaagccaattgacttgcttaggaaggtggctggcaataattgctgtgctgattgtggtgcttcggagcctgattgggcatccctgaaccttggaattcttttatgcatagagtgttcgggggtacacagaaatatgggtgtgcatatatctaaggtaagatccctgacgcttgatgtcagggtttgggagcaatctgtaatcaatctctttcagtcaataggcaacacttttgccaattctgtctgggaagaaatgttaccttcatcaagctgtgttgaccatggtgatatttcaagggctgatggattagaaaacatgtcgcatggctttgcacccaagaagcctaaacaatctgattctattgcagtgaaggagaaatttattcatgccaagtatgctgagaaggatttcgtgcggaaacataacatggatgggattcaacttgcagaacagatgtgggacaatgtaagttcgaacaacaagaagggggtgtacagcttgatcgtggggtcaaatgccgacgtaaatttttcctatggtcatacatcattcaattcggctttgactctgggaaaagctctcctcctacaagagcaatcagcctctccatctaacggaagctctagatgttttgaccgcaatccactcgagaagggttgtaccggggattctgtttctcctgccagcacaagcgcccgtatagacgggccggacgattatgttgaaggattatctttgctccatctagcatgccgcgccgcggacctgggcatggttgagctgctcttgcagtacggcgccaatgtaaactccacagattcaagagggcggacgccgcttcatcacagcatcatgaaagggcgacatgtgtacgccaagctactgctttccaggggcgccgattctcaagccgcggatcgagatggtaggacagcgttacagtatgcaatcgacagcggaaccatagaggacgaagagatccttgttttgctagaggacccaagtagataaatcacgtaggtgtagtagtccaagtctcgagttcctgccgtcctgcggtggtgcattgtggctgccttttgcagtcacctggcacacacagggtccgaggatgccttgctagtattcagtctctgcctttgtggcaagaggaagttatagtttttctaggtctgtctgcggttttggtcgcgcttagggtaaaagtggcctgtttgtcgtggatgcagtttgcaagttgttggtttgcctttgtttgcagatgtcgcagtgtacacttgggaagtggctgccattgttgcgactgatgtacatatagcgatgtctgatacaggttatttatgcaagaatttagatcggtgaaaaaaatgtggctggctgtct

SEQ ID NO: 4858 - DNA, 2896 bp, Panicum virgatum
aagttggccgcggcggcgggggcgggctggcggaggcagccatgtttttcagcaggctcgatgactcgcccatgttcaggaagcagatgcagtcactagaagacggtgctgaattgctaagagagagatgtttaaagtttcacaaaggttgccgcaaatacacggaaggactaggggaagcatatgatggagatattgcattcgcaagttcacttgagacttttggagggggtcataatgatccaatcagtgttgcgtttggagggcctgttatgaccaaatttacaattgccttgagagaaattggaacatacaaggaagtactgcgctcccaggttgagcatatgctaaatgacaagctgctccagtttgtggacattgatttacatgaaatgaaggatgctaggaaacgttttgacaaggctacccttctttatgaccaggctcgtgagaagtatttatccttgaagaaaggtacaaggactgatgtagcaactgctgtagaggatgagcttcacagtgctagatcttcatttgagcaagcgcgtttcaatctggtgaccgcactttcaaatattgaggctaagaaaaggtttgaatttttggaggctgttagtgggacaatggatgcacaccttcgttatttcaaacaaggatacgaactactacatcagatggaaccatatatcaatcaagttcttgcttacgcacagcaatcgagagaaaggtctaactatgagcaggctgctcttgttgagagaatgcaagaatttaaacgacaaattgatcggaaaagtcggtggtcaccaaatggaatgaatgattcccctaacggtgatggaatacaagcaattggtaggagttctcataagatgattgaagcagcgatgcaatcggcttcaaagggcaaggttcagaccattcgacaaggttatctttccaagaggtcttcaaacttgagaggtgattggaagaggaggttctttgtcctcgacagtcgaggaatgctatactattatcgcaagcagaacagtaggccgtccagtggttattctaaccaaagaactagcactccctccgaacatggttctgggttgctcagcagatggttctcatctcattatcatggcggtgtgcatgatgagaaatctgttgcacgccatactgtaaacttgctaacatcgactattaaagttgatgcagatcaatcggatctgcggttctgcttcagaataatttctcccacaaagaactatacattgcaggcagagagtgcaatggatcagatggattggatagaaaaaattactggcgtcatcgcttctttgttgagctcccagtcccctgaacggcgtctgctgctgagtcctaagggcagcagtcatcatcgaactgccagcgaaagcagttctttcagtagctctacagaacttgaacattcaataagtgaagatcgcatgctggaaaagaactcagggagtggttatttcgagcattctgctagggctacacagcatcaccgaacaagcatgatgaagcctgataagccaattgacttgcttaggaaagtggcgggcaatggtaactgtgctgattgtggtgcgtcagagcctgattgggcatccctgaaccttggagttcttttatgcatagagtgttctggggtacacagaaatatgggtgtgcatatatctaaggtaagatctctgacgcttgatgtcagagtttgggagccatctgttatcaatctcttccagtcattaggcaacgcgttcgccaatactgtctgggaggaaatgctaccttcgttgagctgtgctgaccatggtgatatttcaagggctgatagattagaaaacacatcgcactgctttgcactcagcaagcctaaacaatctgatcctattgcagtaaaggagaaatttattcatgccaagtatgctgaaaaggattttgtgcggaaacataacatggatgagattcagctagcacaacagatgtgggataatgtaagttcaaacaacaagaaggggttgtacagtctgattgtggggtcaaatgccgatgtaaatttttcttatggacatacaccatttaattcggctttgactctgggaaaagcgctcctcctacaagagcaaccaggttcaccatcaaatggaagctctagatgttttgaccgcaatccgctcgagaagggttctcctggggactctatttctcctgccagcacaagtgcccgtatagacgaattggatgattatgttgaaggattgtctttgctacatctagcatgccgtgttgcggacctgggcatggttgagctactcctgcaatatggcgccaatgtaaattctacagattcaagagggcgaacaccacttcatcactgcattatgaaaggcagacatttttacgccaagctgctgctttccaggggggctgattctcaagtcacggaccgagatggtagaacagctttacagtatgcaattgacagcggaaccatagacgatgaagagatcctcgttttgttagaggacccaagtagataaatcatgtaggtagtgaactctccagtactggcggtactgcgcgcctttgagacctcctactgcagtcacctggcacggcgccaagtatacctttgccgatattctcagtttctgtcaagagcaagtttatagttttttagggctatccgctgttctggtcacgtttagagtaaaagtgacctgttctgttcatcgtgggtgcagtttgcaatctgtttggttttgttcgcagatgttgcagtgtaaaagtttgtacattggggagtggctgccgttgttgtgacagattgtacatatagcgatgtgtcgtcataatttatgcaaggattagattggtgagc

SEQ ID NO: 4859 - DNA, 3499 bp, Setaria italica
ctgcgtgtcccctcccccactctcgccgagccattcgattcctctctctccgcgcgccccccacgcgaatcgccgccatttcgccgattccggccgccgcctagggtttcggtcccagcggcgccggagggttacggccgtgggtcgcgctccaagcgtgtcgcgctgaggccggaggtggagtggcggttctccgtgaagcggaggtggcggtggttgtggtcccggtggctgcggagcggggtctccggcgagcgagtctttccgacgccgcggctgcgcgggggtcgatgtggaggtagtgcggcagtggggggagaataagtggctgcggcggcggaaggcgggctggcggaggcagccatgtttttcagcaggctcgatgactcgcccatgttcaggaagcagatgcaatcacttgaagaaggtgctgaattgctaagagaaagatgtttcaagtttcacaaaggttgccggaaatacacggaaggactaggggaagcatatgatggagatattgcgttcgcaagttcacttgaaacttttggagggggtcataatgatccaatcagtgttgcatttggagggcctgttatgaccaaatttacaattgccttgagagaaattggaacatacaaagaagtattgcgctcccaggttgagcatatgctaaatgacaagctgctccagtttgtggacattgatttacatgaaatgaaggatgctaggaaacgttttgacaaggctagccttctttatgaccaggctcgtgagaagtatttatccttgaagaaaggtacaaggactgacgtagcaactgctgtagaggacgagctccacagtgccagatcttcatttgaacaagctcgtttcaatctggtgacttcgctttcaaatatcgaggctaagaagaggtttgaatttttggaggctgttagtgggacaatggacgcgcatcttcgttatttcaaacaaggatatgaactcctacatcagatggaaccatatatcaaccaagttcttgcttatgcacagcaatcaagagaaaggtctaactatgagcaggctgctcttgttgagagaatgcaagagttcaaacgacaaattgatcgggaaagtcggtggtcaccaaatggaatgaacgattcccctaatggtgatggaatacaagcaattggtagaagttctcataagatgattgaggcagtgatgcaatcagcttcaaagggcaaggttcagactattcgacaaggctatctttctaagagatcttcaaatttgagaggtgactggaaaaggaggttctttgtactcgacagtcgaggaatgttatactattatcgcaagcaaaacagtaggccatctagcggttattctaatcaaagaactagcactccctccgaacatggttctgggttgctcagcagatggttttcatctcattaccatggaggcgtgcatgatgagaaatctgttgcacgccatactgtaaacttgctaacatcgaccattaaagttgatgcagaccaatcagacttgcggttctgcttcagaataatttctcccacaaagaactatacattgcaggcagagagtgcaatggatcagatggattggattgaaaaaattactggcgtcatcgcttctttgctgagctcccagtcccctgaacggcgtcttctgctgagccctaagggcagcagccatcatcgaactgccagcgaaagcagttctttcagtagctcaacagaacttgaacattcaataagtgaagattgcatgctggaaaagaactcaggaagtggttatttcgatcattctgccaggggtacacagcatcaccgaacaagcatgatgaagcctgataagccaattgacttgcttaggaaagtggctggcaatggtaactgtgctgactgtggtgctgcagagcctgattgggcatccctgaaccttggaattcttttatgcatagagtgttctggggtacacagaaatatgggtgtgcatatatctaaggtaagatccctgacgcttgatgtcagggtttgggagctatctgtaatcaatctctttcagtcattaggcaacacgtttgccaatactgtctgggaaggaatgttaccttcgtcaagctgcgctgaccatggtgatatttcaagggctgatgaattagaaaacacattgcatggctttacactcagcaagcctaaacaatctgatcctattaccgtgaaggagaaatttattcatgccaagtatgctgaaaaggattttgtgcggaagcataatgtggatgagattcagctagcacaactgatgtgggataatgtaagttcaaacaacaaaaagggggtgtacagtctgattgtggggtcaaatgccgatgtaaatttttcttacggacatacatcattcaattcggctttgactctgggaaaagcgctcctcctacaagagcaaccagcttcaccatcaaatggaagttctagatgttttgatcgcaatccgcttgagaaggattcttctggggactctatttctcctgccagcacaagtgcccgtatagacgaattggatgattatgtcgaagggttgtctttgcttcatctagcatgccgcgttgcggacctgggcatggttgagctactcttgcagtacggcgccaatgtaaactctacagattcaagagggcgaacaccacttcatcactgcatcatgaaaggcagacccatgtacgccaggctgctgctttccaggggggctgattctcaagccacggacagagatgatagaacagcattacagtatgcaatggatggcggagccatagacgatgaagagatccttgttttgttagaggacccgagtagataaatcatgtaggtagtcaagtctccagtaccggtgggtggcatggcgccaagtatacctcgccgatactctcagtttgtgtcaagaggaagttatagctttctagggccatctgcggttttggtcgcggttagagtgaaggtgacctgttcatcgtggatgcagtttgcaagctgtttggttttgtttgcagatgttgcggtgtaagtttgtacattgggaagtgtctgcccgttgttgtgacagttgtacatatagcgatgatgtgtcgtcgtaattcatgcaagaattagattggtgagctgagaaatgtggctgccctgatcgatcagatacaaaaaaaaaagtgtgtaaatacggctcaaaccgctgttcctgatgtttctactccgctgctctacatgtagccgaacagcagcagcctgctccgaatctgacgagcaagatgtgtgtaagcgtaacacaaacaccacagcatcgtcagtgtcacacccatcttgcacacaggccgccacctgcagtcatcgctatgctgcagttgtgcagggtctagcactggctgctgagagtcaggttgaacaaagcatggatgggcaggtctgcagccagttcctgtggatgacaa

SEQ ID NO: 4860 - DNA, 4143 bp, Oryza sativa
gttctcctttccgctttacctctctcctctctcctctcgcctcgccgagccattcgattcctccgccgaatcgccgccattacgcccaattccggccgcctcctagggtttcgcccgcgctccgccaccgtcgccctccccccggcactgcgccgccttccccacgccgccctggaggagctgctctgactgcggggaggtgtaggaggaggagggcggaggaggtggtggtggtggtggtggagagagagaggagtgcgtcgccgacgaggtgggtggtggtggtgcgaggagagggcgttgatgaggttgtggtggtagggaggcaaagcagtgtggtggtcgcggcggcgggcggcggcggagatgtttttcaccaggctggatgactcgcccatgttcaggaagcagatacaatcccttgaagaaggttctgaattgctgagagagagatgtttgaggtttcataaaggttgccgcaaatacactgaaggactaggggaagcatatgatggagatattgcatttgcaagttcactggaagcatttggaggggggcataatgatccaatcagtgttgcttttggaggacccgtcatgaccaaatttacaattgccctgagagaaattggaacttacaaggaagtattgcgctcacaggttgagaatatgctaaatgacaagttgctgcaatttgtggacattgatttgcatgatgtgaaggatgccaggaagcgttttgacaaggctagccttctctatgaccaggctcgtgagaggtatttatccttgaagaaaggcacacggacagatgtagcaactgcggtggaggatgagctccatagtgccagatcctcatttgagcaagctcgtttcaacctggtgactgcactttcaaatatcgaggccaagaaaagatttgaatttttagaggctgtcagtgggacaatggatgcacatctgcgctatttcaaacaaggatatgagctactccatcagatggagccatatatcaatcaagttcttgcttatgcacagcaatcaagggaacggtctaactatgagcaagctgctcttgtagagaggatgcaagagtttaaaaggcaaattgatcgggaaagtcgttggtcaccaaatggcataaacgattcccctaatggtgatggaatacaagcaattggtagaagttcacacaaaatgattgaggcggtgatgcaatcagcttcaaagggcaaggtacagaccattcgacaaggctatctctcaaagcgatcttcaaacttgagaggtgactggaaaagaaggttctttgttcttgatagccgaggaatgttatattattatcgcaagcagaatagtagaccatctagtggttatactaaccaaagaagtagcgctccgtcagagcatggttctgggttgcttagcagatggttctcttctcattatcatggtggagtacacgatgagaaatctgtagcaaggcataccgtgaacttgctaacatcaaccattaaagctgatgctgaccaatcggatctgcggttctgcttcagaataatttctcccacaaaaaactacactttgcaggcagagagtgcgatggatcagatggattggattgaaaaaataactggtgtcatcgcttctttgctgagctcccaatcgcccgaacggcgtcttctgtcgagcccaaagggtagcggccataatcgaactgccagcgaaagtagttcctttagtagctcgacagaacttgaccattccattagtgaagactgcatgctggaaaggaactctggaagtgggtattttgaccactctggcagagccatccagcatcaccgaaccagcatgaaacctgacaagccaattgacttgcttaggaaagtggtcggcaataatatttgtgctgattgtggtgcagcagagcctgactgggcatccctaaaccttggaattcttctatgcatcgaatgctctggggtacacagaaatctcggtgtgcatatatctaaggtaagatcactgacacttgatgtcagggtctgggagccatctgtaatcaatctcttccagtcattaggaaacacatttgccaacactatctgggaagatatgttaccttcatcaagcagtgttgatcatggtgataattcaagggctgatggactagaaaacacatcacataacttaattttcagcaagcctaaacactcggatcatattgctgtgaaggagaaatttattcatgcaaagtatgccgagcgagattatgtgcgaaagcttaatatggatgatagcctggtagctcaacagatgtgggaaaatgttagttcaaacaacaagaagggggtttacagtctgattgtggggtcaaatgccgatgtaaatttaacttatgggcagacatcatttaattcggccctaacccttggaaaagctctacttttacaagagcagccaacttcaccatcagatggaagttccagatgttttgatcgtagttcacttgaaaggatttctcccagggactctctttctcttgccagcacaagtgcacgtatagatgaattggatgattgtgtcgagggattgtcattgcttcatctagcatgccgtgttgcagatgtgggtatggtcgaacttctcttgcaatatggtgccaacgtaaattctgcagactctagaggtcgaacgcctcttcatcacagcatcttgaaaggacgacatatgtttgcaaagttgttgctatccaggggcgctgattcacaagccacggaccgagatggtagaacagcattacagtatgctattgacagtggaactattgacgacgaagagattcttgttttgttagaagacccaagtagataatccattagctaccaataccccttcagttcagcagagcaaagctttgtgtgctcagttgcctccatgacagagtcaaccggcacagcaagctccaagtttgtgtcgccgatgatcacaatctgtgacgagaacagtattggtgttctggagctgcattgtgccctcctcgttttccgggtctcgtcttagcgtgacgaatgaccagaccccaatttccttctggttgcagtttgcaaagctcttttggtctttctttttcccctgtttgctgatgatgcactgtgagttttgtacattgcaattggccccaactccccaacatgaagttgctgcccttctgatgacagatgatgatgtacatatagtgatcccatgtaccactatgatttttcctgcaagcattactagtttggtgaaaatgaaaactatgcacttccctcctgccgacacgtggcgcccccagttgtccatgtgactgcccaagctctgaactgctacaaggatctgaatgcctgcagcttcagaacacagtgtcatctgatggactttactctcacgtttctgttgctgagcagtgtgagttttgctcgtgtaaagtgtgacatctacttggacagtgacactctcccttacactgtgttacacccaatatacccacatgcagtcacatccaatcatgctttgtatattttcaaagttttcccaagtttcagctgggcttggagatgaatatgcttcagtttcagaggacaatatatatatcaagctacattccactgcctgcccgctgctcatgacgagagaaaattcaaaatcattcggcaacgtcgttttcagcttcaccaggcagggtgtcacgttgtcaatgccaagattgaataattagctatgctgattaattaagctctgccaagaactgcaccgtcacactgcaaaggtcaattaattgtgcttaggtgttttctcaagtcaagagtctacttatctgttaactgttatcattttcgtgtacaagtcggaaaacgaaagaatttcctccccattaattcctacagaaaatgaacctcatccaccaaatccctagaaatttaatcccctgacaaataaatccgaattagcaaagtgccatttttttcttcgttcttggctgtaacgagttgatggcgcagagtacaatactgcacgtacatatatacgtgtgcgtgcgtgcgtgcatgcatgtataatgatgtggcatgcaagaggcaaacgcacgtactccatccg

SEQ ID NO: 4861 - DNA, 3386 bp, Brachypodium distachyon
ttttttctctttacactcctctcctctttctccctttgcctgtgcgtgtcccctcccctctcgccgagccattcgattcctttcccccaccgccatttcgccaattccggccgccatctagggtttcgcggcgcgcgtgaccggcgcttcctgtagtgcgtcccgctcccgctggcggccagaggaggaggaggaggaggaggaggaggtggtggagggagagtggtcggcctgcgacgacgtggtggagaggtggtggagggtggtcgcgttagccgcggactgtgtcctcggcgagtgaggaggctttgccccggggggttgatgaggaggtaggaggtggtgcggtcgtgttgttgaactggcggcggcgcggcggcgataggcagacatgtatttcagcaggctcgatgactcgcccatgttcaggaagcagatgcaatcacttgaagaaggtgctgaattactcagggagagatgcttgaagtatcacaaaggttgccgcaaatacactgaagggctaggggaagcatacgatggagatattgcattcgcaagttcactagaagcatttggagggggtcataatgatccaatcagtgttgcattcggaggacctgttatgaccaaatttacgattgccttgagagaaattggaacatacaaagaagttttgcgctcccaggttgagcatatgctaaatgacaagttgctgcagtttgtggacatggatttgcacgatgtgaaggatgcccggaagcgttttgacaaggctagtcttctgtatgaccaggctcgtgagaggtatttatcattgaagaaaggcacaaggtcagacatagcaactgcagtagaggatgagctccacagcgcaagatcttcatttgagcaagctcgtttcaacctggtgactgcactctcaaatatcgaggcaaagaaaagattcgaatttttggaggctgttagtgggacaatggatgcacatcttcgttatttcaaacaagggtatgaattactccatcagatggaaccatatatcaatcaagttctggcttatgcacaacaatcaagagaaaggtctaactacgagcaagctgctcttgtagagaggatgcaagagttcaaaaggcaaattgatcgggaaagtcggtggtcaccgactggcatgactgattcccctaatggtgatggaatacaagcaattggtaggagttcacataagatgattgaagcggtcatgcagtcagcttcaaagggcaaggtccagaccattcggcaaggttatctctcaaagcgatcttcaaacttgagaggtgactggaaaaggaggttctttgtccttgataatcgaggaatgttatactattatcgcaagcagaatagtagaccatccagtggttatcccaaccaacgaagtagcactccttccgagcatggttctgggttgcttagcagatggttctcttctcattatcatggtggtgtacatgatgagaaatctgtagcacggcatacagtaaacctgctaacatcaactattaaagttgatgcagaccaatcagatctaaggttctgcttcagaataatatctcccacaaaaaactacacgttgcaggcagagagtgcaatggatcagatggattggatcgaaaagatcactggtgtgattgctaatttgttgagctcccaatcccctgagcggcgtctattgctgagccctaagggcagtggccatcatcgaacaacgagtgaaagtagttctttcagtagctcaacagaacttgaccattctataagtgaagactgtatgatggaaaagaacccaggaagtgggtattttgagcactcttccagagtcacacagcatcacagaaccagcatgaaacctgataggccaattgaattgcttaggaaggtagtcggaaatgatatttgtgctgattgtggtgctgcggagcctgactgggcatccctaaatcttggagttcttctatgcatagaatgctctggtgtacacagaaatcttggtgtacatatatctaaggtgaggtctctgacacttgatgtcagggtctgggagccatctgtaatcaatctcttccagtctttagggaacacatttgccaacacaatctgggaagaaatgctgcctttatcaagcagtgttgatcatggtgatactccaagggctgatggaatagaaaacacttcacctaatttggctgtcagcaagcctaaacactcagatcctatcgctttgaaggagaaatttattcatgccaagtatgctgacaaagattttgtacgaaagcgtaatatggatgagactcagctagcacaacagatgtgggataatgtaagttcaaacaacaagatgggtgtgtacagtctgatagtggggtcgcatgccgatgtaaatttaacttatgggcagacatcatttaattcggctttgactcttggaaaagcactgcttctgcaagagcaaccggcttcgccatcaaatggaagctctagatgctttgatcgcggttcgcttgagaagatttctcccacggactccctttctcctgccagcacaagtgagcgcatagacgaattagatgtcggtgtagagggattatccctgcttcatttagcgtgccgtgttgcggatgtgggcatggttgaactactcctgcagtatggtgccaatgtaaattctacagattctagaggccggacaccgcttcatcacagcattttgaaaggaagacgtgtgtatgccaagctgctcctttccaggggtgctgattcacgagccacagaccgtgatggtagaacagcattacagtatgctattgatagcggaactatcaatgatgaagagattcttgttttgttagaagacccaagtagataatccagtagctagcctagctagaccttcgtttcagcagtaagcgtgtgctctgacgtgcctttctgctgctgttgaaggggcacggctccgagctcgccgggctgatcgatgatccctgcttgtgtcatgagagcataggcccctccctggtttggacccactttagcgtgagctacacactcttatgtattgtgtttgcgatttgcaaagctttcgccgggcttggtttgcagatgatggtatgatacactgtaagtttgtacattgcgttgatcccagagccctgatcgccttctgatgacagatgatgtgtatatagtgacatggattgtaccatggatatgatttaagcaggcattagtttggtcttggtgagaaacatgctcttctttccccgtcagacacttgctgttgctgactgcatatgtagtacatactccttggcctgccccaaatccaacagctacaagatttgatccaaaaa

SEQ ID NO: 4862 - DNA, 2931 bp, Brachypodium distachyon
gcggcggcgcggcggcgataggcagacatgtatttcagcaggctcgatgactcgcccatgttcaggaagcagatgcaatcacttgaagaaggtgctgaattactcagggagagatgcttgaagtatcacaaaggttgccgcaaatacactgaagggctaggggaagcatacgatggagatattgcattcgcaagttcactagaagcatttggagggggtcataatgatccaatcagtgttgcattcggaggacctgttatgaccaaatttacgattgccttgagagaaattggaacatacaaagaagttttgcgctcccaggttgagcatatgctaaatgacaagttgctgcagtttgtggacatggatttgcacgatgtgaaggatgcccggaagcgttttgacaaggctagtcttctgtatgaccaggctcgtgagaggtatttatcattgaagaaaggcacaaggtcagacatagcaactgcagtagaggatgagctccacagcgcaagatcttcatttgagcaagctcgtttcaacctggtgactgcactctcaaatatcgaggcaaagaaaagattcgaatttttggaggctgttagtgggacaatggatgcacatcttcgttatttcaaacaagggtatgaattactccatcagatggaaccatatatcaatcaagttctggcttatgcacaacaatcaagagaaaggtctaactacgagcaagctgctcttgtagagaggatgcaagagttcaaaaggcaaattgatcgggaaagtcggtggtcaccgactggcatgactgattcccctaatggtgatggaatacaagcaattggtaggagttcacataagatgattgaagcggtcatgcagtcagcttcaaagggcaaggtccagaccattcggcaaggttatctctcaaagcgatcttcaaacttgagaggtgactggaaaaggaggttctttgtccttgataatcgaggaatgttatactattatcgcaagcagaatagtagaccatccagtggttatcccaaccaacgaagtagcactccttccgagcatggttctgggttgcttagcagatggttctcttctcattatcatggtggtgtacatgatgagaaatctgtagcacggcatacagtaaacctgctaacatcaactattaaagttgatgcagaccaatcagatctaaggttctgcttcagaataatatctcccacaaaaaactacacgttgcaggcagagagtgcaatggatcagatggattggatcgaaaagatcactggtgtgattgctaatttgttgagctcccaatcccctgagcggcgtctattgctgagccctaagggcagtggccatcatcgaacaacgagtgaaagtagttctttcagtagctcaacagaacttgaccattctataagtgaagactgtatgatggaaaagaacccaggaagtgggtattttgagcactcttccagagtcacacagcatcacagaaccagcatgaaacctgataggccaattgaattgcttaggaaggtagtcggaaatgatatttgtgctgattgtggtgctgcggagcctgactgggcatccctaaatcttggagttcttctatgcatagaatgctctggtgtacacagaaatcttggtgtacatatatctaaggtgaggtctctgacacttgatgtcagggtctgggagccatctgtaatcaatctcttccagtctttagggaacacatttgccaacacaatctgggaagaaatgctgcctttatcaagcagtgttgatcatggtgatactccaagggctgatggaatagaaaacacttcacctaatttggctgtcagcaagcctaaacactcagatcctatcgctttgaaggagaaatttattcatgccaagtatgctgacaaagattttgtacgaaagcgtaatatggatgagactcagctagcacaacagatgtgggataatgtaagttcaaacaacaagatgggtgtgtacagtctgatagtggggtcgcatgccgatgtaaatttaacttatgggcagacatcatttaattcggctttgactcttggaaaagcactgcttctgcaagagcaaccggcttcgccatcaaatggaagctctagatgctttgatcgcggttcgcttgagaagatttctcccacggactccctttctcctgccagcacaagtgagcgcatagacgaattagatgtcggtgtagagggattatccctgcttcatttagcgtgccgtgttgcggatgtgggcatggttgaactactcctgcagtatggtgccaatgtaaattctacagattctagaggccggacaccgcttcatcacagcattttgaaaggaagacgtgtgtatgccaagctgctcctttccaggggtgctgattcacgagccacagaccgtgatggtagaacagcattacagtatgctattgatagcggaactatcaatgatgaagagattcttgttttgttagaagacccaagtagataatccagtagctagcctagctagaccttcgtttcagcagtaagcgtgtgctctgacgtgcctttctgctgctgttgaaggggcacggctccgagctcgccgggctgatcgatgatccctgcttgtgtcatgagagcataggcccctccctggtttggacccactttagcgtgagctacacactcttatgtattgtgtttgcgatttgcaaagctttcgccgggcttggtttgcagatgatggtatgatacactgtaagtttgtacattgcgttgatcccagagccctgatcgccttctgatgacagatgatgtgtatatagtgacatggattgtaccatggatatgatttaagcaggcattagtttggtcttggtgagaaacatgctcttctttc

SEQ ID NO: 4863 - DNA, 2946 bp, Triticum aestivum
ggcggcttacaggtggcagacatgtatttcacccggctcgatgactcgcccatgttcaggaagcagatgcaatcacttgaagaaggtgctgacttgctgagagagagatgcttgaagtatcacaaaggttgccgtaaatacactgaagggctaggcgaagcatatgatggagatattgcgtttgcaagttcactagaagcatttggaggtggtcacaatgatccaatcagtgttgcctttggaggacccgtgatgaccaaatttacaattgccttgagagaaattggaacatacaaggaagttttgcgctcccaggttgaacatatgctaaatgacaagctgctgcagtttgtggacatggatttgcatgatgtgaaggatgcccgaaagcgttttgacaaggctagccttctgtacgaccaggctcgtgagaggtatttatccttgaagaaaggaacaaggacagacatagcaactgcagttgaggatgagcttcacagcgccagatcttcatttgagcaagctcgtttcaacctggtcactgcgctttcaaacattgaggctaagaagagatttgaatttttggaggctgttagtggaacaatggatgcacatcttcgttatttcaaacaaggatatgaattactccatcagatggaaccgtatatcaatcaagtgcttgcttatgcacagcaatcaagagaaaggtccaactacgagcaagctgctcttgtagagaggatgcaagagttcaaaaggcagattgaccgggaaagtcggtggtcaccaaacgggatgactgattcccctaatggtgatggaatacaagcaattggtcgaagttcacataagatgattgaagccgtcatgcagtcagcttcaaagggaaaggttcagactattcggcaaggctatctctcaaagcgttcttcgaatttgagaggcgactggaaaaggaggttctttgtccttgataatcgaggaatgttgtattactaccgcaagcaaaatagtagaccatccagtggttattctaaccaacgaagtagcactcccaatgagcatggctctgggctgcttagcagatggttctcatctcattaccatggcggtgtgcatgatgagaaatctgtagcacgacatacagtaaacctgctaacatcaaccattaaagttgacgcagatcaatcagatctaaggttctgtttcagaataatttcgcccacaaaaaactacacactgcaggcagagagtgcgatggatcagatggattggattgaaaagatcactggtgtcattgcttctttgttaagctcccaatcccctgaacggcgtctactgttgagccctaagggcagtggccatcatcgaacaaacagcgaaagtagttctttcagtagctcaacagaacttgaccattccatgagtgaagattttatgatggaaaagaactcaggaagtgggtactttgagcactccagagtcacacaacatcatcgaaccagcatgagacctgacaagccaattgaattgcttaggaaggtggttggcaatgatgtttgtgctgattgtggtgctgcagagcctgattgggcatccctaaacctcggagtccttgtatgcatagaatgttctggtgtacaccggaatcttggtgtgcatatatctaaggtaaggtctctgacacttgatgtcagggtgtgggagccatctgtaatcaatctcttccagtctttaggcaacacatttgccaacactatctgggaagaaatgttaacttcgtcaagcagttttgatcatggtgatacttcgagagctgatggaattgaaaacacaccagataacttggctgtcagaaagcctaaacaatcggatcctatctctctgaaagagaaatttattcatgccaagtatgctgagaaagattttgtacggaagcatagtatggatgagactcagctagcacaacagatgtgggatcatgtaagttcaaacaacaagatggaggtgtacagtctgatagtgcgatcgaacgccgatgtaaatctaacttatgggcagacatcattcaattcggctttgactcttgggaaagcgcttctcttacaagagcaaccgtcttcgccgtcaaatggtagttctagatgctttgaccgtggtgcatctgagaaaatttctcccaggggttctctttctcctgcgagcacgagtgcgcgaacagacgaattagatggctgtgctgagggcctatctctgcttcatctggcatgccgtgtcgcggatataggcatggttgagctactcttgcagtatggggccagtgtgaattccacggatcctagaggccgaacaccgcttcatcacagcattttgaaaggaaggcgcgtgcatgccaagttgctcctctccaggggtgctgattcgcaggcgacagaccgtgagggtagaacggcattgcagtacgccatcgacagcggaaccatcgaggacgaagagattcttgttttgttagaagaccccaggtagatagatgatccagtagctagaccttgggttgagcagagttacggtttgccgcgctctgatctgatgtgccttctcctgctgctcaacgggcacggctccaagctcgcctcgccgatccgatctctgatcccagctcgtgtcatgaagaacagtattataggtagtgttccagagagacagggggggtccccctccccctgcccccaccccgttatactagcgtgagatacccccctatccctatgtattgtggttttgccgggtttttgtttgcaagcagatagatgatgacagacgacgttgtaaaagtttgtacatggcgccggacccagagtgcccggcccggcccggatccgatggtgatgatgacgatgtgtgtacatagtgagaccgatgtgtggcatgaatgtggtttaagca

SEQ ID NO: 4864 - DNA, 3141 bp, Secale cereale
gatgaggaggtaggacgccgtgcgggttgcggtgttggagtggcgacgacggcggcgcggaggcggcttacgggtggcagacatgtacttcacccggctcgatgactcgcccatgttcaggaagcagatgcaatcacttgaagaaggtgctgagttgctgagagagagatgcttgaagtaccacaaaggttgccgtaaatacactgaaggactaggcgaagcatatgatggagatattgcgttcgcaagttcactagaagcgtttggaggcggtcacaatgatccaatcagcgttgcctttggaggacccgtgatgaccaaatttacaattgccttgagagaaattggaacatacaaggaagttttgcgctcccaggttgaacatatgctaaatgacaagttgctgcagtttgtggacatggatttgcatgatgtgaaggatgcccgaaagcgttttgacaaggctagccttctgtacgaccaggctcgtgagaggtatttatccttgaagaaaggaacaaggacagacatagcaaccgcagttgaggatgagctccacagcgccagatcttcatttgagcaagctcgtttcaacctggtgactgcgctttcaaacattgaggctaagaaaagatttgaatttttggaggctgttagtgggacaatggatgcacatcttcgttatttcaaacaaggatatgaattactccatcagatggaaccatatatcaatcaagttcttgcttatgcacaacaatcaagagaaaggtccaactacgagcaagctgctcttgtagagaggatgcaagagttcaaaaggcaaattgaccgggaaagtcggtggtcaccaaacgggatgactgattcccctaatggtgatggaatacaagcaattggtcgaagttcacataagatgattgaagccgtcatgcagtcagcttcaaagggaaaggttcagactattcggcaaggctatctctcaaagcgttcttcaaatttgagaggcgattggaaaaggaggttctttgtccttgataatcgaggaatgttgtattattaccgcaagcaaaatagtagaccatccagtggttattctaaccagcgaagtagcactcccaccgagcatggctctgggctgcttagcagatggttctcatctcattaccatggcggtgtgcatgatgagaaatctgtagcacggcatacagtaaacctgctaacatcaaccattaaagttgacgcagatcaatcagatctaaggttctgtttcagaataatttcgcccacaaaaaactacacactgcaggcagagagtgcgatggatcagatggattggattgaaaagatcactggtgtcattgcttctttgttaagctcccaatcccctgagcggcgtctactgctgagccctaagggcagtggccatcatcgaacaaacagcgaaagtagttctttcagtagctcaacagaacttgaccattccatgagtgaagattttatgatggaaaagaactcaggaagtgggtactttgagcactccagactcacgcaacatcaccgaaccagcatgagacctgacaagccaattgaattgcttaggaaggtggttggcaatgatgtttgtgctgattgtggtgctgcagagcctgattgggcatccctaaaccttggagtccttgtatgcatagaatgttctggtgtacaccgaaatcttggtgtgcatatatctaaggtaaggtctctgacacttgatgtcagggtgtgggagccatctgtaatcaatctcttccagtctttaggcaacacatttgccaacactatctgggaagaaatgttaacttcgtcaagcaggtttgatcatggtgatacttcgagagctgatggaattgaaaacacaccagataacttggctgtcagaaagcctaaacaatcggatcctatctctctgaaagagaaatttattcatgccaagtatgctgagaaagattttgtacggaagcatagtatggatgagactcagctagcacagcagatgtgggatcacgtaagttcgaacaacaagatggaggtgtacagtctgatagtgcgatcgaacgcggatgtaaatctaacttatgggcagacatcattcaattcggccttgacccttggaaaagcgcttctcttacaagagcaaccgtcttcgccgtcgaatggtagctctagatgctttgaccgcggtacggtcgagaaggtttctcccaggagttctctttctcctgcgagcacaagcgcacggacagatgaattggatggctgcgctgagggcctatctctgcttcatctggcatgccgtgtcgcggatattggcatggttgagctactcttgcagtatggagccagtgtgaactctacggattctagaggcagaactccacttcaccacagcattttgaaaggaaggcgcgtgcatgccaagctgctcctttccaggggtgctgattctcaggcgacagaccgtgaaggtagaacggcattgcagtacgccatcgatagcggaaccatcgaggacgaagagattcttgttttgttagaagaccccaggtagatagatgatccagtagctagaccttgggctcagcagagtacgctctgatgtgccttctcctgccgctcaacgggcacagctccaagctcgcctcgccgatccgattgatgatcccagctcgtgtcatgaagaacagtattatagctagtgttccagggaggcaggggaccccctcccctcaccctccatatccctatgtattgtggttttgccgggttttgtttgcgagcggatgatgatagacgacgctgtaagtttgtacatggcgccggacccagagtgcccggcccggatccgatggtgacgacgtgtgtatgtacatagtgataccgatgtgtggcatgaatgtgatttacgcggagcattggaaaaaaaaaaaaaaaacaaaaaaacaaaaaaacaaaaaaacaaaaaaagaaaaacaaaataaaacaaagaacaacaacatacacacagatatagacacgacacatacacagacagacagatatatagacaacatatcatacacaatacaccacgagacgacgacgttatagatgacagacagtata

SEQ ID NO: 4865 - DNA, 3291 bp, Triticum aestivum
ggtcggcgcctgtcccctctcccctcgccattccattcctccgcccccaccgccatttcgccgattccggccgccgcctagggtttctcgcccagcctcagcggcggtatcgggaagtttgtcccgctccccggcggcacgcggcgtccggagcaggaggaggaggcggaggaggtcagtctgtgtctctgtgagcccggggtggcggcggcggcggcggcggcggagtgggctgtcgacgagcgaggtttcgcgggggcgtaggctgcgggttgatgaggaggtaggacgccgtgcgggttgcggtgttggagtggcgacggcggcggtgcggaggcggcttacaggtggcagacatgtatttcacccggctcgatgactcgcccatgttcaggaagcagatgcaatcacttgaagaaggtgctgacatgctgagagagagatgcttgaagtatcacaaaggttgccgtaaatacactgaagggctaggcgaagcatatgatggagatattgcgttcgcaagttcactagaagcatttggaggcggtcacaatgatccaatcagtgttgcctttggaggacccgtgatgaccaaatttacaattgccttgagagaaattggaacatacaaggaagttttgcgctcccaggttgagcatatgctaaatgacaagctgctgcagtttgtggacatggatttgcatgatgtgaaggatgcccgaaagcgttttgacaaggctagccttctgtacgaccaggctcgtgagaggtatttatccttgaagaaaggaacaaggacagacatagcaactgcagttgaggatgagcttcacagcgccagatcttcatttgagcaagctcgtttcaacctggtcactgcgctttcaaacattgaggctaagaagagatttgaatttttggaggctgttagtggaacaatggatgcacatcttcgttatttcaaacaaggatatgaattactccatcagatggaaccgtatatcaatcaagtgcttgcttatgcacagcaatcaagagaaaggtccaactacgagcaagctgctcttgtagagaggatgcaagagttcaaaaggcagattgaccgggaaagtcggtggtcaccaaacgggatgactgattcccctaatggtgatggaatacaagcaattggtcgaagttcacataagatgattgaagccgtcatgcagtcagcttcaaagggaaaggttcagactattcggcaaggctatctctcaaagcgttcttcgaatttgagaggcgactggaaaaggaggttctttgtccttgataatcgaggaatgttgtattactaccgcaagcaaaatagtagaccatccagtggttattctaaccaacgaagtagcactcccaatgagcatggctctgggctgcttagcagatggttctcatctcattaccatggcggtgtgcatgatgagaaatctgtagcacgacatacagtaaacctgctaacatcaactattaaagttgacgcagatcaatcagatctaaggttctgtttcagaataatttcgcccacaaaaaactacacactgcaggcagagagtgcgatggatcagatggattggattgaaaagatcactggtgtcattgcttctttgttaagctcccaatcccctgaacggcgtctactgttgagccctaagggcagtggccatcatcgaacaaacagcgaaagtagttctttcagtagctcaacagaacttgaccattccatgagtgaagattttatgatggaaaagaactcaggaagtgggtactttgagcactccagagtcacacaacatcatcgaaccagcatgagacctgacaagccaattgaattgcttaggaaggtggttggcaatgatgtttgtgctgattgtggtgctgcagagcctgattgggcatccctaaacctcggagtccttgtatgcatagaatgttctggtgtacaccggaatcttggtgtgcatatatctaaggtaaggtctctgacacttgatgtcagggtgtgggagccatctgtaatcaatctcttccagtctttaggcaacacatttgccaacactatctgggaagaaatgttaacttcgtcaagcagttttgatcatggtgatacttcgagagctgatggaattgaaaacacaccagataacttggctgtcagaaagcctaaacaatcggatcctatctctctgaaagagaaatttattcatgccaagtatgctgagaaagattttgtacgaaagcatagtatggatgagactcagctagcacaacagatgtgggatcatgtaagttcaaacaacaagatggaggtgtacagtctgatagtgcgatcgaacgccgatgtaaatctaacttatgggcagacatcattcaattcggctttgactcttgggaaagcgcttctcttacaagagcaaccgtcttcgccgtcaaatggtagttctagatgctttgaccgtggtacatctgagaaaatttctcccaggggttctctttctcctgcgagcacgagtgcgcgaacagacgaattagatggctgtgctgagggcctatctctgcttcatctggcatgccgtgtcgcggatataggcatggttgagctactcttgcagtatggggccagtgtgaattccacggattctagaggccgaacaccgcttcatcacagcattttgaaaggaaggcgcgtgcatgccaagctgctcctctccaggggtgctgattcgcaggcgacagactgtgaaggtagaacggcattgcagtacgccatcgacagcggaaccatcgacgatgaagagattcttgttttgttagaagaccccaggtagatagatgatccagtagctagaccttgggttgagcagagtacgggttgccgtgctctgatctgatgtgccttctcctgctgctcaacgggcacagctccaagctcgcctcgccgatccgatcaatgaccccagctggtgtcacaagaacagtattatagctagtgttccagggagccaggggacccctctcctgcccccccaccccgttccagcgtgagatacccccctatccctatgtattgtggttttgccgggtttttgtttgcaagcggatgatgatagacgacgctgtaaaagtttgtacatggcgccggacccagagtgcccggcccggcccggatcccggatccgatgatgatgacgatgtgtgtacatagtgataccgatgtgtggcatgaatgtgatttttacgcagagcattggacaaacc

SEQ ID NO: 4866 - DNA, 3094 bp, Hordeum vulgare
tgggttgtcggcggccggggtttcgctggggcggaggctgcggagagggcgttcatgaggaggtaggagcccgtacgcacgcggtgctggagtgacggcggcggcggcggcggcggcgtgggtggcagacatgtatttcaccaggctcgatgactcgcccatgttcaggaagcagatgcaatcacttgaagaaggtgctgaattgctgagagagagatgcttgaagtaccacaaaggttgccgtaaatacactgaagggctaggcgaagcatatgatggagatattgcgttcgcaagttccctagaagcatttggaggcggtcacaatgatccaatcagtgttgcctttggaggacccgtgatgaccaaatttacaattgccttgagagaaatcggaacatacaaggaagttctgcgctcccaggttgaacatatgctaaatgacaagttgctgcagtttgtggacatggatttgcatgatgtgaaggatgctcgaaagcgttttgacaaggctagccttctgtacgaccaggctcgtgagaggtatttatccttgaagaaaggaacaaggacagacatagcaactgcagttgaggatgagctccacagtgccagatcttcatttgagcaagctcgtttcaacctggtgactgcactttcaaacattgaggctaagaaaagatttgaatttttggaggcagttagtgggacaatggatgcacatcttcgttatttcaaacaaggatatgaattactccatcagatggaaccatatatcaatcaagttcttgcttatgcacagcaatcaagagaaaggtccaactacgagcaagctgctcttgtagagaggatgcaagagttcaaaaggcaaattgaccgggaaagtcggtggtcgccaaacgggatgactgattcccctaatggtgatggaatacaagcaattggccgaagttcacataagatgattgaagccgtcatgcagtcagcttcaaagggaaaggttcagactattcggcaaggctatctctcaaagcgttcttcgaatttgagaggcgactggaaaaggaggttctttgtccttgataatcgtggaatgttgtattactaccgcaagcaaaacagtagaccatctagtggttattctaaccaacgaagtagcactcccactgagcatggctctgggttgcttagcagatggttctcatctcattaccatggcggtgtgcatgatgagaagtctgtagcacggcatacagtaaacctgctaacatcaaccattaaagttgacgcagatcaatcggatctaaggttctgcttcagaataatttcgcccacaaaaaactacacactgcaggcagagagtgcaatggatcagatggattggattgagaagatcaccggtgtcattgcttctttgttgagctcccaatcccctgagaggcgtctactgctgagccctaagggcagtggccatcatcgaacaaacagcgaaagtagttctttcagtagctcaacagaacttgatcattccatgagtgaagattttatgatggaaaagaactcaggaagtgggtattttgagcactcttccagagtcacacaacatcaccgaaccagcatgagacctgacaagccaattgaattgcttaggaaggtggttggcaatgatgtttgtgctgattgcggtgctgcagagcctgattgggcatccctaaacctcggagtccttgtatgcatagaatgttctggtgtacacagaaatcttggtgtgcatatatctaaggtaaggtctctgacacttgatgtcagggtgtgggaggcatctgtaatcaatctcttccagtctttaggcaacacatttgccaacactatctgggaggaaatgttaacttcatcaagcagtgttgatcatggtgatgctgtaagaactgatggaattgagaacacgccagataacttggctgtcagaaagcctaaacagtcggaccctatctctctgaaggaaaaattcattcatgccaagtatgctgagaaagattttgtacggaagcacagtatggatgagactcagctagcacaacagatgtgggatcacgtaagttccaacaacaagatggaggtgtacagtctgatagtgcgatcgaacgcggatgtaaatctaacttatgggcagacatcatttagttcggccttgactcttggaaaagcgcttctcttacaagagcaaccgtcttcgccgtcaaatggtagctctagatgctttgatcgcggtacggttgagaagatttctcccaggagttctctttctcctgcgagcacaagcgcacgaacagatgaattggatggctgtgcggagggtttatctctgcttcacctggcgtgccgtgttgcggatattggcatggttgaactactcttgcagtatggagccagtgtgaattgcacagattctagaggccgaacaccgcttcatcacagcattttgaaaggaagacgcgtgcatgccaagctgctcctctccaggggtgctgactcgcaggccaccgaccgcgagggtagaacatcattacagtatgccattgacagcgggaccatcgacgacgaagagattcttgtattgttagaagaccccaggtagatagacgatccatccagtagctagacattcggttcagcagggcacgcttgccgcgctctgatgcgccttcttctcctgctgctcaacgggcacagctccaagctcgcctcgccgatctccgatcccagctcgtgccatgaagaacagtattatagctagtcttatggagccaggggacccgttccctccctccctctgcccctaccccgttttagcgtgagagataccatccacccccctatccccctatgtattgtggttttgccgggtttttgtttgcaagcagatgatgatggtagatgatgccgctgtaagtttgtacatggcgccggacccagagtgcccggcccggatccgacgacgatgatgatgcgtgtgtatatagtgttggttgatgcccatgtaccatggatgtgatttatacaggcgttggtttggccccgtgttgatggttcg

SEQ ID NO: 4867 - DNA, 2657 bp, Pennisetum glaucum
catttgcaagctcactcgaagcattcggaggaggccacaatgatccaattagtgttgcgtttggtggacctgtcatgactaaatttacaattgccttgagagaaattggaacatacaaggaagtcctgcgctcccaggttgaacacatgctaaatgacagattgctgaattttgtagatattgatttgcatgatgtgaaggatgcacataagcgtttcgacaaggctagccttgcatatgaccagattcgtgagaagtacctatcattgaagaaaggcacacgaccagacataacaactgcgatcgaagatgagctccacagtgctagatcttcgtttgagcaagctcgtttcaatctggtcacgtcactttcccacatcgaagcaaagaagaggtttgaatttttggaggctgttagtgcgacaatggattcacatcttcgatatttcaaacaaggatatgaactattgcatcaaatggagccatatattaatcaggttcttgcttatgctcagcaatcaagagaaaggtctaactatgagcaggctgctcttattgagagaatgcaagagttcaaacgacaaattgatcgggaaagtcggtggtcacctaatggaatgaatgattcccctaatggtgatggaatacaagcaatcggtagaagttctcataagatgattgaggcagtgatgcaatcagcttcaaaaggcaaggtccagactattcgacaaggctatctttctaagagatcttctaatttgagaggtgactggaaaaggaggttctttgtactcgacagtcgaggaatgttgtactattatcgcaagcaaaacagtaggccatctagcggttatcctaatcaaagaaccagcactccctcctccgaacatggttctgggttgctcagcagatggttctcatctcattaccatggaggcgtgcatgatgagaaatctgttgcacgccatactgtaaacttgctaacatcgaccattaaagttgatgcagaccaatcagacttgcggttctgcttcagaataatttctcccacaaagaactatacattgcaggcagagagtgcaatggatcagatggattggattgaaaaaattactggtgtcatcgcttctttgctgagctcccagtcccctgaacggcgtcttctgctgagccctaagggaagcagccatcatcgaactgccagcgaaagcagttctttcagtagctcgacagaacttgaacattcaataagtgaagattgcatgttggaaaagaactcaggaagtggttatttcgatcattcgtctaggggtacacagcatcaccgaacaagcatgatgaagcctgataagccaattgatttgcttaggaaagtggctggcaatggtaattgtgctgattgtggtgctgcagagcctgattgggcatccctgaaccttggaattcttttatgcatagagtgttctggggtgcacagaaatatgggtgtgcatatatctaaggtaagatccctgacacttgatgtcagggtttgggagccatctgtaatcaatctcttccaatcattaggcaacacgtttgccaacactgtctgggaaggaatgttgccttcatcatgctgcactgaccatggtgatatttcaagggctgatgaattagaaaacacattgcatgatcttacactcagcaagcctaaacaatctgatcctattgcagtgaaggagaaatttattcatgccaagtatgctgaaaaggattttgtgcggaagcataatgtggatgaggttcagctagcacaacagatgtgggataatgtaagttcaaacaacaaaaagggggtgtacagtctgattgtggggtcaaatggtgatgtaaatttttcttacggacatacatcattcaattcggctttgactctgggaaaagcgctcctcctacaagagcaaccagcttcaccatctaatggaagttctagatgttttgatcgcaatccgcttgagaaggattctcctggggactctatttctcctgccagcacaagtgctcgtattgacgaatttgacgattatgtcgaagggttgtctttgcttcatctagcttgccgcgttgcggacctgggcatggttgagctgctcttgcagtacggcgccaatgtaaattccacagattcaagagggcgaacaccacttcatcactgcatcatgaaaggcagacccatgtacgctaggcttctgctttcaaggggagctgattctcaagccacggaccgagacggcagaacagcattacagtatgcaattgacggcggaaccatagaagatgaggagatcctcgttttgttagaggacccgagtagataaatcacgtaggtagtcaggtctccagtaccggcgggtggcattgcgtggcgccaagtatagctcgccggtactcccagtttatgtcaagagggaagttatagctttctaggggccatcctcggttttggtcgcggctagagtaaggtgacctgtttcatcgtggatgcagtttgcaaagctgtttggttttgtttgcagatgttgcggtgtgagttttgtacattgggaagtggcttcccgctggtggttgtgacagatgtacatatagcccgtaatttcatgcaagaattagattgg

SEQ ID NO: 4868 - DNA, 2165 bp, Zea mays
ttccttggcgaaggagggaggagtagccgcccggcgatgttcacctgccgctgtgccgtcgtcgttgtcgtcgccctcgccgtgcttctactgccggccgcggcgacccagttggtttactgcgacgattccacctatgccgacaacagcacgttccaggcgaacctgaatctccttagcgcggcgctccccgccaacgcctccgcctcgccggcagggttcgccactggcgcagtcggtacggcgccggaacaggtcaatgggatggcgctctgccgcggcgatacgaacgcttcctcctgttcctcctgcgtcgcggccgcgttccggtacgcgcaggcgcagcagggctgccccctcacgaagggcgccaccgtctacctggacgattgtacccttcgcttcgccggcatccgattcctcgacttccttagagaggaccagtggctcgtcccagaattggttcccgcgattgaacctgcctctgggagcgtcaacgccacagatgcctggttcggcgccgccgtcgcggggatcttcacggccctggtcgaccgcgcagcggcggcgagcaacgcgacgaggaagtacttcgccacggcggagatggatttcgaccctaagctctacggcctcgcgcagtgcgcgccggatctgacgccggcgcagtgccagggctgccttggagacctccagtcgagggtgacggcgcagttcctgagcggacggcccctcggcaacaacgctttcatggtgtggtgctccctgaggtatagtgtgtcgccgttctacgctggccgggcgatgctacagcttccggcgccgccggcacctccaccaacgtccacgcccacgcttcattcttcagggaggaaagtgaatgcagcaggaatctctgcaggcatagcctgtgttgttgtgttgatgttgattctttcggtctttttctttattcgcttcaggctaaggattaaagtgaagaaaaatgatcactcactaaagaagattgggagagctcaatgcacgatctttgatttattgacactggaagaggcgactgaacatttcgcagagaaaaataagcttggaaaaggtggtttcggtattgtgtacaaggggatactgtctgacgggcaagagatagcagtcaagaaacttttaggaagagccgggagtgggttggatcagctacaaaatgaggtgcaagtactggcagagcttcagcacaaaaatcttgttgggttacagggtttttgctcgcatcataatgatacactgctagtttatgaatacatcaagaacgggagccttgacactattctatttgatgatagggaaggaaatgcacttaactgggagcaacagtacaacatcatctttggaattgccaaggggattttgtatctccatgaggactcaagcatgaggatcatccatcgggacctgaaggcaaataacattcttcttgacgacaacatggaaccgaaaattgcagatttcgggttggcaaggcttctaggagaaggccacacacatactcagacaggcagagttgttgggacattcggttatatggcgccagagtatgcatcacatggtagtgtgtcgcctaagattgacatctttagcttcggcgtcttgatccttgagatcgtgaccaggagaagcaactgcagctctgatgaccacagcactgtgaatctcctaagtgatgtctgggatcactggaagaaagggacgatgccacaaatgcttcaccggtcactggatgagtttgctcgaagccaagcgctgcgatgcatccacattggtctgctgtgcgtccagccggaacctgacgataggcctgacatatcagccgtagtgttcatgttaaccagggatagcatagagctccagccgccggggcagcctgcgttcttcttcggtagagaatcaccttcagctttacgattagatggtcaaagcagctatgtatatcaccgtgatggtttcaaattgggacagggcgtctcggtgaatggggttacactcagtgaactgtatcctagataggatcaaagtctggatactgagcacatggaatacagttaacatgttgaactcgataggtttctttgatgattagggtcttgctaatcccctctaacctgtctccatccttt

SEQ ID NO: 4869 - DNA, 790 bp, Saccharum officinarum
cacgcagagaaaaagctcggagagctgagatggcacaagccatggcgtcgatgaccggcctctcgcagggcgtcctgcccagcaggcgcgccgccagcagggccaggacggccgtcgtcgtcagggcgtccgccgagggcgaggccgcggcgcaggcgggccgccgcgccgtgctcgggctggtggccaccggcatcgtcggcggcgccttgtcgcaggcggtgcacgcggcgaccgtcaatcccatcaagatcggagccccgccgccgccctccggtggactcccggggactgaaaactctgaccaggcgagggacttcggcctccccttgaaggatcggttctacctgcagccgctgccgccggcggaggcggcggcgagggtgaagacgtcggcgcaggacatcatcaacctcaagccgctcatcgacaagaaggcgtggccgtacgtccagaacgacctccgcctccgggcctcctacctgcgctatgacctcaagaccgtcatcgcttccaagcccaaggaggagaagaagagcctcaaggagctcaccggcaagctcttcagcaccatcgacgatcttgaccatgccgcgaagatcaagagcaccccggaggccgagaaatacttcgcagcaaccaaagatgtgctcggcgatgttctcgccaagataggctagatggaagataacaaatgggctaaaaagggcatgtaatttcggatttgtgtttgttcatatggagccggcaatgtaccattttctgttgatattatatcagcaagcactta

SEQ ID NO: 4870 - DNA, 846 bp, Zea mays
acgagcacgagactgctcggccgacgaaataataaagcgcgcgcgcgcacgcggagaggctcggagagctgagtgagatggcacaagccatggcgtccatgaccggcctctcgcagggcgttctgcccagcaggcgcgccgccaacagggccaggacggccgccgtcgtcagggcgtccgccgaggcgcaggcgcaggcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgctgccgccggcggaggcggtggcgagggtgaagacgtcggcgcaggacatcatcaacctcaagccactcatcgacaagaaggcgtggccgtacgtccagaacgacctccgcctccgggcctcctacctgcgctacgacctcaagaccgtcatcgcttccaagcccaaggaggagaagcagagcctcaaggagctcaccggcaagctcttcagcaccatcgacgatcttgaccatgccgcaaagatcaagagcaccccggaggccgagaaatacttcgcagcaaccaaagatgcgctcggcgacgtcctcgccaagctagcctagatggaagctaatagatgggttaacgatggccacgtaatttcggacttgtgtttgttcatatggagccggcaaatgtaccgtttcctgttcatattatatcccaagttcttgacaagta

SEQ ID NO: 4871 - DNA, 997 bp, Zea mays
gcgagcgacgtatatgtttgccacgctgccactcgggcaagagactgctcgaccggaccgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgccctccggtggactccccgggactctcaactctgaccaggcgagggacttcgacctccccttgaaggagcggttctacctgcagccgctgccgccggcggaggcggcggcgagggtgaagacgtcggcgcaggacatcatcaacctcaagccgctcatcgacaagaaggcgtggccgtacgtccagaacgacctccgcctccgggcctcctacctgcgctacgacctcaagaccgtcatcgcttccaagcccaaggaggagaagaagagcctcaaggagctcaccggcaagctcttcagcaccatcgacgatcttgaccatgccgcgaagatcaagagcaccccagaggccgagaaatacttcgcagcaaccaaagatgctcttggcgatgttctcgccaagctaggctagacgcaagggctaataatggccatgtaatttcggacttgtgtttgttcatatggacccggcaaggcaatgtaccattttctgttgatattgtatcaggaagcacttaactacaatgctatcttgagtccttgacaagtaccgttgcgagcttatgcaaacatcagaaaaaggtactaacagacttaattcgtgatccactacattaaaaaggtgcaaaattgaaagttcggcattttaaa

SEQ ID NO: 4872 - DNA, 843 bp, Panicum virgatum
gctcgaccggagaagtgcacacacaagccagccaaggcccccgagctgctgagatggcacaagccatggcgtccatgaccggcctctcgcagggcgtgctgcccagcaggcgcgccgccagcagggccagggcggccgtcgtcagggcgtcggccgagggcgaggccgcggcgcaggctggccgccgcgccgtgctcgggctggtggccaccggcatcgtcggcggcgtcttcacccaggcggtgcgcgccgatgaggccgtcaagaccatcaagatcgggcccccgccgccgccctctgggggacttcccgggaccttgaactctgaccaggccagggacttcgacctcgccttgaaggagcggttctacctgcagccgttgccaccggcggaggccgcagcgagggccaagtcgtcggcgcaggacatcctcaacctcaagccactcatcgacaagaaggcttggccgtatgtcatgaacgacctccgcctccgggcctcctacctgcgctacgacctcaacaccgtcatcgcctccaagcccagggaggagaagaagagcctcaaggagctcaccggcaagctcttcagcaccatcgacgatcttgaccatgcggcaaagatcaagagcaccccagaggctgagaaatactacgcggcgaccaaatctgccctcgatgatgttttcgccaagctaggctagatggaatataatgggctaatggccatgtaatttcagacttttgtgtttgttcatatggatatggagccggcaatgtgccatttcctgttgatattatatcaacaagcacgtaactatgatgctatcgtgaggtcttgac

SEQ ID NO: 4873 - DNA, 893 bp, Panicum virgatum
ctgctcgaccggagaagcacacacaagccagccaaggcctccccgagctgagatggcacaagccatggcgtccatgaccggcctctcgcagggcgtgctgcccagcaggcgcgccgccagcagggccaggacggccgtcgtcagggcgtcggccgagggcgagggcgaggccgcggcacaggctggccgccgcgccgtgctcgggctggtggccaccggcatcgtcggcagcgtcttcacccaggcggtgcgcgccgatgaggccgtcaagaccatcaagatcggccccccgccgccgccctctgggggacttcccgggaccttgaactcggaccaggccagggacttcgacctcgccttgaaggagcggttctacctgcagccgctgccaccagcgcaggcggcggcgagggccaagtcgtcggcgcaggacatcctcaacctcaagccgctcatcgacaagaaggcttggccgtacgtcatgaacgacctccgcctccgggcttcctacctgcgctacgacctcaacaccgtcatcgcctcaaagcccaaggaggagaagaagagcctcaaggagctcaccggcaagctcttcagcaccatcgacgatcttgaccatgcggcaaagatcaagagcaccccagaggctgagaaatactatgcggcgactaaatctgccctcgatgacgttttggccaagctaggctagatggaatataatgggctaatggccatgtaatttcagacttttgtgtttgttcatatggagccggcaatgtaccatctcctgttgatattatatcaacaaacacttaactatgatgctatcgtgaggtcttgacaagaacaatcccaagcagatgtgataatcagaaatcaataccaacaacaat

SEQ ID NO: 4874 - DNA, 958 bp, Setaria italica
tatattttttgccacgctgccactggagcccgagactgctccaccgaaaaagctccctcctgactgctccaccgaagaagcgtggaagcgaagccaaggcagctgagatggcacaagccatggcgtccatgaccggcctctcgcagggcgtgctgcccagcaggcgcgccgccagcagggctaggacggccgtcgtcagggcgtccgccgacggcgaggccggccgccgcgccgtgctcgggctggtggccaccggcatcgtcggcagcgtcttctcccaggcggcgcacgccgaggccgtcaagaccatcaagatcggccccccgccgccgccctccggtggacttcccgggaccttgaactctgaccaggccagggacttcgacctcgccttgaaggagcggttctacctgcagccgctgccgccggcggaagccgcggcgagggccaagtcgtcggcccaggacatcctcaacctcaagccgctcatcgacaagaaggcgtggccgtacgtcatgaacgacctccgcctccgagcctcctacctgcgctacgacctcaacaccgtcatcgcctccaaacccaaggatgagaagaagagcctcaaggagctcaccggcaagctcttcagcaccatcgacgatcttgaccatgcggcaaagatcaagagcaccccggaggctgagaaatccttcgcggcgaccaaatccgcgctcgatgatgttttcgccaagctaggctagatggaatatgatgggctgatggccatgtaatttcagacttttgtgtttgttcatatggagccggcaatgtaccatttcctgttgatatttatcaacatgcacttaactatgatgctatcctgagtccttgaccgtacaattccaagcagatgcaaaaatcagaaaccaattctaacaacaataattcgtgatccacgtacatcagaaaatgcgtc

SEQ ID NO: 4875 - DNA, 833 bp, Eragrostis curvula
  misc_feature (4)..(4): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (16)..(19): n is a, c, g, or t
  misc_feature (21)..(23): n is a, c, g, or t
  misc_feature (25)..(25): n is a, c, g, or t
  misc_feature (29)..(30): n is a, c, g, or t
  misc_feature (33)..(37): n is a, c, g, or t
  misc_feature (39)..(39): n is a, c, g, or t
  misc_feature (41)..(42): n is a, c, g, or t
  misc_feature (242)..(242): n is a, c, g, or t
  misc_feature (252)..(252): n is a, c, g, or t
  misc_feature (262)..(262): n is a, c, g, or t
  misc_feature (270)..(270): n is a, c, g, or t
  misc_feature (296)..(296): n is a, c, g, or t
agcnccncgnggngcnnnngnnngntcgnnagnnnnnancnnccagaggaagagcagcgagcagaggcggagaggttgagatggcacaagccatggcgtccatgaccgggctgtcgcagggcgtgctgcccgggcggcgcgtcggcagggccaggacggccatcagggcgtcggcggcggccgagggcgagacgagccgccgcgcggtgctcgggctcgtggccaccgggatcgtcggcggngccttgtccnaggcggcgcncgccgagnccgtcaagaccatcaagatcgggggngcgccgccgccgtccggtggacttcccgggaccgagaactccgaccaggcgagggacttcgggctccccttgaaggagcggttctacctgcagccgctgccgccggcggaggccgcggcgagggccaagcagtcggcgcaggacatcatcaacctcaagccgctcatcgacaagaaggcgtggccgtacgtcatgaacgacctccgcctcagggcctcctacctgcgctacgacctcaagaccgtcatcgcctccaagcccaaggacgagaagaagagcctcaaggagctcaccggcaagctcttcaacaccattgacgaccttgaccacgcggcgaagatcaagagcaccccagaagctgagaaatactacgcggagaccaaaaccgttctcagtgatgtcctcgccaagctaggctagatggagcatgatgggcatatggccatgtaatttcagacttttgggtttgttcatatggaaccggcaatgtaccttccctgttgatattgtatcaacaagcgcttaactatgattcta

SEQ ID NO: 4876 - DNA, 2423 bp, Pennisetum glaucum
cacgctgccactggagcccgagactgctccaccgaaaaagctacccgaagaagcgtggaagcgaagccaaggtagctgatcgatatggcacaagccatggcgtccatgaccggcctctcgcagggcgtgctgcccagcaggcgcgccgccagcagggccaggacggccgtcgtcagggcgtccgccgacggcgagaccggccgccgcgccgtcctcggcctggtggccaccggcatcgtcggcggcgtcttcacccaggcggcgcacgccgaggacgtcaagaccatcaagatcggccccccgccgccgccctctggtggacttcccgggaccttgaactctgaccaggccagggacttcgacctcgccttgaaggagcggttctacctgcagccgctgcccccggcggaagccgcggcgagggccaagtcgtcggcgcaggacatcctcaacctcaagccgctcatcgacaagaaggcgtggccgtacgtcatgaacgacctccgcctccgggcctcctacctgcgctacgacctcaacaccgtcatcgcctccaagcccagggaggagaagaagagcctcaaggagctcaccggcaagctcttcagcaccatcgacagtcttgaccatgcggcaaagatcaagagcaccccagaggctgagaaatactacgcggcgaccaaatctgcgctcgatgatgttttcgccaagctagcctaggtggaatgtaatgggctgatggccatgtaatttcagacttttgtgtttgttcatatggagccggcaatgtaccatttcctgttgatgggcataacattgatgatctcatctgtgtattaaaggaagttgcaactctagattcaactggtccagtacttgtacatgtaattactgggactgaaaatgacactggtggaaatattaggagtgaaataactccaaatgaggaagggccttcaaactcaagccatgatcttcttaaacttttagaaactggactttctaggacatataatgactgctttgtagaagcattaaccgcagaagcagagaatgacaagcgcattgtggtagttcacggtggcatgggaatggatcgatcactccgcttattccagtccagcttcccagacagattttttgacttgggcattgctgagcaacatgctgttaccttttcggctggtttggcctgtggaggtttaaagcctttctgcataattccatccacatttcttcagcgagcatatgatcagatagtagaagatgtggacatgcaaaagatcccagttcgatttgctatcacaaatgctggtctggtggggtctgagggcccaactaattcaggaccgtttgatattacattcatgtcctgtttgccaaacatgattgtcatgtcaccatctaacgaggatgaacttgttgacatggtggcaacagctgcaatggttgaggacagacctatttgcttccggtaccctaggggtgccattgttggaactagtggcactttaacatatggaaatccacttcagattggtaaaggagagattcttgtcgagggaaaagagatagcttttcttggctatggtgaggtggtccagcgatgcttgattgctcgatctcttttatccaactttggcattcaggcgacagttgcaaatgcgagattttgcaaaccacttgacattgatctgatcagaacgctatgtcagcagcatagttttcttatcacagtggaagaaggaacagttggtggctttggatcgcatgtctctcagtttatatcactcgatggtctacttgatggccgaataaagtggcgacccattgtgctaccagacaggtatatcgaacatgcttcactcgctgagcaactcgacttggctggcctaactgctcaccacatagctgcaaccgcattgaccctcctaggtcgtcaccgagatgcacttttgttgatgaaataggaaaaatgaaccaacaagaagaaaagttgaagaaatttgtactgtgcaaaagtttggcatgaagaaagctccttgtatgattgtttttgggagaactgaacctgtcctgggagttggtcaaatgcactactctgaagagcgccggcaaagccagcacccagcatcactactataatcctatgcactactcactagaatagcacctagcatcacttctataaatcttatcatggggattaggtgaccccacaaagcatctacagggtgctatgctgtaatattttgtgaatgtaaatactaaaatgccggtgctattctggtgattaggtgaccccgtgaagcatttacatgacgataccctgtgctgtaatgtattttggatgtaaataccaaaatgcaggtgctacactgaggtgccttgcattagttaataaagttactgagtttcttgtg

SEQ ID NO: 4877 - DNA, 1461 bp, Zea mays
gatctagtcatcggctccgacttctccggtcaagtcctccccctacctctaccagctgcccgtcgcacacaaaaccccaggctgcccgccgccgccgcgacccgccacgccgccatgtccgctgccgcggcgctccggccgatcgagccacttcccctcccgactgggctctccctctcgccgcgcctcaagcttctgctcaccttctttcgcgccgacctcaccgtccggcccctggacgagtggcagctcaagtccgccctcctcgcgtttctccgcgacccacctctccccctcccgctcctccccgactcagacctctccgtgagccgcctccctgacctccagaagcgccgtcgcgaggagcccgtagcctctggggtcctccacgtccgcgacctctccttcctccgcccccgcaagggagacggcgaggccgaggagatgaccggggagcaggagaagtacttcgagtggcggagcaccctggttcagaagctcgaaggcatcgagctcaacctcgagggagtgaagttccggatgaccgtcgagatcccatcgtctgacgacttcagaacgatgaagaagtcatgggaggatttctactcctccgagctactcaataccaggaatcctgtgagaaagatagctaaaaggccagacacaattgttgtccgtggcgtgccttccaggtggtttgcagagacaagagtatcatccaaaccttccacgctggtcacccacactgttttctcagcgcttggtaaaataaggaacctaaatatttccaatgatgatgagatagaagcaaaaggacatggagtcaacaaggggctcatatctggacttaattgcaaagttcaggtgcaatttgagagctacaatgacttccaggatgcaatgaaggcattatgtggacgttctttagagaaggaaggatcacggttgaaagtagactatgacgtgacctgggactgtgaaggtttctttcgcatttctcaatatgagccagttcgtaacaatttagaggagagggattcattagcatcggttaatagccagaggaaacatcacacttcgcgaattgaatcagattataggaagagattcagggagtgatgacataagcccatggtatgagcgagatttctttgtcctctggagagggaaaacagctgcattgtaccatcgtattgtttcgttctcagatttcaagttatatttctcatttgttcacaattaaccgaacagaaaaacccattctgatacttactaatttgtatttattattagtatcggttttatccttgatgatacccagaggccagagagcgccacaaaacgaactgtttttttattccaaagaattcttagatgttgagcattggcgcctggacccatgctcatcgatcagtcacagtggcgtctgagttcagacttcagagtaatgaatgatttcag

SEQ ID NO: 4878 - DNA, 1390 bp, Setaria italica
ccccggcctgtaacccggcagccgcaccaaaaaaccccaggccgccaggcgccgccccgacccaccgcgccaccatgcccgccgccgcggcgctccggccgaccgaaccgctcccacttccgagcgggctctccctaacaccgcgcctcaagcttatcctcaccttcttccgtgctgacctcaccgtccgccccctcgacgagtggcagctcaagtctgccctcctcaccttcctccgcgacccgcccctctcgctcccgctcctccccgactccgacctctccgtgcgccgccttcccaacctccagaagcgccgccgcgaggagcccgtcgcctccggggccctccatgtccgcgacctatccttactacgcccccgcaaaggcgacagcgaggccgaggagatgaccccggaacaggaggaggagaaatacttcgagtggcggagctccctggtcgagaagctggaaggcattgagctcaatctcgagggagtcaagttccggatgaccatcgagatcccgccgtcggaagacttcaggacgatgaagaaatcgtgggaggatttctactcctccgagctactcaatagcaggaatccggtgaggaagatagcgagaaggcctgacactattattgtccgtggagtgccgtccaggtggtttgcagagacaagagtatcatccaagccatccacgctggtcacacacactattttctcagctctcggtaaaataaggactctaaatattgccaatgatgatgagttagaagccaaagaagatggagccaataaggagctcatatctggactcaattgcaaagtttgggtgcaatttgagagctatgatgacttccatgatgcaatgaaggcgttatgtggacgctctttagagaaggaaggatcgcggctaagggtagactatgatgtgacctgggaccgcgaaggtttctttcgtattgctcagtatgaacctgctcgtagcaatgtaggtgagaaggatgcatcagcgtcggttcatggccggaagaaacattacacttcacgaattgagtcagatcataggaagagatttagggattgatgacacaaggcatggtatgggaagacattgctatgttatgagagggaaaacggctgatttgtatcattgtattgctccattctcagatttcaactttttttccacctttcattgtcaattaactaacagaaaatcattctgatagttactgatttgtagttataactatcagtattgtcctggttgatgcccagacggcagatatcacgacaaaacgaaattgttttttcgtgtctaagaatccacagcacattgagcatcggcggacggcggttccgcccatgctcatttatcagtcacaatgg

SEQ ID NO: 4879 - DNA, 3039 bp, Oryza sativa
cgcgtgaagcaacagttctctcgcctccggttctccattgtccattcacccggcccatctgcaacccgtcgagtccaacccgccgccggtccgccgccatcccgccgtctctctccccaccaccgcgccgccatgtccgccgccgccgccgccctccggccgaccgagccgctccccctcccgagcggcctctccctcgcgccgcgcctcaagctgctcctcaccttcttccgcgccgacctctccgtccgccccgtcgacgagtggcagctcaagaccgcgctcctcgccttcctccgcgacccgcccctctccctccccgtcctccccgactccgacctctccgtgcgcaccctccccgacctgcataagcgccgccgcgacgagcccgtcgcctcgggcgtcctccacgtccgcgacctctccttcctccgcccacgccgccgcaacggggatgatgaggaggaggaggccgaggagatgacccgtgagcaggaggaggagaagtacttccagtggaggagctccctggtcgagaagctggccgggatcgagctcaacctcgagggggttaagtttcggatgagcgtcgagatcccgccctccgatgacttcagggcaatgaagaagtcttgggagaatttctacgcctccgagctcctcagtagcaggaatcctgtgaggaagatagcgaaaaggccagacaccattcttgtccggggtgtgccatccaggtggtttgcggagacgaggatatcatcgaaagcctccacgctggtcacacacactattttctcggcacttggtaaaataaggaaccttaatatttctagtgatgatgaatggggagcaaaacaagacggaaccaataaggagattatatctggactaaattgcaaagtgtgggtgcaatttgagaactacgacgatttcaacagtgcaatgcaggcattatgtggacgttcattagaaaaagaaggatcacggttgaaggtagactatgaagtaacttgggatcatgaaggtttcttccgcaatgcacaatacgagcctgttcgcagcaatttagaagagagaaattcatcggctcatggaaggaagaaacattacacatcgcgaattgagtcagatcatagaaagagatttagggattgatggatatagggcatggcatgatggtgggattacttggttccaaggacagggaaaatgattgtactgtatcattctgttgtttcatcattagtctaacagtaaagtctttctgaattaggtattgcgtagttattactattagcctatgtcctggttgattcccagagatcatcacaacacagtcttgcttgtgatttgtaaaagaatttgcactgttggcatctcaatgtatgctcattcattgttcaatcacaaactcacaattttgctgaatgagaaattgcaatggctaagatcagcctaagcctgcaaattctaagcataactgtttgtattggttaaaagtcagataatgtgaattgacattgacgaggcaggtacaattgcattttcttctggattgtcaaacaagtaagttctctaacttctagaagtaaacatgcttgactttctattcattgtgatatgcgtggctacacaatcacatgcctgaatctagaagttctttactgatgattgtacctaaaaacaaggtcaacggatagagccaaaaaaaaaaaacatgtttccacaacgtataaacgaatggcgctctctcaaatcaaccagagatccagaagtcgaaggcatagttaacatacatagagatgaaaataaactgccagtacaccagggacgagttaatggacaaaattctgtaaaatttatgaacaattttgggtagccacacaagaagggggctgatgctacatgaacactggatgcaattgcaaccaaactgaatcgaaacggtaggaaagataacaaaaaaaatctgatcttcctggccaccctactgtacaaacatttacaaacacggcgttgattttttcacagcgtgtggtgaatgaatccacgcgaattactaccctttcttcccatgtggatgacttctcggcgagatcaactcatggacaccggagctacccctcttgccgtgcgaaggacccagcaatggcgtcacggccatcttcttgtcgctcgccttcttgccgagaaccttgacggcggccttcgatctcctcacgccgtgcgccccgccggcgccgccggcgccattagagctggccgtcaggatcggcacgaggtaccaccagacggaggtgcagcagatggcgaacaccttgccgaacaccacgaggctcgccagcagcagcaccgccacgaacggcatgtagtggcgcggccgcacgtccgaccacgaccacctcacgccggccttccgcttcgcactccccggctccgccgccgccgcggcggcggcggggcgcgcgggcttgatcacgtcctccctggggctggcgggctccgacgtcggtggcgtggacgactgcgacgaggtcgccgacgtcgcggccgcctgctgcttccgcttgttcttccctcccttccgctgctgctgctcctcctcctcaggcgggagcttgacgacgatgggcacccaccctttcccctccgactgcacgaaccggacgagcacatgctcaccaccaccaccgccgccgccctcccccggtgcgccgccgccgccggcgccgccgacttggcgaaggatcttctcccgccgcgactcgagctcggacagcacggtggagaacttgtcgagccccctcgacgcgtacgggttctccttcttcccaccaccaccaccgccgccctgcttcttcttcttcgcctccggcgccgccgccttgccgtcgacgtccttgaaactgcccgtgccgcagaacaacatctcttgcatattaccgtgtgcggatcaacgatttctggcgccacgggcacgagccttttaaagaggatttgccaacgcaacgcaacgcaacgcgatcgcctctgtttctg

SEQ ID NO: 4880 - DNA, 647 bp, Zea mays
ttcggcagcatgggcgcggttgagccgccggcgtggatgtccgccgcggcgcgcaggtggctggagaacgccggcgccacggcggaggacaccccgggccgggccttcaacgcgctgccgctctccggcgtgcgcgtgtccctcgcggagcgcggccgcgcgctctgctcgctccgcgtgccgccccacctcacggacgcggaggggaactggcacgcgggcgccatcgcggcggcggcggacgacgtgtgcgccgcggccatcatgtccgtggagggcatcatcaaggtctccgtccactacgacatctcctacttcacaccggccaagctccatgatgaagtggagatggatgggcgggtggtggagcacaaagggaggatgacggcggtggtggtggagatccggaagaagaaatccggcgagctggtggctatcgggaggcagtggatgacggcctccaggcccaaaggcgctgctgctcacagcaagatctgaactgaagcttcttccttccttccttccttgggtttcctttcctacctcgaaaactactgctctcgagtgaattgaactggctgtaattactaattactggggaaaaacacggtttaggttgctgtgatttgttactggcgtccccttta

SEQ ID NO: 4881 - DNA, 535 bp, Zea mays
tggtcatccgcgacacaacattcggcagcatgggcgcggtggagccgccggcgtggatgtctgccgcggcgcgcaggtggctggagaacgccggcgccacggtggaggacgccccgggccgaggcttcaacgcgctgccgctctccggcgtgcgtgtgtccctcgcggagcgcggccgcgcgctctgctcgcttcacgtgccgccccacctcacggacgcggaggggaactggcatgcgggcgccatcgcggcggcggcggacgacgtgtgcgccgcggccatcatgtccgtggagggcatcatcaaggtctccatccactacgacatctcctactttacaacggccaagctccatgatgaagtggagatggatggtcgggtggtggagcagaaagtgcggatgacggcggtggcggtggagatccggaagaaggaatccggcgagctggtggccatcgggaggcagtggatgacggcctccaggcccaaagtcgctgctgctcacagcaagatatgaactgaagcttcttcctt

SEQ ID NO: 4882 - DNA, 772 bp, Setaria italica
gtagcgtcgtcgtcccactcccatcagagcccaccgctgaccgccaccgatccccaccccgcatgcatgggcgccccgacggaaggccccccggcgtggatggcggccgccgcccgcaggtggctggaggacgccggcgccaaggtggaggggggccaggaccgggccttcaacgcgctgccactcgccggagtgcgcgtgtccctcgctgagcggggccgcgcggtctgctcgctccgcgtgccggcgcacctcaccgacgcggaggggaactggcacacgggcgccatcgccgcggcggcggacgacgtctgcgccgccgccatcatgtccgtcgagggcatcatcaaggtctccgtccactacgacatctcctacttcgcgccggccaagctccatgacgaagttgagatggacggcagggtggtggagcgtaaagggaggatgacagcggtggcggtggagatccgaaggaaggagtccggcgagctggtggcgatcgggaggcagtggatgacggcgtccaggcccagtggttctcggagcaagatctgatacttcatctgtcttctatcttgccctgaaacgggagattggttgctgtaacacaggagatgggtttggtgactcttcatttgtctggcaattcagttggacctgttgtttctgcctatctgttcttgtgcgctgctctctggctgctgcactgctgctatgtgcattgtgctctctgaatggcgggccgaaacgctgatggcttgccaaaccagtt

SEQ ID NO: 4883 - DNA, 833 bp, Panicum virgatum
  misc_feature (643)..(643): n is a, c, g, or t
  misc_feature (650)..(650): n is a, c, g, or t
gcctcgtcgtccggtgagagcccaccgccaacgaaccccaccatgcgggagcccccggcatggatggcggacggcgcccgcagatggctggaggacgccggcgccacggtggagggcggccccgaccgggccttcaacgcgctgccgctctccggcgtgcgcgtgtccctcgccgagcggggccgcgccgtctgctcgctccgcgtgccggcgcacctcaccgacgcggaggggaactggcacacgggcgccatcgccgcggcggcggacgacgtctgcgccgccgccatcatgtccgtcgagggcatcatcaaggtctccgtccactacgacatctcctacttcgcgccggccaagctccatgaggaagttgagttggatggcaaggtggtggagcataaagggaggatgacagcggtgacggtggagatccggaagaaggagtctggcgagctggtggcgatcgggaggcagtggatgacggcatccaggcccagagggagcaagatctgacgcctcatctatcatccctgcctggccctgaaacgggtgttgagttactaaactagcagttggtgagctcggctcaaggcaattgccgggtgagttaccgttacaaagattgattgctgttacacagganatatgtntggtgactctctggcaattaagttggatttgtttctgccttgtgggccaaacaagttagtaggagctctgtttttgtgcattgttgctttttgctccattccattgcattgcaagctgtgcagggctcttgttgtggtgaatcgatggctgatgggcctaacctgttatacccttttttcatc

SEQ ID NO: 4884 - DNA, 517 bp, Zea mays
cattcggcagcatgggcgcggtggagccgtcggcgtggatgtctgccgcggcgcgcaggtggctggagaacgccggcgccacggcggaggacgccccgggccgaggcttcaacgcgctgccgctctccggcatgcgtgtgtccctcgcggagcgcggccgcgcgctctgctcgcttcgcgtgccgccccacctcacggacgtggaggggaactggcatgcgggcgccatcgtggcggcggcggacgacgtgtgcgccgcggccatcatgtccgtggagggcatcatcaaggtctccatccactacgacatctcctacttcacaacggccaagctccatgatgaagtggagatggatggtcgggtggtggagcagaaagtgcggatgacggcggtggcagtggagatccggaagaaggaatccggcgagctggtggccatcgggaggcagtggatgatggcctccaggcccaaagtcgttgctgctcacagcaagatatgaactgaagcttcttcctt

SEQ ID NO: 4885 - DNA, 507 bp, Zea mays
catgggcgcggtggagtcgtcggcgtggatgtctgccgcggcgcgcaggtggctggagaacgccggcgccacggcggaggacgccccgggccgaggcttcaacgcgctgccgctctccggcgtgcgtgtgtccctcgcggagcgcggccgcgcgctctgctcgcttcgcgtgccgccccacctcacggacgcggaggggaactggcatgcgggcgccatcgcggcggcggtggacaacgtgtgcgccgcggccatcatgtccgtggagggcatcatcaaggtctccatccactacgacatctcctacttcacaacggccaagctccatgatgaagtggagatggatggtcgggtggtggagcagaaagtgcggatgacagcggtggcagtggaggtccggaagaaggaatccggcgagctggtggccatcgggaggcagtggatgacggcctccaggcccaaagtcgttgctgctcacagcaagatatgaactgaagcttcttcctt

SEQ ID NO: 4886 - DNA, 889 bp, Triticum aestivum
cccgaaagaaagatgaggagtaggtctgccggtcatcgcgtcaacctcgatccccgtccaccgcgcacgccgccgaggcaccccgcgcccgcacggcgcgtgcatgggcgacccggcgccgcccgcgtggatggccgccgcggcccgcaagtggctcgaggacgccggcgccatcgcggaggatggcgccggcgccggcgacggccgcagggcttttaacgcgctgccgctgttcggcgtgcgcgtgtccctcgccgagcgcggccgcgccgtctgctcgctccgcgtgcccgcccacctcacggacgcagacgggaactggcacgcgggggctatcgcggcggcggtggacgacgtttgcgcggcggcgatcatgtcggtggagggcatcatcaaggtctccgtccactacgacatctcctacttcgcgccggccaagcaccatgaggaggtggagatggacggaagggtggtcgatcagaaagggaggatgacggcggtgacgacggaagtccggaagaaggagtccggcgagctggtggcgatcggccggcagtggatgaccacctccagaccaaagggatatcaaggaagcaagctatgatacagcaacgatgaggacactatctgtccaaattcattgattaactgacaatgttaaatgagtggagatcttgttcgaaaaaaaatgagtggagatcaccttcagtctaaagggatctcaaggaagctgcgttgggcatttcgtcggttgacttgagtttgaggatatgcctacatcgtgcattgtttttttcttttttgcggggttacatcgtgcattgttgctagtcactatcatgggttaattaagtcgaaaacctcggcgccctatagtgagtcgtattag

SEQ ID NO: 4887 - DNA, 1835 bp, Panicum virgatum
cccgccaaatcaaaatcaaagcctagcaaggagagcagagcacccgcggccaccaccagctccagcctccagctaccaggtcatccgcctcgttcgttggctttccagcatctccattccgcgattcatggcggcggccaagtccatcaagcggctgccggcgcggcgggtggtcccggccgagcccacgccggccggcccgctccgcctctcgtggctggaccggtaccccacgcagatggcgctcatcgagtcgctccacgtgttcaagccggccgctgaccgcgtcgccgccgccggcggcgacgtcgatgcctccgccagcccggccaggacgatcgagcgcgccctggcccgcgcattggtgcgctactacccgctggccgggcggctggtgctctcggcggacggcgcgcagcaggcggtggactgcagcaacgcgggcgtgtggttcacggaggccgcggcggcgtgcagcctcgaggacgtggactacctggaggccccgctgatgatccccaaggacgagctcctcccgcccacgcccgccggcgaggacgagcgcgcgctcgtcctgctcgtccaggtcaccgccttcgcgtgcggcggcttcgtcgtcggcttccggttcagccacgcggtcgccgacgggcccggcgccgcgcagttcatgaacgccgtcggggagctggcgcgcggcgcggaggcggaggccgcgccggtggagccgcagtggggccgcgacgcgatcccggaccccgccgccgccctggtcagcagcctcccgcggtccgacggcgccagcaagcggctcgagtacctcgccatcgacatctccgccgactacatcagccacttcaaggcccactacgtcgcggcgcacggcggcgccgcctggtgctcggcgttcgaggtgctgatcgccaaggcgtggcagagccgcacccgggccgccgggcttcgagcccgactccccccgtccacctctgcttcgctatgaacgcgcgccccatgctgcacgcctccctcccgcgcggcggcgccgggttctacggcaactgctactacatcatgcgcgtgtcggcgccggcgggcagggtggccgggtcgtcggtgacggaggtggtcaagatcatcaaggacgggaagcgccgcatgccggcggagttcgcgcggtgggcggcgggggagatgggcgccgccgacggcgtcgacccgtaccagatcacgtccgactaccggacgctgctggtgtccgactggacgcggctcgggttcgcggaggtggactacgggtggggcccgccggcgcacgtcgtgccgctgacgaacctggactacatcgccacgtgtatcctggtgaagccgtgggcccacaagccaggggcgcggctcatcacgcagtgcgtcaccccggaccgcgtcgccgccttccacgagggcatgctcgacatgaactgaacaagtctgatgaatgtctgacggaggagagcgagggagtcagtcagtcagagaagccgaaggcgaaaagggagctcgtgattaaggctaatgatgacgtgattaggtgggtaattagagatggttgttggtgtcatgtggggattggtattggattagctaaccgatggggggttgatgagtgttgttggttggttggtgatgtgtgcgtagcactagcacctgaataaccgaactcctgaattcaggaaggttttggggaactgaactgtattgcattgcattgcatctggtgggaagccaccacctgcttacaccaatattggattatttcatctttgatcattttttcgaagaggatttcatctttgacc

SEQ ID NO: 4888 - DNA, 1785 bp, Setaria italica
gtcaagccaacaaccaaatcaaatcaaagccaagcaaagggggagcagagcaccagcagccaccagctccagctacctggtcatcccacccgccccctcctccgaccttccatccagcaactcgaaccaactccattccgggattcatggcggcggcgaagtccatcgagcggctcgcggcgcgccgcgtggtcccggccgagcccacgccggccggcccgctccgcctctcgtggctggaccggtacccgacgcagatggcgctgatcgagtcgctccacgtgttcaagccggcccccgaccgggccgtcgccgacgcctccgcgagcccggccaggacgatcgagcgcgccctggctcgcgcattggtgcactactacccgctggccggccggctggtcctctcggaggacggtgcgcagcaggcggtggactgcagcaacgccggcgtgtggttcacggaggccgcggcggcgtgcagcctcgaggacgtggactacctggaggccccgctgatgattcccaaggacgaggtcctcccgcccacccccgccgccggcgaggaggacgagcgcgcgctcgtcctgctcgtccaggtcacctccttcgcgtgcggcggcttcgtcgtcgggttccggttcagccacgcggtcgccgacggtcccggcgccgcgcagttcatgaacgccgtcggcgagctggcgcggggcggggaggtcgtgtccgtcgagccgcagtggggccgcgacgcgatccctgaccccgcgggcgccatggtagtggcttcccgacccccgacggcgccaagcggctcgagtactcggcatcgacatctcgccgactacatcaacacttcaaggccagtacagcgcgggcggcggctggtgctcggcgttcgaggtgctgatcgccaaggcgtggcagagccgcacccgggccgccgggttcgagccggactcccccgtccacctatgcttcgctatgaacgcgcgcccgatgctgcacgcctccctcccgcacggcggcgccgggttctacggcaactgctactacatcatgcgcgtgtcggcgccggcggggaaggtggcgggctcctccgtcacggaggtggtcaagatcatcaaggacgggaagcggcgcatgccggccgagttcacgcggtgggcggcgggggagatgggcgccggcggcgtcgacccctaccagatcacctccgactaccggacgctgcttgtgtccgactggacgcggctcgggttcgcggaggtggactacgggtggggcccgcccgcgcacgtcgtgccgctgacaaacctggactacatcgccacgtgtatcctggtgaagccctgggtccacaagccaggggcgcggcttatcacgcagtgcgtcaccccggaccgcgtcgccgctttccacgagggcatgctcgacatgaactgatgaacaggtctgttctctcttctctggaggagagggaagagcgagtcaatcagagagaagccgaaggcgaaaaggaagctcgtgatcaaggttaatgacgtgattaggcgggtaattagaaatggttgttggtgtcatgtggggattggtattgtattagttaactaatgggtgggattggatgggtggtgttggttagcgatgtgtgcgtagcaccgcctgaataactgagctcctgaattcaggaaggttttggggaactgaattgtacttgcatttggtgggaagccaccacctgattacaccaatattgaattattatttttatcttcgatcatacta

SEQ ID NO: 4889 - DNA, 1955 bp, Zea mays
cgtcaatccaacaaccaaaccaagcgcaggcggcaggcggtttgcttacctggcaggctcccttctcctttcctcacccagctccatcccgtgatcctgatccatcgatccatggcggcggccaataagtccatcgaccggctggcggcgcgccgggtggtcccggccgagcccacgccaaccggcccgctccgcctgtcctggctagaccgctacccgacgcagatggcgctcatcgagtcgctccacgtgttcaaggcggcccccgaccggcccgccaccaagaccggcagcactgacgccgccgccagcccggccaggaccatcgagcgggcgctcgcgcgcgcgctggtccgctactaccctctggcgggccgcctggtgctgtcggagtccggcgcgcagcaggcggtggactgcagcaacgccggcgtgtggttcacggaggccgaggccgcctgcaccctggaggacgtggactacctggaggcgccgctgatggtgcccaaggacgagctcctcccgcccaccccggccggcgacggcgaggacgagcgcgcgctggtcctgctcgtccaggtcaccgccttcgcgtgcggcggcttcgtcgtgggcttccgcttcagccacgccgtggccgacggcccgggcgccgcgcagttcatgaccgcggtcggggagctggcgcgagccgccggccaaggcctcgcgctcgcggtgccgtcggtggagccgcagtggggccgcgacgccgtcccggaccccgcggccgcgctggtggggcggctcccggctcccggtcccggcagccagcggcggcggctcgagtacctcgccatcgacatctccgccgactacgtcgcccactacaaggcgcagtacagcgcggccgcgcacggcggcggaggcgccgcgtggtgctccgcgttcgaggtgctgatcgccaaggcgtggcggagccgcacccgcgcggccgggttcgacgacccggactccgccgtgcacctctgcttcgccgtgaacgcgcggcccatgctgcacgcgtcgctcccgcggggcggcgccgggttctacggcaactgctactacatcatgcgcgtgtcggcgcccgcggggaaggtggcgggcgcctcggtcgcggaggtggtgaggatgatcaaggacgggaagcgccggatgcccgcggagttcgcgcgctgggcggcgggggagctgggcgccggcggcgtcgacccctaccagatcacgtccgactaccgcacgctgctggtgtccgactggacgcgcctcggcttcgcggaggtggactacggatggggcccgcccgcgcacgtcgtgccgctgacaaacctggactacatcgccacgtgcatcctcgtgaagccctgggcccacaagccaggggcgcggctcatcacgcagtgcgtcaccccggaccgcgtcgccgccttccacgaggccatgctcgacaccagctgctgatcggagagaagagatgagtctgggggctctatttgcatgcatcgtctgtgtctgtgtggtgggaagccgccgcctacttacagaaatatgtgacattattcatgatatctggaaaaaaatgtgagctgtattgcatcagtgagtgctagcgccaacacactccacctgtgactgtgacagcctcgtgtgcggctacgacaaatcggtcccgactccgggagatctatcacgacagaatgagcatcagaaaggaagcgtacgttgctgcactgatactgaacttcacagctgcactgcacacatgcagaacagacaacgagttcaaaggctagcagcctagcactaagtcagaaagctagcagcgtgccctatccagaattcataattaaaatgtcaactgttttctgtaacttccggtcgcatcttgctctcaatcacagatgcccagatcagtcagtacgcaaacgcaagta

SEQ ID NO: 4890 - DNA, 2094 bp, Zea mays
gggaatatgcgtacacgatcattatgggggagtggatgggacgggaatgggatggatagagcagtgctgcaggggccagggagcaggggagtcgaaggccccaccctagtccgccaacccacccagctcggctccaccgtggcagcttctttgaccctgacgctactgagcgtgtgggccctcgtggacgccttccatccgactctcgtcctcgtcaccagcccccgacccatcacccaccacttttcaacacctcccccctccgaccgcacacctataaaacacaccagcaaccacccttcccgtccaagtcaatccatccagcaaccaaaatcaaaccaagcaaagcgcaccgcaggcggcgccagccagcggcagtagcttgcttacctggtccccgcccccacacctcttcccttcccttctccctcccatcacacaactccatctccaccccgtgaccgacccacccatccatggcggcggcgcccaagtccatcgagcggctgccggcgcgccgggtggtcccggccgagcccacgccagccggcccgctccgcctctcctggctggaccggtaccccacgcagatggcgctgatcgagtcgctccacgtcttcaaggcggcccccgaccggccggccgccgccagaggcagcccggccgggaccatcgagcgcgccctcgcccgcgcattggtccactactaccctctggcgggccgcctggtcctgtcggagtccggcgcgcagcaggccgtggactgcagcaacgccggcgtgtggttcacggaggcccaggccgcgtgcacgctcgaggacgtggactacctggaggccccgctgatggtgcccaaggacgacctcctcccgcccaccccggccgccgaggacgagcgcgcgctggtcctgctcgtccaggtcaccgccttcgcgtgcggcggcttcgtcgtgggcttccgcttcagccacgccgtcgccgacggcccgggcgccgcgcagttcatgaccgcggtcggggagctggcccgcgccagcgccggaggcgccggcgccggcgcggtgtcggtggagccgcagtggggccgcgacgcgatcccggacccggcggcggcgctggtggggcggctcccgacccccgacgccggcaccaggcggctggcgtacctcgccatggacatctccgccgactacatcgggcactacaaggcggagtacagcgcggcgcacgcggcgggcgccgggtggtgctccgcgttcgaggtgctcatcgccaaggcgtggcggagccgcacccgcgcggcggggttcgagccggacaccctcgtccacgtctgcttcgccgtgaacgcgcggcccgcgctgcacggctcgctcccgcgcggaggcgccgggttctacggcaactgctactacatcatgcgcgtgtcggcgcccgcggggaaggtggcgggctcctcggtggcggaggtggtgaggatcgtcaaggacggcaagcggcggatgcccgcggagttcgcgcggtgggcgacgggcgaggccggcgccgccggcgtcgacccgtaccagatcacggccgactaccgcacgctgctggtgtccgactggacgcgcctcggcttcgcggaggtggactacggctggggcccgcccgcgcacgtcgtgccgctcaccaacctggactacatcgccacgtgcatcctggtgaagccgtgggcgcacaagcccggggcgaggctcatcacgcagtgcgtcaccccggaccgcgtcgccgccttccacgacggcatgctcgacaccagctgctgagctgagcagctctgcctgcctgtgctggattcgaggaaggcaggattggtattggattggatggggggtgggggagcgtggatgcattggttggtggtgattgtttgtcagtgtgtgtgtgttacctgctgaataactcccagaccccctcgattcagggagtttgggggagctgagctgtgttacctactcgcaccaatattgaattattcatctccgaaaaaaaggagatcaattaaccattctacatgacctgctggtagctgttaccatcctgttttcgatg

SEQ ID NO: 4891 - DNA, 2114 bp, Oryza sativa
aaaaaacactgctaatttggagatagagtccagagtctatggagcaggaaggaagggttcagacttgcttggaaagcacatcttcccctacctttgaccacgacgctggaactcacacgagcaggaaatctctgacaatggcaggtgggccccaccccgactccttcctacccacggccgactcccctcctcgtcaccacgttgtccatttgatccaccatttcccaaatccaaaacacctataaataccactcaccctccttgcactccaaacaagtcaaatcaaaccaaccatttcaaaccaaagcaaagcaacgagctagcaagggcaacaacaaccacccctctcctcgtcttcgtagttggttattcctctcagctacaccattttgttaacaatggcggccgccaagtccgtcgagcggctcgggcagcggcgggtggtgccggccgagccgacgccggccggtcccctccgtctgtcgtggctcgaccgctaccctacccagatggcgctgatcgagtcgctccacgtgttcaagccggctctcgatagggcgatcggcggcgatgacgtggcggttgggccggcccgcacgatcgagcgggccttggcgagggccttggtgcattactaccccctcgcgggccggctcgccttctccgactccggcgaggtgtgcgtggactgcggcgacgccggcgtgtggttcacggaggcggaggcgagctgcagcctcgaggacgtggactacctcgagtacccgatgatggtgcccaaggacgagctgctcccgccgacgccggcgggggaggaggagcgcgagctcgtgctgctcgtccaggtcaccgcgttcgcgtgcggcggcttcgtcgtcgggttccggttcagccacgcggtggcggacggccccggcgcagcgcagttcatggccgccgtcggcgagctcgcccgcggcgcgggcggcgtgtccgtcgatcccgtgtggggccgcgacgcgatcccggaccccgccgccgccgtcatcggcagcctccccgaccccgccggcgccaagcgcctcgagtacctcgccgtcgacatctccgccgactacatcaaccacttcaagaaccagtacaacgcggaggcgcacgccgccgccgcgggcgtcgccaggtgctcggcgttcgaggtgctgatcgccaaggcgtggcggagccggacgcgcgcggcggggttcgagcccgacaccaccgtcaacctctgcttcgccatgaacgcgcgccccctcctccacgcctccctcccgcgcggcggcgccgggttctacggcaactgctactacatcatgcgcgtctccgcccccgccgggaaggtggcgggctcgtcggtgacggaggtggtgaagatcatcaaggacgggaagcggcggatgccgtcggagttctcccggtgggccgccggcgacatggccggcggcgacccgtaccagatcacctccgactaccggacgctgctggtgtcggactggacccggctgggcttcgccgaggtggactacgggtggggcccaccggcccacgtcgtgccactgacgaacctggactacatcgccacgtgcatcctcgtcaggccctgggcccacaagcccggggcccggctcatcacccagtgcgtcacccccgaccgcgtcgccgccttccacgagggcctcctcgacctgaactgacgccgccggcggcgaacctggactcgccggaggccgggaggatgggtggattagcgtcgcgtgattaggtgggggtgattactactgatgattagatgggtggtcgttgtgtgattagtgggggttggtaactgaattggattggattagttattaatacggaagctcgtgggtggagcgtggtgtgggtgtgggtgatgtaagcctgaaaataagcagctcaactcctgaaaatcgggggtgtttttggttcatccattcaattgaatttgggttgcatttgataacaatcttcgaattgttgtgtttacgtttacggcgttgtctgaattgtgttcccttctgtccgaaagggacaaaagcggcagaaaattctcgtcagtcactccgttgtcacaggga

SEQ ID NO: 4892 - DNA, 1431 bp, Oryza sativa
atggcggccgccaagtccgtcgagcggctcgggcagcggcgggtggtgccggccgagccgacgccggccggtcccctccgtctgtcgtggctcgaccgctaccctacccagatggcgctgatcgagtcgctccacgtgttcaagccggctctcgatagggcgatcggcggcgatgacgtggcggttgggccggcccgcacgatcgagcgggccttggcgagggccttggtgcattactaccccctcgcgggccggctcgccttctccgactccggcgaggtgtgcgtggactgcggcgacgccggcgtgtggttcacggaggcggaggcgagctgcagcctcgaggacgtggactacctcgagtacccgatgatggtgcccaaggacgagctgctcccgccgacgccggcgggggaggaggagcgcgagctcgtgctgctcgtccaggtcaccgcgttcgcgtgcggcggcttcgtcgtcgggttccggttcagccacgcggtggcggacggccccggcgcagcgcagttcatggccgccgtcggcgagctcgcccgcggcgcgggcggcgtgtccgtcgatcccgtgtggggccgcgacgcgatcccggaccccgccgccgccgtcatcggcagcctccccgaccccgccggcgccaagcgcctcgagtacctcgccgtcgacatctccgccgactacatcaaccacttcaagaaccagtacaacgcggaggcgcacgccgccgccgcgggcgtcgccaggtgctcggcgttcgaggtgctgatcgccaaggcgtggcggagccggacgcgcgcggcggggttcgagcccgacaccaccgtcaacctctgcttcgccatgaacgcgcgccccctcctccacgcctccctcccgcgcggcggcgccgggttctacggcaactgctactacatcatgcgcgtctccgcccccgccgggaaggtggcgggctcgtcggtgacggaggtggtgaagatcatcaaggacgggaagcggcggatgccgtcggagttctcccggtgggccgccggcgacatggccggcggcgacccgtaccagatcacctccgactaccggacgctgctggtgtcggactggacccggctgggcttcgccgaggtggactacgggtggggcccaccggcccacgtcgtgccactgacgaacctggactacatcgccacgtgcatcctcgtcaggccctgggcccacaagcccggggcccggctcatcacccagtgcgtcacccccgaccgcgtcgccgccttccacgagggcctcctcgacctgaactgacgccgccggcggcgaacctggactcgccggaggccgggaggatgggtggattagcgtcgcgtgattaggtgggggtgattactactgatgattagatgggtggtcgttgtgtgatta

SEQ ID NO: 4893 - DNA, 1683 bp, Brachypodium distachyon
caacaaatcaacacaaagcaaagcaatcggctgagcagcaacaatcatctccgtctccatcacatccaatccactgatcaattcctcttctcaccaactccgatctgtcacattctcgtctcccatggcggcagccaacaagtccgtctcacggctgccgcagcggctggtgctcccggcggagcccacgccggccggcccgctccggctgtcctggctcgaccgctacccgacccagatggccctcatcgagtcgctccacgtcttcaagcccgcccccgcccacgacggcgcggacccggcccgcaccatcgagcgggccctggcccaggccctggtccgctactacccgctcgccggccgcctcgccttcacggacgacggcgggcagtcccacgtggactgcggcgggcccggcagcggcgtgtggttcacggaggccgcggcggcgtgcgggctggaggacgtcgactacctggagcaccccatgatgatccccaaggacgcgctcctcccgcccacgccgcacgccgccgaggaaggcgacgagcggaggctcgtcctgctcgtccaggtcacctccttcgcctgcggcggcttcgtcgtcgggttccgcttcagccacgccgtcgccgacggccccggcgccgcgcagttcatggccgccgtcggagacctcgctcgcggggcagagtccctgtcaatggagccgcagtggggccgcgacgcggtgcccgacccggccggcgccgtcgtgggcgccctgccggaccccgccggcgcgaagcggctcgagtacctggccatggacatctccgcggactacatcgaccacttcaaatcccaatacaactccagcaacaatggcggcggcgcccggtgctcggcgttcgaggtgctggtggccaaggcgtggcagagccgcacccgggccgccggcttcgacccatccgccaccgtccacctctgcttcgccatgaacgcccggccgctgctccacgcgtcgctcccttccgccggcgccgggttctacggcaactgctactacatcatgcgcgtgtcggcgcccgcggggaaagtctcgggctcctccgtgcccgaggtcgtgaagatcatcaaggacgggaagcggcggatgccggcggagttcgcgcggtgggcgagcggggaggccggcgccggaggggaagacccgtaccggatcacgtcggactaccggacgctgctggtgtcggactggaccaggctcgggttcgccgaggtcgactacggctggggtcccccggcgcatgtcgtgccgttgacgaacctcgactacatcgccacctgcatcctggtgaagccatgggcgcacaagcccggggcgaggctcatcacccagtgcgtcacgcctgaccgagtcgctgcgttccaccagggcatgctcgacatgaactgattgatcgagcttcagctgagctgaccgattggagaagatggctgaaggcggaaggaatcgattgactgttgattgattattttggcatgctttgtactttcggattggttacatggacgaattggctgacggtggagtgtcattggctcattgctgtgcagtgaagctcaaaataactttcggaattactctctccactctaatatcaagtcactcaaatttgtctaaatattaatgtacgcatg

SEQ ID NO: 4894 - DNA, 1625 bp, Brachypodium distachyon
aacaaatcaacacaaagcaaagcaatcggctgagcagcaacaatcatctccgtctccatcacatccaatccactgatcaattcctcttctcaccaactccgatctgtcacattctcgtctcccatggcggcagccaacaagtccgtctcacggctgccgcagcggctggtgctcccggcggagcccacgccggccggcccgctccggctgtcctggctcgaccgctacccgacccagatggccctcatcgagtcgctccacgtcttcaagcccgcccccgcccacgacggcgcggacccggcccgcaccatcgagcgggccctggcccaggccctggtccgctactacccgctcgccggccgcctcgccttcacggacgacggcgggcagtcccacgtggactgcggcgggcccggcagcggcgtgtggttcacggaggccgcggcggcgtgcgggctggaggacgtcgactacctggagcaccccatgatgatccccaaggacgcgctcctcccgcccacgccgcacgccgccgaggaaggcgacgagcggaggctcgtcctgctcgtccaggtcacctccttcgcctgcggcggcttcgtcgtcgggttccgcttcagccacgccgtcgccgacggccccggcgccgcgcagttcatggccgccgtcggagacctcgctcgcggggcagagtccctgtcaatggagccgcagtggggccgcgacgcggtgcccgacccggccggcgccgtcgtgggcgccctgccggaccccgccggcgcgaagcggctcgagtacctggccatggacatctccgcggactacatcgaccacttcaaatcccaatacaactccagcaacaatggcggcggcgcccggtgctcggcgttcgaggtgctggtggccaaggcgtggcagagccgcacccgggccgccggcttcgacccatccgccaccgtccacctctgcttcgccatgaacgcccggccgctgctccacgcgtcgctcccttccgccggcgccgggttctacggcaactgctactacatcatgcgcgtgtcggcgcccgcggggaaagtctcgggctcctccgtgcccgaggtcgtgaagatcatcaaggacgggaagcggcggatgccggcggagttcgcgcggtgggcgagcggggaggccggcgccggaggggaagacccgtaccggatcacgtcggactaccggacgctgctggtgtcggactggaccaggctcgggttcgccgaggtcgactacggctggggtcccccggcgcatgtcgtgccgttgacgaacctcgactacatcgccacctgcatcctggtgaagccatgggcgcacaagcccggggcgaggctcatcacccagtgcgtcacgcctgaccgagtcgctgcgttccaccagggcatgctcgacatgaactgattgatcgagcttcagctgagctgaccgattggagaagatggctgaaggcggaaggaatcgattgactgttgattgattattttggcatgctttgtactttcggattggttacatggacgaattggctgacggtggagtgtcattggctcattgctgtgcagtgaagctcaaaataactttcggaatta

SEQ ID NO: 4895 - DNA, 2026 bp, Brachypodium distachyon
tgccaagtcaagcaaacgagcagagcactcaacacaagcgaccaaacagagcagcttcagcagcagctgctgcctgcgagcggcaaccaacgagcccggcccttgtctgtccggctgtctgtcgccgtccaccgatcaattcttcttcctctcgatctcccatggcggcagccaagaagtccgtatcacggctggcgcagcggctggtgctcccggccgagcccacgccgtccggcccgctccgcctctcctggctcgaccgctacccgacccagatggcactcatcgagtcgctccacgtcttcaagcccgcccccgcccgccacgccgacgcctgccccggcccggcccgcaccatcgagcgggccctggcccaggccctggtccgctactacccgctcgccggccgcctcgccttcaccgacgacggcgggcagtcccacgtggactgcggcgggccccgcagcggcgtgtggttcaccgaggccgaagcggcgtgcgggctggaggacgtcgactacctggagcaccccatgatgatctccaaggacgagctcctcccgcccacgcccgccgccgaggagggcgacgagcggaggctcgtccttctcgtccaggtcacctccttcgcctgcggcggcttcgtcgtcgggttccgcttcagccacgccgtcgccgacggccccggcgccgcgcagttcatggccgctgtcggagacctcgcccgcggggcagagtccctgtcaatggagccgcagtggggccgcgacgcggtccctgacccggccggcgccgtcgtgggagctctcccggaccccgccggcgcgaagcggctcgagtacctggccatggacatctccgcggactacatcgaccacttcaaagcccagtacaactccaccaacaatggcggcgcccggtgctcggcgttcgaggtgctggtggccaaggcgtggcagagccgcacccgcgcggccggcttcgacccatccaccaccgtccacctctgcttcgccatgaacgcccgcccgctgctccacgcgtcgctcccctccgccggcgctggcttctacggcaactgctactacatcatgcgcgtgtccgcgcccgcggggaaagtctcgggttcctccgtgcccgaggtcgtgaagatcatcaaggacgggaagcgacggatgccggcggagttcgcgcggtgggcgagcggggaggccggcgccggaggggaagacccgtaccggatcacgtcggactaccggacgctgctggtgtcggactggaccaggctcgggttcgccgaggtcgactacggctggggacccccggcgcatgtcgtgccgttgacgaacctcgactacatcgccacctgcatcctggtgaagccatgggcgcacaagcccggggcaaggctcatcacccagtgcgtcacgcctgacagagtagctgcgttccaccagggcatgctcgacatgaactgatcgagctgagctcgccggagccgagcacgacgatgaatcgaagccgaaggccagaggaattgattgattgcgcggttaattagagaggttgttgtgtttgattggtttaaaggataggtgggtgttcatggttggtgtgtggaaattggaaataagagggcagttcctggaattggggagttgacagttggttctcggttgagtttggcgggaagccaccacactaaactaatgttggacttctaaggattatattatcccaaatttaattacactgcgaaaatctcgagcttttttaagaaacctgatagatgagttcttgttcagttcagaatctagcagtgcagtcgaattcaaaacgaagcatctggtttccgcgctgcagttgcgaagctcacattcagaatacaactgcgatgcagcccatatctgaatcgtctcactctcaactgcatcgtcactctaagaaaccggatatatagatgaggtcttgttcagttcagaaatccagaagcacacattcagaatataactccacttgcagccaa

SEQ ID NO: 4896 - DNA, 1507 bp, Brachypodium distachyon
cttcttcctctcgatctcccatggcggcagccaagaagtccgtatcacggctggcgcagcggctggtgctcccggccgagcccacgccgtccggcccgctccgcctctcctggctcgaccgctacccgacccagatggcactcatcgagtcgctccacgtcttcaagcccgcccccgcccgccacgccgacgcctgccccggcccggcccgcaccatcgagcgggccctggcccaggccctggtccgctactacccgctcgccggccgcctcgccttcaccgacgacggcgggcagtcccacgtggactgcggcgggccccgcagcggcgtgtggttcaccgaggccgaagcggcgtgcgggctggaggacgtcgactacctggagcaccccatgatgatctccaaggacgagctcctcccgcccacgcccgccgccgaggagggcgacgagcggaggctcgtccttctcgtccaggtcacctccttcgcctgcggcggcttcgtcgtcgggttccgcttcagccacgccgtcgccgacggccccggcgccgcgcagttcatggccgctgtcggagacctcgcccgcggggcagagtccctgtcaatggagccgcagtggggccgcgacgcggtccctgacccggccggcgccgtcgtgggagctctcccggaccccgccggcgcgaagcggctcgagtacctggccatggacatctccgcggactacatcgaccacttcaaagcccagtacaactccaccaacaatggcggcgcccggtgctcggcgttcgaggtgctggtggccaaggcgtggcagagccgcacccgcgcggccggcttcgacccatccaccaccgtccacctctgcttcgccatgaacgcccgcccgctgctccacgcgtcgctcccctccgccggcgctggcttctacggcaactgctactacatcatgcgcgtgtccgcgcccgcggggaaagtctcgggttcctccgtgcccgaggtcgtgaagatcatcaaggacgggaagcgacggatgccggcggagttcgcgcggtgggcgagcggggaggccggcgccggaggggaagacccgtaccggatcacgtcggactaccggacgctgctggtgtcggactggaccaggctcgggttcgccgaggtcgactacggctggggacccccggcgcatgtcgtgccgttgacgaacctcgactacatcgccacctgcatcctggtgaagccatgggcgcacaagcccggggcaaggctcatcacccagtgcgtcacgcctgacagagtagctgcgttccaccagggcatgctcgacatgaactgatcgagctgagctcgccggagccgagcacgacgatgaatcgaagccgaaggccagaggaattgattgattgcgcggttaattagagaggttgttgtgtttgattggtttaaaggataggtgggtgttcatggttggtgtgtggaaattggaaataagagggcagttcctgg

SEQ ID NO: 4897 - DNA, 2579 bp, Zea mays
gctcaacactcggagtgtgtcctctcgcctcctcccctctccgccagcggctgccaccagcccaccaccgcccctcctcaaaacgccaaaaatttccccacctctagacgccctttcccctccccccgagatcccatccatggccacctcccgcccccggatctggcgctgagcccgccattgccggatccctgccaggtctccaccccgccgtcgcgctcccggcccggttctattgggcgcggcgtggcattccctttcttctttgtgcgctaaccggggggtggtggttgatctgtactggcgggtgcagcgcgccttgcgatctctagctgttgctgcgggaggaccggccgcctcgtcgccgttgccaagtgcgctcttttaaagcccgaagattcgccccctccgcgtgttcgtgtcgccgagaggaggtcggacttgtcggaatggtcgtctaattggggagatttgatgtgttattggtgccgccggatctcgccgacatgtggaagcaatttatcggaaagctatcgtggaagtcaatgaaatccagctctggcagcggggggtcgccgccggcgccactatcgtcgccgcgggataatggagcctcaccgcgggagaatggggccacggggaagcctaacgtctcgcctcggtctcccgcggctggcgccggagccggagccgaggtgaggtccagggaggacgcctttgtccagaaagttaacatttgctgcgcggtgtacgacttctccgaccgaggcaaggactcgccggagaaggagcggaagcggcaaatgctcatgtccctcgtcgactgcattggcgccgccgaggagccgctcacggagacgatgatagcagcgtgcgtgcgcatgttcgctgctaacctgttcagggtcttcccgcccaaagtccggtctggcacctcggcttcggagaccgaggaggacgagccgttcttcgatccgtcctggtaccacctgcaagtcgtttacgagtttctccttaggtttgtgacctcaccactcgtggatgctaaggtggctaggaagtatgtggatagccctttcgtctccaagctgctcgatctgtttgattcggatgacccgagagaaagggactgcttgaagacaatattgcataggatatatggcaagttcatgggaaaccgaccgttcatccgtaaggctgtgagcaacatcttctataggtttgtgttcgagacggatcaccacaatgggattgccgaactattggaggtctttggcagtgtgataagtgggtttgcaaagccattgaaggaggaacataagttgttcttatggaaagcattgataccacttcataagccgaaatcaatgggagtgtatctgccacagctgacatattgcatcacacaatttattgacaaggaaccaaagcttgctgggactgtgatcaggggcctgttaaagtattggccagttacaaatagtcaaaaggaaatgatgtttttgggggagttggaggaggtgctggagttgactgacatggctgaatttcagaagtgcatggtccccttattccggaagattgctagttgcctgaatagctctcattttcaggttgcagagagagccttgttcctatggaacaacgagcacctattcgacatgatctcccaaaaccgccaagtaatcctaccaatcatatacccagctctggagaggaacacccgctggcactggaaccagtcggtcctcaacgtaaccatgaacgtgcggaaaatgttccgcgacatggacgagaggctgcttcaagcctgccacgacaacttccaagaggaagaggagaagcgggccgtgactgaggagcggcggaggctcatgtgggagcagctggagcgaagtgccgctcgcgggtaccaccagccgacgacgatcgctgccgatgcgagcagcttccccgcgccctcttcatcggctcgtcttgtatccctcaccgtgacatgagaacacgaggttgcaaccagatgttgctctgttttcgccgcttggtagctaaagctagatgatggagttgcttgcttcgctgggggatgcacgcacgaaggcattttgttaccttctgtgtatgcataaccccccttgtcaaagtctgtaattaatagctgacggtttgaggacaaagggacgttttggatttttgcaatggcgtattcttgaaatgggcatggtgttctcttcttgctgcctaaatgttgtctggttctaccacagcgctctctgctgtgtatctggacagtatgtatgccccatgggaggatgacaatcgacaagtttgcagctttccttttttttggttgttgatttcgtggcaaatagcttgtgcttatttttttattcttttaagtggacataatcagtaaaaaaagaaacaagaacagctgaggctggatgaaaacgaacaagtctctctcaaaatgttgtgcttaggttatctacttgctgattggtactgttttttttttggaaatcaagtgctccttagattttctcggggtaacgcgcacactctagattctataatct

SEQ ID NO: 4898 - DNA, 2470 bp, Setaria italica
gctcactcgcagtgctcctcgcctcgccttcgctcccagcggctgccctgccctgccaccaccccctcctcaaaacgccaaaaatttccccacctctccacgccctttcccctcctcccgagatccaatccatggccgcctcccgcccccggatctggcgctgagcccgccattgccggatccctgccaggcctcctccccaccgtcgcgctccgggcccggacttttttggcgcggtgtgtcgtcccctctggttccgggggtggtggttgatctgttccggcgggtgcacctcgccctgcgaggatcggccgcttgttgccgccgcgaaagcgtggtctttcacggcccgggattcgcgccgccgtgttgttgagggaggaggctgggctggtcggaatggttgtttaattggggggagatttgatgtggtgttggtgccgccggatctcgccgccatgtggaagcaatttattggcaagctgtcgtggaagtcgatgaaatccagctccggcggtggcgggggcgccggctcgccgcctgcgaagccaccgccgccactgccgtcgccgcgggagaatggggccgcggggaagcccagcgcctcgcctccgtctcccttggcgggcgccggagccgaggtgaggtccagggaggaggccttcatccagaaggtgaacatttgctgcgtggtgtacgacttctccgaccggggcaaggactcgccggagaaggagcgcaagcggcagatgctcatgtccctggtcgactgcattggcgccgccgaggagcccctcacggagacgatgatcgcggcctgcgtgcgcatgttcgccgccaacctcttcagggtcttcccgcccaaagtccggtcgggcaccacggcttcggagaccgaggaggacgagccgttcttcgatccgtcctggtaccacctgcaagtcgtgtatgagtttctccttcgctttgtgacctcgccactcgtcgatgccaaggtagctaggaagtatgtggatagcgctttcgtctcgaagctgctcgatctgtttgattctgatgacccgagagagagggactgcttgaagacgatattgcataggatttatggaaagttcatggggaaccgtccattcatccgtaaggctgtgagcaatatcttttataggtttgtgttcgagactgatcatcacaatgggattgccgagctgttggaggtctttggcagtgtaataagtgggtttgcaaagccattgaaggaggaacacaagttgttcttatggaaagcattgattccgcttcataagccgaaatcagtgggagtgtatctgccgcagctgacgtattgcattacacaatttattgagaaggaaccaaagcttgccgggactgtgattagaggcctgttgaagtattggccggttacgaatagtcagaaggaagtgatgttcttgggggagttggaggaggtgctggagttgactgacatggctgaatttcagaagtgcatgattcctttattccggaggattgcttgttgcctgaataactctcattttcagattgctgagagagccttattcctatggaacaatgagcatctgtttgatatgatctcccaaaatcgtcaagtcatcctgccgattgtatatccagctctggagcggaacacccgttggcactggaaccaatcagtcctcaatgtaacaatgaacgtgcggaaaatgttccacgacatggacgagaggttgctcctggcttgtcagaacaattttgaagaggaagaagagacgcgagccgcaaccgaggagcggcggagactcatgtgggagcagctggagcggagcgccgcgcgtggataccatcagccggtgatcgccgcggacgtgagcttcccaccgcccccttcatcagctcgtctggtagcccctactgtgacatgagattggaacaaactgcattccgttttcaccacttggtagctaagctagatgaagttgcttgcttcactggggatgtgcaaaggcattttgttaccttttgtatgcgtccccaatgtcaaagtctgtaattaatagttgatggtttgaggacaagggacattttgatttttgcatggcgtattcttggaatgggcatgtgtttcttcttctctaaatcttgtctcgttcaaattctaccagagtgctctgttttctgtgttgtctggacagcgtgcattgcatgagaagatgaaaagtttgcagcgcttcctttttgctgtttttgtggcagataacttatgtttcttttttaaaaaaaaatctattatgtggacaaaattgaagtatggaatggaaagcgtaaaggaaacaagagcagctggggctagctgagacataaacatctctttcaaaatgtgctttggttatctacttgctaattgctagcgattttctattatataatcaggatcctgtctcattgttctcct

SEQ ID NO: 4899 - DNA, 2139 bp, Panicum virgatum
gaccccctcctcaaaacgccaaaattttccccacctctccacgcccctttcccctcctccccccgagatcccatccatggccgcctcccgcccccggatctggcgctgagcccgccattgccggatccctgccaggcctccgcgccccgccgtcgctcgcgctctcggccccggataatttgcgcggcgtgtcgtccccttatccggagggtggtggtcgatctgcatcaggcggctgcagctcgcctctgcgatctcttgcggttgttgctggaggatcggccgctcgctgccgtcgccaaagcgcggtcttttacgggcccgggattcgcgccgtcgtgttgtcgagaggaggctgggcttgttggaatggttgtttaattggggagattggatgtggtgttggtgccgccggatctcgccgccatgtggaagcaatttattggcaagctctcgtggaaggtgatgaaatccagctctggcggtggcgggggcgcgggctcgccgcttccgaagatgccgccgccgctgccgttgccgcgggagaatggggccgcggggaagcccagcgcctcccctccgtcccccttggcgggcgccggggccgaggtgaggtccagggaggaggccttcatccagaaggtgaacatttgctgcgccgtgtacgacttctccgaccggggcaaggactcgccggagaaggagcgcaagcggcagatgctcatgtccctggtcgactgcattggcgccgccgaggagcccctcacggagacgatgattgcggcgtgcgtgcgcatgttcgccgccaacctcttcagggtcttcccgcccaaggtgcggtcgggcaccacggcttcagagaccgaggaggacgagccgttcttcgatccgtcctggtaccacctgcaagtcgtgtatgagtttctccttcgttttgtgacctctccgcttgtcgatgccaaggtagctaggaagtatgtcgataattctttcgtctcgaagctgctcgatctgtttgattctgatgacccaagagagagggactgcttgaagacgatattgcataggatttatggcaagttcatgggaaaccgcccattcatccgtaaggctgtgagcaatatcttttataggtttgtgttcgagactgatcatcacaatgggatcgctgaactgttggaggtctttggcagtgtaataagtgggtttgcaaagccattgaaggaggaacataagttgttcttatggaaagcattgattccgcttcataagccgaaatcagtgggagtttatctgccgcagctgacgtattgcatcacacaatttattgagaaggaaccaaagcttgccgggactgtgattagaggcctgttgaagtattggccaattacgaatagtcagaaggaaatgatgttcttgggcgagttggaggaggtgctggagttgactgatatggctgaatttcagaagtgcatggttcccttattccggaggattgcgagttgcctgaatagctctcattttcaggttgctgagagagctttgttcctatggaacaatgagcacctgttcgatatgatctcccaaaatcgtcaagtgatcctgccgataatatatccagctctggagcggaacacccgttggcactggaaccaatcggtcctcaatgtaacaatgaacgtgcggaaaatgttccatgacttggacgagaggttgctcctaacttgtcagaacaattttgaagaggaagaagagaagcgagccgcaaccgaggagcggcggaggctcatgtgggagcagctggagcggagcgccgcgcgtgggtaccaccagccggtgattgtcgcggacgttagctttccgccgcctccttcatcagctcgtctggtagccccaactgtgacatgaggttggaaccaactgcattccgttttcactatttggtagctaaattagatgaagttgcttgcttcactgggggtgtatacaaaggcattttgttaccttttgtatgcgccccctctgtcaaagtctgtaattaatagctgatggtttgaggacgaagggacattttgatttttgcatggcgtattcttggaatggggtgtttcttgtctaaatcttgtctgattcaaattc

SEQ ID NO: 4900 - DNA, 2901 bp, Oryza sativa
aaaacgccaaaaatttttcccccactgctccccactgctttcccctcctcctccccgcgagatcccatccatggtggccgcctcccgcccccggatctggccctgacgaggccgccattgccggatatttttggccctcctgccatttcctgaggtgtcctgtcgtttcccctttttcttttttcttttttggcccatttcttgtgaggtgctttctttgggttgggttcttgatccgtcgcatttcgcgcctggcactcggcgatccgttcttgcgatcccccgcacgttgcaagcgcggatttgttgtttttattattatttttttttgttgtgatttgcggcgtcgtgttcttggtgctggctggcaatggtggtttgatttgggggggggggggggggggtggggggccgatttgatgcggtgttggtgccgacggatctcgccgccatgtggaagcaattcatcgggaagttgtcgtggaagtcggtgaaatcgagctccaccggaggcggcgggggtggaggaggagggttctcgccgacggcggcgaagccgccgccgccgccgtccccgcgggcgaatgggacggcggcggcggcgaagccgagcgcctcgccgccgccgccgccgccgccggccgccgcgggcgccgaggggaggtccagggaggaggcattcgtccagaacgtgaacatctgctgcgcggtgttcgacttctccgaccgcgggaaggacaccaccgagaaggagcggaagcggcaggtgctcatgtcgctcgtcgactgcgtcggcgccgccgaggagcccctcacggaggcgatgatcgcggcgagcgtgcgcatgttcgccgccaacctcttccgggtgttcccgcccaaggcgaggtcgggcgccgcggcgtcggagacggaggaggacgagccgttcttcgacccctcgtggtaccacctccaagtcgtgtatgaattgctcctccggttcgtgacgtcgccgatggtggacgcgaaggcggcccggaagtatgtcgacagctcgttcatctcgcggctgctggatctcttcgattccgatgaccccagagagagggacagcttgaagacagtgttgcataggatatacggcaagttcatggggaatcggccgttcattcgtaaggccgtcagcaatatcttctataggttcgtgttcgagacggatcatcacaacgggatagcggagctgttggaggtgtttggcagtgtgataagcgggtttgcgaagccattgaaggaagagcacaagttgttcctatggaaagcgttgatcccgcttcacaagccaaagacggtgggtgtgtatcttccgcagctgacgtactgcatcacacagttcatcgagaaggaaaccaagcttgcagggactgtaatcagaggcctgctgaagtactggccagttacaaacagtcagaaggagatgatgttcttgggggagttggaggaggtgctcgagttgaccgacatggctgagtttcagaaatgcatggtaccgctgttccgcaggattgcaagttgcctgaatagctctcactttcaagttgctgagagagccttattcttgtggaacaacgagcacttgttcgatatgatctcccaaaatcgtcaggtgatcctaccgatcatatatccagctctggagaggaacacccgttggcactggaatcagtcggtcctcaatgttaccctgaatgtcaagaaaatgttcttggacatggacgagagattgctcctggcctgccagaacaacttccaagcggaagaagagaagcgagccgcgaccgaggagcggcgaaggctgatgtgggagcagctggagcggaatgccgctgcggcatgccatccacatccagtgatcaccactactgactcaagctttccttcacccccttcatcaactcctctggtagctcccactgtgacatgacatgtggatcaaatatactccatttccacttatttgttagctagctagatgatgatgaagttgcttgcttctcctgggactatacagaaggcattttgttaccttcgtaaggcccccccatgtcaaagtctgtaattaatagttgatggtttgaggacaaaatgacacttgattttttcttctttttttgtggtgtattctcgagtaatgggcattgctttctaggcaaaatctttgattggttcatcctgagtgagtgatctgtcaaagtgtggacaacaatgatttttgtgtgagagaaatgacaagtttgcagccgttctttgtggctaagaacttctgtctatttttaacaggcacatttttagctacagtgtaataatatcagatgcacttgtatagaaacaaaaagggcttcgggaacagcttaaacaaattgatttgttatttctgttcaatggactatatctggatggattctatggagaagaaaacaagagtagctgagatttcagaagaaataaaaaacatctctttcaacatttgttgtaggttatctgcctggtcttttcaagtacttttctttgctaaaccacatgagaagcatctcttcaaaaagaggactaactgaaacattgacaaaacaagatttgttgctcaaatcaaacctaaaacaaataatagaagaaaatgatggcaaggacaagtatactccctgacgtcaaactaacacatacataatcttctggaaattatctaggcccatctctgatgcgcctacacttgaacttttttaagattggaaatggtttataatcctacacttgaatgctgtacattagcagcctaacggattgatacatctggttacaaatgtgcactacatattgtgttattcaaagcacggattcagtcgtcctgtctccttgagtatggat

SEQ ID NO: 4901 - DNA, 2365 bp, Brachypodium distachyon
attccccactttctctccacactcttccctttccggctttcccctccctcctcctcccgagatcccatccatggccgcctcccgcccccggatctggccctgaggccgccattgttgctggatcccgctccgggggcctccctcctccgcgccgtcgcgtttcctggctcgtttgcatgtaccccgtgtattgaggcggcctgtcctttcgccttttttggggggtgcttgcgctcattggttcttgatccgtctgcatttgcgccgtggagcttgtccgggggcaagggaattggtgcctaccgttctttggttgcttaccttgagatctcttgttgttgctgctgtcgaatccggaatcctccctgccattgcaatctcttgttgccattgcaggtgcgttttttcgtgtatttttttgcgaggatttgcaagcgcggatttttcgcggtcgttcgtgggaggccggatgcttgtaatggttctttgatttgggggaattgatgtggtattggtgctgccgaatcttgccgccatgtggaagcaatttattggcaagctgtcgtggaaatcgctgaaatctagccctggaggcggagggggctcgcctacggcgaagtcgcaccctatgtctcccagggaaaatgggggctcggggaagccgaacgcttcgcctacgtcgccctcaggggtcgctgcagccgaggggaggtccagggaggatgcattcatccagaaggtgaacatttgctgcacggtatacgactttgctgaccgggggaaagactcgccggagaaagagaggaagcggcaggtcctgatgtccctcgttgactgcattggtgctgccgaggagcccctcacagaggcgatgatgtcggcgtgcgtgcacatgtttggtgttaacctcttcagggtcttcccacccaaggtgcgatcaggcacggcggcatccgagacagaggaggacgacccattctttgacccctcatggtaccacctgcaagtcgtgtatgaattgcttcttcggtttgtcacttcaccgttcgttgatcccaaagtggctaggaaatatgtagacagttcattcgtctcgaagctacttgacctatttgattctgatgacccaagagagagggactgcttgaagacagtattgcataggatatatggaaagttcatgggaaatcgaccgttcattcgtaaggctgtgagtaatatcttctataggttcgtctctgaggctgatcatcacaatgggatagccgagctgttggaggtgtttggcagtgtaataagtgggtttgccaagccattgaaggaggaacataagttgttcctatggaaagcattaattccccttcacaagcctaagacagtgggcggatatctgccacagctgacttactgcataacgcaatttattgagaaggaacctaagcttgcaggaactgtgatcagaggtctgttgaagtattggccaattaccaatagtcagaaggagatgatgtttttgggggagttggaagaggtgctcgagttaattgacatggctgagttccagaagtgcatggtgccattgttccggaggattgcaacttgcctgaatagctcccacttccaggttgcagagagagccttattcttgtggaacaatgaacatttgtttgatatgatatcccaaaaccgtcaagtgattgtgccaattgtatatccagctctggagagaaatgcccgctggcattggaaccaatcggttctcaacgttacgatgaatgtgaggaaaatgttcttcgacatggatgagagattgctcctggcttgtcagagcaacttccaattagaagaagagaagcgaactgcagccgaggagcgtcgaaggcttgtctggaagcaactggagcggaatgctcaaccagtggtagctggtagtgcgagctttccacagccctcttcatctgtgcccccagtagttcccactgtgacatgacatggctccaaatatactccatttcacttccttgcttcgtagctagctagatgaagttgcttgcttctctggggtacagaaggcattttgttacctttgtaagccccccttgccaaagtctgtaattaatagttgttggtctgaagacaaaggaatcttgatttttttttgcagcgaattctcaattaatgggcattgctttcttggcaaaatattgattgattctaccttagtattctgtgaagtgtggacacttccgattttgtatgtgagggatgtcaaattgaaaggccatctttttgtatgtgacagtagcatcttttacagtgtaatataatatcagatccacttgtgtgtggacagtgtcttctccaa

SEQ ID NO: 4902 - DNA, 1829 bp, Brachypodium distachyon
tgctgccgaatcttgccgccatgtggaagcaatttattggcaagctgtcgtggaaatcgctgaaatctagccctggaggcggagggggctcgcctacggcgaagtcgcaccctatgtctcccagggaaaatgggggctcggggaagccgaacgcttcgcctacgtcgccctcaggggtcgctgcagccgaggggaggtccagggaggatgcattcatccagaaggtgaacatttgctgcacggtatacgactttgctgaccgggggaaagactcgccggagaaagagaggaagcggcaggtcctgatgtccctcgttgactgcattggtgctgccgaggagcccctcacagaggcgatgatgtcggcgtgcgtgcacatgtttggtgttaacctcttcagggtcttcccacccaaggtgcgatcaggcacggcggcatccgagacagaggaggacgacccattctttgacccctcatggtaccacctgcaagtcgtgtatgaattgcttcttcggtttgtcacttcaccgttcgttgatcccaaagtggctaggaaatatgtagacagttcattcgtctcgaagctacttgacctatttgattctgatgacccaagagagagggactgcttgaagacagtattgcataggatatatggaaagttcatgggaaatcgaccgttcattcgtaaggctgtgagtaatatcttctataggttcgtctctgaggctgatcatcacaatgggatagccgagctgttggaggtgtttggcagtgtaataagtgggtttgccaagccattgaaggaggaacataagttgttcctatggaaagcattaattccccttcacaagcctaagacagtgggcggatatctgccacagctgacttactgcataacgcaatttattgagaaggaacctaagcttgcaggaactgtgatcagaggtctgttgaagtattggccaattaccaatagtcagaaggagatgatgtttttgggggagttggaagaggtgctcgagttaattgacatggctgagttccagaagtgcatggtgccattgttccggaggattgcaacttgcctgaatagctcccacttccaggttgcagagagagccttattcttgtggaacaatgaacatttgtttgatatgatatcccaaaaccgtcaagtgattgtgccaattgtatatccagctctggagagaaatgcccgctggcattggaaccaatcggttctcaacgttacgatgaatgtgaggaaaatgttcttcgacatggatgagagattgctcctggcttgtcagagcaacttccaattagaagaagagaagcgaactgcagccgaggagcgtcgaaggcttgtctggaagcaactggagcggaatgctcaaccagtggtagctggtagtgcgagctttccacagccctcttcatctgtgcccccagtagttcccactgtgacatgacatggctccaaatatactccatttcacttccttgcttcgtagctagctagatgaagttgcttgcttctctggggtacagaaggcattttgttacctttgtaagccccccttgccaaagtctgtaattaatagttgttggtctgaagacaaaggaatcttgatttttttttgcagcgaattctcaattaatgggcattgctttcttggcaaaatattgattgattctaccttagtattctgtgaagtgtggacacttccgattttgtatgtgagggatgtcaaattgaaaggccatctttttgtatgtgacagtagcatcttttacagtgtaatataatatcagatccacttgtg

SEQ ID NO: 4903 - DNA, 2467 bp, Triticum aestivum
gatcggcggcccagatgaaccgaaccgtccatgcatcgccactgcgacgttctctccctcactcgcactgtcgtcctccagtgtgtctgtgtaccaccgccccctccaaaacgccaaaaaaattcctcacttctgcgccctttcccccctcccctcccctccctcctcccgagatcccatccatggccgcctcccgcccccggatctggccctgaggccgccattgctggatccgcctcccccctccgcgccgtcgcgttcctggctcctccgcgcaccccgctgattgaggcggcctgtcctttccccccctttttctggcggtgcgctcattcgtcggttcttgatccgtcgcatttgcgccggcgagctgcccgagagcaaggaattcaccctgagatctccggtcgccgttgctgtcgaagtccccccctccctgcctgccattgcaatctcctgttgctgtcgcaaggtgcgtcttttacataaaatttctgcgaggaatttcacggccgattctcgggaggacggattcctcgcaatggttctttgattgggggagaatttgatgtggtgttggtgccgccgtattctgccgccatgtggaagcaatttatcggcaagctgtcgtggaaatcgctgaaatctggccctggcggcggcggcggagggggctcgcccacggcgaagtccaatcccatgtcccccagggagaatggggcattcgggaagccccccgcctcgcctaggtccccctcgggggccgccggagccgaggggaggtccagggaggacgccttcatcgagaaggtgaccatttgctgcacggtgtacgacttcaccgaccggggcaaggactcgccggagaaggagaggaagcggcaggtccttatgtccctcgtcgactccattggcgccgccgaggagcccctcacggaggcgatgatgtcggcgtgcgtgcgcatgttcgctgtcaacctcttcagggtcttcccgcccaaggtccgatcaggcaccaccacgtcggagacagaggaggacgagcccttcttcgacccctcttggtaccacctgcaagttgtgtatgaattgcttctgcggtttgtgacctcgccatttgttgaccccaaggtggcaaggaagtatgtggacagttcgttcatctccaagctgcttgacctgtttgattccgatgatcccagagagagggactgtttgaagacagtgttgcacaggatatatggaaaattcatgggaaaccgaccgttcatccgcaaggctgtgagcaacatcttctataggttcgtctccgaggccgatcatcacaatgggatatccgagctgttggaggtgtttggcagcgtgataagtgggtttgcaaagccattgaaggaggagcataagttgttcctatggaaagcgttgatcccacttcacaagcctaagacagtgggtgtatatctgccgcagctgacctactgcataacacaatttatagagaaggaacccaagcttgcaggaactgtgattaggggtctgttgaagtactggccagttacaaatagtcagaaggagatgatgttcttgggggagttagaagaagtgcttgagttgattgacatggctgagtttcagaagtgcatggtgccattattccggaggattgcgacttgcctcaatagctcccattttcaggttgctgagagagccttattcttgtggaataatgaacatttgttcgatatgatctcccaaaaccgtcaagtgattgtgccaatcgtatacccagctctggagagaaatgcacgtttgcactggaaccaatcggttctcaacgttactatgaatgtgagaaaaatgttcttcgacatggacgagagattgctcctgacttgccagagcaacttccaagcggacgaagagaagcgagccgcagcggaggagcgtcgaaggctcacatgggagcaactggagcggaatgccgaccctgcattccgaccagccaacgcgcccccttcttcggcccctccgagagtccccaccgtgacatgacacgggtccgaatatactccaccccaccttcccttgcttcctagctagctagatgaagttgcttgcttctctgggatacagaaggcgttttgttacctttgtaaacccccccacccttgccacaaagtctgtaattaatagttgttgattcgaagacaaatggattcttgattttttccttttcttttttgcggcgaattctcgagtaatgggcattgctttcttggcaaaatcttgattgagatttaccccccagtgttctgtgaagagtgggcgctactgactttgtatgttaggagtggcaattttgcagccatttttttgtatgtgagatttccgttctttttacagcgtaatataatgtcaggttcacttgtttgtttctgaacaaaatgccttctctaacagcatatgc

SEQ ID NO: 4904 - DNA, 2151 bp, Hordeum vulgare
ggcgccctttcccccctcccatccctcctcccgagatcccatccatggccgcctccctcccccggatctggccctgaggccgccattgctggatccgcctcccccctccgcgccgtcgcgtccccggctcctccacgcgccccgttgattgaggcggcccgtcctctcctcccttctttggtggtgcgctcattcgttggttcttgatccgtcgcatttgcgccggtaagctgcccgagagcaaggaattcgccctgagatctccggttgccgttgccgtggaagtccaccccctccctgccattgcaatcccctgttgccgtcgcaaggtgcgtcttttacataaaatttctgcgaggaatttcacggccggttctcgggaggacggatttctcgcaatggttctttgattgggggagaatttgatgtggtgttggtgccgccgtattctgccgccatgtggaagcaatttatcggcaagctgtcgtggaaatcgctgaaatctggccctggcggcggcggcggagggggctcgcccacggcgaagtccaatcccatgtctcccagggaaaatggggccttcgggaagccccccgcctcgcccaggtcgccctcgggggccgccggagccgaggggaggtccagggaggacgccttcatcgagaaggtgactatttgctgcacggtgtacgacttcaccgaccggggcaaggactcgccggagaaggagaggaagcggcaggtcctcatgtccctcgtcgactgcattggcgccgccgaggagccgctcacggaggcgatgatgtcggcgtgcgtgcgcatgttcgccgttaatctcttcagggtcttcccacccaaggtccgatcaggcaccaccgcatcggagacagaggaggacgagcccttcttcgacccctcttggtaccacctgcaagttgtgtatgaactgcttctgcggtttgtgacctcgccatttgttgaccccaaggtagccaggaagtatgtggacagttcgttcatctccaagctgcttgacctgtttgattctgatgatcccagagagagggactgcctgaagacagtattgcacaggatatatggaaaattcatgggaaaccgaccgttcatccgcaaggccgtgagcaatatcttctataggttcgtctccgaggccgatcatcacaatggaatatccgagctcttggaggtgtttggcagtgtgataagtgggtttgcaaagccattgaaggaggaacataagttgttcctatggaaagcgttaattccgcttcacaagcctaagacagtgggtgtatatctgccgcagctcacatactgcataacacaatttatagagaaggaaccgaagcttgcaggaactgtgattagaggtctgttgaagtactggccagttacaaatagtcagaaggagatgatgttcttgggggagttagaagaagtgcttgagttgattgatatggccgagtttcagaagtgcatggtgccattattccggaggatcgcaaattgcctcaatagctcacattttcaggttgctgagagagccttattcttgtggaataatgaacatttgttcggtatgatctcccaaaaccgtcaagtgatcgtgccaatcgtatacccagctctggagagaaatgcacgtttgcactggaaccaatcggttctcaacgtcacgatgaatgtgagaaaaatgttctttgacatggacgagagattgctcctggcttgccagagcaacttccaagcggacgaagagaagcgagccgcggcggaggagcgtcgaaggctcacatgggagcaactggagcggaacgctgaccctgcattccaaccagctaaagcgcccccttccgcagcccctccgagagtccccaccgtgacatgacacgggtccgaatatactccaccccaccttcccttgcttcctagctagctagatgaagttgcttgcttctctgggatacagaaggccttttgttacctttgtaaacccccccaccccttgccacaaagtctgtaattaatagttgttgattcgaagacaatggattcttgattttttttattttatttttgcggcgaattctgagtaatgggcattgctttcttggcaaaaatcttgattga

SEQ ID NO: 4905 - DNA, 2519 bp, Hordeum vulgare
gaccggacggcccagatgaaccgtatcgtccatgcatcatcactctgacgttctctccctcactcgcactgtcgtcctccagtgtgtctgtgtaccaccgccccctccaaaacgccaaaaaaaaaatccccacttctgcgccctttcccccctcccatccctcctcccgagatcccatccatggccgcctccctcccccggatctggccctgaggccgccattgctggatccgcctcccccctccgcgccgtcgcgtccccggctcctccacgcgccccgttgattgaggcggcccgtcctctcctcccttctttggtggtgcgctcattcgttggttcttgatccgtcgcatttgcgccggtaagctgcccgagagcaaggaattcgccctgagatctccggttgccgttgccgtggaagtccaccccctccctgccattgcaatcccctgttgccgtcgcaaggtgcgtcttttacataaaatttctgcgaggaatttcacggccggttctcgggaggacggatttctcgcaatggttctttgattgggggagaatttgatgtggtgttggtgccgccgtattctgccgccatgtggaagcaatttatcggcaagctgtcgtggaaatcgctgaaatctggccctggcggcggcggcggagggggctcgcccacggcgaagtccaatcccatgtctcccagggaaaatggggccttcgggaagccccccgcctcgcccaggtcgccctcgggggccgccggagccgaggggaggtccagggaggacgccttcatcgagaaggtgactatttgctgcacggtgtacgacttcactgaccggggcaaggactcgccggagaaggagaggaagcggcaggtcctcatgtccctcgtcgactgcattggcgccgccgaggagccgctcacggaggcgatgatgtcggcgtgcgtgcgcatgttcgccgttaatctcttcagggtcttcccacccaaggtccgatcaggcaccaccgcatcggagacagaggaggacgagcccttcttcgacccctcttggtaccacctgcaagttgtgtatgaactgcttctgcggtttgtgacctcgccatttgttgaccccaaggtagccaggaagtatgtggacagttcgttcatctccaagctgcttgacctgtttgattctgatgatcccagagagagggactgcctgaagacagtattgcacaggatatatggaaaattcatgggaaaccgaccgttcatccgcaaggccgtgagcaatatcttctataggttcgtctccgaggccgatcatcacaatggaatatccgagctcttggaggtgtttggcagcgtgataagtgggtttgcaaagccattgaaggaggaacataagttgttcctatggaaagcgttaattccgcttcacaagcctaagacagtgggtgtatatctgccgcagctcacatactgcataacacaatttatagagaaggaaccgaagcttgcaggaactgtgattagaggtctgttgaagtactggccagttacaaatagtcagaaggagatgatgttcttgggggagttagaagaagtgcttgagttgattgatatggccgagtttcagaagtgcatggtgccattattccggaggatcgcaaattgcctcaatagctcacattttcaggttgctgagagagccttattcttgtggaataatgaacatttgttcggtatgatctcccaaaaccgtcaagtgatcgtgccaatcgtatacccagctctggagagaaatgcacgtttgcactggaaccaatcggttctcaatgtcacgatgaatgtgagaaaaatgttctttgacatggacgagagattgctcctggcttgccagagcaacttccaagcggacgaagagaagcgagccgcggcggaggagcgtcgaaggctcacatgggagcaactggagcggaacgctgaccctgcattccaaccagctaaagcgcccccttccgcagcccctccgagagtccccaccgtgacatgacacgggtccgaatatactccaccccaccttcccttgcttcctagctagctagatgaagttgcttgcttctctgggatacagaaggccttttgttacctttgtaaacccccccaccccttgccacaaagtctgtaattaatagttgttgattcgaagacaatggattcttgattttgtttattttatttttgcggcgaattctgagtaatgggcattgctttcttggcaaaaatcttgattgagattctaccccagtgttctgtgaagagtgggtgcagctactgacttcgtatgtgcggaatggcaattttgcagccatttttttttgtatgtgagacttccaatttttttacagcggaatataatgtcagattcttgtgtctgaacaaaatggcttccttatctaacaacatatgcaagttgttttttattgttttctacccaacccaaggagcaaatgtggggcagatggag

SEQ ID NO: 4906 - DNA, 2158 bp, Secale cereale
ccccggatctggccctgaggccgccattgctggatccgcccaccccccctccgcgccgtcgcgccccggctcctccacgcgccccgttgattgaggcggcctgtcctttccctccttttctggcggtgcgctcattcattggttcttgatccgtcgcatttgcgccggtgagctgcccgagagcaaggaattcaccttgagatctccggttgctgttgccgtcgaagtgccccctccctgccattgcaatctcctctgttgctgttgcaaggtgcgtcttttacatataatttctgcgaggaattccacggccggttctcgggaggacggatttcccgcaatggttctttgattggggagaatttgatgtggtgttggtgccgccgtattctgccgccatgtggaagcaatttatcggcaagctgtcgtggaaatcgctgaaatctggccctggaggcggcggcggaggggctcgcccacggcgaagtccaatcccatgtctcctagggaaaatggggccctggggaagccccccgcctcgcccaggtccccctcgggggccgccggggccgaggggaggtccagggaggacgccttcatcgagaaggtgaccatttgctgcacggtgtacgacttcaccgaccggggcaaggactcgccggagaaagagaggaagcggcaggtcctcatgtccctcgtcgactccattggcgccgccgaggagcccctcacggaggcgatgatgtcggcgtgcgtgcgcatgttcgctgtgaacctcttcagggtcttcccgcccaaggtccgatcaggcaccaccacgtcggagacagaggaggacgagcccttctttgacccctcttggtaccacctgcaagttgtgtatgaattgcttctgcggtttgtgacctcgccatttgttgaccccaaggtagctaggaagtatgtggacagttcgttcatctccaagctgcttgacctgtttgattctgatgatcccagagagagggactgcttgaagacagtcttgcataggatatatgggaagttcatgggaaaccgaccgttcatccgtaaagccgtgagcaatatcttctataggtttgtctctgaggccgatcatcacaatgggatatccgagctgttggaggtgtttggcagcgtaataagtgggtttgcaaagccattgaaggaggagcataagttgttcctatggaaagcgttgatcccacttcacaagcctaagacagtgggtgtatatctgccgcagctgacctactgcattacacaatttatagagaaggaacccaagcttgcaggaactgtgattaggggcctgttgaagtactggccagttacaaatagtcagaaggagatgatgttcttgggggagttggaagaagtgcttgagttgattgacatggctgagtttcagaagtgcatggtgccattattccggaggattgcaacttgcctcaatagctcccattttcaggttgctgagagagccttattcttgtggaataatgaacatttgttcgatatgatctcccaaaaccgtcaagtgattgtgccaatcgtatacccagctctggagagaaatgcacgtttgcactggaaccaatcggttctcaacgttacgatgaatgtgagaaaaatgttcttcgacatggacgagagattgctcctggcttgccagagcaacttccaagcggacgaagagaagcgagctgcagcggaggagcgtcgaaggctcacatgggagcagctggagcggaatgccgaccctgcattccaagcagccaacgcgcccccttcttcggcccctccgagagtccccaccgtgacatgacacgggtccgaatatactccaccccaccttcccttgcttcctagctagctagatgaagttgcttgcttctctgggatacagaaggcgttttgttacctttgtaaaccccccacccttgccacaaagtctgtaattaatagttgttgatttgaagacaaatggattcttgattttttttttcccttttctttttttgcggcgaattctcgagtaatgggcattgctttcttggcaaaatcttgattgacattctacccccagtgttctgtgaagagtgggcgctactgactttgtatgtgagggatggca

SEQ ID NO: 4907 - DNA, 1666 bp, Zea mays
cccaaagcccgtaacgtaaaacccgccctctctgaagtgagtacctgacctcgccgccttagaacaccctggccgcgatggcgtcagcggcggcggaagctccgggcgcatcggcctcttccgcggagaacaggctcctgcagtccctcgcagagcgggggtggcgcttccgtgaccccaccgacgaggccatccaagccctgctcctcgcctcccccactccgtcgccggaggccgtggagtccgagctcgtcagcatggacctgaggatgtttggcggaaagtgccttcccgatcgggccgccgccggcggcacgtcgaagcggctttcgtacctccacggccccgtcgtcttgcagatagtctctttaagagatatatatcacagcagcattgatgcgtcctttaagaacccgcagcagcgtcgccttctgcgctttggtctcactgatgggatatgtgaagcagtagccatagagttttctcccatcccattcatcaccgaagagatagctccaggtaccaagattcgcctcgagaatagggttccaatcaataatggcatattgtgcttaagcgcgaaaaatgtgactgttattgggggggctgtccaatcattgtatgaagaatggcagatgaaccagaaatactctggcttatcccgtccatcattgaggttgtctccaagtgatgatggagttgggcctccaccatttgagaagttagacattgaagcacgcccctgcagggaaaccaaagttcaagcatatcctgctaggaagttggcagttactcatgaccatggaccagttaattctggtggcaagccaatgaatgagggttcaaacgatgagaacagagacaatattgagagtaaggttgaatctaagcaaattactcaagacagcaggccaaaagaggtcagcgaagctgttccagtccagaaccaagctgccgcgcagaagctactgcagaaaatgtcgcaggccgtgcctgaggacaggcgcggtcgcggtcatagattcaagggcaaaggcaaggaagaagatgctcaggtttttaccctcgatgaatgggagaagaggaaagccatcagttcgaagcccgctgcggaaagctacgtgcatgacactagccgagacgaggagctggcgaggcaactgcaggaacaactagacctagaagacttgcatggtggggcaggtgcaggcgttctccatggcggggccgagagctcggatgctgaacggttacggatgagcatgttcagcttcagtggccctgacgaagcaggtggtggtaggagagattttcgaggccgcggcaggggaaggggcggagggcgacgcaggggcagaggaagattttaggcccggccacacagttgtaggtttattggtttgttgcgtgttcagtgtagtccaccggttgtatgggtaaaagtggcgcgatgatatccttctcaaatcctgtttctgaatttctctagcctcatggcgagagcagatgctagtcagattaaggaacagtttgtagacttcctggagtttttgaactgttcttagatgcaggagcacatcgtacattgtttttggaagaacgagttaaaagtctgaaatttacatgacttgtatcttctgtttacgtgtgctgttcagccgtttga

SEQ ID NO: 4908 - DNA, 1600 bp, Setaria italica
ccggaacgcaaaatcctctgacggtctgacctcgccgccggagaacaccctgactcagtgaccccgcaccaactgcgatggcggcagcggcggcggcggaagcgccgagcgcatcggcctcttccgccgggaaccacaggctcctgcagtccctcgcggaccgaggatggcgctttcgcgaccccaccgacgaggctatccaggccctgctcctggcttcccccacgccgtcgccggaggccatggagtcagagctcgttgacatggacttgaggtcgttcggcggcaagtcgccaccggaccgcgccaccaccgccgccacggcgaagcggctttcgtaccttcacggccccatcgtgctgcaggtagtctctgtaagagatatatatcgcagcagcattgatgcctccttcaagaacccgcaacagcgtcgtcttctgcgctttggtctcactgatgggacatgtgaagcagttgccatagagtttactcctatcccattcatcactgaagagatagcgccaggtaccaaggttcgccttgagaataaaattccaatcaataatggtatattgtgcttaagtgcgaaaaatgtgagagtcattggggggactgtccaatcattgtatgaagaatggcagatgaaccagaaatactctggcttatctcgtccatctttgaggttgtctcaaagtgatgatggagctggacctccaccatttgaaaagttagacattgaagcacgtccctgcaggacaaccaaagttcaaccgtatcctgctattaagttggcagttactcatgaccacgtgccagttaattccggtggcaaaccaatgaatgagggttcgaatgatgtatacaaagacactacaaaaagcaaggttgaatccactcaagatagcagaccaaaagaagtcagtgaaacagttcctgttcaaaaccaagctgctgcacagaagctactgcagaaaatgtcgcaggctgtgcctgaaggcaggcatggtcggggtcatagattcaagggcaaaggtaaggaagaagatgctcaggtttttacccttgacgaatgggagaagaggaaggccattggttcaaagtccacctcagaaagctatatgcaagacactagccgagatgaggaactggcaaggcaactgcaggaacaactagacctagaagatatgcatggtggggcagatgttttccatggcaggccagagagttcagatgctgaacgtttacggatgagcatgttcagcttcagtggccctgatgaagcaggtggtggtagaagagagtttggaggatgggggcggggcaggggaaggggccgagggcgaggtcggggcaggggaagattttagtccagtaacggaattgtaggtttatgagtttgttgtgtgtaggagtaatagcggtatgatgatgacctcctcaaatcatgttctcattttctctagccggatgggaaatttaggaaaaaattgtatacttccatggaaattttgttctattcttcgatgcacgacagcacgagaatagacacatgatttgaactttgaagaatgaattcaagtccaaatttccatgactttaa

SEQ ID NO: 4909 - DNA, 2130 bp, Zea mays
aatactgcatcgctgcatcggataaaccgtcccccaccccacctccaacgacaacctccacctcgtcttcccctcctccgcgctcccgtcatctacacctctcgctcccacccacgagtcccaccgccaccaccaccagtctatcccctcgccatttgtttcctccccgtgcatgaaaccctaaacctaaaccccacctcccttcccgagccatcccctccagcgcggcgatggcaaaggcgctgctttcctcctccctcctccccgcgctgcccggcgctgccggaggcagccggagcgctgcgaggccgatgctgctcccaccgctccggttgcggcgcggccggcgcggcgcctccgcttgcgaggtgagggcgggcctgcacgggctcgactccgtcggcgggccccaccttcaggccgcgctggagcgcgccgaggcggcgctatacacactcgctgacgccgcggtcgccgcggcggacaccgccgcgggcgcaggggccgacgcaggccaggctgcggcggtccaaaagaacagcggctggttcggcttcatctccgaggccctcgaggtcgtgctcaaggtgctcaaggatggtctttctgcagtccatgtgccatactcctacgggtttgccatcattctgctcactatcattgttaaggctgcgacattgcctctaaccaaaaagcaggtggaatcaactctggcaatgcagaatttacagccgcagattaaggcaatccagcagagatacgcaggcaaccaggaaaggatacagctagagactgctcggttatacaagcaagctggtgtaaaccctttagcaggatgttttccaacgttagcaacaattcctgtatggattggtctttaccaggccctttcaaatgtagcaaatgaggggctattgacagaaggatttttctggattccatcactgggaggtcctacaacaattgcagctcggcaaagtggttctggaattacatggctcttcccatttgtggatggtcatcctccgctaggctggcatgacacgatatgctaccttgtattgcctgtgctacttgttgcttctcagtatgtatctatggagatcatgaagccacctcagagcgatgacccatcacagaagaacacaatgctcattttgaaatttcttccatttatgattggctggttctctttgtcagtgccatcaggattgtctatttactggtttacaaacaatgtcctcagcacagcccagcaggtgtggttacggaaaatgggaggagcgaagcctgtagtgactgagggaggtagtggaataattaccgcaggacgagcaaaacgctctaatgctcaacctgccggagagaggtttaggcagctaaaggaagaagagaacaggagaaaattcagcaaagcacttgctgcaggagattcagatgcgtcgtcatcgacatatgacatggatgatgaagagtcggatgagacgatagaagagggaggacctgtggaggaagcatctactagcagtgacaagaaacttccaaactactcagggaagaagggcaaaagatcgaagaggaagcgcatggtgcagtaatcgttgcagcataattggatgcgatttttgtcacaactggttaattcagctgaccagttaggtgccgtagtatcatggagacagttttggtgggggccttttggaggcataattgcataaatctgaggtgcagacaattagacagtttccggggacacaagtatttgctgctaagctatccaatgaactagctcagtcagtatatatgctttagacctgagggtaatggacaggagaacaggagtggggtaaatgcacaagcagagagacaggatctgtagaggtaggcgagagatactccggtgtactctgtacatggttctaaaaaattgggcagaaactggattgtccagaccgttcatatacgttgtactagccggttgttgtactagccagttgcgctacggttgttatatattatataaatagatattgagatatttattcaaatataactattgtttatttctaaacactacaagaagggtattatataattgattaattgtaaaggcttgtttgggaacccttc

SEQ ID NO: 4910 - DNA, 2072 bp, Setaria italica
ccgagtccacgagcaccgaagcggataaaacgtcccccacctcctctcctcctccaacgacaacctccacctcctcagcagctcctcttcccttcccacctccacctccaccgccaccgcacctcctctcccggccacgcgcttcccctcccccgtgcatgaaaccctaaccctaaaccccctcatcctccccgagccatcccctccgcgatggccaaggcgctgctctcctcctcctcctccctgctccccgcgctgccccgcgccggcggggccggcgccgcgagcctgctcccgccgctccggctgcggcgcgggggccgccggcgcgccgcggcgtgcgcggtgagggcgggcctccacgggctggactcgctcgcgggaccccacctccaggccgcgctggagcgcgccgaggccgcgctctacacgctcgccgacgccgcggtcgtcgcggccgacgcggcggcgggaggaggggacgccggggaggcggtgacggcggtgcagaagaacggcggctggttcggcttcatctccgaggccctcgaggtcgtgctcaaggtgctcaaggatggtctgtcagcagtccatgtgccgtactcttatgggtttgcaatcattctgctgaccatcattgttaaggctgcgacgttgcctctaaccaaaaaacaggtggaatcaactctggcgatgcagaatttgcagccgcagattaaggcaatccagcagagatatgcaggcaaccaggaaaggatacagctagagactgctcggttatataggcaagctggagtcaacccgttagcaggatgttttccaacattggcaacaatacctgtctggattggtctttaccaagccctttcaaatgtagcaaatgaggggctgttgacagaaggatttttctggattccatcattgggaggccctacaacaattgcagctcggcaaagtggtgctgggatttcatggctcttcccatttgtggacggtcatcctccattaggttggcatgacacaatatgttatcttgtgttgcctgtgctacttgttgcttctcagtttgtctctatggagataatgaagccaccccagagcgatgacccatcacagaaaaccagcctgctcgttttgaaatttcttccatttatgattggatatttctctttatcagtgccatcaggattgtccatttattggtttacaaacaatgtcctcagcacagcccagcaggtgtggttacggaaaatggggggagcaaagcctgcagtcagtgagggaggtagcggaataattacagcgggacgtgcaaaacgctctaatgctcaaccagctggggaaaggtttagggagctaaaagaagaagagaacaggagaaaactcaacaaagcacttgctgcaggagattcaaaagcatcggcatcaacgtatgactcagacgatgaagagtcagatgatgagaccacagaggagggaggacctgtggagaaagcatccagtactgggagtgacaagaaacttccgagttactcagggaagaagggcaaaagatcgaaaaggaagcgcatggtgcagtaatcgttacaacctaattggatgtcagttttgttgcaactggttaattcagttgaccagttcagtggcacagttgatctcagcagacaattttgatggtctcttggaggcctaaatttgaggtgctgacaaataggccatttctgggggtcacacgtatatgctcagtatatgctaggctttgagagggtaatggacaggagaacaggagtcgagtatatggacaagcagagagaaaggatctgtagaagtagataagagatactcgtgtatgctgtaagctgggttcccaaattgggccgaatctggatattccagactatcggtatgcattccttttcttctcatgtaacctattaaaccattgtttgggggggtatattgcgtaagctcacaaccatccagtcatacaaattaaatgagttttaatacaacttttggcactgtattttgaggaaaaaaaaactggacttgtggaaatgagctttggtgaa

SEQ ID NO: 4911 - DNA, 2493 bp, Oryza sativa
cgcggaaaggaggaagaagataaagcatcccccacctccgcctcttcccctccaacgactacctcttcttcctcctctcgcaccaccaccactcaccaccccccaccccccacctccaccctcctcctcctcctccgcctcggcgttcgtgcatgaaaccctagaccccccccccctctaaacccccctccctcccgcaccccccgcgatggccaaggcgctcctctcctcgtcgctgctcccctcgctgcagccccgcgccgccgccgcgaggctgcctatgctgacgctgccttcgctgcggaggcacgggggccgccgcgcgtcggcgtgcagggtgagggcgagcctccacgggctcgactcgatcgcggggctcgacctccacgccgcgctggagcgcgccgaggcggcgctctacacgctcgccgacgccgctgtcgtcgcggcggacgcggcggcgggaggaggagggggtggcggtggtggtggcggtgaagcggcggcgtcggtggcgcagaagaacggggggtggttcgggttcatctccgaggccttggaggtcgtgcttaaggtgctgaaggatggcctgtcagctgttcatgtgccgtactcttatggattcgccatcattcttctcactgttattgtgaaggctgcaacattacctttaacgaaacaacaggtcgaatcaactctggctatgcagaatttacagccacagatcaaagcaattcaacagagatatgcaggaaatcaggaaaggatacagcttgagactgctcggttatacaagcaagctggagtcaaccctctggcaggatgttttccaactttggcaacaatacctgtctggattggcctctaccaagccctttcaaatgtagcaaacgagggattactgacagaaggatttttctggattccatctttgggaggccctacaacaattgctgctcggcaaagtggtgctggcatttcttggctcttgccttttgtggatggccatcctccattaggctggcatgacacgatatgttatcttgtgttgcctgtgctacttgttgcttctcagtttgtctctatggaaatcatgaagccaccccagactgatgatccatcgcagaagaacacactgcttgttttgaaatttcttccatttatgatagggtggttctctttgtcagtgccgtcagggttgtccatttattggttcacaaataatatcctcagcacagcccagcaagtttggttacggaaactgggaggagcaaagcctgttgtcaatcaggggggtagtgggataattactgcaggacgagcaaaacgtacgagtgctcaaccagcccaacctggtgaaagatttaaacagctgaaagaagaggagagcaagagaaaaggcaacaaagcgcttgctgcaggagattcagatctttcagcctcaacatcagaggatgaagagtcggatgatgagactactgaagagggaggacctgaggaaagatacaattccagtagcaacaagaaacttccaaattactccggaaagaagggcaaaagatcaaagaggaagcgcatggttcagtaggtgtgacagaacctgattggatttcatttttgtcattactggttaattcagttggccagtacggttgtgtagttgatctcggacacaattttgatgatcagttgggaaggctaatcttcaggtgcaggacagacacgaaacattccagtggtacaggtgttttgctggcacacagcaagatgaaaatagttcagtacactacaataggtttgagaggataggcatggcttgagtatgtgctacaacataagagtagtacacaaattattcttgtgctactctgcaatgtgggtaccaaactcacgcaggaattgcataattcatgctctacatgcatttatttccctcttgtaacctaataacattctttgcggagtatattgcagaagttagaacaatccagtcgcctagaaaaggtgaggaaaaaaaaatacattgctgaacttacgtctactttaaatctttgagccaatttctgtgattctgagcaattatactaataaggccaaatcctaataattcgatgaagaggtgtttggtttggttggagacaatatatcattagctcaactgcagcttgtcgaatctgctggctacaattattgtgcctgagatgtctgtgccatactttgtttgcacttttcacatttgaggcaaactttgtgtgcacgattgatcaattccacaccgttgctttggcacgcattttttttaattttgacaacaggcaactttcattaatcattacccagcttggtaacaagcccaaaacgaacatagtctgatacagaaaggaacaaacaaaaactagaagtttggcacgcaattttcacgcagaatttgagttctgtgtcgcaaatccttcgtgtaacctacgtatatatgcagaaggaaaaaaaagttac

SEQ ID NO: 4912 - DNA, 2180 bp, Triticum aestivum
ggaccggcctcctcttccactcctctcctctgctccaccaccaccaccaccactcgctgctccctccccgccgtgcatgaaaccctagccccgccgcggccccacccaccccagcccagccccgcccgcccgcgatggccaaggcgctgctctcctcctcgctgctcccctcgctcccgcgcgccgtcgcgggcgccggcgccgcgaggctgccgccgctcccctcgctgcgccgccgcgccgcggggtgccgggtcagggccagcctccacgggctcgactccgtgggaggcctccacgcggcgctcgagcgcgccgaggccgcgctctacacgctcgccgacgccgcggtcgtcgccgccgactcggcggccggggcggccggaggaggagaggacgcgggcgcggccgtgcagaagagcggcggatggttcgggttcatctccgacgccatggaggtcgtgctcaagattctgaaggatggtctctcagcagttcatgtgccctacgcttatgggtttgccatcattctgctcaccattgtcgtgaaggctgcaacattgccgttaacgaagcagcaggtcgaatcaaccatggcgatgcagaatttgcagccacagctcaaggcaattcaggcgagatacgcaggcaatcaggaaagaatacagcttgagactgctcgtttgtacaagcaagctggagtcaatcctctagcaggatgtttgccaactttggcaacaatcccagtctggattggactttaccaagccctttcaaatgtagcaaatgagggtttgttgacagaaggatttttctggattccatctttgggaggccctacaactattgctgctcgtcaaagtggtgctggcatttcatggctctttccttttgtggatggtcatccaccaataggctggcatgatacgatatgttatcttgtgttgcccgtgctactcgttgcttctcagtttgtctccatggagatcatgaaaccaccccagagtactgatccatcgcagaagaatacacaacttattttgaaatttcttccatttatgattggttacttctctttgtcggtgccatcaggattgtccatttattggtttacaaacaatgtcctcagtacagcccagcagatatggttgcggaaactgggaggagcaaagcctgctgtgaatgagggagcaagtggaattataactgcaggacgagcaaaacgttcaggtgctcaatcaggccagggtggagaaaggtttaagcagctaaaagaagaggagaacaggagaaaagctgtgaaagcacttggtgcaggagattcaaatggttcaactacatcagaggatgaagagtcagatgatgatactacagaggagggaggacctgtagaggaaacattcgctaccggcaacgacaagaagctccctacttactctggaaagaagggcaagaggtcaaagaggaagcgcattgtgcagtaacgtgagaaagcctaattggaattcatttttgtcaaaactggttaattcagttgaccagtgagccactgtagatgatctcggatacaattttgatggtcacctgcatgggaggccagatcttcagatggggatagacaaaagttttactacaggcaggtatttgctgggaagctgtaagatgaaaatagttgggttcagtcagcacagtatgttatggtaggatcgcgaggttaatggatcaggcaagcctgttccagccgaggagaggatatgtagagaagaggtacataaactttcttgtgctgttctgtaaggcgggctcggaaatcgggcaggaattgcgtactttgtacaatctgtattttctctacccctcttgtaataacctaataacattgtacgtagttcttgggagtacatggtatgcaaatcgtacaaattaggccgaattggaagaaacccgctcacacacagagaagcactcgacggcccctagccacccccataatagacccccagcccttgtattgcaacaccctcttttccacaacatcattaaacagtacccggcgcttcaaaccacacaacacttcacgctggacccatcctttgcacatgagagacgccagcccaatatctcatactttgcgaaccactttgagctcaagattaccttgttcggaccttctctattac

SEQ ID NO: 4913 - DNA, 1939 bp, Triticum aestivum
cttccactcctctcctctgctccaccaccaccaccactcgctgccccctccccgccgcgccgtgcatgaaaccctagccccgccgcggccccagcccagcccagccccacccgcccgcgatggccaaggcgctgctctcctcctcgctgctcccctcgctcccgcgcgccgtcgcgggcgccggcgccgcgaggctgccgccgctcccctcgctgcgccgccgcgccgcggggtgccgggtcagggcgagcctccacgggctcgactccgtggggggcctccacgcggcgctcgagcgcgccgaggccgcgctctacacgctcgccgacgccgcggtcgtcgccgccgactcggcggccggggcggccggaggaggagcggacgcggacgtggccgtgcagaagagcggcggatggttcgggttcatctccgacgccatggaggtcgtgctcaagattctgaaggatggtctatcagcagttcatgtgccgtacgcttacggatttgccatcattctgctcaccatcgtcgtgaaggctgcaacattgccgttaacgaagcagcaggtcgaatcaaccatggcgatgcagaatttgcagccacagctcaaggcaattcaggcgagatacgcaggcaatcaggaaagaatacagcttgagactgctcgtttgtacaagcaagctggagtcaatcctctagcaggatgtttgccaactttggcaacaattccagtctggattggactttaccaagccctttcaaatgtagcaaatgagggtttgttgacggaaggatttttctggattccatctttgggaggccctacaacaattgctgctcgtcaaagtggtgctggcatttcatggctctttccttttgtggatggtcatccgccaataggctggcatgatacgatatgttatcttgtgttgcccgtgctactcgttgcttctcagtttgtctccatggagatcatgaaaccgccccagagtactgatccatcgcagaagaatacacaacttattttgaaatttcttccatttatgattggttacttctctttgtcggtgccatcaggattgtccatttattggtttacaaacaatgtcctcagtacagcccagcagatatggctgcggaaactgggaggagcaaagcctgctgtgaatgagggagcaagtggaattataactgcaggccgagcaaaacgttcaggtgctcaatcaggccagggtggagaaaggtttaagcagctaaaagaagaggagaacaggagaaaagctgtgaaagcacttggtgcaggagattcaaatggttcaactacatccgaggatgaagagtcggacgatgacaccacagaggagggaggatccgtagaggaaacattcactaccggcaacgacaagaaactccctacttactctggaaagaagggcaagaggtcaaagaggaagcgcattgtgcagtaacttgacagcctaattggacttcatttttgtcaacactggttgattcaattgaccagtgagccgccgtagatggtctcggatacagttttgatggcacaggaggccagatcttcagatggggatagacaaaagttttactatcaggcaggcatttgctggaaagctgtaagatgaaaatagttgggttcagtcagcgcagtacgttatggtaggatcgcgatgttaatgggtcaggcaagcctgttccagccgagaggatatgttagagcagaggtacataaactttcctgtgctgttctgtatggtgggctcggaaatcgggcaggaattgcatactttgtacactgtgtattttttttctacccctcctcttgtaataacctaataacattgttgttcttgggagtacatgtgtatgcaaatcgtacaaattagtgtgatggtcattacttgttctcattgcctctcaa

SEQ ID NO: 4914 - DNA, 1815 bp, Secale cereale
atggccaaggcgctcctctcctcctcgctgctcccctcgctcccgcgcgccgtcgcgggcgccggcgccgcgaggctgccgcctctcccctcgctccgccgcggcgcctgccgccgcgccgcgggctgccgggtcagggcgggcctccacgggctcgactccgtggggggcctccacgccgcgctcgagcgcgccgaggccgcgctctacacgctcgccgacgccgcggtcgtcgcggccgactcggccgccggggcggccggagggggagcggacgccgacacggccgtgcagaagagcggcggctggttcgggttcatctccgacgccatggaggtcgtgctcaagattctgaaggatggtctctcagcagttcatgtgccgtacgcttacggatttgccatcattctgctcaccgtcatcgtgaaggctgcgacattgccgttaacaaagcagcaggtcgaatcaactatggcgatgcagaatttgcagccacagctcaaggcaatccaggcgagatatgcaggcaatcaggaaagaatacagcttgagactgctcgtttgtacaagcaagctggagtcaatcctctagcaggatgtttgccaactttggcaacaatcccagtctggattggactttaccaagccctttcaaatgtagcaaatgagggtttgttgacagaaggatttttctggattccatctttgggaggccctacaacaattgctgctcgtcaaagtggtgctggcatttcatggctctttccttttgtggatggtcatccgccaataggctggcatgatacgatatgttatcttgtgttgcccgtgctacttgttgcttctcagtttgtctccatggagatcatgaaaccaccccagagtactgatccttcgcagaagaatacacaacttattttgaaatttcttccatttatgattggttacttctctttgtcggtgccatcaggattgtccatttattggtttacaaacaatgtcctcagtacggcccagcagatatggttgcggaaactgggaggggcaaagcctgctgtgaatgagacagcaagtggaatcataactgcagggcgagcgaaacgctcaggtggtcaatcaggccagggtggagaaaggtttaagcagctaaaagaagaggagaacaggagaaaagctgtgaaagcacttggcgcaggagattcaaatggttcagctacatcagaggatgaagactcggacgatgatactacagaggagggaggacctgtagaggaaacattcgctaccggcaacgacaagaaactccctacatactctgggaagaagggcaaaaggtcaaagaggaagcgcatagtgcagtagcttgacaaagcctaattggaattcatttttgtcaaaactggttaattcagttgaccagtgggccgccgtagatgatctcggatacaaattttgatggtcacctgcatgggaggccagatcttcagatggggatagacaaggttttactacaggtgtttgctgggaagctgtaagatgaaaatagttgggtacagtcagcacagtatgttacggtaggatcgcgaggttaatggaccaggcaagcctgttccagccgaggagagggtatgtagagaagaggtacataaactttcttgtgctgttctgtaaggcgggctcggaaatcgggcaggaattgcgtactttgtacaatgtgtatttttcctatccctcctcttgttgtaataacctaataacattgtagttcttgggagtacatggtatgcgaatcgtacaaattagtcggatggaaaa

SEQ ID NO: 4915 - DNA, 2184 bp, Brachypodium distachyon
aagaagaagaattttggtgcgccgagtccacaaagcacccaaaatccaaaaagaggataaagcatccatcgtccacctcctcttcttcttcctctcgtctcttctcttccactcctctcttctgctgctgcttccacccgctagcacgctgagggcccccacggcgcgatggccaaggcgctgctctcctccacgctgctcccctcgctcccgcgcggcggcgccgtcgcgttccgcggcctgccgccgctccgcactgccgggcaccgtggccgcgcggcgggatgcgcggtcagggcgagcctcgactccgtcgggggcctccacgcggcgctcgagcgggccgaggcggcgctctacacgctggcggacgcggccgtcgtcgcgggggcggcgggaggggacctggaccaggcggtgcagaagaaaggcgggtggttcgggttcatctccgacgccatggaggtcgtgctcaaggtgctgaaggatggtctctcggcggttcatgtgccgtactcttatgggtttgcaatcattttgctcaccattgttgtgaaggctgcaacattacctttaacaaaacagcaggtcgaatcaactctggcgatgcagaatctgcagccgcagctcaaggctattcagcagagatatgcaggcaatcaggaaaggatccagcttgagactgctcgtttatacaagcaagctggagtcaatcctctagcaggatgtttgccgactttggcaacaatacctgtctggattggactgtaccaagccctttcaaatgtagcaaatgagggattgttgacagaaggatttttctggattccatctttgggaggccctacaacaattgctgctcgtcaaagtggagctggcatttcatggctcttcccttttgtggatggtcatccgccaataggttggcatgacacaatagcttatcttgtgttgcctgtgctacttgttgcttctcaatttgtctccatggagatcatgaagccaccccagtctactgatccatcacagaagaatacacagcttattttaaaatttcttccattcatgatcgggtatttctcattgtcggtgccatcaggattgtccatttattggtttacaaacaatgtcctcagtacagcccagcaagtgtggttacggaaattgggaggagcaaagcctattgtgaacgagggaggcagtggaatcataactgcaggacgagccaagcgttcaagtgctcaatcaggccagggtggagaaaggtttaagcagctaaaagaagaggagagcaggagaaaagctaccaaagcgcttgctgcaggagatacaaaagcttcagtggagacatcagaggatgaagaaacggatgacgagattacagaggagggaggagctgtagaggaaacttacgcttccggtagtgacaagaaacttcctacttactccggaaagaagggcaaacggtcgaaaaggaaacgcatagtgcagtaacgcgacagagcctaattggacatcatttttgtcaggactggttaagttgaccagttaggtgatgtagttgttctcgggttacaattttggtggcgtctcacgggacgcctaatcttcagacgcggacatatacacaattcgaagtgatgctgatactcgcatgcagaagatgtgtaggatgaaatagccagttaagtttattacgaatttacgataggaaccgaaaggtcaagaggaccaggcagcaaactaaacctgttccagctgaggagaggagaggagaggatctttagaagaggtacataaaccgtttaaaaatctttgttctgtatgtaagggcgggtatggttcgaaaaccgggctggaaatgattcgcatacttggtatatactcttatgtaatttcctttgttccccactcctgtcgtgtaatctgacaactttgttcttgggagagagagcatatggtatgcaaccgtacaaacaattggatgcaagtgtaaagaaagagatgagcattttgagcagtgtggtggtggatgctgaactgttaagcttgctacactactctaatgtctgtttgggcccagctccatgattctctgacgatgcctgtggcaaaagttaatttgtgggcgctaccagcaaactacatataaagtacttataaaagagttaatttgtgggcgct

SEQ ID NO: 4916 - DNA, 1897 bp, Avena sativa
accaccaccactcgctgctccctccaccggctccccgtcccccgtcccccgtccccgccgccggtgcatgaaaccctagccccgccgcgccctcgcctgcccccacctccatccgcgatggccaaggcgctcctctcctcctcgctgctgccctcgctcccgcgcgccgtcgcgggcggggccgcgaggctcccgccgctcccgtcgctcagccgcagcgggtgccgccgcgcggcggggtgcagggtcagggcgagcctccacgggctggactccgtgggcggcctccacgcggcgctcgagcgcgccgaggccgcgctctacacgctcgccgacgcggcggtcgtcgcgggggccggcggagcgggagcaggaggaggggacgtggagcaggcggtgcagaagagcggcgggtggttcgggttcatctccgacgccatggaggtcgtcctcaaggtgatgaaggacggtctctcggcggttcatgtgccgtacgcctatgggttcgccatcattctgctcaccgtcgccgtgaaggctgcgacgttaccgctcacgaaacagcaggttgagtcaactctggcaatgcagaatttgcagccacagctcaaggcgattcagaagagatatgaagggaatcaggaaagaatacagctggagactgctcggttatacaagacagctggagtcaatcctctagcaggatgtttgccaactttggcgacaatacctgtctggattggactttaccaagccctttcaaatgtagcaaatgaggggttgctgacagaaggatttttctggattccatctttgggaggccctacaacaattgctgctcgtcaaagtggtgctggcatttcatggctcttcccttttgtggatggtcatccaccaataggctggcatgacagcatatgctatcttgttttgcctgtgctacttgtggcttctcagtttgtctccatggagatcatgaagccaccccagagtactgatccatcgcagaagaatacacaacttattctaaaatttcttccatttatgattgggtatttctccttgtcggtgccatcagggttgtccatttactggttcacgaacaatgtcctcagcacagcccagcaaatatggttgcggaaactgggaggagcaaagcctgtcgtgaatgagggagcgagtgggatcataactgctgggcgagcaaagcgttcaggtgctcaatcaggccagggtggggaaagatttaagcagctaaaggaagaggagaacaggagaaaagctgccaaagcacttggtgcaggagattcgaatggttcagcatcaacatcagacgatgaagagtcggatgatgatactacagaggagggtgaagccgtagaggaaacgtacattgccggcaccgacaagaaacttcctacttactctggaaagaagggcaagaggtcaaaaaggaagcgcattgtgcagtaatttgggcagagcctaattggaattcgtttttgtcaaagctggttaattcagttgaccagtgagctgccataggtgatctcgggtacaattttgatggccactcgcatgggagggctgatcttcagatggggatagacaaagttttactactactactacaagtattggctggcaagatgtaagttggaaatagttggttcagccagcacgtcacgtaggatcacgggtatagtggatcaggcaagcctggttcagcttgaggagatgatgcttaggtacataaactatcttgtgatggtctcgaaaatcactccggaattgcataccctgtattttctctaccccctcttgtaacctaatagagttctaacattgttgtccttgggagtacatggtatgcaaatcgtacaaattagtttgatgg

SEQ ID NO: 4917 - DNA, 1965 bp, Zea mays
tatatacataaccgctggcaggcaggctcatgcgattagcgcggcggcagggcaggcatggagaaggaggcggcggcggagctggagatccccggtgagtgccagtacgcgggggatccagtgttggtgcgaccgagccagccgacgccgcgccacaccctgcacctctccaacctcgacgaccagcggttcctccgtttctccatcaagtacctgtacgtgttcggcgccgacgccgccgtgcccgccgacgcgctgcgggcggcgctcggcagggtgctcgccgactactacccgctcgccggccggctccggccgagcgccgaggaggatgggaagctcgtcgtggactgcaatgccgagggcgccctcttcgccgagggccgcctcccgggcctcgccgccgccgacttcctcagcggcagcgaccggccgcacaagtcctggaggaagctgcactacagggtggaggcgcagagcttcgtcgccgtgccacctctcgtcgtccaggtcacttggctcgcgtgcggcggcatggtcctctgcaccgccatcaaccactgcatctgcgacggcatcggcaccgcgcagttcctccacgcctgggcgcgcgccgtgcgcggcggcggcggccgcgacgcactggacgccggcggcgacgacactgccctgccgttccacgaccgccgcgccctgcgcccgcgctgcccaccgcgcgtcgcgtttgcgcacccggagtacagcacccgcggcatcatcaacgccgccgtcgccaacggcaacggcaacggcagcgcgaacgaggcgccgagcctgctggcgcgcctgctggggcagccgctagcgcccgtgtcgctcaccttcacggcggcgcacctcctccggctgaagcggcagtgcgtgccgtcgctcaagtgcacctccttcgaggccctggcggcgcacgtgtggcgcgcgtgggtgcgcgccctggacccgcccggcgcgctgcgcgtgaagctgctcttctccgtgaacgtgcggcggcgcctgaggcccgagctgccgcggggctactacggcaacggcttcgtgctcgggtgcgccaggtccacggcggcccagctgacgtccccgtcctgcggctcggccgcgcgctacggggtgcggctggtgcaggacgccaaggcgtgcgtggacgacgactacgtgcgctccatggtcgacctcctggaggagcggcgcggcgcccgcccggacctggcggccagcctggtgatctcggcgtggacgcgcctgggcctcgaggacctggacttcggcgccggcaaggccgcgcacatgggcccgctcaccagcgagatctactgcgtcttcctgcccgtggtcggcgacccgcacgccgtcactgtgctcgtctccgtcccgcaggccgccgccgacaagttccagcacttctgcctcgggttcctcaaggacgtcgaagtggacgcgaagctcacctgagctactatggctatgatgtatgatccagcttgctagctcgtcgatgagtctcagtttgattttccaccgtgcattctgctttctgcatgctatatgagaaaatgatggagtattatgctaattactcccggtcaatataattgtgtcgaacggatgaaatgaaagatcgtctggtgatgatcatagtcatgcatgtatcggctgcggtccgatccagtagtaatatcaatcaatcaatcggtgatgaggtcctttttgtggtgtcatcaactatctggctcgtggtagctagtcggcgatcatgacgctcatcgtgtcgtgcatatatttgtctgtctctctaattaataaacatgtagtactactagtaattacgatgaagattcatgctcatttattcaattctctactatattaaagcactagttttttctagtttcattgtcgttgtgatccacgtttaaatagtaaaaaaataaa

SEQ ID NO: 4918 - DNA, 1653 bp, Setaria italica
ggcagccatggagagggagtcggcgccggcgacggcggagctcgagatcccgggggagtgccagtactccggcgagccggcggtggtgcggccgtgccagcccacgccgcggcacacgctgtacctgtccaacctcgacgaccagcggttcctccgcttctccatcaagtacctctacgtgttcgccgcccccgccgccgtgcccaccgacgccctgcgcgcggcgctcgccagggtgctcgtcgactactacccgctcgccggccgcctacggcccagcgacgacgacgaggggaagctcgtcgtggactgcaatgccgagggggcgctcttcgccgaggggtgcctgccggggctcaccgccgccgagttcctccgccgccgcgccaggccgcacaagtcatggaggaagcttctctacagggtggaggcgcagagcttcgtcgccgtgccacctctcgtcgtccaagtcacccggctgggctgcggcggcatggtcctctgcacagccatcaaccactgcctctgcgacggcatcggcacggcgcagttcctccacgcctgggcccacgccgcgcgcgccggccacggcgctctggacgccgtcgacatcggcgacggctccgccatgctggcgccgccgttccatgaccgccgcgccctgcgcccgcgctgcccgccgcgcgtcgccttcacccacccggagtacaacagctgcggcggcatcggcgccgtcgccaacggcaacggcaacgggaacgggagcgaggcgccgagcctcctggcgcgcctgctgggtcagtcgctggcgcccgtgacgctcaccttcacggcggcgcacctcctccggctgaagcgccagtgcgcgccaccgctcaagtgcacgtccttcgaggccctggcggcgcacgtgtggcgcgcgtgggtgcgcgccctggacccgcccggcgcgctccgcgtgaagctcctcttctccgtcaacgtccgccgccgggtgaagcccgaactgccccggggttactacggcaacgggttcgtgctcgggtgcgccgagtccacggcggcgcagctggtctctccctccccctccgccgccgcccgctacggcgtgcggctggtgcaggaggccaaggagtgcgtggacgacgactacgtgcggtccatggtggacctcctcgaggagcggcgcggcgcccggccggacctggcggcgagcctggtgatctcggcgtggacgcggctggggctcgaggacctggacttcggcgcgggggcggcggcgcacatgggcccgctcaccagcgagatctactgcgtgttcgtccccgtgatcggcgacccgcacggcgccaccgtgctcgtctccgtcccgcaggccgccgccgaccggttccagcactactgcctcgggtttctcaaggacgccgacgtggacgcgaagctgatgagctgagctgattgagcttgtcgatgagtgaattaagaatactaattactccgatcgaaaagggttgaacgaaagatcatctggtgaagatcgatcgtgatgatgcatgaatgcacactccagtagcaatcaactgttgtaaatcgagcacctttttgtgtgatcaacatcaactagctccctcgctcgtggtagtttatttgccg

SEQ ID NO: 4919 - DNA, 1526 bp, Saccharum officinarum
caaaactcaaaagcaaggccggctcactgtcgtgtactcgtgtctcgttctcacctctgattccttccgcctcgtcagcgaaccgcgcgcgaaccagacccacccaagccaacaacccatggccgccgcggcgcctcttctcctcgccctcgccgtcctcgccgccgcggcatggccgtccctagcggcggaggggccggcggcggcgctgcaggacccggcggagctcctgcgccgggccaaggagccggcgttcgcggactggatggtcggggtgcggcggcggatccacgagaacccggagctggggtacgaggagttccagaccagcgagctcgtgcgccgggagctcgacgcactggggatcccctacaggcacccctttgccgtcaccggcgtcgtggcaacagtcggcaccggcggcccgcccttcgtcgctctgcgggccgacatggacgcgctgcccttgcaggaaagtgtggaatgggaacacaagagcaaagttcccgggaagatgcatggatgtggacatgatgcacatgttgctatgctgttgggatctgctaagattcttcaggagcatcgtgatgagttgatgggtacagtggttcttgttttccaaccagctgaggaaggtggcggtggggcccagaaaatgatagaagctggagctctagaaaacatagatgccatttttgggcttcatatagctgattctgtgcctattggtgtactggcatccaggccagggcctattatggctgggagtggattctttgaggccgtaataagtggaaagggagggcatgctgcacttcctcatcacactatagatccgatattggctgcctcaaatgttattgtgagccttcagcaacttgtttcccgagaagctgatcccttggactcacaggttgtaacagttggaaagtttcaaggaggtggagccttcaatgtgatccctgattcggttactataggtggcaccttccgagcctttctgaaagagagttttaatcaattgaagcagcgaattgaagaggtgattgtgtctcaagcatctgtgcagcgctgcagcgctagcgtggacttcctcacaaaggaccgtccattcttccccccaaccatcaacagccctgagctccatgatttctttgtgaatgtggccagcgagatggttgggtcgaggaacgtgagggacagacaaccgctaatgggcgctgaggacttctcgttctacgctgaggcgatcccctcgacctactactacttcgtgggcatgtacaacgagactcgtggactacaggcgccccatcactccccctacttcaccgtcaacgaagatgccctcccctatggtgcggctgcgcaagtggcattggcagctcgctatctactcgagcatcagcaacctgctgccaccactgataaggcaaaaccccatgatgagctgtagatacataatgtttgcttcactctgttaatgaaattagattgagcaataatttctttcccaagttattcca

SEQ ID NO: 4920 - DNA, 1892 bp, Zea mays
cggtcgactattccatcagtacaaccagcagtcgtagatagacgccttgaaacaaaagactacccgagagggccagacaatgaaaagcagaaacgatcgcgcacgcacggcagcaggatcggcacacgaaaaacgcagttgcatcgtggcatgcatttggaaatatcgtaatcaaaataaaccagccgccgccctcgtgcgggcctgcgcttgccttggcctcgtcaaaagcaaggccgccccactctaggctcacctgattccttccgccttgtcagcgcagcgatccagacccacccgagccaacaacccatggccgccgcgacgccgcgtctcctgctcgcggtcgcgggcctcaccctcgccgtcctcgccgccgcggtctcgccgtctctggcggcggggccgccggtgctgcaggacccggcggagctcctgcgccttgccaaggagccggccttcgcggactggatggtcggggtgcggcggcggatccacgagaacccggagctgggatacgaggagttccagaccagcgagctcgtgcgccgggagctccacgccatggggatcccctacaggcaccccttcgccgtcaccggcgtggtagcaacagtcggcaccggcggtccgcccttcgttgctctgcgggcggacatggacgcgctgcccttgcaggaaagtgtggagtgggaacacaagagcaaagtccctgggaagatgcatggatgtggacatgatgcacatgttgctatgctgttgggatctgctaagattcttcaggagcatcgtgatgagttgaagggtacagtagttcttgtcttccaaccagctgaggaaggtggcggtggggccaagaaaatgatagaagacagagctgtggaaaacatagatgccatttttgggcttcatatagctgactctgtgcctattggtgtgctggcatccaggccagggcctattatggctgggagtggattctttgaggccgtaataagtggaaagggaggacatgctgcacttcctcatcacactatagatccgatattggctgcctcaaatgttattgtgagccttcagcaacttgtttctcgagaagctgatcccttggactcacaggttgtgacagttggaaagtttcaaggaggtggagccttcaatgtgatccctgattcggtaactataggtggcaccttccgagcctttctgaaagagagttttaatcaattgaagcagcggattgaagaggtgattgtgtctcaagctagcgtgcagcgctgcagcgctgccgtggacttcctcagcaaggaccgtcctttcttcccgccgaccatcaacagccccgagctccacgacttcttcgtgaacgtggccggcgagatggtcggctcgaggaacgtgagggacaggcagccgctgatgggcgccgaggacttcgcgttctacgccgaggcggtcccttccacctactactacttcgtgggcatgtacaacgagacgcgcgggccgcaggcgccccaccactccccctacttcaccatcaacgaagacgcccttccctacggcgcggccgggcaggcggcgctggcagctcgctacctactcgagcgtcagcagcctgctgccgccaccgctgataaggcagaaacccatgatgagctgtagatagtacatgatgtttgcgtccctgtccctgtgttgatggaattagattgagcaataatttcttcgccaagtttattcagcggctgtacatatcctggtatctccatgctttggtaatgatcggttgggatcagtcagcaaatagtctgagaaacatgctttagtctgagaaacatgattccatcccttgatcaacgtcgcagtaactatcttctgctgattccaaa

SEQ ID NO: 4921 - DNA, 1694 bp, Panicum virgatum
ttccgtctctcacccgaccctccgcctcatcagcgagcgaactaaccaaccgcgccgcaaccgaaccgagccaaaccatggccgccgcgccgccgcccctcctgctcgcgggcctcgccctcgccgtcatcgccgccgcgggatggcccccggcggtgacggcggcgctggaggaccccgcggggctcctgcggcgggccaaggagccggcgttcgcggactggatggtcggggtgcggcggcgcatccacgagaacccggagctggggtacgaggagttcgagaccagcgagctcgtgcgccgggagctcgaggccatggggatcccctacaggcaccccttcgccgtcaccggagtggtcgccacagtcggcaccggcggcccgcccttcgtcgcgctgcgggcggatatggacgcgctacccttgcaggaaagcgtggaatgggagcacaagagcaaagttcctgggaaaatgcatggatgtggacatgatgctcatgttgctatgctcttgggatctgccaagattcttcaagagcatcgtgatgagttgaagggcacagttgtccttgttttccaaccagctgaggaaggtggtggtggggcccagaaaatgatagaagctggagctgtggaaaacatagaagccatttttgggcttcatgtagctgactctgtgcctattggtgtactggcatccagaccagggcctattatggctgggagtggattctttgaggctgtaataagtggaaagggagggcatgctgcacttcctcatcacactattgatccgatattggctgcctcaaatgttattgtgagccttcagcagcttgtttctcgggaagccgatcccttggattcacaggttgtaacagttggaaaatttcaaggaggtggtgccttcaatgttatcccagattcagtaacaattggtggcaccttccgagcctttttgaaggatagttttaatcaattgaagcagcgaattgaagaggtcattgtctctcaagcatccgtgcagcggtgcagtgctactgtggacttccaaaccaaggaccgccctttcttccccccaaccagcaacagccccgaactccacgatttcttcgtgaatgtggctagtgagatggttggctccaagaatgtgagggacaggcagccgctgatgggtgctgaggacttcgccttctacgctgatgcgatcccctccacctactactactttgtgggaatgtacaacgagacccgtggactgcaggcgccccatcattccccctatttcaccatcaacgaggatgccctcccctatggcgcggctgctcatgcagcgttggctgctcgctatctgctcgagcaccaggagcctgctgctaccccggataaggcgaaatcccatgacgagctgtagatagttactgtctgcttcattggattctggtgagatgcaaaaaatgggtgcaattagattgagccattgaagctgaattttcggctggttggctttatctttcgccaagttattcagaagatgtacatatattctgatatatctgcacactttgataataatcgcttgcttgtcaattgcatactcgggcattatttagtgtgatactgaagttagcaaataatctgggaaacacggctcttcaaacctgattccatttcttatcatctgtgattgctt

SEQ ID NO: 4922 - DNA, 1684 bp, Setaria italica
cactcctcacctgacctccgcatcatcagttcatcactcaccagcaaaccaaccgcgcaaggcgcaaccgaaccaaccaaaaaaacatgggcaccgctgcgccgccactcctgctggcgggcctcgccctcgccgtcctcgccgccgcgggatggccttcggtggcgacggcggcgctggaggaccccgcggggctcctgcggcgggccaaggagccggatttcgcgggctggatggtcggggtgcggcggcgcatccacgagaacccggagctggggtacgaggagttcgagaccagcgcgctcgtgcgccgggagctcgacgctatggggatcccctacaagcaccccttcgccgtcaccggggtggtcgcgacagtcggcaccggcggcccgcccttcgtcgcgctgcgggcggatatggacgcgctaccgatgcaggaaagcgtggaatgggaacacaggagcaaagttcctgggaaaatgcatggatgtggacatgatgctcatgttgctatgctcttgggatctgccaagatccttcaggagcatcgtgatgagttgaagggcactgtagtccttgttttccaaccagccgaggaaggtggtggtggggctcagaaaatgatagaagctggagcagtggaaaatattgatgccatttttgggattcacatagctgactctattcctattggtgtgctggcatccaggccagggcctattatggctgggagtggattctttgaggctgtaataagtggaaagggagggcatgctgcacttcctcatcacactatagatccgatattggctgcctcaaatgttattgtgagccttcagcaacttgtttcccgggaagctgatcccttggactcacaggttgtaacaattggaaaatttcaaggaggtggggccttcaatgttatccctgattcagtaacaataggtggcaccttccgggcctttttgaaagagagttttaatcaattgaagcagcgaattgaagaggtaattgtctctcaagcatctgtgcagcggtgcactgctactgtggacttcctcaccaaggaccgccctttctttcccccaaccatcaacagccctgagctccatgatttcttcgtgaatgtggccagcgagatggttggctccaagaatgtgagggacaggcaaccgctgatgggtgctgaagacttcgccttctacgccgaggcgatcccctccacctactactattttgtgggaatgtacaacgagacccgcggaccacaggcgccccatcattcaccctacttcaccatcaacgaggatgccctcccctacggggcggctgcacaagcagcaatggctgctcgctatcttcacgagcaccagcagcctgcttctaccctggataaggcaaaaacccatgatgagctgtagatagttactgtctgcttcattgacttctgatgaaatgcaaatgatagcataagttggtgcaaatagattgagccatcgaagctgaattttcagctggtcaccttacctttcgccaagttattcatcagatgtacatatactctgatatttgcgcacttttcataataatcgcttgctcaataattgtgcactctggtattatttagcgcgatgctgaagtcagcaaataatgtgggaaaattggttcttcaaacctgttc

SEQ ID NO: 4923 - DNA, 1548 bp, Pennisetum glaucum
cgcaccatcaatcagtccatcactcatcagcaaccaaccgcgccaccaaaccatgggcaccgctgcgccgacactccttctcgcgggcctcgccctcgccgtcctcgccgccgcgggatggcctccggtggcgacggcggcgctggaggaccccgcggggctcctgcggcgggccaaggagccggctttcgcagactggatggtcggggtgcggcggcgcatccacgagaacccggagctggggtacgaggagttcgagaccagcgcgctcgtgcgccgggagctagacgccatggggatcccctacaagcaccccttcgccgtcaccggggtggtcgccgccgtcggcaccggcggcccgcccttcgtcgcgctgcgggcggatatggacgcgctaccgatgcaggaaagtgttgaatgggaacacaagagcaaagttcctgggaagatgcatggatgtggacatgatgctcatgttgctatgctgttgggatctgccaagatccttcaggagcatcgtgatgagttaaagggcaccgtagtccttgttttccaaccagccgaggaaggtggtggtggggcccagaaaatgatagaagctggagcagtggaaaatattgatgccatttttggaattcacatagctgacgctattcctgttggtgtgctggcatccaggccagggcctattatggctgggagtggattctttgaggctgtaataagtggaaagggagggcacgctgcacttcctcatcacactatagatccgatattggctgcctcaaatgttattgtgagccttcagcaacttgtttcccgggaagctgatcccttggactcacaggttgtaacagttggaaaatttcaaggaggtggtgccttcaatgttatccctgattcagtaacaataggtggcaccttccgcgcctttttgaaagagagttttaatcaattgaagcagcgaattgaagaggtaattgtctctcaggcatctgtgcaacggtgcagtgctacagtggacttcctcaccaaggaccgccctttcttccccccgaccattaacacccccgagctccacgatttctttgtgaatgtggcaagcgatatggttggctccaagaatgtgagggacaggcaaccgctgatgggtgctgaagacttcgccttctatgcggaggcaatcccctccacctactactatttcgtgggaatgtacaatgagacccgcggaccgcaggcaccccatcattcaccttacttcaccatcaacgaagatgccctcccctacggggcggctgcacaagcagcgatggctgctcgctatctgctcgagcaccagcagcctacttctaccctggataaggcaaaaacccatgatgagctgtagatagttactgtatgcttcattgaattctgatgaaatacaaatgatagcaagcattggtgcaattgattgagccattgaagctgaattttcggccggtcacctctttcaccaagttattcatcagatgtacatatactctgttattcacttatttgcgc

SEQ ID NO: 4924 - DNA, 1649 bp, Setaria italica
ttcgattgccttgcctaggcctatgaaacaaggactaccaacactctcacctgatcggtttgacccccggcctcatcactcagcactcatcagtgaaccaaccgaaacaagctgagaatcatggccgccgcggcgccacctccactgctcgcgtgcttcgccctcgccgtcctcgccgccgcggtatggccgtcgctaggggcgggagcgtcgctgctggatgaccccgcggggctcctgcgacgggccaaggagccggcgttcgcggactggatggtcgcggttcggcggcgcatccacgagaacccagagctggggtacgaggagttcgagaccagcgagctcgtgcgccgggagctcgacgccatggggatcccctacaggcacccgttcgccgtcaccggggtggtggcgacgatcggcaccggcggcccgcccttcgtcgctctccgggcggacatggacgcgctacctatgcaggaaagtgtggaatgggaacacaagagcaaagttcctggaaagatgcatggatgtggacatgatgcgaatgttgctatgctattgggatctgccaagattcttcaggagcatcatgacgagttgaagggcacagtagtgctggttttccaaccagccgaggaaggtggcggtggggcgcagaaaatgatagaagctggagctttggaaaacgtagatgctatttttggggttcatgtagctgactctgttcctattggtgtgctggcatccaggccagggcctatcatggctgggagtggatgctttgaggccgtaataagtggaaagggagggcatgctgcacttcctcatcacactatagatccgatcttagctgcctctaatgttattgtgagccttcagcaacttatttcgcgggaagctgatccattggactcacaggttgtaacaattgggaaatttcaaggtggtggggccttcaatgtgatccctgattctgtaacaataggtggcaccttccgagcctttttgaaagaaagttttaatcagttgaagcagcgaattgaacaggtgattgtgtctcaagcatccgtgcagcgatgcaatgctactgtggacttcctcaccaatcgtatccctttcttccccccaaccatcaacagccctgagctccacagtttcttcgtgaatatggccggtgagatggttggctccaagaacgtgagggacaggcagccgctgatgggtgccgaggacttcgccttctatgccgaggtgatcccgtccacctactactactttgtaggcatgtacaacaagactcgaggaccgcaggcatcccaccactccacctacttcaccgtcaatgaggatgccctcccctacggcgcggctgcgcaagcagcgttggctgctcactatctgctcgagcacgagcagcctgctgctacccctgataaggcgaaagcccatgaggagctgtagatagatatcttccccttcagcacacagttctgcatatctttgtattaaaatactagtgaacgtgcacgtgcggcacacacgtgatacaaaaaggattgcatacaagactatgtataatgtaataataaatagttactatattattaccgaaattgaaactgaaataacatataactaacaatcca

SEQ ID NO: 4925 - DNA, 1828 bp, Brachypodium distachyon
ggcagagagccttgatagcctagtagccttagccgggcctgaatcgtgcacgtttcgcctgatcgatacaagagtccaaaactaaaacgcgaacagcgcggcggaatttactgttgttgaccatggccgcgcgtgcttcgcctctcctgctcctgctgctgccagcggccatcgttctcgccgccgccgcggcgccgagctcggcggcggcggggctggacgacccggcggggctcctgcggcgggccaaggaggcggagttcatggactggatggtcggggtgcggcggcggatccacgagaacccggagctcggctacgaggagttcgccaccagcgagctcgtgcggcgggagctcgacgccatggggatcccctacaggcaccccttcgccgttaccggcgtcgtcgccaccgtcggcacaggcggcccgcccttcgtcgcgctccgggccgacatggacgcgctccccatgcaggaaagtgtggagtgggagcataagagcaaagtgcctgggaaaatgcatgggtgtggccatgatgcacatactgctatgctattgggctctgccaagattcttcaggagcaccgtgatgagttgcagggtactgtagttctccttttccaaccagctgaggaaggcggtgggggcgcaatgaaaatggtagaagatggagctgtggaaaacatagaggccatgtttgggcttcacgtagctgacattgttcctatcggtgtgctggcatccaggcctgggcctattatggcagggagtggattctttgaggcagtaataagtggaaagggagggcatgctgcacttcctcatcacactatagatccgatactggctgcatcgaatgtcatcgttagccttcagcaacttgtttcccgagaagctgatcccttggactcacaggtggtaacagttggaaagtttcaaggaggtggagccttcaatgttatccctgactcggttacaataggtggcaccttccgagcctttttaaaagagagctttaatcaattgaaacaacgaattgaagaggtcatagtgtcacaggcatctgtgcagcggtgcagcgctgtcgtggacttcctcaagaaagatcgccctttcttccccccaacaatcaacagcccggagctgcacgatttctttgggaaggtggccagtgagatggttggccccaacaacgtgagagacaggcagccactgatgggtgctgaggacttctccttctatgccgaagccgttcccacgacatactattacttcgtgggcatgctcaacgagacccgcggaccacaggcgcctcatcactctccctacttcaccatcaacgaggatgcaatgccgtatggcgcggccatgcaaacgtcattggctgctcgctacctgcttgagcaccagcctgttaaagctgccaagtcggaaccccgcgacgagctgtagatgtgccccaaatctggttaatgtgaactgcaattgattaaaaagaaagattctgtgccaaatcaagcggactcgcgcagtcaccaggtgattgtgcaacagtttgtacataatttcctgacttctaagcatttatccgagtcgactagtaatcttcggtgcagtactgggacaaaataaaatgcctcgtcgataatttataaccatttggatctaccatttgtcaaagctcttgcgaagaataaatttttaagcaatcacatgaaatcagcttgtgcgccggctgcaattttatgctcggcagttgtctttcaggagcttgtatgatggtagagtatttaatttggagtaattccacttctgcccctcta

SEQ ID NO: 4926 - DNA, 1438 bp, Brachypodium distachyon
aaactaaaacgcgaacagcgcggcggaatttactgttgttgaccatggccgcgcgtgcttcgcctctcctgctcctgctgctgccagcggccatcgttctcgccgccgccgcggcgccgagctcggcggcggcggggctggacgacccggcggggctcctgcggcgggccaaggaggcggagttcatggactggatggtcggggtgcggcggcggatccacgagaacccggagctcggctacgaggagttcgccaccagcgagctcgtgcggcgggagctcgacgccatggggatcccctacaggcaccccttcgccgttaccggcgtcgtcgccaccgtcggcacaggcggcccgcccttcgtcgcgctccgggccgacatggacgcgctccccatgcaggaaagtgtggagtgggagcataagagcaaagtgcctgggaaaatgcatgggtgtggccatgatgcacatactgctatgctattgggctctgccaagattcttcaggagcaccgtgatgagttgcagggtactgtagttctccttttccaaccagctgaggaaggcggtgggggcgcaatgaaaatggtagaagatggagctgtggaaaacatagaggccatgtttgggcttcacgtagctgacattgttcctatcggtgtgctggcatccaggcctgggcctattatggcagggagtggattctttgaggcagtaataagtggaaagggagggcatgctgcacttcctcatcacactatagatccgatactggctgcatcgaatgtcatcgttagccttcagcaacttgtttcccgagaagctgatcccttggactcacaggtggtaacagttggaaagtttcaaggaggtggagccttcaatgttatccctgactcggttacaataggtggcaccttccgagcctttttaaaagagagctttaatcaattgaaacaacgaattgaagaggtcatagtgtcacaggcatctgtgcagcggtgcagcgctgtcgtggacttcctcaagaaagatcgccctttcttccccccaacaatcaacagcccggagctgcacgatttctttgggaaggtggccagtgagatggttggccccaacaacgtgagagacaggcagccactgatgggtgctgaggacttctccttctatgccgaagccgttcccacgacatactattacttcgtgggcatgctcaacgagacccgcggaccacaggcgcctcatcactctccctacttcaccatcaacgaggatgcaatgccgtatggcgcggccatgcaaacgtcattggctgctcgctacctgcttgagcaccagcctgttaaagctgccaagtcggaaccccgcgacgagctgtagatgtgccccaaatctggttaatgtgaactgcaattgattaaaaagaaagattctgtgcc

SEQ ID NO: 4927 - DNA, 1803 bp, Oryza sativa
gctcgacataaataaaaagaaaattataaaaagcggaggcggctggagtgaagtgggcgagggcgcaaaccagagagaggtcacgagattatcgccggccatggccgccgcatcgtcgtcgcgtgttctgctcgccgccgtcgccgtcctggccgccgccctcgcgggctgcggtgcgggggcggcgctggacgacccggcggggctcctgcggcgtgcgaaggaggcggagttcgcgggctggatggtggggctgcgccgccggatccacgagaacccggagctcgggtacgaggagttcgccaccagcgagctcgtgcgcagggagctcgacgcgctggggatcccctacaggcaccccttcgccgtcaccggcgtcgtcgccaccgtcggcaccggcggccctcccttcgtcgcgctccgggcggacatggacgcgctcccgatgcaggaaagtgtggaatgggagcacaagagtaaagtgcctggaaagatgcatgggtgtggtcacgatgcacatgttgctatgctgttgggttctgccaggatacttcaggaacaccgtgatgagctgaagggtaccgtagtacttgttttccaaccagctgaggaaggtggtggtggggcaaagaaaatgatagatgatggagctgtggaaaatatagaggccatttttggggttcatgttgctgatgttgtacctattggtgtggtggcatccaggccaggacctgtaatggcagggagtggattcttcgaggcagtaataagtggaaagggagggcatgctgcacttccccaccacactatagatccaatactggctgcatcaaatgttattgtaagccttcagcaacttgtttcccgggaagctgatcccctagactcacaggtagtaacagtaggaaaatttcaaggaggtggagccttcaatgtcatccctgattctgttacaattggtggcaccttccgagcctttttaaaagagagttttaatcaattgaagcagcgaattgaagaggtcattgtgtcacaagcatccgtgcagcggtgcaatgctgtcgtagacttcctcgacaaagaccgccctttcttccctccaacaatcaacagcgcggggctccacgatttctttgtgaaggtagctagcgagatggttggccccaagaatgtcagggacaagcagccactgatgggtgccgaggacttcgccttctacgctgatgcgattcctgcaacttactactacttcctgggcatgtacaacgagactcgcggaccgcaggcgcctcaccactccccctacttcaccatcaacgaagacgccctgccctacggtgcagccttgcaagcatcactagctgctcgctatctgcttgagcaccagccccctaccactggtaaggcgaaagcacatgacgagctgtaggtacggacactttcgctctctccctctccttctctctcgtgaacgaattctctttattgaacgcgaatgataaagattggcaagatagaattctgtcaaattaaggtggcatgcccatcgattctgtatttctaggtgccatgtgtgactgatgtacatatactcctgattactgcgcattccaattagcaaatttggtacttctgcttcatttgcacttgagcattgttcagtaagatacatgattgtggaacatggaaaacgtggctgttagtcgcccgattgtggctgatggcatatgggcaccggacagacgtgtttcgtgcctgactcttcacttgtcctattaaattgatcctggttagttttaacac

SEQ ID NO: 4928 - DNA, 1812 bp, Hordeum vulgare
ctcgtgcgcgtttcgcctggttgatagcccaaaccgaagcagaacatcacgacggaattcatttactccgtactagcgttggccatggccgctggcgcttcgcccctcctgctgttgcgcgtcgccctcgtcctcatcgccgccgccgcggcctgggcggcggcgctggacgacccggcggggcttctgcgacgggccaaggaggcggagttcttggactggatggtgggggtgcggcggcggatccacgagaaccctgagctcggctacgaggagtttgccaccagtgaactcgtccggcgcgagctcgatgccatggggatcccgtacaggcaccccttcgcgctcaccggcgtcgtcgccaccgtcggcacaggcggcccgcccttcgtcgcgcttcgggccgacatggacgcgctccctatgcaggaaagtgtggaatgggaacataagagcaaagtgcctgggaagatgcatggatgtggccatgatgcacatgttgctatgctgttgggttctgctaagattcttcaggagcaccgtgatgagttgaagggtactgtagtccttcttttccaaccagctgaggaaggtggtggtggagccaagaaaatggtagaagccggagctgtggaaaacatagaggtcatgtttgggattcatgtagctgacactgtgcctattggtgtgctggcatccagacctgggcctataatggcggggagtggattttttgaggcagtaataagtggaaagggagggcatgctgcacttcctcatcacactattgatccaatactagctgcatccaatgttattgttagccttcagcaacttgtttcccgagaagctgaccccttggactcacaggtagtaacagttggaaagtttcaaggtggtggagccttcaatgttatccctgattctgtgacaataggcggtaccttccgagcctttttgaaggagagttttaatcaattgaagcagcgaattgaagaggtcatagtcacacaggcatctgtccagcgctgcagcgcagttgtggacttccttgacaaagatcggccgttcttccctccaacaatcaacaaccctgagcttcacgatttctttgtgaaggtgggtagcgaaatggttggccccaacaaggtgagagagaagcagccactgatgggtgcggaggacttctccttctacacggaggtcgttcccaagacatactactacttcgtggggatgctgaacgagactcgtggaccgcaggcgcctcatcactcaccctacttcaccatcaacgaggatacactgccctacggtgcggccatgcaagcatcgttggctgctcgctatctgcttgagcaccagctcgttaccgctgctaaggtggtggaaccacgggacgagctgtagatggtgtccatgttgaatgaaacggcggagggacgtgcacagcaactgttgattaaaaagagggaaaacaaaaaaaaaggtaaggccctgggccaaatgaagctgacttgttcgaggaggacctctgtatcgccgggtgattatgcaactgtctgtacatggtttcctgatttcagtgcattacaagcgagcagatgaccttgtgaaaacactgtgcgcatgtgattctgtggtaggtctcgtttgttttcgtatctgcacttagccgagtacgtgtaatctttgagtgcagtcgtggataatgcatgtacgtcgtgcaaacagaataaattgggaagcagacacacctctttgtcctgtttagagtggggaaagatatgaatttgtagcatggttccatct

SEQ ID NO: 4929 - DNA, 2244 bp, Secale cereale
gactaatcgagcgagctcagcctagcccacgcccctcgtgcgcgtttccgcctgattgatactatagtcgaaaggagtatgtactactgtacagtaaaatgtccaaaccgaaagccagaacgtcacgacggaattcatttactattgttggccatggccgctgggctgttgcgcgtcgccctcttcctcatcgccgccgccgcgacctgggcggcggcgctagacgacccggcggggcttctgcgacgggccaaggaggcggagttcatggactggatggtgggggtgcgccggcggatccacgagaaccctgagctcggctacgaggagtttgccaccagtgagctcgtgcggcgcgagctcgatgccatggggatcccctacaggcaccccttcgctgtcaccggcgtcgtcgccaccgtcggcacaggcggcccgcccttcgttgcccttcgggccgacatggacgctctccctatgcaggaaagcgtggaatgggaacataagagcaaagtgcctgggaagatgcatggatgtggccatgatgcacatgttgctatgctattgggttctgctagaattcttcaggagcaccgtgacgacttgaagggtactgtagcccttcttttccaaccagctgaggaaggtggtggtggagccaagaaaatggtagaagtcggagctctggaaaacatagaggtcatgtttggacttcatgtagctgacagtgtgcctattggtgtgctggcatccagacctgggcctataatggcagggagtggattttttgaggcagtaataagtggaaagggagggcatgctgcacttcctcatcacactattgatccgatactggctgcatccaatgttattgtaagtcttcagcaacttgtttcccgagaagctgaccccttggactcacaggtagtaacggttggaaagtttcaaggtggtggagccttcaatgtaatccctgattccgtgacaataggcggtaccttccgagcttttttgaaggagagttttaatcaattgaagcagcgaattgaagaggtcatagtcacacaggcatctgtccagcgctgcagcgcagttgtggacttccttgacaaagataagcctttcttccctccaacaatcaacaatcctgagcttcacgatttctttgcgaaggtgggcagtgagatggttggccccaacaacgtgagagagaagcagccactgatgggtgccgaggacttctccttctacacggaggccgttcccaagacatactactacttcgtggggatgctcaacgagactcgtggaccgcaggcgcctcatcactccccctacttcactatcaacgaggatgcactgccctacggtgcggccatgcaagcatcgttggctgctcgctatctgcttgagcaccagcacgttaccgctgctaaggtggaacctcgcgacgagctgtagatggtgttcgtgttgaatgaaacggtggaaggacaaggacatgcgcagcaattgttgattaaaaaggaaaaaaaggtaaggctctgggccaaatgaagctgacttgttcgacgaggacctctgtatcggcaggtgattatgcaactgtttgtacataatttcctgatttcagcgcattccaagcgagcagatgaccttgtgacagcattgtgttgacgctcaaaagtggcacaatcataaaaattgctttaatctatgtcaatacttcaaacttatgattggaagtcaccatgagatgtctttctttgagaagatcaagatggatatgaaagtggtctaaaacggagtccggatgcaaaagttatgacaagttcagagatgcttatgatgacaccagattaaagaatggctttaaacccaattaagatgacttccaaatggaaaaggtttctaacgactcgaaagttgtgcgtctacgtcgtaaacggtcgaattttgatataaaaatacgtcccaatccgagttcgtatgctaaagttacagccatccgaacacaaccctgtcacaagagccaataagtcggcgcgccaacaccagccacgtgtctgatgggtagcgcgaataacacgcccgtattgtagtagaccgttttcggtaccctaagaagatggcattaaatcgaaaacgttcaacatgaaagttgttcgtatcgtcgaaacggtcaagattgcttttgtgctcttttccatccgaggtcgtttaccacctcaagaattatcagtc

SEQ ID NO: 4930 - DNA, 1882 bp, Triticum aestivum
aaaaagcggaatcctcccaaaccgaagctcaaggttcacttgagcctagcccactcccctcgtgcgcgtttcgcctgattgatactgtagtatagtacaagtgtccaacccgaaagcgagaacgtcacgacggaattcatttactattgtttggccatggacgctgggctgttgcgcgttgccctcgtcctcatcgccgctgccgcgacctgggcggcggccctagacgacccggcggggcttctgcgacgggccaaggaggcggagttcatggactggatggtgggggtgcgccggcggatccacgagaaccctgagctcggctacgaggagtttgccaccagtgagctcgtgcggcgcgagctcgatgccatggagatcccctacaggcaccccttcgcggtcaccggcgtcgtcgccaccgtcggcacaggcggcccgcccttcgtcgcgcttcgggccgacatggacgcgctccctatgcaggaaagcgtggaatgggaacataagagcaaagtgcctgggaagatgcatggatgtggccatgatgcacatgttgctatgctattgggttctgctaagattcttcaggagcaccgtgacaagttgaagggtactgtagcccttcttttccagccagctgaggaaggtggtggtggagccaagaaaatggtagaagccggagctgtggtaaacatagagatcatgtttggacttcatgtagctgacagtgtgccgattggtgtgctggcatccagacctgggcctataatggcagggagtggattctttgaggcagtaataagtggaaagggagggcatgctgcacttcctcatcacactattgatccgatactggctgcatccaatgttattgtaagccttcagcaacttgtttcccgagaagctgaccccttggactcacaggtagtaacggttggaaagtttcaaggtggtggagccttcaatgttatccctgattccgtgacaataggtggtaccttccgagcctttttgaaggagagttttaatcaattgaagcagcgaattgaagaggtcatagtcacacaggcatctgtccagcgctgcagtgcagttgtggacttccttgacaaagataagcctttcttccctccaacaatcaacaatcccgagcttcacgatttctttgcgaaggtgggcagtgagatggttggccccaacaacgtgagagagaagcagccactgatgggtgccgaggacttctccttctacaccgaggccgttcccaagacatactactacttcgtggggatgctcaacgagactcgtggaccgcaggcgcctcatcactccccctacttcaccatcaacgaggatgcactgccctatggtgcagccatgcaagcatcattggctgctcgctatctgcttgagcaccagcccgctaccgctgctaaggtggaacctcgtgacgagctgtagatggggggaggtaaggctctgtgccaaatgaagctgacttgttggacgaggacctatcgccaggtgattatgcaactgtttgtacataatttcctgatttcagcgcattccaagcgagcagatgaccttgtgacggcattgaagcactgcgaatatgtgtttctgtggtaggtctcgttcgttttcgcatctgcacttagccgggtctacgtgtaatctttgagtgcagtgctgagacaaaataaaacacctcatggatgatggatgtattgggttgttaagagtggggtcagacaggaattttatagcatgattccatcttttagtagcaagaaatggtcgaaatatattccagcaaaaagaaaagaaacggttgaaacaatggtttgagcaccaaaaagaaaagtaaccgactgcg

SEQ ID NO: 4931 - DNA, 1780 bp, Triticum aestivum
ctgattgatactgtggtacagtacaagtgtccaaaccgaaagcgagaacgtcacggcggaattcatttactgctattgttggccatggccgcctatgctgggctgttgcgcgtcgccctcgtcctcatcgccgccgccgcgacctgggcggcggccctagacgacccggcggggcttctgcgacgggccaaggaggcggagttcatggactggatggtgggggtgcgccggcggatccacgagaaccctgagctcggctacgaggagtttgccaccagtgagctcgtgcggcgcgagctcgatgccatggagatcccctacaggcaccccttcgcggtcaccggcgtcgtcgccaccgtcggcacaggcggcccgcccttcgtcgcgcttcgggccgacatggacgcgctccctatgcaggaaagcgtggaatgggaacataagagcaaagtgcctgggaagatgcatggatgtggccatgatgcacatgttgctatgctattgggttctgctaagattcttcaggagcaccgtgacaagttgaagggtactgtagcccttcttttccagccagctgaggaaggtggtggtggagccaagaaaatggtagaagccggagctgtggtaaacatagagatcatgtttggacttcatgtagctgacagtgtgccgattggtgtgctggcatccagacctgggcctataatggcagggagtggattctttgaggcagtaataagtggaaagggagggcatgctgcacttcctcatcacactattgatccgatactggctgcatccaatgttattgtaagccttcagcaacttgtttcccgagaagctgaccccttggactcacaggtagtaacggttggaaagtttcaaggtggtggagccttcaatgttatccctgattccgtgacaataggtggtaccttccgagcctttttgaaggagagttttaatcaattgaagcagcgaattgaagaggtcatagtcacacaggcatctgtccagcgctgcagcgcagttgtggacttccttgacaaagataagcctttcttccctccaacaatcaacaatcctgagcttcacgatttctttgcgaaggtgtgcagtgagatggttggccccaacaacgtgagagagaagcagccactgatgggtgccgaggacttctccttctacaccgaggccgttcccaagacatactactactttgtggggatgctcaacgagactcgtggaccgcaggcgcctcatcactccccctacttcaccatcaacgaggatgcactgccctacggtgcagccatgcaagcatcgttggctgctcgctatctgcttgagcaccagcccgctaccgctgctaaggtggaacctcgcgacgagctgtagatggtgtccatgttgaatgaaacggtggaaggacaaggacgtgcacagcaattgttggttaaaaagggacgaggacctctgtatcgccaggtgattatgcaactgtttgtacataatttcctgatttcagcgcattccaagcgagcagatgaccttgtgacggcattgaagcactgcgaacatgtgtttctgtggtaggtctcgttcgttttcgcatctgcacttatccgggtctatgtgtaatctttaagtgcagtggtgagacaaaataaaacaccccgtggatgatgaatgtattgggttgttaagagttgggacagacaggaattttatagcatgattccatcctttagtagcaagaaatggtcgaaaatatattcca

SEQ ID NO: 4932 - DNA, 2099 bp, Triticum aestivum
cacccacctctgcaaccaacccactccactgctgccaaatcaacgtgccaaaccgagccaaagcgtctcgaaacaaaagactactcaaagagggcagagaaacaaggaggaagtaaaaagcggaatcctcccaaaccgagctcaaggtcacagagacgcttgttcacttcagcttagcccacgccactcgtgcgcgtttcgcctgattgatactgtggtacagtacaagtgtccaaaccgaaagcgagaacgtcacggcggaattcatttactgctattgttggccatggccgcctatgctgggctgttgcgcgtcgccctcgtcctcatcgccgccgccgcgacctgggcggcggcgctagacgacccggcggggcttctgcgacgggccaaggaggcggagttcatggactggatggtgggggtgcgccggcggatccacgagaaccctgagctcggctacgaggagtttgacaccagtgagctcgtgcggcgcgagctcgatgccatggggatcccctacaggcatcccttcgcggtcaccggcgtcgtcgccaccgtcggcacaggcggcccgcccttcgtcgcgcttcgggccgacatggacgcgctccctatgcaggaaagcgtggaatgggaacataagagcaaagtgcctgggaagatgcatggatgtggccatgatgcacatgttgctatgctattgggttctgctaagattcttcaggagcaccgtgacgagttgaagggtactgtagcccttcttttccaaccagctgaggaaggtggtggtggagccaagaaaatggtagaagccggagctgtggaaaacatagaggtcatgtttggacttcatgtagctgacagtgtgccgattggtgtgctggcatccagacctgggcctataatggcagggagtggattctttgaggcagtaataagtggaaagggagggcatgctgcacttcctcatcacactattgatccaatactggctgcatccaatgttattgtaagccttcagcaacttgtttcccgagaagctgaccccttggactcacaggtagtaacggttggaaagtttcaaggtggtggagccttcaatgttatccctgattcagtgacaataggtggtaccttccgagcctttatgaaggagagttttaatcaattgaagcagcgaattgaagaggtcatagtcacacaggcatctgtccagcgctgcagcgcagttgtggacttccttgacaaagataagcctttcttccctccaacaatcaacaatcctgagcttcacgatttctttgcgaaggtgtgcagtgagatggttggccccaacaacgtgagagagaagcagccactgatgggtgccgaggacttctccttctacaccgaggccgttcccaagacatactactactttgtggggatgctcaacgagactcgtggaccgcaggcgcctcatcactccccctacttcaccatcaacgaggatgcactgccctacggtgcagccatgcaagcatcgttggctgctcgctatctgcttgagcaccagcccgctaccgctgctaaggtggaacctcgcgacgagctgtagatggtgtccatgttgaatgaaacggtggaaggacaaggacgtgcacagcaattgttggttaaaaagggacgaggacctctgtatcgccaggtgattatgcaactgtttgtacataatttcctgatttcagcgcattccaagcgagcagatgaccttgtgacggcattgaagcactgcgaacatgtgtttctgtggtaggtctcgttcgttttcgcatctgcacttatccgggtctatgtgtaatctttaagtgcagtggtgagacaaaataaaacaccccgtggatgatgaatgtattgggttgttaagagttgggacagacaggaattttatagcatgattccatcctttagtagcaagaaatggtcgaaaatatattccagcaaaaagaaaagaacggttagaaacgtagggtttgaggagacaataaaaagaaaagtacgactgcgtggccgctcgtactgaagtacgttgaccgaaggcacgacgaggggatagg

SEQ ID NO: 4933 - DNA, 2828 bp, Zea mays
gtggcctcagcgattttgctgccccccatctcctttttttagcacatcgcttgcgttctctctctggtttcctcctctgctctgcgctccgcttcccaccgctcctcccctgccgtctctcctaccacaaagccgtggcccgtgggcgctgttcgcggcggcgacgggtctctcatctcctctaccctctctcgcgcgcaacggcctaaaaaaaccctagcgactcggtcggcgctcgacttggatcgtgccggggggctaggggcaggggcagctctcttctctcgtcgtcgtccaggacattgttgataacttgatactggattttcttccttctcgaacctgtagagggctctgctttatttgattagaccttatatggtttgagtgccacaactgaaactttgcacctaaaacccgaggccaagttcactactttattatatccttccatacacagaaagtggagagacatggatcgtgatgatatagctggtttcgtcagtggaggttgctatgagtcctgaatttctaacccagtatatataacagagttatgatatccagaaggcagacaattgtttcttttcgttttctagttggtttgcatttgatgtttcataattggaatggatacaactactcaaggccttgagtttggtggtggtatcaactctccgaagccatattgctattggagcacaactcaagacactactgtgcacaaagatagtacaccagaggcatattccaccttttctatttccaactcaaaagcgtcaaaaaggaagcaaggtgccatgtctggagcaaaaggtggaaaccctttactcactttgggtctaggctgctcaccaagttcatcttataacagcaagctaagttctggcactgcttgcataacatcatcatctttattaaaggagattgatgaagagtcttcaatagatcttggccttaaccttgggttgtatattggaaatgatattggacactgccaacagaaatcccatgctggttttgaaaatgtgctctcgacaaactctcctaaactggatcttcagttgagtttgtctaccagttcgcctgaatcagttgtcattgatgcaaataggtcaccagatggcttggcgatgccgatggccaattcaccactcgccattgtagaagaaggatcagtaccacatagttgggttttcgagcattcaattgtttcatcatcacatgcttctaaggcaacgcatggctttccattatcaaagaaaaccaatggaggcaatgcctctgtgccttctcatgtcatgtcatcaactatgtttacaagtgtgaaaggtccagttgcctctgcttctgagacaactaactcccaacaacgcaacagtaacgctaaaagctgtcagtttccaggatgtgtgaaaggagcaagaggggcatcagggcgttgcatagcacatggcggcggtaggcgttgccagaaacctggttgtgagaagggcgctgaagggaggacaatctattgcaaggcccatggtggaggcaggagatgtcaatttctcgggtgtacaaagagtgctgaagggcgcacagaccactgcatagctcatggtggtggccgccgctgcagccatgaaggttgctcccgagctgctcgtggaaaatctggcctgtgtatcaagcatggtggtggcaaaaggtgtcagaaggagaactgtaccaaaagtgcagaaggccattctggactctgcattgcccatggtggtggaaggcggtgccagtttccagactgcacaaagggtgctcagggaagcacaaagttctgcaaggcacatggtggaggaaagcgctgcacattcgtcggatgcaccagaggggctgaaggcagcacttcattttgtaagggccatggtggaggcaagcgctgtgcctttcagggcggtggcgtgtgcccaaagagcgtgcatggtggcactcagtattgtgttgcacatggtggtgggaaaaggtgtgctagctttggttgcactaagagtgctagagggcgcacagagtattgtgtgcgccatggaggtggcaagaggtgcaagttcgagagctgcaccaagagtgcgcaggggagcactgatttctgtaaggctcatgggggaggtacacgatgcctgtggggccaggcggacacaagctttggtgctggtgcacagcaatgcgataaatttgttcggagcaagaccggtctctgctcagctcatagtgctttgatccaggaccactgtgttcatggcggtggtacattaggttccgctatctaccagtctgtgcatgtcaaaccgactgagatgatcaatggtgataaaactttactggatccggctatccctgttacaaacagtggtgttcatcctcctgtcctagctcagtctatgatcgatccgctgccagagggcagagttcatggtggtggcctgttggctttactttcgcggggcggaagcagaacaagcgctggtggctcagaattgtgcttcgggcaagatcgtgtggatctgaggctatcaggatctccatgaaactgatgactgcctgcagttttgatccaaattgtgttgctcatgctcgggttccataggatctacccggacgtgtactgtgaatctacccagacgtgtactatgaaaataagagggtagctcctagagcagatgtgttgttttattttagttaattgtttcagtgcatgtaatcacttactttaatgctcatgtttggacttgattaactctcagcaacttaaggttgaaatataatgtgcattttgctgcttattctgctga

SEQ ID NO: 4934 - DNA, 1565 bp, Zea mays
cttccgaatcagcaatccgtgccacctgtttccgcattccgccattccgccttctgctgctggggttttagacaaaaatcactcgtcccatttctcgcgtccccaggccacggtcgcgagcaaggctaccccactgtctcgatccaccgatttccctccctcttctgtgcctccacggatcttctcgttgtggaagcggaggcggacgctggaggcgtctcggcgcgaggatttgcgagctgctgcggtggtgggaaatgaggatctgcgaatcgggagacggtgacgacgttgcgggcctggtgtttcagcaagagcagcaggaggaggtccaggcgagcggcgagctcgtacggcttaaggcgaagcacgcgctcgtcggcgccggcgcgagggtgctgttctacccgacgctgctctacaacgtcttgcgcaaccggttcgaggcggacttccggtggtgggatcgcgtcgaccagtttattttgctgggcgctgttcctttcccaagtgatgttccacggttgaagcagcttggagttcaaggggttgtaacgttgaatgaaccttatgaaactcttgtcccaacatctttataccaggctaatgagattgagcacctggtaattccaacaagagattacctctttgcaccttcattcgaggatatttctcaagccatagatttcatccatcggaatgcatcacaaggcggtactacatatgttcattgtaaagctggaagaggacgaagcaccactattgtattgtgctacttgattaaatacaggaacatgacccctgaagcagctttggatcatgtacgatccattaggcctcgagtgcttttggcaccctcgcagtggcatgctgttaattcatttggagctctcaccggtggacaacttccagtacggagtacaaacctggcctgtttcctagaagccattgaagctggctgtacgaacacaacaggaaatgatgattaccacgtgatggagtttgactgcgaagatagtggcttaccactttatcaaattatgctacctaggccagccagccccactgggtctgggtgcaccgatgcagtcctcgtaacagaagcagatcttgagggctatgatacttatattggtaccaggaaagatgcggtgtcgttggaagtagccactcgcagtcccatcatgaggagattgtcctgcctctttggctccctcaaacttagtaacagcaactgtgagccagcttcaagccggttcactgaggttcgcgcctgctaggtaggtagtgtcttcctccagttttccatgctgcatcaagagtgtatctctagataggcaggcaatcatccaaaaaggatttgtagaagcctgtgttcatttcatggccatggggcagtgccatcgggaagaaagttgtgtgcatagccagaggggttgtttagttttcattagagtgtagagctgtgaacgcgtcgaatatccttgttttttcttgagagcatgtgattcattgcaatttgcatcattgtttacttgaaataaaataagttttctttccatcca

SEQ ID NO: 4935 - DNA, 1644 bp, Setaria italica
cttccgattcagcatttctgtgccacctgtttccgccttccgctgctggggttttagacaaaatcactcttcccatttctcgcgtccccagaccacgagaccacgaccacgagcaaggctacccactccctccccccctcgatccgctgatttgtttcacccatcttcctgcctccacggatctgctcgtcctggaaggggaggaggacgctggaggcgtcttggcggcgaggatttgcgagctgttgtggtagtgggacatgaggatttgcgaattgggagacggtgatggggggctggcgggtcagcaggagcagcaggaggaggaggttggggcgagcggtggcggagaggtcgtaaggctgaaggcgaagcgcgcgctagtcggtgccggcgcgagggtgctgttctacccgacgctgctctacaacgtcctgcgcaaccgcttcgaggcggatttccggtggtgggatcgcgtcgaccagtttattttacttggcgctgttccatttccaagtgatgttccgcgtttgaagcaacttggagttcgaggagttgtgactttgaatgaaccttacgagactcttgttccgacatctttataccaggcccatgagattgagcacctgatgattccaacaagagattatctgtttgcaccttcggtcgaggatatttctcaagccatagatttcatccaccggaacgcatcacaaggtggtactacctatgttcactgtaaagctggaagaggacgtagcaccactattgtattgtgctacttgattaaatacagaagcatgacccctgaagcagctttggatcatgtccgatccattaggcctagagtacttttggcaccatcacagtggcaggttgttagcacatttgggactctcgtcactggacaacttccagtacgaagtacaaaactaggcagtttcctagaagccattgatgcttgccgcacagacacagaatatgatgattaccatgcgatggagtttgattacgaagatagcggcttgccactttctcaaattatgctacctaggccaaccagccccactggctgtatcgatgctgtccttataacagaggcagaccttgagggctatgatacttatgttaataccaggaaggatgccctggaagtagccactcgcaggcccatcatgaggagattgtcctgcctctttggttccctgaaacttaatagcagcaactgtgaaccagctcaaagctgcttcagtgaggttcgtgcctgctaggttgcttctttttcccagttttccattttgtgaatgaagagtgtatctctagataggcgttcagccaaataggattgtagaagctgcggagtttcttctatagccatggcaatgccgccaccgggaagaaagttgtgtgcacatccatagaggttctagtccttgagtgtagagttgtgaatgtgtcgattatccatgtttttcctcgaaaacatgtgattcatttgcatcattgtttccttggaataaaaaggctattccagccaacgggggtgcagtgaccccccaattcgattgattcttgacaaatttgtaccatctgtgacctgtgaattcattctgtgtacaagaaattgatttccttttgtgttag

SEQ ID NO: 4936 - DNA, 1165 bp, Saccharum officinarum
ttccgcattctgctgctgtggggttttagacaaaaatcactcgtcccatttctcgcgtccccaggccacggtcgcgagcaaggctaccacccactgtctcgatcccagcgattcccctcctcttccgttcctccacggatctgctcgctgcggaagcggaggaggacgctggaggcgtctcggcagcgcgaggattcgcgagctgctgtggtggtggtgggaaatgaggatctgcgaattgggagacggtgacgcgggcctggcgtggcagcaggagcagcaggaggaggaggttcaggcgagcggtggcggcgagctcgtacggcttaaggcgaagcgcgcgctcgtcggcgccggcgcgagggtgctgttctacccgacgctgctctacaacgttcttcgcaaccggttcgaggcggacttccggtggtgggatcgcgtcgaccagtttattttgcttggcgctgttccttttccaagtgatgttccacgattgaagcagcttggagttcaaggggttgtaacgttgaatgaaccttatgaaactcttgtcccaacatctttataccaggccaatgagattgagcacctggtaattccaacaagagattacctctttgcaccttcactcgaggatatttctcaagccatagatttcatccaccggaatgcatcacaaggcggtactacgtatgttcattggtaaagctggaagaggacgaaacaccactattggattgtgctacttgattaaataccaggaacatgacccctgaagcagctttggatcatgtccgatccattaggcctagagtgcttttggcaccatcgcagtggcatgctgttagctcatttggaactctcaccactggacaacttcccgtacggagtacaaacctgggctgtttcctagaagccattgaagctcgccgtacgaacacagaaaatgatgattaccacgtgatggagtttgactgcgaagatagtggcttaccactttctcaaattatgctatctaagccagccagccccaccgggtgcaccgatgcagtcctcataactgaagcagatcttgagggctatgatacttatattggtactaggaaagatgccgtgtcgttgatagttgccactcgcaagcccatcatgaggagatggtcctgcc

SEQ ID NO: 4937 - DNA, 1225 bp, Pennisetum glaucum
tagagtgaggaggaggaggttgaggcgagcggtggcggagaggtcgtacggctgaaggcgaagcgcgcgcttgtcggtgccggcgcgagggtgctgttctacccgacgctgctctacaacgtcctgcgcaaccgcttcgaggcggatttccggtggtgggatcgcgtcgaccagtttattttacttggtgctgttccgtttccaagtgacgttccacgtttgaagcaacttggagttcaaggagttgtaactttgaatgaaccttatgagactcttgtcccgacatctttataccaggcccatgagattgagcacctggtaattccaacaagagattatctatttgcaccatcggttgaggatatttctcaagccatagatttcatccaccggaactcatcacaaggtggtactacctatgttcactgtaaagctggaagaggacgtagcaccactattgtattgtgctacttgattaaatacagaagcatgacccctgaagcagctttggatcatatccggtccattaggcctagagtacttttggcaccatcgcagtggcaggttgtttgcacatttgggactctcggcactgggcaacttccagtacgaagtacaaaactgggcagttacctagaagccctcgaagcttgtcgcgcaaacacagaaaatgatgattgttattcgatggagtttgattttgaagatagcggtttaccactttctcaaatcatgttacctaggccagtgagccccactgggtgcatcgatgcagtctttataacagaagcagatcttgagggctatgatgagtatgttgataccaggaaggatgccttggaagaagccactcgcaggcccatcatgaagagattgtcctgcctctttggttccctgaaacttattaacaacaactgtgagccagctccaagccgcttcactgaggttcacgcttgttaggtagcgtctttttcccagtttcccttgtggatgaagagtgtatctctagataggcgttcaaccaaataggattgtagaagctggctgcagagtttctatagccatggcaatgtcgccaccgggaagaaagttgtgttcatacccatatagagagatctagtccttgagtgtacagttgtgaatgcgtcgattgtccttgttttttccccaaaaacatgtgattcatttgcatcattgtttctttgaataaaaaggctattccagc

SEQ ID NO: 4938 - DNA, 1092 bp, Zea mays
agagactacttcctagctcaaacgtctggtccaccagctcgtcacacgctccgatctcctcccacacctctccacctccgacgacgaccaccaccatggcggccgcttccctcgcgcgcctctcccgccgcgccaccacttccacctccgtggcggcgcccgccttccggcgcctcctctccgccacctccaccgcccccgccgcggcatccgccccgccgccgccccccagcgcggccgccgccgcggccgtgggcgcggatcgagtgcggtgggactaccggggccagcggcagctcgtccctctgggacagtggatgcccaaggtggccgttgacgcgtacgttgctcccgaggccgtgctcgccggccaggtcaccgtgcacgacggcgcctccgtctggagcggcgccgtcctgcggggggacctcaacaagatcacgctcggcttctgcgccaacgtccaggagcgatgcgtcctccatgccgcatgggcggcgcccacagggcttccagctgagacccttgtggaccggtacgtgacagtgggtgcctactgcctgctgcgctcttgcaccatcgagcccgagtgcatcattggccagcactctatcctcatggaaggttcgctggttgagaccaactcaatcctggaggctggctctgtattgcccccaggaaggcgaattccgactggtgaactctgggctggaagcccggctaggtttgttcggaagctgaccaacgaggagatcatggacattccaaagcttgcaactgccatcaacgatctgatgcaaagccatttctcggagttcctgccttactctaacgcttatttggaggtagagaagttgaagaagtcgttctcgatccccctgtaagagcatgttgccccgctcgtccagttgaatgaatgaggaaataaaggttccccaatgctagatgttttgtattgaatcgaacttctacttctgttacgtctttttggggggttctttgttgttttgagcatggggacacgtgcaggaatcatgtcttgatatctttttacgcaacccaattctgtgttgattactttcagttctacta

SEQ ID NO: 4939 - DNA, 1134 bp, Setaria italica
ataaagcccagcccaaacatccggtccaacagctcgtcgtaaacgtccccacgaacccatcacaccctccgcccactcccctcacgcgcacggccacacctctccacctccgacgacgaccaccaccatggcggccgcctctctctcgcgcctctcccgccgcgccacctcctccgccgttgccgcggcgccctccctccgccgcctcctctcggccacctccaccgcccccgccgcgcagtccgccccgccgccgcccccgagcgcggctgcggccgcggcggcgggcgcggatcgggtccggtgggactaccgcgggcagcggcagctggtgccgctggggcagtggatgcccaaggtggccgtcgacgcgtacgtcgcccccgaggccgtgcttgccggccaggtcaccgtccacgacggcgcctccgtctggagcggcgcggtgctgcggggggacctcaacaagatcacgctcggcttctgcgccaacgtccaggagagatgcgtcctccacgccgcctgggcggctcccacaggacttccagctgagactcttgttgaccggtatgtgacagtgggcgcctactctctgctgcgatcatgcaccatcgagcctgagtgcatcattggtcagcactccatccttatggaaggttcgctggttgaaaccaactcgatccttgaggcaggctctgtcctgccccctggaaggcggattcctaccggtgaactctgggctggaagcccagccaggtttgtccggaagctgacaaatgaggagatcatggagattccaaagctcgcgacggccatcaacgatctgatgcaaagccatttctcggagttcctcccttactctaccgcttatttagaggtagagaagttgaagaagtcgttctcaattcccctgtaagagcatgtttcccccctcgtccagctgaatgaatgaggaaataaaggtacccaaatactagatgttctgtgttgattctaacttgtactctgggttaatatgttgcatcgcgaaatttttgtccattgttgttgtgagcctgggggccactcttgcaggaaccatgtctttgtatctgtttacccaatgcaatgcaatgcactgttctctattgtgca

SEQ ID NO: 4940 - DNA, 1050 bp, Pennisetum glaucum
ctccaccacttccgacgaccaccaccatggcggccgcctccctctcgcgcctctcccgccgcgcctcctcctccgccgtcgccgcggcgccctccctccggcgcctcctctcggccacctccaccgcccccgccgcgccgtccgccccgccgccgccctccagcgctgccgcggccgccgcggcgggcccggatcgggtgcggtgggactaccgcgggcagcggcagtttgtgccgctgggacagtggttgcctaaggtggctgtcgacgcgtacgtcgcccccgaggccgtgctcgccggccaggtcaccgtccacgatggcgcctccgtttggagcggcgcggtgctgcggggggacctcaacaagatcacgctcggcttctgcgccaacgtccaggagagatgcgtcctccacgccgcatgggcggctcccacaggacttccagctgagactcttgtcgaccggtatgtgacagtgggcgcctactctctgctgcgatcatgcaccatcgagcccgagtgcatcattggtcagcactcaatccttatggaaggttcactggttgaaacaaactcaatccttgaggctggctctgtcctgccccctggaaggcggattccgaccggtgaactctgggctggtagcccagccaggtttgtccggaagctgaccaacgaggagatcatggagattccaaagctcgcaacggccatcaacgatctgatgcaaagccatttctcggagttcctcccttactctaatgcttatttggaggtagagaagttgaagaagtcgttctcgattcctctgtaagagcatatgtttaccccttcgtccagctgaatgaatgaggaaataaagttgcccaaatactagatgttttgtattgagtctaacttgtactctgggttaatctcttgcatcgcaaaatttttgtccattgttgttgtgagcctggggccacgcttgcaggaaccatgtcgttttatctgtttacccaatccaatgcaatgcactgttcttggtaaaaaaaaaaaaaaagaaaaaa

SEQ ID NO: 4941 - DNA, 1020 bp, Setaria italica
ctctccacctccgacgacgaccaccaccatggcggccgcctctctctcgcgcctctcccgccgcgccacctcctccgccgttgccgcggcgccctccctccgccgcctcctctcggccacctccaccgcccccgccgcgcagtccgccccgccgccgcccccgagcgcggctgcggccgcggcggcgggcgcggatcgggtccggtgggactaccgcgggcagcggcagctggtgccgctggggcagtggatgcccaaggtggccgtcgacgcgtacgtcgcccccgaggccgtgcttgccggccaggtcaccgtccacgacggcgcctccgtctggagcggcgcggtgctgcggggggacctcaacaagatcacgctcggcttctgcgccaacgtccaggagagatgcgtcctccacgccgcctgggcggctcccacaggtcacattcctcatcttgttgaccggtatgtgacagtgggcgcctactctctgctgcgatcatgcaccatcgagcctgagtgcatcattggtcagcactccatccttatggaaggttcgctggttgaaaccaactcgatccttgaggcaggctctgtcctgccccctggaaggcggattcctaccggtgaactctgggctggaagcccagccaggtttgtccggaagctgacaaatgaggagatcatggagattccaaagctcgcgacggccatcaacgatctgatgcaaagccatttctcggagttcctcccttactctaccgcttatttagaggtagagaagttgaagaagtcgttctcaattcccctgtaagagcatgtttcccccctcgtccagctgaatgaatgaggaaataaaggtacccaaatactagatgttctgtgttgattctaacttgtactctgggttaatatgttgcatcgcgaaatttttgtccattgttgttgtgagcctgggggccactcttgcaggaaccatgtctttgtatctgtttacccaatgcaatgcaatgcactgtt

SEQ ID NO: 4942 - DNA, 1198 bp, Zea mays
tttgaacgtaacaggctaacagcccagcccaaacatccggcccaccagatggtcgtgagtgtccgcacgaacccatcacacgctccgcccactcccccaggcgcacggccgcacctctccacctccggcgactaccaccaccatggcggccacctccctcgcgcgcctctcccgacgcaccaccatttccgctaccgccgcggcgccctccctccggcgcctcctctcagtcacctccacagcctctgtcgcggcaaccgccccgccgccgccgccgcccagcgcgactggcgccgcggccgtgggcgcggatcgggtgcggtgggactatcgtgggcagaggaagcttgttccgctgggacaatggatgcccaaggtggccgtggacgcttacgtcgcccccgaggccgtgctcgccggccaggtcaccgtccacgacggcgcctccgtctggagcggcgcagtcctgcggggggacctcaacaagatcacgctcggcttctgcgccaacgtacaggagcgatgcgtcctccatgccgcatggacggctcccacagggcttccagctgagacactcgtggaccggtacgtgacagtgggcgcctactgtctgttgcgctcttgcaccatcgagcctgagtgcatcattggccagcactctgtcctcatggaaggttcgctggtggagaccaactcgatcctcgaagctggctctgtattgcccccaggaaggcggattccgaccggcgagctctgggctggaagcccggccaggttcgttcggaagctgaccaatgaggagatcatggagattccgaagctggcaactgccatcaacgatctgatgcagagccatttctcggagttcctgccttactctaacgcttatctggaggtagagaagctgaagaagtcgttctccatccccctgtaacagcctgttgccctcactcgtccagttgaatggacgaggaagtaaataaaggtgcccaaatactagatgttttgcgttgaaatctaacttgtgctgggtttgatctgttacgtcccaaatttttttgttcattgttgttgtgagcatggggacacgtgcaggaatgtcttgtgtctttttacccaacccaatggacattatgttctgcaaatttcacctgtactgtgttctgtgaatggtgccattgcttaccgtcgtgcagta

SEQ ID NO: 4943 - DNA, 987 bp, Panicum virgatum
ccctctcccgcctctcccaccgcgccacctcctccgccgtcgctgcggcgccctccctccggcgcctcttctcggcaacctccaccgcccccgcagcgcagtccgccccgccgccgccgccgagcgcggcctcggcagctgaggcgggcgcggatcgggtgcggtgggactaccgcgggcagaggcagctggtgccgctgggccagtggatgcccaaggtggccgtggacgcctacgtcgcccccgaggccgtgctcgccggccaggtcaccgtccacgacggcgcctccgtctggagcggctcggtgctgcggggggacctcaacaagatcacactcggcttctgcgctaacgtccaggagcgatgcgtcctccacgccgcatgggcggcacctacaggacttccagctgagactcttgttgatcggtatgtgacagtgggcgcctactctctgctgcgctcatgcaccattgaacctgagtgcataattggtcagcactccatccttatggaaggttcactggtcgaaacaaactcgatccttgaggctggctctgtccttccccctggaaggcggattccaacaggtgaactctgggctggaagcccggccaggtttgtccgaaagctaaccaatgaggagatcatggagattccaaagcttgcgacggctatcaacgatctgatgcaaagccatttctcagagttcctcccttactctactgcttatttggaggtagagaagttgaagaagtcgttctcgattcccctgtaacagcatgttccccactcgtccagctgaactgaatgaggaaataaaggtgcccaaatactagatgttttgtattgagtctaacttgtactctgggttgatctgttgcatcgcaaaaattttgtccattgttgttgtgagcctggggccacgcttgcaggaaccatatcgctctatctatttacctaatgcaatgcaatgcactgttctcgat

SEQ ID NO: 4944 - DNA, 1087 bp, Oryza sativa
tccagacacaatcccacaatatactgtacatgttttctcaatggcacaaggtatgtttcccagccggaaaataccggtagtgagaagcgaaagcaatgcattcagacatggtccttaacgcctgtccccaagttgacaacaacaatgaacgaaaaattcacaacgtaacacatccacccaagttacaagttagattcaatacaaaacatctaggtactttgggctgctttattttctcgttcatttggcggagaaggtgacaaaaaaaaagagctcttacagaggaattgaaaacgatttcttcaacttctccacctccaaataagcagtggagtacggaaggaactccgaaaaatggctttgcatcaaatcgttgattgccaccgcgagctttgggatttccatgatctcttcattggttagcttccgaacaaacctagctggattaccagcccagagctcaccagttggaatcctccttccagggggcaggacagagccagcttcaaggattgagttggtttcaaccaatgaaccttccatgaggatggaatgctgaccgatgatgcactcaggttcaatagtgcatgagcgcaacagacagtatgcacccactgtcacataccggtcaacaagggtgtcagctggtaagacctgtgggcgccgaccaggcggcgtggaggacgcatcgctcctggacgttggcgcagaagccgagggtgatcttgttgaggtcgccgcgcagcacggcgccgctccacacggaggcgccgtcgtagacggtgacctgcccggccagcacggcctcgggggcgacgtaggcgtcgacggccaccttgggcatccactgcccgagcggcaccagctggcgctgcccgcggtagtcccaccgcacccgatccgcgcccgccgcggcggccgcggcggcggaggggggcggcggtgggggcgacgccgcggcgggggaaggggccgatgcggtggcggagaggaggcggcggagggagggcgccgcggcccggtgggagaggcgcgagagcgaggcggcggccatggcggtggtcggggaggtgtgcgggggttgggg

SEQ ID NO: 4945 - DNA, 1280 bp, Oryza sativa
ccaaagcccagcccagacactcgtcttctttcttcttcttctcggggcagcacgaacccatcacaccgtgcgcccactacccccaacccccgcacacctccccgaccaccgccatggccgccgcctcgctctcgcgcctctcccaccgggccgcggcgccctccctccgccgcctcctctccgccaccgcatcggccccttcccccgccgcggcgtcgcccccaccgccgcccccctccgccgccgcggccgccgcggcgggcgcggatcgggtgcggtgggactaccgcgggcagcgccagctggtgccgctcgggcagtggatgcccaaggtggccgtcgacgcctacgtcgcccccgaggccgtgctggccgggcaggtcaccgtctacgacggcgcctccgtgtggagcggcgccgtgctgcgcggcgacctcaacaagatcaccctcggcttctgcgccaacgtccaggagcgatgcgtcctccacgccgcctggtcggcgcccacaggactaccagctgacacccttgttgaccggtatgtgacagtgggtgcatactgtctgttgcgctcatgcactattgaacctgagtgcatcatcggtcagcattccatcctcatggaaggttcattggttgaaaccaactcaatccttgaagctggctctgtcctgccccctggaaggaggattccaactggtgagctctgggctggtaatccagctaggtttgttcggaagctaaccaatgaagagatcatggaaatcccaaagctcgcggtggcaatcaacgatttgatgcaaagccatttttcggagttccttccgtactccactgcttatttggaggtggagaagttgaagaaatcgttttcaattcctctgtaagagctctttttttttgtcaccttctccgccaaatgaacgagaaaataaagcagcccaaagtacctagatgttttgtattgaatctaacttgtaacttgggtggatgtgttacgttgtgaatttttcgttcattgttgttgtcaacttggggacaggcgttaaggaccatgtctgaatgcattgctttcgcttctcactaccggtattttccggctgggaaacataccttgtgccattgagaaaacatgtacagtatattgtgggattgtgtctggatgtcatggatgtgtcggtaacgtgcggcttggaaaatagcttgagcctcccctttcacaatcctgctggttcatttaggctctttatcctcttgttgttttaacaagcatgcag

SEQ ID NO: 4946 - DNA, 1133 bp, Triticum aestivum
gcaaaagcccgttggcacacaaagccgagcccaggcgcgcttgtctgagagagcgacgaagaccgcctgctcgcccgacccacgcacctcccggaccaccacgccaccatggccgccgcctccctgtctcgcctctctcgccgcgcctccgccgccgcggcgccttccctccgccggatcctctcctccaccgccaccgcccccgctgcgccatcgtcctcaccaccccccgtcgcagccgcggcggcaggtgcggatcgggtgcggtgggattaccgcgggcagcggcagctagtaccactcgggcagtggcttcccaaggtggccgtcgacgcgtacgttgctcccgacgccgtgctcgccgggcaggtcaccgtccacgacggcgcctccgtctggagcggctccgtgctgcggggcgacctcaacaagatcactcttgggttctgcgccaacgtccaggagcggtccgtcctccacgccgcctggtcggcctctacaggtcttccagctgagacccttgttgaccggtatgtgacagtgggtgcgtactgtcttctgcgctcatgcactattgaacctgagtgcatcatcggtcagcattccatcctaatggaaggctcattggttgaaactaactcagtccttgaagctggctccgtcctggccccagggaggaggattccgactggcgaactctgggctggcaaccctgccaggtttgttaggaagctgaccaacgaagagataatggagattccaaagctcgctgtggccatcaatgatcttatgcaaagccatttctcagagttcctcccatactctaatgcttatttggaggtagagaagctgaagaagtcgttttcaattcctttgtaagatcatgttttccctctcccagcaaatgagtgaggaaataaagcagcccgaatactagaatctctgtattcaatctaatttgtagcctgggtccatctgttacgttgaattttttgttcatggttgtcaactggggacaccctgcacagcaggaattgtacctcgttgcacctttgttcggcagtgcaacgcacatacctgttttcccctcacattgaacatattttatgggtagaaatttgctttctgtgcca

SEQ ID NO: 4947 - DNA, 1158 bp, Triticum aestivum
gcaaaagcccgtttgcacacaaagccgagcccaggcgcgcttgtctgagagagcgacgaagaccgcctgctcgcccgacccacgcacctcccggaccaccacgccaccatggccgccgcctccctgtctcgcctctctcgccgcgcctccgccgccgcggcgccttccctccgccggatcctctcctccaccgccaccgcccccgctgcgccatcgtcctcaccaccccccgtcgcagccgcggcggcaggtgcggatcgggtgcggtgggattaccgcgggcagcggcagctagtaccactcgggcagtggcttcccaaggtggccgtcgacgcgtacgttgctcccgacgccgtgctcgccgggcaggtcaccgtccacgacggcgcctccgtctggagcggctccgtgctgcggggcgacctcaacaagatcactcttgggttctgcgccaacgtccaggagcggtccgtcctccacgccgcctggtcggcctctacaggtcttccagctgagacccttgttgaccggtatgtgacagtgggtgcgtactgtcttctgcgctcatgcactattgaacctgagtgcatcatcggtcagcattccatcctaatggaaggctcattggttgaaactaactcagtccttgaagctggctccgtcctggccccagggaggaggattccgactggcgaactctgggctggcaaccctgccaggtttgttaggaagctgaccaacgaagagataatggagattccaaagctcgctgtggccatcaatgatcttatgcaaagccatttctcagagttcctcccatactctaatgcttatttggaggtagagaagctgaagaagtcgttttcaattcctttgtaagatcatgttttccctctcccagcaaatgagtgaggaaataaagcagcccgaatactagaatctctgtattcaatctaatttgtagcctgggtccatctgttacgttgaattttttgttcatggttgtcaactggggacaccctgcacagcaggaattgtacctcgttgcacctttgttcggcagtgcaacgcacatacctgttttcccctcacattgaacatattttatgggtagaaatttgctttctgtgccatgaggaaacatgtattttgacaaat

SEQ ID NO: 4948 - DNA, 1170 bp, Secale cereale
gaacccacgtgcgcgcttgtctgagagagcgacgaagaccgcctgctcgccagacccacacacctcccggaccaccacgccaccatggccgccgcctccctgtctcgcctctctcgccgcgcctccgccgccgcggcgccttccctccgccggatcctctcctcgaccgccaccgcccccgctgcgccttcgtcctcaccaccccctgtcgcagccgcggcggcaggtgcggatcggatgcggtgggattaccgcgggcagcggcagctagtaccacttgggcagtggcttcccaaggtggccgtagacgcgtacgttgctcccgacgccgtgctcgccgggcaggtcaccgtccacgatggcgcctccgtctggagcggctccgtgctgcggggcgacctcaacaagatcactcttgggttctgcgccaacgtccaggagcggtccgtcctccacgccgcctggtcggcctctacaggtcttccagctgagacccttgttgaccggtatgtgacagtgggtgcgtactgtcttctgcgctcatgcactattgaacctgagtgcatcatcggtcagcattccatcctaatggaaggctccttggttgaaactaactcagtccttgaagctggctccgtcctggccccgggaaggaggattccgactggcgaactctgggctggcaatcctgctaggtttgttaggaagctgaccaacgaagagatcatggagattccaaagctcgctgtggccatcaatgatctgatgcaaagccatttctcagagttcctcccatactctaatgcttatttggaggtagagaagctgaagaagtcgttttcaattcctttgtaagatcatgtttgttttccctctcccagcaaaagagtgaggaaataaagcaacccgaatactagaatctttgtattcaatagcctgggtccatctgttacgttgaattttttgttcatgactgaactggggacacccctgcacagcagggattgtacctcgttgcacctttgttcggcagtgcaacgcacgtacctgttttcccctcacattgaacatattttatggttagaaatttgctttctgtgccatgaggaaacatgtattttgactactgatttctgcttcttatcagactagtcataggccgttagatgc

SEQ ID NO: 4949 - DNA, 2035 bp, Brachypodium distachyon
ggtgctctgagactctgactgctctctattaaacccaacgttactcttccgcggctcccctgccaattcattactcgcgtccccaaaaatttgaatctactactacagagcaagcgagagagagatcgagatggcggactggggtccggtggtgatcgcgacggtgctgttcgtgctgctgacgccggggctgctgttccagctgccggcgcagggccggatcgtggccttcggcagcatgcacaccagcggcctcgccatcctcgtccacgccatcctctacttcgccctcatcaccatcttcctcgtcgccatcggggtccacatctacgccggatagctgctctgctctgctctgctacccccatctacatcgacccttctccgcccgcagcatgccttattgccttgcctaagcccctacggctggctactttcactctctcgacgctagtttaagattgtcttctgctgtagtattgtggttgctgtagcttctcctgtcttgtttgatcagagacgcgggatgcggaatcagtgtggtttgttggatcggctgggattaaattggagatgacatgttcttctctaaatccagctcgaaagcgttctcctttctcatgtattaagattgggcctgttaacttatcaagcttttttttggaaaagttatctgcttccttcaatcagaagattaacaacaactgtacactttgtattgcctaaagtgtactgaagcgctgcttcgatccctcggattttgtttggaagggtattttcgtactcagaaattcaccattctcctcctcgcgcagccgaaccagattctcaaaatttgtagcgcaaaaaagtaacatgcggcacccgagcaacgcccgcataagatcagcggttttcaggcaggtcccctggcgtggagtggcgcagcggcgatatgcaaagatcagcgaccagctgaaaacacgacggagacaccaccgaagcgttgcacatccggctgctcgcccaacccccacacctcccccgttcgggcccggaccaccaccaccaccatggccgccgcctccctgtcccgcctctctcgccgcgcctccgccgccgcggcgccctctctccgccgcatcctctcctccactgccacctcatcaccctcccccgccgcgccttcgcccccgctaccccccgccgcggcggcgggtgcggatcggatgcggtgggactaccgcgggcagcggcaactgatcccgctgggtcagtggctgcccaaggtggccgttgacgcctacgtggctcccgaggccgtgctcgccgggcaggtcaccgtccacgacggcgcctccgtctggagcggcgccgtgctccgaggcgatctcaacaagatcactctcggcttctgcgccaatgtccaggagcggtgcgtccttcatgccgcctggtcagcccctacaggacttccagcagagaccctagttgacaggtatgtgacagtaggtgcatactgtctgctgcgctcatgcactattgaacctgagtgcatcatcggtcagcattccatcctaatggaaggttcgttggttgaaaccaactctatccttgaagctggctccgtcctggctcctggaaggaggattccgacaggtgaactctgggctggcaaccctgctaggtttgttcgaaagcttaccaatgaagagatcatggagattccaaagctcgcagtggccatcaatgatctaatgcaaagccatttctcggagttcctcccatactctactgcttatctggaggtagagaagctgaagaagtcgttttcaattcctttgtaagattatgtttttccctttcccagtaaatgattgaggaaataaagcagcccaaatactagatgctttgtatcgaatctaatttgtagtcttggttgatctgttacgttcgaatttttttgttcatggttgttgtgaaccggggaaatgcctgcaggaattgtttttccttgtacgggtgtacttgttccgcggtgcaatatgatctgttt

SEQ ID NO: 4950 - DNA, 1180 bp, Hordeum vulgare
ggcctgcaggcaattcggcacgaggcctcgtgccgaattcggcacgagggccgagcccaggtacgcgcttgtgtctgagagaaagacgaagagttaacgattcgcctgctcgcccgacccacacacctcccggaccaccacgccaccatggccgccgcttccctgtctcgcctctctcgccgagcttccgccgccgcggcgccttccctccgccggatcctctcctccaccgctaccgcctgcccgtctcccgctgcgccttcgtcctcaccaccccccgtcgcagccgcggcggcaggtgcggatcgggtgcggtgggattaccgcgggcagcggcagctagtaccactcgggcagtggcttcccaaggtggccgtcgacgcgtacgttgctcccgaagccgtgctcgccgggcaggtcaccgtccatgacggtgcctccgtctggagcggctccgtgctgcggggcgacctcaacaagatcactcttgggttctgcgccaacgtccaggagcggtccgtcctccacgccgcctggtcggcctctacaggtcttccagctgagacccttgttgaccggtatgtgacggtgggtgcgtactgtcttctgcgttcatgcactattgaacctgagtgcatcatcggtcagcattccatcctaatggaaggctcattggttgaaactaactcagtccttgaagctggctccgtcctggccccaggaaggaggattccgactggcgagctctgggctggcaaccctgctaggtttgttaggaagctgaccaatgaagagatcatggagattccaaagctcgctgtggccatcaatgatctgatgcaaagccatttctcagagttcctcccatactctaatgcttatttggaggtagagaagttgaagaagtcgttttcaattcctttgtaagatcttgttttccctctcccagcaaatgagtgaggaaataaagcagctcgaatactaggaagctttgtattcaatctaatttgtagcctgggtccatctgttacgttgaattttttgttcatggttgtgaaccggggacgcccctggacagcaggaattgttcttcgttgcaccttgttcggtagtgcaacgcacatacatgttttttccctcgcattgaccatattttatggttagaaattgagaaaattcc

SEQ ID NO: 4951 - DNA, 1215 bp, Brachypodium distachyon
ccggctgctcgcccaacccccacacctcccccgttcgggcccggaccaccaccaccaccatggccgccgcctccctgtcccgcctctctcgccgcgcctccgccgccgcggcgccctctctccgccgcatcctctcctccactgccacctcatcaccctcccccgccgcgccttcgcccccgctaccccccgccgcggcggcgggtgcggatcggatgcggtgggactaccgcgggcagcggcaactgatcccgctgggtcagtggctgcccaaggtggccgttgacgcctacgtggctcccgaggccgtgctcgccgggcaggtcaccgtccacgacggcgcctccgtctggagcggcgccgtgctccgaggcgatctcaacaagatcactctcggcttctgcgccaatgtccaggagcggtgcgtccttcatgccgcctggtcagcccctacaggacttccagcagagaccctagttgacaggtatgtgacagtaggtgcatactgtctgctgcgctcatgcactattgaacctgagtgcatcatcggtcagcattccatcctaatggaaggttcgttggttgaaaccaactctatccttgaagctggctccgtcctggctcctggaaggaggattccgacaggtgaactctgggctggcaaccctgctaggtttgttcgaaagcttaccaatgaagagatcatggagattccaaagctcgcagtggccatcaatgatctaatgcaaagccatttctcggagttcctcccatactctactgcttatctggaggtagagaagctgaagaagtcgttttcaattcctttgtaagattatgtttttccctttcccagtaaatgattgaggaaataaagcagcccaaatactagatgctttgtatcgaatctaatttgtagtcttggttgatctgttacgttcgaatttttttgttcatggttgttgtgaaccggggaaatgcctgcaggaattgtttttccttgtacgggtgtacttgttccgcggtgcaatatgatctgtttaagaaagtttcgcgattcagtcatggaataatgtagttgcttgataccacaggaataagctgatgcgtgcatgctttatgtgaaattgctgtgaacaagtaggcctggtgcatactactgtgtgtacagattatcttcttttttatagttgtacacatccttatttttatcgt

SEQ ID NO: 4952 - DNA, 1140 bp, Leymus cinereus x Leymus triticoides
  misc_feature (43)..(43): n is a, c, g, or t
  misc_feature (122)..(122): n is a, c, g, or t
  misc_feature (599)..(599): n is a, c, g, or t
  misc_feature (1037)..(1037): n is a, c, g, or t
  misc_feature (1045)..(1046): n is a, c, g, or t
  misc_feature (1104)..(1107): n is a, c, g, or t
cgaagagttgcacaatccgcctgctcgcccgacccacacatcncccggagcaccacgccaccatggccgccgcctccctgtctcgcctctctcgccgcgcctccgccgccgcggcgccttcnctccgccggatcctctcctccaccgccaccgcctgcccctcccccgctgcgccttcgtcctcaccaccccccgtcgcagccgcggcggcaggtgcggatcgggtgcgatgggattaccgcgggcagcggcagctagtaccacttgggcagtggcttcccaaggtggccgtcgacgcgtacgttgctcccgacgccgtgctcgccgggcaggttaccgtccacgacggcgcctccgtctggagcggttccgtgctgcggggcgacctcaacaagatcactcttgggttctgcgccaacgtccaggagcggtccgtcctccacgccgcctggtcggcctctacaggtcttccagctgagacccttgttgaccggtatgtgacagtgggtgcgtactgtcttctgcgctcatgcactattgaacctgagtgcatcatcggtcagcattccatcctaatggaaggctcattggttgaaacnaactcagtccttgaagctggctccgtcctggccccgggaaggaggattccgactggcgaactctgggctggcaaccctgctaggtttgttaggaagctgaccaacgaagagatcatggagattccaaagctcgctgtggccatcaatgatctgatgcaaagccatttctcagagttcctcccatactctaatgcttatttggaggtagagaagctgaagaagtcgttttcaattcctttgtaagatgatgttttccctctcccagcaaatgagtgaggaaataaagcagcccgaatactagaatctttgtattcaatctaatttgtagcctgggtccatctgttacgttgaattttttgttcatggttgtgaactggggacacccctgcacaacagtttgtacttcgttgcaccttgttcggcagtgcaacgcacatncctgtttnnccccctcatattgaccatattttatggttagaaatttgcttttgtgtgccatgagaannnntgtattttgacaaattatggtggataactatga

SEQ ID NO: 4953 - DNA, 1138 bp, Pseudoroegneria spicata
  misc_feature (34)..(34): n is a, c, g, or t
  misc_feature (111)..(111): n is a, c, g, or t
  misc_feature (232)..(232): n is a, c, g, or t
  misc_feature (1049)..(1049): n is a, c, g, or t
cgattgcaaaagcccgtttgcacacagtgccgancccaggtgcgcgtagagagcgacgaagaccgcctgctcgcccgacccacacacctcccggaccaccacgccaccatngccgccgcctccctgtctcgcgtctctcgccgcgcctctgccgccgcggcggcttccctccgccggatcctctcctccaccgccaccgcccccgctgcgccttcgtcctcaccaccccccntcgcagccgcggcggcaggagcggatcgggtgcggtgggattaccgcgggcagcggcagctagtaccacttgggcagtggcttcccaaggtggccgtcgacgcgtacgttgctcccgacgccgtgctcgccgggcaggtcaccgtccacgacggcgcctccgtctggagcggctccgtgctgcggggcgacctcaacaagatcactcttgggttctgcgccaacgtccaggagcggtccgtcctccacgccgcctggtcggcctctacaggtcttccagctgagacccttgttgaccggtatgtgacagtgggtgcgtactgtcttctgcgctcatgcactattgaacctgagtgcatcatcggtcagcattccatcctaatggaaggctcattggttgaaactaactcagtccttgaagctggctccgtcctggccccgggaaggaggattccgactggtgaactctgggctggcaaccctgccaggtttgttaggaagctgaccaacgaagagatcatggagattccaaagctcgctgtggccatcaatgatctgatgcaaagccatttctcagagttcctcccatactctaatgcttatttggaggtagagaagctgaagaagtcgttttcaattcctttgtaagatcatgtttgttttccctctcccagcaaacgagtgaggaaataaagcaagccgaatactagaatctttgtattcaatctaatttgtagcctgggtccatctgttacgttgaattttttgttcatggttgtgcactggggacacccctgcacagcagggattgtacctcnttgcacctttgttcggcagtgcaacgcacatacctgtttttccctcacattgaacatattttatggttagaaatttgctttgtgtgcca

SEQ ID NO: 4954 - DNA, 1079 bp, Festuca arundinacea
  misc_feature (140)..(140): n is a, c, g, or t
  misc_feature (540)..(540): n is a, c, g, or t
ggcacgaggcagacacacacaacccggaccaccagcgccaccatggccgccgcctccatgtcccggctctctcgccgcgcctccgcctccgcggggccttttctccgtaggattctctactcaaccgccaccgcctcacngtcacccgccgcttcttcgcccccactatcccccgccgcagccgcggcagcaggtgccgatcgggtgcggtgggactaccgcgggcagaggcagctagtaccgctcgggcagtggctgcccaaggtggccgtcgatgcgtacgtggctcccgaggccgtgctcgctgggcaggtcaccgtccacgacggcgcatccgtctggagcggctctgtgctgcggggagacctcaacaagatcacactcggattctgcgccaacgtccaggagcggtgcgtactgcacgccgcctggtccgcacctacaggactgccagctgagacccttgttgatcggtatgtgacagtgggtgcatactgtctgctgcggtcatgcactattgaacccgagtgcatcatcggncagcattccatcctaatggaaggttcgttggttgagactaactcaatcctagaagctggttctgtcctggcgccaggaaggaggattcctactggtgaactctgggctggcaaccctgctaggtttgttcggaagctgactaatgaagagatcatggagattccaaagctcgctgtggccatcaatgatctgatgcaaagccatttctcagagttcctcccgtactctaatgcttatttggaggtagagaagctgaaggaatcgttctcatttcctttgtaagatcatgttttcccctctcccagcaaatgaatgaggaaataaagcagcccaagtactagatgatttgcattgaatctaatttgtagtctgggctgatctgttgcgttgtgaattttttttgttcattgttgttgtgaattggggagacgcctgcaggaattgtgtttctttgtacggttgtaccttgttccctagtgcaatatgcactgtgctcaacatcctacttttaccggtgttgtattcacattatctatatt

SEQ ID NO: 4955 - DNA, 1092 bp, Avena sativa
ctcttaaccatacgcctgctcgcccatccagacctcccgaaccaccagcgccaccatggccgccgcctccctgtctcgcctttctcgccgcgcttccgcctccacaaggccttctctccgtcagattctctactctaccgccactgcatccccgtcccccgccgccccctcgcccccactgccactcgccgcagccgcggcagcaggtgcggatcgggtgcggtgggactaccgcgggcagcgacagctagtaccgctcgggcagtggctgcccaaggtagccgtcgacgcgtacgtggctcccgaggccgtactcgccgggcaggtaaccgtccacgatggcgcatcggtctggagcggctccgtgctgcggggagacctgaacaagatcactctcggattctgcgccaacgtccaggagcggtgcgtactccacgccgcctggtcggcacctacaggacttccagctgagacccttgttgatcggtatgtgacagtgggtgcatactgtctgctgcgctcatgcactattgaacctgagtgcatcattggtcagcattccatcctgatggaaggttcgttggttgagactaactctatccttgaagctggttctgtcctggcaccaggaaggaggattcctactggtgaactctgggctggcaaccctgctaggtttgttcggaagctgactaatgaagagatcatggagattccaaagctcgctgtggccatcaatgatctgatgcagagccatttctcagagtttctcccgtactctaatgcttatttggaggtagaggagctgaagaaatggtactcatttcctttgtaagatcatgtttttcactctcctggcgaatgaatgaggaaataaagcagccaaatactagaggctctgtactgaatctaatttgtagtctgggttgatctgttacgttgtggaatttttgttcatggttgtgaactggggagacgactgcaggaattgtgttcctttgtacggttgtaccttgttccctagtgcgtatgaactgtgctcaacatcctacttttgccggtgttgtattcacgttatctatatttatcggg

SEQ ID NO: 4956 - DNA, 923 bp, Zea mays
aacataatgtccattgggttgggtaaaaagacacaagacattcctgcacgtgtccccatgctcacaacaacaatgaacaaaaaaatttgggacgtaacagatcaaacccagcacaagttagatttcaacgcaaaacatctagtatttgggcacctttatttacttcctcgtccattcaactggacgagtgagggcaacaggctgttacagggggatggagaacgacttcttcagcttctctacctccagataagcgttagagtaaggcaggaactccgagaaatggctctgcatcagatcgttgatggcagttgccagcttcggaatctccatgatctcctcattggtcagcttccgaacgaacctggccgggcttccagcccagagctcgccggtcggaatccgccttcctgggggcaatacagagccagcttcgaggatcgagttggtctccaccagcgaaccttccatgaggacagagtgctggccaatgatgcactcaggctcgatggtgcaagagcgcaacagacagtaggcgcccactgtcacgtaccggtccacgagttgatgacgattacctgtgggagccgtccatgcggcatggaggacgcatcgctcctgtacgttggcgcagaagccgagcgtgatcttgttgaggtccccccgcaggacggcgccgctccagacggaggcgccgtcgtggacggtgacctggccggcaagcacggcctcgggggctacgtaagcgtccacggccaccttgggcatccattgtcccagcggaacaagcttcctctgcccgcggtagtcccaccgcacccgatccgcgcccacggccgcggcgccggccgcgctgggcggcggcggcggggcggatgccgcgacagaggctgtggaggttactgagaggaggcgccggaggg

SEQ ID NO: 4957 - DNA, 818 bp, Saccharum officinarum
ccgcggccgtgggcgcggatcgggtgcggtgggactaccgcggccagcggcagctcgtgcctctgggacagtggatgcccaaggtggccgtggacgcgtacgtcgcccccgaggccgtgctcgccggccaggtcaccgtccacgacggcgcctcagtctggagcggcgccgtcctgcggggggacctcaacaagatcacgctcggcttctgcgccaacgtccaggagcgatgcgtcctccatgccgcatgggcggcgcccacagggcttccagctgagacacttgtcgaccggtatgtgacagtgggtgcctactgtctgctgcgctcatgcaccatcgagcctgagtgcatcattggccagcactctatcctcatggaaggttcactggttgagaccaactcaatccttgaagctggctctgtattgcccccaggaaggcggattccgacgggtgaactctgggctggaagcccggctaggtttgttcggaagcttaccaatgaggagatcatggagattccaaagctcgcaactgccatcaacgacctgatgcaaagccatttctcggagttcctgccttactctaacgcgtatttggaggtagagaagttgaagaagtcgttctcgatccccctgtaagagcatgttgacccccgccgtccaggttgaatgaatgatggggaaataaaggttcctaaatactagatgttttgtattgaatctaatttctgggttggattgagcaatattttttgttcattgttgttgtgagcatggggacacgtgcaggaatcatatcttcgtatctttttacgc

SEQ ID NO: 4958 - DNA, 1327 bp, Zea mays
cttcttccctgccaagaaaggccaaaggggaggagatgcggcgtcccgtgcacgccttaaaaacgagatccctggggtcaccactggtccactgcgtcactgcgccgaatcactagaaaccccaacaaacggaatttcacatccagcgagcaataccgcaccgcaggtaagatcaaagaggaggcgatggctggcggcgggcaggcggcgatttcgttcatgacgcggatggcgaaggtggcggcggggttgggcgtggcggcgtccgcagcctccacgtccttctacacggtggacggcggagagcgcgccgtcatcttcgatcgcgtccgcggcgtgctcccgcgtacgatgtcagagggcacccatttgctggtccccatccttcagaagcccttcattttcgacatccgcactcgccctcacagcttctcctccacctccggcaccaaggacctccagatggtcagcctcacgctccgcgtcctgtcgcgacccgacgtcgaacacctcccggacatcttcacctccctcgggctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcaccaagcgcgcccgcgagttcaacatcgtcctcgacgacgtcgccatcacccacctagcctacgggcaggagttcgcgcaggccgtcgagaagaagcaggtcgcgcaacaggaggccgagcgctccagattcctcgtcgcgcgcgctgagcaggagaggcgcgccgccatcgtccgcgcagagggggagagcgaggccgcgcgccttatctccgaggccacgaccactgcgggcaacggcctgatcgagctcaggaggatcgaggcggccaaggagatcgcaagcgttctgtcgcgcacgcccaacgtctcctacatccccgccggcgacaatggccagatgctgctcgggcttaacgccgcccggtgaatggatcgtctttttcccgcataattagcttcagaatttcaggacgagatgaaactgttcttggtggggaggagggaaagttgtttctgtagagcttctagaagtgttgctaagagtctgtttttgattaatgaaatggctggaagtctgtttgtgctcaatagagtgtttcttctgtgaaataaaactggtctatgagatggtgtggcgagctctttgctttgctctctgcaattcagttgtatctcatacatgctgtcttctctgaaataaaacttttcgagtgaactgg

SEQ ID NO: 4959 - DNA, 1240 bp, Setaria italica
cttcttctctgccaagaaaggggtaggaggagatgcggcgccccgtgcccatctttaaaacctcacaatcaccacggcgccggatctcccaaaacccctgagccaaagggaattccaccaccagcgatcaatccaccaccgcaagtaacagcgaggaggaagcgatggccggcggcgggcaggcggcggtgtcgttcctgacgcggattgcgaaggtggctgcggggattggcgtggcggcgtccgccgcctccacgtccctctacacggtggacggcggggagcgcgccgtcatcttcgaccgcctgcgcggcgtgctcccgaggacggaggcggagggcacccacctcctggtccccatcctccagaagcccttcatcttcgacatccgcacccgcccccacagcttctcctccacctccggcaccaaggacctccagatggtcagcctcacgctccgcgtcctctcgcgccccgacgtcgaccgcctcccggagatcttcaactccctcggcctcgagtacgacgagaaggtcctcccctccatcggcaacgaggtgctcaaggccgtcgtcgcgcagttcaacgccgaccagctcctcaccgagcggccccacgtctcggcgcttgtccgcgagtccctcacccagcgcgcccgcgagttcaacatcgtcctcgacgacgtcgccatcacccacctcgcctacgggccggagttcgcgcaggccgtcgagaagaagcaggtcgcgcagcaggaggccgagcgctctaggttcctcgtcgcgcgcgcggaccaggagaggcgcgctgccatcgtccgggccgagggggagagcgaggccgcgcgcctcatctccgaggccacaaccaccgccggcaacggactgatcgagctcaggaggattgaggcggccaaggagattgccggcgtgctggcgcgctcgcccaacgtctcctacatccccgccggcgacaacggtcagatgctgctggggctcaacgccgcccggtgaatggatcgtccatttcccctttaattagttagcggttactttagtaatttcagatgcatcgaccgacttagttatggtattgtggtacgatggagacttggtaaagattttattttgcactaccaataaagttctgcagatgtagaatctatcgaacaattgttgcattgtgttgccaaaattatttatgttccacttgttgttgtgattaattatttttttaatct

SEQ ID NO: 4960 - DNA, 1238 bp, Panicum virgatum
gagatgcggcgtcccgggcacggctcttaaaaccccacctcaccacgccgccgctggatccccaaaccctcaagttcacagccagcgatcaatcccccatcgccagtgagagcaaggagcaagcgatggcaggcggcgggcaggcggcggtgtcgttcctgacgcggattgcgaaggtggctgcggggatcggcgtggcggcgtccgcggcctccacgtccctctacacggtggacggcggggagcgcgccgtcatcttcgaccgcatgcgcggcgtgctcccggggacggagtcggagggcacccacttccgcgtccccttcctccagaagcccttcatcttcgacatccgcacccgcccccacagcttcgcctccacctccggcaccaaggacctccagatggtcagcctcacgctccgcgtcctctcgcgccccgacgtcgaccacctcccggagatcttcacctccctcggcctcgagtacgacgagaaggtcctcccctccatcggcaacgaggtgctcaaggccgtcgtcgcgcagttcaacgccgaccagctcctcaccgagcgcccccacgtctccgcgctcgtccgcgagtccctcacccagcgcgcccgcgagttcaacatcgtcctcgacgacgtcgccatcacccacctcgcctacgggccggagttcgcgcaggccgtcgagaagaagcaggtcgcgcagcaggaggccgagcgctccaggttcctcgtcgcgcgcgccgagcaggagaggcgcgccgccatcgtccgcgccgagggggagagcgaggccgcgcgcctcatctccgaggccacgacaaccgcgggtaacggcctcatcgagctcaggaggatcgaggcggccaaggagatcgccggcgtgctggcgcgctcgcccaacgtctcctacatccccgccggggacaacggccagatgctgctcgggctcaacgccgcccggtgaatggatcgtctcctgctcttcaattagttattacttatatatagagttctattgaaatactttagtaattcagatgcatcgacttagttttggtattttggtacgaccggagactaggtcaagatggtactctgcaccaccaataaagttctgcagatgtagaatttatcgaacaattgttgcattttattccaaaattatgttccacttgtcattgtgatgatctctctcttttctattaattttgattgtgttgccctgatt

SEQ ID NO: 4961 - DNA, 1697 bp, Oryza sativa
gtcacaaagcatcgaccggaggaggcccacggcccatcaggcctgagcacgaatctcaatgcgagtgccctgccacctgccaaccatcgacgcccacgcactggaagtttcgttcttcttcccttccaagaaatgcggaaacccgtgcacggctttaaaaccaaaccccaccagatcaaccaaatccccccccccccccccccaaaaaaaaacccaaacccctttcccaaacaatcccccaccggaaaagcaggcgaacccccatccatcgggatccatggccggcggcgggcaggcggcggcgtcgctgctgacgaagctggcgcaggcggcggccgggctgggcatcgcggcgtcggcggcgtcgacggcgctgtacacggtggacggcgggcagcgcgccgtgatcttcgaccggttccgcggcgtgctcccggagacctcgtcggagggcacccacttcatcgtcccctggctccagaagcccttcatcttcgacatccgcacccgcccgcacagcttctcctccacctctgggaccaaggacctgcagatggtcagcctcaccctccgcgtcctcgcgcgccccgacatcgaccgcctcccggacatcttcacctcgctgggcctcgagtacgacgagaaggtgctcccctccatcggcaacgaggtgctcaaggccgtcgtcgcgcagttcaacgccgaccagctcctcaccgagcgcccccacgtctccgcgcttgtccgcgactccctcatccgccgcgccgccgagttcaacatcgtcctcgacgacgtcgccatcacgcacctcgcctacggcccggagttctcccaggccgtcgagaagaagcaggtggcgcagcaggaggccgagcggtccaggttcctcgtcgcgcgcgccgagcaggagaggcgcgccgccatcgtccgcgccgagggggagagcgaggccgcgcgcctcatctccgaggccaccgccgccgcgggcaccggcctgatcgagctcaggaggatcgaggccgccaaggagatcgccggggagcttgcgcgctcccccaatgtctcgtacatcccggccggcgacagcagccagatgctgcttggtctcagcggcgctcggtgaatgaatcatcatctttccctttagtcagttgcattaccttttagatcttattatcacttcatggtattattggatcccataaattttccactgatggagatgaattgtcgaacaattgctgcatttgtcttgcccaaaatatgtggcaatttgttgaattttgtgatccttcaaccactgcaatgcaggaatcttatatttagaaatctacattgctttgttgatgctgtgaatgttttatccaattttgtgctatgataattcttttagcattggattgacatgtttctgcccttatcacgaggattgcatctatgtgcccttaggaataatgaaccgaacaatgtatataaagagaacagaagaccccctgttttttcagataaccagtttgttgcagcttttgtttgcccattttgattgatttgtctgaagttagtcttagtctaaatcactagtctgaagtctgaacgttgtggagtatgtgatgaatggaattatgctaattgtcactgaattggaatcctgtagtgtgttttatgctttagtgcgattaacatgttcagtttgt

SEQ ID NO: 4962 - DNA, 1202 bp, Brachypodium distachyon
aaaactatcagatccgagagggtagaaacccacaaacccctaacccaaaacagccccaaatccaccccaaaggttggtcgtcacccatggccggcggcggacaagcggcagtctcgttcctgacgaagatcgcgaaggcggcggccggggtcggccttgctgcgtctgcggtctctacgtccctctacacggtggacggcgggcagcgggcggtcatcttcgaccgcttccgcggcgtgctcccggagaccgtctcggagggtacccacgtcctcgtcccctggcttcagaagcccttcatcttcgacatccgcacgcgcccacacagcttctcctccacatccggcaccaaggacctgcagatggtcagcctcacgctccgcgttctctcccgccccgacgtcgaacgccttccggatatcttcacctcgctcggcctcgactacgacgacaaggtgctcccctccatcggcaacgaggtgctcaaggccgtcgttgcccagttcaacgcagaccagctcctcaccgaccgcccccacgtctctgcgctcgtccgtgacgccctcgtccgccgcgccggcgagttcaacatcgtgctcgacgacgtcgccatcacccacctcgcctacgggcacgaattcgccctggccgtcgagaagaagcaggtggcgcagcaggaggccgagcgctccaggttccttgtagcgcgtgcagagcaggagaggcgtgctgccatcgtccgtgcggagggagagagcgagtccgcacggctcatctctgaggccactgctgctgcgggcaacggcctgatcgagctgaggaggatcgaggccgccaaagagatagctggagtgctggcgcgctcacccaatatctcctacatcccctccagtgacaacagccagatgctgctcgggctcagcgccgcccggtgaatgaactgtcactaatccttcagttgattacagtactttagtaacttcaggtgcatcggaaccattagcaatttatgattttattggagaatgtacccttatgatgatgatatgatgctaataaatttgcacttatgggtgctgttattgaacaaattctgcattttggttgcccaaattatgttatatttgtgcttttggtaaatcatctacttctgtggaccttaactatgcagtgatattgttatttcttagaagtaacttgga

SEQ ID NO: 4963 - DNA, 1076 bp, Brachypodium distachyon
acaaacccctaacccaaaacagccccaaatccaccccaaaggttggtcgtcacccatggccggcggcggacaagcggcagtctcgttcctgacgaagatcgcgaaggcggcggccggggtcggccttgctgcgtctgcggtctctacgtccctctacacggtggacggcgggcagcgggcggtcatcttcgaccgcttccgcggcgtgctcccggagaccgtctcggagggtacccacgtcctcgtcccctggcttcagaagcccttcatcttcgacatccgcacgcgcccacacagcttctcctccacatccggcaccaaggacctgcagatggtcagcctcacgctccgcgttctctcccgccccgacgtcgaacgccttccggatatcttcacctcgctcggcctcgactacgacgacaaggtgctcccctccatcggcaacgaggtgctcaaggccgtcgttgcccagttcaacgcagaccagctcctcaccgaccgcccccacgtctctgcgctcgtccgtgacgccctcgtccgccgcgccggcgagttcaacatcgtgctcgacgacgtcgccatcacccacctcgcctacgggcacgaattcgccctggccgtcgagaagaagcaggtggcgcagcaggaggccgagcgctccaggttccttgtagcgcgtgcagagcaggagaggcgtgctgccatcgtccgtgcggagggagagagcgagtccgcacggctcatctctgaggccactgctgctgcgggcaacggcctgatcgagctgaggaggatcgaggccgccaaagagatagctggagtgctggcgcgctcacccaatatctcctacatcccctccagtgacaacagccagatgctgctcgggctcagcgccgcccggtgaatgaactgtcactaatccttcagttgattacagtactttagtaacttcaggtgcatcggaaccattagcaatttatgattttattggagaatgtacccttatgatgatgatatgatgctaataaatttgcacttatgggtgctgttattgaacaaattctgcattttggttg

SEQ ID NO: 4964 - DNA, 1096 bp, Hordeum vulgare
aacgaaaatccatacccgaactaggtcatccatggctggcggcgggcaagcagcggtctcgttcctgacgaaggtcgcgaaggtggctgccgggttgggcttggcggcatctgcggtctccacgtccctctacacggtggacggcggccaacgggcggtcatcttcgaccgcttccagggcgttctcccggcggtcgtctcggagggcacccacttcctcgtcccctggctccagaagcccttcctcttcgacatccgcacgcgcccgcacagcttctcctccacatctggaaccaaggatctgcagatggtcagcctcacgctccgcgtcctcgcccgccccgatgtggaacgccttcctgaaatcttcaccaacctcggtctcgactacgacgacaaggtgctcccctccatcggcaacgaggtgctcaaggccgtcgtcgcccagttcaacgcagaccagctcctcaccgaccgtccccacgtgtctgccctcgtccgtgaagccctcgtccgccgcgccggcgagttcaacatcgtgctcgatgacgtcgccatcacccacctcgcctacgggcacgacttcgcccaggccgttgagaagaagcaggtcgctcagcaggaggctgagcgctccaggttcctcgttgcgcgtgcagagcaggagaggcgtgctgctatcgttcgcgcggagggagagagcgagtccgcacggctcatctcagatgccaccgctcttgtaggcaatggactgatcgagctcaggaggatcgaggctgccaaagagatagctggggtgattgctcgctcaccaaatgtttcctacatcccttccggcaacaacggcaagatgctgcttgggctcagtactgcccggtgaatgaattgtcacttaccttccagtttatcacagtactttagtcacttcagatgtccaattacccttcacttgattccaatatttaaataactttatcgtaaaatggagacttttattatggaggatcattgaacaatgtcgtattttagtcgccaacctatgatatatttgtgcttatgatacattcttgagttatgtgaacctttttattattgc

SEQ ID NO: 4965 - DNA, 1287 bp, Hordeum vulgare
acaggccagtcgggcctatccaagtgcacggcccgcaccatgcttgttcttcttctctatcaagaaatggtacagctttaaagccaccagatcccacggcgcagaacgaccccaaaccccccaaaccccaacgaaaatccatacccgaactaggtcatccatggctggcggcgggcaagcagcggtctcgttcctgacgaaggtcgcgaaggtggctgccgggttgggcttggcggcatctgcggtctccacgtccctctacacggtggacggcggccaacgggcggtcatcttcgaccgcttccagggcgttctcccggcggtcgtctcggagggcacccacttcctcgtcccctggctccagaagcccttcctcttcgacatccgcacgcgcccgcacagcttctcctccacatctggaaccaaggatctgcagatggtcagcctcacgctccgcgtcctcgcccgccccgatgtggaacgccttcctgaaatcttcaccaacctcggtctcgactacgacgacaaggtgctcccctccatcggcaacgaggtgctcaaggccgtcgtcgcccagttcaacgcagaccagctcctcaccgaccgtccccacgtgtctgccctcgtccgtgaagccctcgtccgccgcgccggcgagtttaacatcgtgctcgatgacgtcgccatcacccacctcgcctacgggcacgacttcgcccaggccgttgagaagaagcaggtcgctcagcaggaggctgagcgctccaggttcctcgttgcgcgtgcagagcaggagaggcgtgctgctatcgttcgcgcggagggagagagcgagtccgcacggctcatctcagatgccaccgctcttgtaggcaatggactgatcgagctcaggaggatcgaggctgccaaagagatagctggggtgattgctcgctcaccaaatgtttcctacatcccttccggcaacaacggcaagatgctgcttgggctcagtactgcccggtgaatgaattgtcacttaccttccagtttatcacagtactttagtcacttcagatgcccaattacccttcacttgattccaatatttaaataactttatcgtaaaatggagacttttattatggaggatcattgaacaatgtcgtattttagtcgccaacctatgatatatttgtgcttatgatacattcttgagttatgtgaacctttttattattgcagggatatggtcctctatggttattgcccagaggcaacttggtttttgaattatttgtttta

SEQ ID NO: 4966 - DNA, 1126 bp, Triticum aestivum
cccaaactaggtcatccatggctggcggcgggcaagcagcggtctcgttcctgacgaaggtcgcaaaggtggctgccgggttgggcttgacggcatctgccgtctccacgtccctctacacggtggacggcggccaacgggcggtcatcttcgaccgcttccagggcgttctcccggcggtcgtctcggagggcacccacttcctcgtcccctggctccagaagcccttcctcttcgacatccgcacgcgcccgcacagcttctcctccacctccggaaccaaggatctgcagatggtcagcctcacgctccgcgtcctcgcccgccccgatgtggaacgccttcctgaaatcttcaccaacctcggcctcgactacgacgacaaggtgctcccctccatcggcaacgaggtgctcaaggccgtcgtcgcccagttcaacgcagaccagctcctcaccgaccgtccccacgtctctgccctcgtccgtgaagccctcgtccgccgcgccggcgagttcaacatcgtgctcgatgacgtcgccatcacccacctcgcctacgggcacgacttcgcccaggccgttgagaagaagcaggtcgcgcagcaggaggctgagcgctccaggttcctcgttgcgcgtgcagagcaggagaggcgtgctgctatcgttcgcgcggagggagagagcgagtccgcacggctcatctcagatgccaccgctcttgtaggcaatggcctgatcgagctcaggaggatcgaggctgccaaggagatagctggggtgattgcgcgctcacccaatgtttcctacatcccttctggcaacaacggccagatgctgcttgggctcagcactgcccggtgaatgaattgccacttatcttccagttggtcacagtactttcccaattatccttcacttgattacaatacttgaataacttcagatgcttcgacatagtagttatgattttatgattttatcgtagaatggagacttctattatggaggagtcattgaacaaatgttgtattttggttgccaacctatgctatatttgtgcttatgatgcgttcttgaattacatgaacctttttattattgcaaaaaaaaaaaaaaaacga

SEQ ID NO: 4967 - DNA, 1205 bp, Triticum aestivum
acggcgcagaactcccccagcccccaaccaaaatccacccccaaactaggtcatccatgtctggcggcgggcaagcagcggtctcgttcctgacgaaggtcgcaaaggtggctgccgggttgggcttgacggcatctgccgtctccacgtccctctacacggtggacggcggccaacgggcggtcatcttcgaccgcttccagggcgttctcccggcggtcgtctcggagggcacccacttcctcgtcccctggctccagaagcccttcctcttcgacatccgcacgcgcccgcacagcttctcctccacctccggaaccaaggatctgcagatggtcagcctcacgctccgcgtcctcgcccgccccgatgtggaacgccttcctgaaatcttcaccaacctcggcctcgactacgacgacaaggtgctcccctccatcggcaacgaggtgctcaaggccgtcgtcgcccagttcaacgcagaccagctcctcaccgaccgtccccacgtctctgccctcgtccgtgaagccctcgtccgccgcgccggcgagttcaacatcgtgctcgatgacgtcgccatcacccacctcgcctacgggcacgacttcgcccaggccgttgagaagaagcaggtcgcgcagcaggaggctgagcgctccaggttcctcgttgcgcgtgcagagcaggagaggcgtgctgctatcgttcgcgcggagggagagagcgagtccgcacggctcatctcagatgccaccgctcttgtaggcaatggcctgatcgagctcaggaggatcgaggctgccaaggagatagctggggtgattgcgcgctcacccaatgtttcctacatcccttctggcaacaacggccagatgctgcttgggctcagcactgcccggtgaatgaattgccacttatcttccagttggtcacagtactttcgtcacttcagatgcccaattatccttcacttgattacaatacttgaataacttcagatgcttcgacatagtagttatgattttatgattttatcgtagaatggagacttctattatggaggagtcattgaacaaatgttgtattttggttgccaacctatgctatattagggtccctatattagtgcttatgatgcgttctttttattattgcagggatatggtcctctatggttattgctcagaagcaacttggttttt

SEQ ID NO: 4968 - DNA, 987 bp, Pennisetum glaucum
gtggcgtccgccgcctccacgtccctctacacggtggacggcggcgagcgcgccgtcatcttcgaacgcctgcgcggcgtgctcccgaagacggaggcggagggcacccacctcctggtgcccgtccttcagaagcccttcatcttcgacatccgcacccgcccccacagcttctcctccacctccggcaccaaggacctccagatggtcagcctcacgctccgcgtcctttcgcgccccgacgtcgaccgcctcccggagatcttcaactcccttggcctcgagtacgacgagaaggtcctcccctccatcggcaacgaggtgctcaaggccgtcgtcgcgcagttcaatgccgaccagctcctcaccgagcgcccccacgtctcggcgctcgtccgcgagtctctcacccagcgcgcccgcgagttcaacatcgtcctcgacgacgtcgccatcacccacctggcctacgggccggagttcgcgcaggccgtcgagaagaagcaggtcgcgcagcaggaggccgagcgctccaggttcctcgtcgcgcgcgccgaccaggagaggcgcgccgccatcgtccgggccgagggggagagcgaggccgcgcgcctcatctccgaggccacaaccaccgccggcaacggcctcatcgagctcaggaggatcgaggcggccaaggagattgccggcgtgctggcgcgctcgcccaacgtctcctacatccccgcgagcgacaacggccagatgctgctggggctcaacgccgcccggtgaatggatcgtatatcttctctttaattagtgagcgtactttagtaatttcagatgcatcgacttagttgtggtattgtagttcgatggggacttggcaaagattttattatgcactaccaataaagttctgcagatgtagaatctatcgaacaattcttgcattgtgcttccaaaattatttatgttccattattgtgattaatatttttt

SEQ ID NO: 4969 - DNA, 1258 bp, Secale cereale
gataggcttggtagtaggctcgcaggccaatcgggccatccacgtgcgcggccaacaccacgcttcttcttcttctctatcaagaaaaggtacagcgttaaagccaccagatcccccaaaccctaaccaaaatccacacccgaaataggtcatccatggctggcggcgggcaagcagcgggctcgttcctgacgaaggtcgcaaaggtggctgccgggttgggcttgacggcatctggcgtctccacgtccctctacacggtggacggcggccaacgggccgtcatcttcgaccgcttccagggcgttctcccggcggtcgtctcggagggcacccacttcctcgtcccctggctccagaagcccttcctcttcgacatccgcacgcgcccgcacagcttctcctccacctccggaaccaaggatctgcagatggtcagcctcacgctccgcgttctcgcccgccccgatgtggaacgccttcctgaaatcttcaccaacctcggcctcgactatgacgacaaggtgctcccctccatcggcaacgaggtgctcaaggccgtcgtcgcccagttcaacgcagaccagctcctcaccgaccgtccccacgtctctgccctcgtccgtgaagccctcgtccgccgcgccggcgagttcaacatcgtgcttgatgacgtcgccatcacccacctcgcctacgggcacgacttcgctcaggccgttgagaagaagcaggtcgcgcagcaggaggctgagcgctccaggttcctcgttgcgcgggcagagcaggagaggcgtgctgctattgttcgcgcggagggggagagcgagtccgcacggctcatctcagatgccaccgcccttgtaggcaatggcctgatcgagctcaggaggatcgaggctgccaaggagatagctggggtgattgcgcgctcacccaatgtttcgtacatcccttccagcaacaacggccagatgctgcttgggctcagcactgcccggtgaatgaattgccacttttctcccagttatccttcacttgattacaatacttaaataagttcagatgcttcggcatagttatgattgtaggattttattgcagaatggagacttttataattctggtactcgtcaatttccagttatggaggaggcattgaacaaatgttgtcctccctccgttcactttcttgagttgtttaagacagctgaaattgacctgttttaggtgaacggtattttggttgccaccctat

SEQ ID NO: 4970 - DNA, 1082 bp, Leymus cinereus x Leymus triticoides
gcagcggtctcgttcctgacgaaggtcgcaaaggtggctgccgggttgggcttgacggcatctgccgtctccacgtccctctacacggtggacgggggccaacgggcggtcatcttcgaccgcttccagggcgttctcccggcggtcgtctcggagggcacccacttcctcgtcccctggctccagaagcccttcctcttcgacatccgcacgcgcccgcacagcttctcctccacctccggaaccaaggatctgcagatggtcagcctcacgctccgcgtcctcgcccgccccgatgtcgaacgccttcctgaaatcttcacctccctcggcctcgactacgacgacaaggtgctcccctccatcggcaacgaggtgctcaaggccgtcgtcgcccagttcaacgcagaccagctcctcaccgaccgtccccacgtgtctgccctcgtccgtgaagccctcatccgccgcgccggcgagtttaacatcgtgctcgatgacgtcgccatcacccacctcgcctacggccacgacttcgcccaggccgttgagaagaagcaggtcgcgcagcaggaggctgagcgctcgaggttcctcgttgcgcgtgcagagcaggagaggcgtgctgctattgttcgcgcggagggagagagcgagtccgcacggctcatctcagaggccaccgcccttgtaggcaatggcctgatcgagctcaggaggatcgaggctgccaaggagatagctggggtgattgcgcgctcacccaatgtttcctacatcccttccggcaacaacggccagatgctgcttgggctcagcactgcccggtgaatgaattgccacttatcttccagttgaccacaacactttagtcacttcagatgcccaattatccttcacttgtttacaatacttaaataacttcagatgcttcgacatcgtagttatgattttacgattttatcggagaatggagacttttataattgtggcactcatcaatttccagttttggaggagtcattattgaacaaatgttgtattttggtaggcaacctatgctatatttgtgcttatgataa

SEQ ID NO: 4971 - DNA, 1151 bp, Avena sativa
aatccaccccaaaactaggtcatccatggccggcggcggacaagcggcggtctcgttcctgacgaagctcgctaaggtagcggccggcgtcggcgtggctgcgtcggccgtcaccacgtccctttacacggtggacggcgggcagcgggcggtcatcttcgaccgcttccagggcgtgctaccggaggtcgtctcggagggcacccacttcctcatcccctggctccagaagcccttcatcttcgacatccgcacgcgccctcacagcttctcctccaactccggaaccaaggacctgcagatggtcagcctcacgctccgcgtcctctcccgccccgacgtcgggcgccttccggagatcttcacctccctcggcctcgactacgacgagaaggtgctcccctccatcggcaacgaggtgctcaaggccgccgtcgcccagttcaacgctgaccagctcctcacagagcgtccccgggtctctgagctcgtccgtgaaaccctcgtcaaacgtgccgccgagttcaacatcgtgctcgacgacgtcgccatcacccacctcgcctacgggcacgacttcgccctggccgtcgagaagaagcaggtcgcgcagcaggaggccgaacgctccaagttccttgtcgcgcgtgcagagcaggagaggcgtgctgccatcgtccgtgctgaaggagagagcgagtctgcacggctcatctctgaggccaccgctcttgtcggcaatggcctgatcgagctcaggaggatcgaggccgccaaggagattgctggggtgctggcacgctcacccaacatctcctacatcccttccggccaaaacggccagatgctgcttgggctcagtgccgcccggtgaacataatacctgcttatccttcagttgattacaagtactttagtagcttcagatgcatcgacatcgttatcgttttatcagtttatcggaggttggagacttttatgagtgacattgtgatcatcaattgccacttatggaggagttattgaacaaatgctgtagtattttggttgccaaagtatgctatattcgtgcttactgtaagttctcgaattatgtggatcttattagctattccagggtatggttattgctcagaagcaacatggttact

SEQ ID NO: 4972 - DNA, 1297 bp, Saccharum officinarum
cccctgcaaaacccgctagaacccgccacgctcagatccgcatagcgccgccgccgcccccagacacaatcccccaccccactctagggttttcgtcccggcgccgccgcgcccccaaatcaccccgaaacaaccatggccggcggtcccgcggcggtgtcgttcctgaccaacatcgcgaaggcggctgtggggctcggagccgcggcctccctcgcctcagcgtcgctctacaccgtcgacggcggcgagcgcgccgtcatcttcgaccggttccgcggggtgctcccggagaccgtcggcgagggcacccatttcctcgtgccatggctacagaagcccttcatcttcgacatccgcacgcggccgcacaacttctcctccaactcggggaccaaggacctgcagatggtcaacctcacgctccgcctcctctcccgccccgacgtccagcacctccccaccatcttcacctccctcggcctcgagtacgacgacaaggtgctcccctccatcggcaacgaggtgctcaaggccgtcgtcgcccagttcaacgccgaccagctgctcaccgagcgcccccacgtctccgccctcgtccgcgacgcgctcatccgccgcgcccgcgagttcaacatcatcctcgacgacgtcgccatcacccacctctcctacggtattgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcagagctggctcgctcaccgaatgtggcatacattcctgctggggagaacggcaagatgctgcttggtctcaatgctgccggatttggccggtgattcactgttttgttttagtttgcttggctatgctgatgcatgactaaaacggtggttcgaaggacagtgatatcttctgctacccttgcttatgttaagtttcccttgtcttggaactaaatgtgtttgtcttgggctccaaataagtttttggtcttgctgggcaagtgggcatatttacaattcgtagggttaatgtgacatattgagttgatcctgcatagtgcattctaatttctctttgcattgcattctcatgtcaaattcattgatatgtaaccttgctggaaatgtagatctgtttagg

SEQ ID NO: 4973 - DNA, 1190 bp, Pennisetum glaucum
ccccacccatccccgagagaggcgccatggccggcggtcccgcggcggtgtcgttcctgaccaacatcgcgaaggcggcggcaggtctcggcgccgcggcctctctcctctccgcgtcgctcttcaccgtcgacggcggcgagcgcgccgtcatcttcgaccggttccgcggcgtgcttccccagaccgtcagcgagggcacccacttcatcgtaccctggctccagaagccctacatcttcgacatccgcacgcgcccccacaacttctcctccaactcgggcaccaaggacctgcagatggtcaacctaacgctccgcctcctctcccgccccgacgtcgagcacctccccaccatcttcacttccctcggcctcgagtacgacgacaaggtgctcccctccatcggcaacgaggtgctcaaggccgtcgtcgcccagttcaacgccgaccagctcctcaccgaccgcccccacgtctccgccctcgtccgcgacgccctcatccgccgcgcccgcgagttcaacatcatcctcgacgacgttgccatcacccacctctcctacggcatcgagttctcccaggccgtcgagaagaagcaggtcgcgcagcaagaggccgagcgctccaagttcctcgtcgccaaggccgagcaggagaggcgcgccgccatcgtgcgtgctgagggagagagtgagtccgcgcgcctcatctccgaggccacggcgatggctgggactgggctgattgagctcaggaggattgaggcggccaaggagattgctgcggagttgtctcgctcgccgaacgtggcatacattcctgctggtgacaatggcaaaatgctgcttggtctcaatgctgctggattcgggcggtgattcactagtcagtttttaagtaagccttttgttgcttgagcatctgcctgcttgtgctatgctatgcatgactaaaactgtggctccaaagacaatgatatctgctgcgcttgcttaagtttcagttatctcagaacgaattgtgttagtcttgtgctacaaataatattttggtctaaagtctgaacgcaaatgatttgtctgtttatggcgacagatggatgaattgttgaatctgcattctaattcttcagatgcaaaggctcttgtttattttgtagctatctaattttgcaggaattgaaaatc

SEQ ID NO: 4974 - DNA, 1342 bp, Sorghum bicolor
gcaataaacccctgccaaaacccgctagaacccgccacgctcagatccgcatagcgccgcgccgccccccagacacacacaatccccaccctctctagggttttcgtccccgcgccgccgcgctcccaaatccaccccccgaagcaaccatggccggcggtcccgcggcggtgtcgttcctgaccaacatcgcgaaggcggccgctgggctcggaatcgcggcctccctcacctcagcgtcgctctacaccgtcgacggcggcgagcgcgccgtcatcttcgaccggttccgcggggtgctcccggagacggtcggcgagggcacccatttcctcgtgccgtggctgcagaagcccttcatcttcgacatccgcacgcggccgcacaacttctcctccaactccgggaccaaggacctgcagatggtcaacctcacgctccgcctcctctcccgccccgacgtccagcacctccccaccatcttcacctccctcggcctcgagtacgacgacaaggtgctcccctccatcggcaacgaggtgctcaaggccgtcgtcgcccagttcaacgccgaccagctcctcaccgagcgcccccacgtctccgcgctcgtccgcgacgcgctcatccgccgcgcccgcgagttcaacatcatcctggacgacgtcgccatcacccacctctcctacggtatcgagttctccctggccgttgagaagaagcaggtcgcgcagcaggaggccgagcgctccaagttcctcgtcgccaaggcggagcaggagaggcgggcggccatcgtgcgcgccgagggagagagcgagtccgcgcgcctcatctctgaggccacggcgatggctgggacagggctgatcgagctcaggaggatcgaggcggccaaggagattgccgcagagctggctcgctcgccaaatgtggcatacattccttctggggaaaacggaaagatgctgcttggtctcaatgctgcgggatttggtcggtgattcaccgttctgttttagttttgccttatgtgcttgggcatctgcctgcttgtgctatgccgatgcatgactaaaatggtggttcgaaggacagtggtatctgctacccttggttatgttaagtttcccttatcttggaactaaatgtgttttgtctcgtgctccaaataagtgtttggtcttgactctgggcaagtgggcatattttcaattggtagggttaatgtgacatattgtcttgagcgtgcattctaattcctcttgcattccattctcatgtcaagttcattgatatctaaaactgcttgaaccttctgatattgctcctgcattacagc

SEQ ID NO: 4975 - DNA, 1943 bp, Sorghum bicolor
cgggcccacgtgccatgacacagaccgccgcttccaaccttcttatctcgcaagaaatgggcggacccaacgcgcaataaacccctgccaaaacccgctagaacccgccacgctcagatccgcatagcgccgcgccgccccccagacacacacaatccccaccctctctagggttttcgtccccgcgccgccgcgctcccaaatccaccccccgaagcaaccatggccggcggtcccgcggcggtgtcgttcctgaccaacatcgcgaaggcggccgctgggctcggaatcgcggcctccctcacctcagcgtcgctctacaccgtcgacggcggcgagcgcgccgtcatcttcgaccggttccgcggggtgctcccggagacggtcggcgagggcacccatttcctcgtgccgtggctgcagaagcccttcatcttcgacatccgcacgcggccgcacaacttctcctccaactccgggaccaaggacctgcagatggtcaacctcacgctccgcctcctctcccgccccgacgtccagcacctccccaccatcttcacctccctcggcctcgagtacgacgacaaggtgctcccctccatcggcaacgaggtgctcaaggccgtcgtcgcccagttcaacgccgaccagctcctcaccgagcgcccccacgtctccgcgctcgtccgcgacgcgctcatccgccgcgcccgcgagttcaacatcatcctggacgacgtcgccatcacccacctctcctacggtatcgagttctccctggccgttgagaagaagcaggtcgcgcagcaggaggccgagcgctccaagttcctcgtcgccaaggcggagcaggagaggcgggcggccatcgtgcgcgccgagggagagagcgagtccgcgcgcctcatctctgaggccacggcgatggctgggacagggctgatcgagctcaggaggatcgaggcggccaaggagattgccgcagagctggctcgctcgccaaatgtggcatacattccttctggggaaaacggaaagatgctgcttggtctcaatgctgcgggatttggtcggtgattcaccgttctgttttagttttgccttatgtgcttgggcatctgcctgcttgtgctatgccgatgcatgactaaaatggtggttcgaaggacagtggtatctgctacccttggttatgttaagtttcccttatcttggaactaaatgtgttttgtctcgtgctccaaataagtgtttggtcttgactctgggcaagtgggcatattttcaattggtagggttaatgtgacatattgtcttgagcgtgcattctaattcctcttgcattccattctcatgtcaagttcattgatatctaaaactgcttgaaccttctgatattgctcctgcattacagctagtgccattgatattcttctatatgttgtgaccttttaagcatatatcttctgattactattgtgttattgtgttgttgagcctgtagttgtctaagacgccttttctcatctttgttctgaagtgctctagttaggtcttggattgataagctagtggtagtggcgtagctgggacgtttctattaggcttgctccacctggctatgctgcagtgatatgaccctgtcatcttaattaggttctaatgacatttaaatgctttgtaagtgcctcattggttgattacttgctttgatatgccctgtcatcttaaataggttctcatgacatttaaatactttgtttgtgcctaattagttgattatttgcttgttgtgctatacgtgattggtctcataatttgcaatacatgaactgttcattcattgatgcttgatgaacctaggcatattctattcttttgggaggctgttatcagatttaacaatgccaacttagggcttgtttggcacagctcaacttcac

SEQ ID NO: 4976 - DNA, 1160 bp, Triticum aestivum
gcacgagcaaaaacccgccactctcagatccgcacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagccttcatcttcgacatccgcacgcgcccgcacaacttctcctccaactcggggaccaaggacctgcagatggtcaacctcacgctccgtctcctctcccgccccgacgtccagcacctccccaccatcttcacctccctcggactcgagtacgacgacaaagtgctcccctccatcggcaacgaggtgctcaaggccgtcgtcgcccagttcaatgccgaccagctcctcaccgaccgcccccacgtctccgccctcgtccgcgacgctctcatccgccgcgcccgcgagttcaacatcatcctcgacgacgtcgccatcacccacctctcctatggtatcgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcagagctggctcgctcaccgaatgtggcatacattccttctggggaaaacggaaagatgctgcttggtctcaatgctactggatttggccggtgattcactgtttttttagtctgcttgtgctatgtgctgatgcatgactaaaacggaggttcgaactttgaaggacagtgatatctgctatccttgcttatgttaagttttccttgtcttggaactaaatgtgtctgttgtgctccaaataagttttggtttttgactgcatatttgcaattggta

SEQ ID NO: 4977 - DNA, 1117 bp, Panicum virgatum
aaacccaccaccaaaagccacgctcagatccgcacagcgccgccgccccccgaaaccaatcctcctccccttcgctagggtttttaccgccccccgcgccgccgcaatcccagccaccccccgagagaggcgccatggccggcggtcccgcggcggtgtcgttcctgaccaacatcgcgaaggcggcggcggggctcggcgccgcggcctccctcctctccgcgtcgctctacaccgtcgacggcggcgagcgcgccgtcatcttcgaccggttccgcggggtgctcccggagaccgtcaccgagggcacccacttcctcgtcccctggctccagaagccctacatcttcgacatccgcacgcgcccgcacaacttctcctcccactcgggcaccaaggacctgcagatggtcaacctcacgctccgcctgctctcccgccccgacgtcgaccacctccccaccatcttcacctccctcggcctcgagtacgacgacaaggtgctcccctccatcggcaacgaggtgctcaaggccgtcgtcgcccagttcaacgccgaccagctcctcaccgagcgcccccacgtctcggccctcgtccgcgacgcgctcatccgccgcgcccgcgagttcaacatcatcctcgacgacgttgccatcacccacctctcctacggtatcgagttctctcaggccgtcgagaagaagcaggtcgcccagcaggacgccgagcgctccaagttcctcgtcgccaaggcggagcaggagaggcgcgcggccatcgtgcgcgccgagggagagagcgagtctgcgcgcctcatatctgaggccaccgcgatggctggtgctgggctgattgagctgaggaggatcgaggcggccaaggagattgctgcggagctgtctcgctcgccaaatgtggcatacattcctgctggtgacaacggcaaaatgctgcttggtcttaatgctgccggatttggccggtgattcaccaatctgttttaattaagccttttgttgcttgagcatcttcctgcctgtgctatgctaaactgtggatcaaaagacaatgatatctgctacttttgcttaaatttcagttgtcttggaacgaa

SEQ ID NO: 4978 - DNA, 1164 bp, Triticum aestivum
gcacgagcaaaaacccgccactctcagatccgcacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagccttcatcttcgacatccgcacgcgcccgcacaacttctcctccaactcggggaccaaggacctgcagatggtcaactcacgctccgtctcctctcccgccccgacgtccagcacctccccaccatcttcacctccctcggactcgagtacgacgacaaagtgctcccctccatcggcaacgaggtgctcaaggccgtcgtcgcccagttcaatgccgaccagctcctcaccgaccgcccccacgtctccgccctcgtccgcgacgctctcatccgccgcgcccgcgagttcaacatcatcctcgacgacgtcgccatcacccacctctcctatggtatcgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcagagctggctcgctcaccgaatgtggcatacattccttctggggaaaacggaaagatgctgcttggtctcaatgctactggatttggccggtgattcactgtttttttagtctgcttgtgctatgtgctgatgcatgactaaaacggaggttcgaactttgaaggacagtgatatctgctatccttgcttatgttaagttttccttgtcttggaactaaatgtgtctgttgtgctccaaataagttttggtttttgactgcatatttgcaattggtagggtt

SEQ ID NO: 4979 - DNA, 1396 bp, Setaria italica
ctccgggcccacgcgccatgacacagaccgccgcttcggaccttcttatctcgcaagaaatgggcggacccaatgcgcacgcaataaacccccgcaaaaccactaaaagccacactcagatccgcacagcgccgccgccccccaaaccgaatccccctccttcccctcgctagggttttaccccccgcgccgccgcaccccccgaaatccccccaacccccgagagaggcgccatggccggcggtcccgctgcggtgtcgttcctgaccaacatcgcgaaggtggcggcgggtctcggcgccgcggcctccctcctctccgcgtcgctcttcaccgtcgacggcggcgagcgcgccgtcatcttcgaccggttccgcggcgtgctgccccagaccgtcagcgagggcacccacttcatcgtgccctggctccagaagccctacatcttcgacatccgcacgcgcccgcacaacttctcctccaactcgggcaccaaggacctgcagatggtcaacctcacgctccgcctcctctcccgccccgacgtcgaacacctccccaccatcttcacctccctcggcctcgagtacgacgacaaggtgctcccctccatcggcaacgaggtgctcaaggccgtcgtcgcccagttcaacgccgaccagctcctcaccgaccgcccccacgtctccgccctcgtccgcgacgccctcatccgccgcgcccgcgagttcaacatcatcctcgacgacgtcgcgatcacccacctctcctacggtatcgagttctcccaggccgtcgagaagaagcaggtcgcgcagcaggaggccgagcgctccaagttcctcgtcgccaaggccgagcaggagaggcgcgcggccatcgtgcgtgctgagggagagagtgagtccgcgcgcctcatctctgaggccacggcaatggctgggactgggctgattgagctcaggaggatcgaggcggccaaggagatagccgcggagctgtctcgctcgccgaacgtggcatacattcctgctggtgacaatggcaaaatgctgcttggtctcaatgcttctggatttggccggtgattcactagtctgtttttaagtaagccttttggtgcttgagcatctgcctgcttgtgctatgctatgcatgactaaaactgtggcttcaaagacagtgatatcaactctcgcttaaatttcagttgtctcggaacgaaatgtgttcgtcttgtgctacaaataagatctgggtctaaagtctgaacgcatttgtgatttgtctggttaatgcgacaaatagatgaattgttgaatctgcattctaattcttcagctgcaaatgctcttgttgatttcgttgctatctaattttgcaggaattggaaatc

SEQ ID NO: 4980 - DNA, 1359 bp, Zea mays
ggaacgggcacggactttgtggccacgaagcggcccattctcccagagtcaagtccaatttcaacgcaaaactcagacaagttttctttcttctctcccaagtcccaatccacaaaaactgtctacgggcccacgtgccatgacacagacccgccgcttccgaccttcttatctcgcaagaaatgggcggacctaacgcgcaagcgcaataaaacccctgcaaaaacccgccactctcagatccgcacagcgacgccgccagccagacccgatcccctccctcgctagggttttcgtccccgcgccgccgcgctcccggatcccaccgaaacaaccatggccggcggtcccgcggcggtgtcgttcctgaccaacatcgcgaaggtggctgcggggctcggagccgcggcctcgctcgcctccgcgtcgctctacaccgtcgacggcggcgagcgcgccgtcatcttcgaccgtttccgcggggtgctcccggagaccgtcggcgagggcacccatttcctcgtgccctggctgcagaagcccttcatcttcgacatccgcacgcgcccgcacaacttctcctccaactcggggaccaaggacctgcagatggtcaacctcacgctccgtctcctctcccgccccgacgtccagcacctccccaccatcttcacctccctcggactcgagtacgacgacaaagtgctcccctccatcggcaacgaggtgctcaaggccgtcgtcgcccagttcaatgccgaccagctcctcaccgaccgcccccacgtctccgccctcgtccgcgacgctctcatccgccgcgcccgcgagttcaacatcatcctcgacgacgtcgccatcacccacctctcctatggtatcgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcagagctggctcgctcaccgaatgtggcatacattccttctggggaaaacggaaagatgctgcttggtctcaatgctactggatttggccggtgattcactgtttttttagtctgcttgtgctatgtgctgatgcatgactaaaacggaggttcgaactttgaaggacagtgatatctgctatccttgcttatgttaagttttccttgtcttggaactaaatgtgtctgttgtgctccaaataagttttggtttttgactgca

SEQ ID NO: 4981 - DNA, 2086 bp, Oryza sativa
gtgaaaggcttgggccttatcagcgagcttgagcccatttataacggccgttctggtccaaatacgagcccattacacggtcttcgaatttcgcacggcccgttctggtcgaaacacaagacggcaagttttctttcttctgctccaaaccaagaaaaagacaatgggccaccacctgtcatacactcggaccggccgcaccttcttctctcccaagaaataaacccctccccacaaaacccactaaaaacacactcctcctcatcagatccacacccatcctccccaccccccaagcggcggcgagaccaaatcccccacttctctctcaatctctctctctgctagggtttatccctccgcgccgccgcccccggaagacgagagagcgccatggccggcggtcccgcggcggtgtcgttcctgaccaacatcgccaaggcggcggcggggctcggcgccgcggcctccctcctgtcggcgtcgctctacaccgtcgacggcggcgagcgcgccgtcatcttcgaccggttccgcggggtgctcccggagaccgtcggcgaggggacccacttcctcgtgccgtggctccagaagcccttcgtcttcgacatccgcacgcgcccccacaacttctcctccaactccggcaccaaaggaccctgcagatggtcaacctcacccttccggcctcctctcccccccccgacgtccgtgcacctccccaccatcttcacctccctcggcctcgagtacgacgacaaggtgctcccctccatcggcaacgaggtgctcaaggccgtcgtcgcgcagttcaacgccgaccagctcctcaccgagcggccccacgtctcagccctcgtccgcgacgccctcatccgccgcgcccgcgagttcaacatcatcctcgacgacgtcgccatcacccacctctcctacggcatcgagttctcgcaggccgtcgagaagaagcaggtggcgcagcaggaggccgagcgctccaagttcctcgtggccaaggctgagcaggagaggcgcgcggccatcgtgcgcgcggagggagagagtgagtccgcgcggctcatttctgaggccaccgccgccgctgggacagggctgattgagctgaggaggatcgaggcggccagggagattgctgccgagctggcccgttctcctaatgttgcatacgttcctgctggggacaatggccggatgctgctcggcctcaacgctgccgggttcggccggtgatccgtcactccaattttacccctttagttgcccaggcatccgctctgtgttacattaaactggaatgatggtatggggaattatgttatctgctacttttggtaatatttagtctggatgtctttgaacggaatgtgctaatctttgtgatccaaataagttctgggtctaagactcatttatgttttatgatttgtctgctgattaagctttatgttgctgttcaatacgcatgctagttatgcttcttcttgtttatggattgttcttatcattgcaggggtgtatctttggttactgatgttgccttgctgaattagcactgccttgacacttgcagggatgattatctagttgccctgtggcatctcgaatagtcatgtaccagttacctgacctttcggtgataatattctttgatttgtggctcatatgctgttgttcttaagcaaccgtgtcccgtagctcatctaattaacctggagtttgccagtgttacgggagtcaattttggatatggaatggcagtgcatagtcggttgatgctttgatatttgattttagcttcacaatgcgatttaggcatacattgtctaatttggtccattttattgttagagtttatccctaaaatttggtctatatatagctctttgatgcttgtgaagcactgacagattctgatagtatcgatacatgatgaaaatgttggattcatgttgataccatttatattttattatgacatgtaggatcagtgttaagctcttatgtacaatctgattgggattgcgttttggtcttagtattcataagtgttgggtggcgtatt

SEQ ID NO: 4982 - DNA, 1138 bp, Hordeum vulgare
cccaagcccgcaccgagaccaaatcctcgctagggttttactcccgcgccgccgcccgtccccaaatctcccccggaaaggccaccatggccggcggtcccgcggcggtctcgttcctcaccaacatcgccaaggcggcggcgggcctcggcgccgcggcctccctcctctccgcgtcgctctacaccgtggacggcggcgagcgcgccgtcgtcttcgaccggttccgcggggtgctgccggacaccgtcggcgagggcacccacttcatcgtgccgtggctccagaagccctacatcttcgacatccgcacccgcccgcacaacttctcctccaactccggcaccaaggatctgcagatggtaaacctcaccctccgcctcctctcccgccctgacgtcgtcaacctgcccaccatcttcacctccctaggcctcgagtacgacgacaaggtgctcccctccatcgggaacgaggtgctcaaggccgtcgtcgcccagttcaacgccgaccagctcctcaccgaccgcccccacgtctcggcgctcgtccgcgactccctcatcaaaagggcccgcgagttcaacatcatactcgacgacgtcgccatcacccacctctcctacggcgccgatttctcccaggccgtcgagaagaagcaggtcgcacagcaggaggctgagcgctccaagttcctcgtcgccaaggccgagcaggagaggcgcgctgccattgtgcgtgctgagggagaaagtgagtctgcacggctcatttctgaggccacagccatcgctgggacaggcctgatcgagctcaggaggatcgaggctgccaaggagatcgccgctgagctggcccgctcacccaacattgcctacatcccctctggtgacaacggcaacatgctgctcggcctcaacgctgctggaatgggcggccggtgatttaccactcccgttttacttgcccaaacatcatcttgcgtcatgaaggactaaactgtggtttggagagacaatgctatctgttgctgtaggtcttgttaagtttgattctcctgggacaaaatctggcagtctttgatccaaataaggtctgggtctggatatctcatttatgatttgccagattaagcttt

SEQ ID NO: 4983 - DNA, 1452 bp, Hordeum vulgare
ttcacacagaccccaccgtctagcttcttctctcccaagaaataaacccaaacaaaacccacaggtggtcagatccagccccccattcccctccccaagcccgcaccgagaccaaatcctcgctagggttttactcccgcgccgccgcccgtccccaaatctcccccggaaaggccaccatggccggcggtcccgcggcggtctcgttcctcaccaacatcgccaaggcggcggcgggcctcggcgccgcggcctccctcctctccgcgtcgctctacaccgtggacggcggcgagcgcgccgtcgtcttcgaccggttccgcggggtgctgccggacaccgtcggcgagggcacccacttcatcgtgccgtggctccagaagccctacatcttcgacatccgcacccgcccgcacaacttctcctccaactccggcaccaaggatctgcagatggtaaacctcaccctccgcctcctctcccgccctgacgtcgtcaacctgcccaccatcttcacctccctcggcctcgagtacgacgacaaggtgctcccctccatcgggaacgaggtgctcaaggccgtcgtcgcccagttcaacgccgaccagctcctcaccgaccgcccccacgtctcggcgctcgtccgcgactccctcatcaaaagggcccgcgagttcaacatcatactcgacgacgtcgccatcacccacctctcctacggcgccgatttctcccaggccgtcgagaagaagcaggtcgcacagcaggaggctgagcgctccaagttcctcgtcgccaaggccgagcaggagaggcgcgctgccattgtgcgtgctgagggagaaagtgagtctgcacggctcatttctgaggccacagccatcgctgggacaggcctgatcgagctcaggaggatcgaggctgccaaggagatcgccgctgagctggcccgctcacccaacattgcctacatcccctctggtgacaacggcaacatgctgctcggcctcaacgctgctggaatgggcggccggtgatttaccactcccgttttacttgcccaaacatcatcttgcgtcatgaaggactaaactgtggtttggagagacaatgctatctgttgctgtaggtcttgttaagtttgattctcctgggacaaaatctggcagtctttgatccaaataaggtctgggtctggatatctcatttatgatttgccagattaagctttctggtggtgacgtggtgttgaatttgcatgctagttatgcttatgatgtttgcttgtttgatatcattgttttctaacgctgcaggggttgcttgcattagccacaactacttattgatgttgcctggttgcacttttcttgctatttcatggatgctatctttgttttaggaagcactggattttgtgtattctgtattgccctgtggtttcttaggctc

SEQ ID NO: 4984 - DNA, 1935 bp, Brachypodium distachyon
gacgcccacagtctagcttcttctctcccaagaaatacccacacaaaaccactactccaacacacacaaacggtcagatccggccgcccccaaactccccaagacaagcacacagagaccaaatcctctctagggttttactcccgcgccgccgtcctaaaatctccccacccaaaaggcgaccatggccggcagtcccgcggcggtgaagttcctgaccaacatcgccaaggcggcggctgggctcggcgtcggggcctccctcctctcggcgtcgctctacaccgtcgatggcggcgagcgcgccgtcgtcttcgaccggttccgcggtgtgctgccggacaccgtcggcgagggcacccacttcatcgtgccctggctccagaagccctacatcttcgacatccgcacgcggccgcacaacttctcctccaactccggcaccaaggacctgcagatggtaaacctcacgctccgcctcctctcccgccccgacgtcgccaacctgcccaccatcttcacctccctcggcctcgagtacgacgacaaggtcctcccctccatcggcaacgaggtgctcaaggccgtcgttgcgcagttcaacgccgaccagctcctcaccgaccgcccccacgtctcggcgctcgtccgcgactccctcatcaaaagggcccgcgagttcaacatcatactcgacgacgtcgccatcactcacctctcctacggcatcgagttctccctggccgtggagaagaagcaggtcgcgcagcaggaggccgagcggtctaagttcctcgtcgccaaggcagaacaggagaggcgtgccgctatcgtgcgtgctgagggagagagtgagtctgcacggctcatttctgaggccacggccatcgctgggactggactgatcgagctgaggaggatcgaggctgccaaagagatcgcagcggagctcgctcgctcgccgaatgttgcctacatcccctctggtcagaacggccaaatgctgcttggtctcaacgctgccgggtttggcggccggtgatttagcactcccgttttactcctttatcagttgcccaaacaggtgtcttgcgttatgagggactaaaactatggtttggagaacaatgatatctgttattctaggtggcattatgtttgagtgccatgggacgaaatgtggtagtcttttgatccaaataaggtctgggtctggatatctcgtatgatttgtcggattaagctttctggtgttgtggaatctgcatgctgcttatgcttataatgtttgcttgtttcgatttatcgttcttaatgtcacagggttgtatgtttgattttgtagttacttaactaatgttgccttattgcagttcggtcaactgttttatggatgccatctttgtttcgaaatcactagattctgtgtattgtcctgtcatatcttgaatggattttccttagaagaattgaatgcccaagggactaagaggtgacggtgcttttgctgttgatagtgtccatgttctgaattgttgttttgaagctttttagctccttcgtcttggagtttgcttctcttgtgttttacaagtcaattctggatatgatatgccagtgggtggcaggttgatgctgtcatgttttttttagctcaacagtatggtttgttatggcatggtcgaatattagccttttaggtgatagttttcttcttctggaactcatgaattgttatttagaagaaatttagctcttgtgaagcaatgcatccatttaacttctgtgtttgctttcctcatgttaaattaaaacttgaaagagccacttctggataagataatgtgagtggacagtagattgagatcctgatgttcaatttagctcgccactatgattatgccttttctcataaggtctagtgcactgttggag

SEQ ID NO: 4985 - DNA, 1242 bp, Brachypodium distachyon
ctccccaagacaagcacacagagaccaaatcctctctagggttttactcccgcgccgccgtcctaaaatctccccacccaaaaggcgaccatggccggcagtcccgcggcggtgaagttcctgaccaacatcgccaaggcggcggctgggctcggcgtcggggcctccctcctctcggcgtcgctctacaccgtcgatggcggcgagcgcgccgtcgtcttcgaccggttccgcggtgtgctgccggacaccgtcggcgagggcacccacttcatcgtgccctggctccagaagccctacatcttcgacatccgcacgcggccgcacaacttctcctccaactccggcaccaaggacctgcagatggtaaacctcacgctccgcctcctctcccgccccgacgtcgccaacctgcccaccatcttcacctccctcggcctcgagtacgacgacaaggtcctcccctccatcggcaacgaggtgctcaaggccgtcgttgcgcagttcaacgccgaccagctcctcaccgaccgcccccacgtctcggcgctcgtccgcgactccctcatcaaaagggcccgcgagttcaacatcatactcgacgacgtcgccatcactcacctctcctacggcatcgagttctccctggccgtggagaagaagcaggtcgcgcagcaggaggccgagcggtctaagttcctcgtcgccaaggcagaacaggagaggcgtgccgctatcgtgcgtgctgagggagagagtgagtctgcacggctcatttctgaggccacggccatcgctgggactggactgatcgagctgaggaggatcgaggctgccaaagagatcgcagcggagctcgctcgctcgccgaatgttgcctacatcccctctggtcagaacggccaaatgctgcttggtctcaacgctgccgggtttggcggccggtgatttagcactcccgttttactcctttatcagttgcccaaacaggtgtcttgcgttatgagggactaaaactatggtttggagaacaatgatatctgttattctaggtggcattatgtttgagtgccatgggacgaaatgtggtagtcttttgatccaaataaggtctgggtctggatatctcgtatgatttgtcggattaagctttctggtgttgtggaatctgcatgctgcttatgcttataatgtttgcttgtttcgatttatcgttcttaatgtcacagggttgtatgtttg

SEQ ID NO: 4986 - DNA, 1190 bp, Triticum aestivum
ccgggggcggcgcttttcccctccccaagcccgcacccagacgaaatccctcgctagggttttactcccgcgccgccgtcccgaaatcccccccggaaggcgaccatgtccggcggtcccgcggcggtctcgttcctcaccaacatcgccaaggcggcggctggcctcggcgccgcggcctccctcctctcggcgtcgctctacaccgtggacggcggcgagcgcgccgtcgtcttcgaccggttccgcggagtgctgccggataccgtcggcgagggcacccacttcatcgtgccgtggctccagaagccctacatcttcgacatccgcacgcgcccgcacaacttctcctccaactccggcaccaaggacctgcagatggtaaacctcaccctccgcctcctctcccgccccgacgtcgtcaacctgcccaccatcttcacctccctcggcctcgagtacgacgacaaggtgctcccctccatcgggaacgaggtgctcaaggccgtcgtcgcccagttcaacgccgaccagctcctcaccgaccgtccccacgtctcggcgctcgtccgcgactccctcatcaaaagggcccgcgagttcaacatcatactcgacgacgtcgccatcacccacctctcctacggcgccgatttctcccaggccgtcgagaagaagcaggtcgcgcagcaggaggctgagcgctccaagttcctggtcgccaaggccgagcaggagaggcgcgctgccatcgtgcgtgctgagggagaaagtgagtctgcacggctcatttctgaggccaccgccatcgctgggacagggctgatcgagctcaggaggatcgaggctgccaaggagatcgccgcggagctggcccgctcacccaacgttgcctacatcccctctggtgacaacggcaagatgctgctcggcctcaacgctgctggattcggcggccggtgatttaccactcctgttttacttgcccaaacatcatcttgcgtcatgacggactaaactatggtttggagagacaatgatatctgttgctgtaggatcttattaagtttgaatgtcttgggacaaaatctggtagtcttttgatccaaataaggtctggatctggatatcttgcttatgatttgtcagattaagctttctggtggtgttgaatttgcatgctagttacg

SEQ ID NO: 4987 - DNA, 1524 bp, Triticum aestivum
gcaccgtctagcttcttctctcccaagaaataaacccaaacaaaacccacaggcagtcagatccagccgccccccaccccccattcccctcccaaagcccgcacccagacgaaatcctcgctagggttttactcccgcgccgccgtcccgaaatcccccccggaaggcgaccatgtccggcggtcccgcggcggtctcgttcctcaccaacatcgccaaggcggcggctggcctcggcgccgcggcctccctcctctcggcgtcgctctacaccgtggacggcggcgagcgcgccgtcgtcttcgaccggttccgcggggtgctgccggagaccgtcggcgagggcacccacttcatcgtgccgtggctccagaagccctacatcttcgacatccgcacgcgcccgcacaacttctcctccaactccggcaccaaggacctgcagatggtaaacctcaccctccgcctcctctcccgccccgacgtcgtcaacctgcccaccatcttcacctccctcggcctcgagtacgacgacaaggtgctcccctccatcgggaacgaggtgctcaaggccgtcgtcgcccagttcaacgccgaccagctcctcaccgaccgtccccacgtctcggcgctcgtccgcgactccctcatcaaaagggcccgcgagttcaacatcatactcgacgacgtcgccatcacccacctctcctacggcgccgatttctcccaggccgtcgagaagaagcaggtcgcgcagcaggaggctgagcgctccaagttcctggtcgccaaggccgagcaggagaggcgcgctgccatcgtgcgtgctgagggagaaagtgagtctgcacggctcatttctgaggccaccgccatcgctgggacagggctgatcgagctcaggaggatcgaggctgccaaggagatcgccgcggagctggcccgctcacccaacgttgcctacatcccctctggtgacaacggcaagatgctgctcggcctcaacgctgctggattcggcggccggtgatttaccactcctgttttacttgcccaaacatcatcttgcgtcatgacggactaaactatggtttggagagacaatgatatctgttgctgtaggatcttattaagtttgaatgtcttgggacaaaatctggtagtcttttgatccaaataaggtctggatctggatatcttgcttatgatttgtcagattaagctttctggtggtgttgaatttgcatgctagttacgcacttatgcttatgatgtttgctcgtttgatttcattgtttcgaacgctgcagttgttgctttgcatcagtcaggactacttattgatgttgcctgcttgcacatttcttgcctttcatggatgccatctttgttttagaaagttaggcgctgcttcaaaaatataattcttaggaggctttagaattggcagtgctatgtctggttgcatattaggcctgcttgttctgcaactgatgtactgccatttagtagctttagctcatt

SEQ ID NO: 4988 - DNA, 1113 bp, Pseudoroegneria spicata
  misc_feature (63)..(63): n is a, c, g, or t
  misc_feature (69)..(69): n is a, c, g, or t
  misc_feature (76)..(76): n is a, c, g, or t
  misc_feature (81)..(82): n is a, c, g, or t
  misc_feature (97)..(97): n is a, c, g, or t
  misc_feature (99)..(100): n is a, c, g, or t
  misc_feature (103)..(103): n is a, c, g, or t
  misc_feature (118)..(118): n is a, c, g, or t
  misc_feature (121)..(121): n is a, c, g, or t
  misc_feature (124)..(125): n is a, c, g, or t
  misc_feature (130)..(130): n is a, c, g, or t
  misc_feature (135)..(135): n is a, c, g, or t
  misc_feature (139)..(139): n is a, c, g, or t
  misc_feature (142)..(142): n is a, c, g, or t
  misc_feature (145)..(146): n is a, c, g, or t
  misc_feature (148)..(148): n is a, c, g, or t
  misc_feature (152)..(155): n is a, c, g, or t
  misc_feature (160)..(160): n is a, c, g, or t
  misc_feature (163)..(165): n is a, c, g, or t
  misc_feature (172)..(173): n is a, c, g, or t
  misc_feature (187)..(187): n is a, c, g, or t
  misc_feature (190)..(190): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (212)..(212): n is a, c, g, or t
  misc_feature (223)..(223): n is a, c, g, or t
  misc_feature (228)..(229): n is a, c, g, or t
  misc_feature (232)..(232): n is a, c, g, or t
  misc_feature (235)..(235): n is a, c, g, or t
  misc_feature (238)..(238): n is a, c, g, or t
  misc_feature (243)..(243): n is a, c, g, or t
  misc_feature (245)..(246): n is a, c, g, or t
  misc_feature (251)..(253): n is a, c, g, or t
  misc_feature (268)..(269): n is a, c, g, or t
  misc_feature (274)..(274): n is a, c, g, or t
  misc_feature (277)..(277): n is a, c, g, or t
  misc_feature (294)..(294): n is a, c, g, or t
  misc_feature (296)..(296): n is a, c, g, or t
  misc_feature (324)..(324): n is a, c, g, or t
  misc_feature (336)..(336): n is a, c, g, or t
  misc_feature (343)..(343): n is a, c, g, or t
  misc_feature (352)..(352): n is a, c, g, or t
  misc_feature (364)..(364): n is a, c, g, or t
  misc_feature (366)..(366): n is a, c, g, or t
  misc_feature (373)..(373): n is a, c, g, or t
  misc_feature (439)..(439): n is a, c, g, or t
cctccccaagccagcaccgagaccaaatcctcgctagggttttactcccgcgccgccgtcccnaaatcncccccgnaaggnnaccatggccggcggncnngcngcggtctcgttcctnacnaanntcgcnaaggnggcngcnggnntnggcnnnncggcntcnnncctctcnncgtcgctctacacngtngacggcggcnancgngcngtcntcttcgaccgnttccnnggngtnctnccggngnncgtcnnngagggcacccacttnntcgtnccntggctccagaagccctncntcttcgacatccgcacgcgcccgcacancttctcctccanctccggnaccaagganctgcagatggtnancctcacnctccgcgtcctcgcccgccccgatgtggaacgccttcctgaaatcttcaccaacctcggcctcgantacgacgacaaggtgctcccctccatcggcaacgaggtgctcaaggccgtcgtcgcccagttcaacgcagaccagctcctcaccgaccgtccccacgtctctgccctcgtccgtgaagccctcgtccgccgcgccggcgagttcaacatcgtgctcgatgacgtcgccatcacccacctcgcctacgggcacgacttcgcccaggccgttgagaagaagcaggtcgcgcagcaggaggctgagcgctccaggttcctcgttgcgcgtgcagagcaggagaggcgtgctgctatcgttcgcgcggaaggagagagcgagtccgcacggctcatctcagatgccaccgctcttgtaggcaatggcctgatcgagctcaggaggatcgaggctgccaaggagatagctggggtgattgcgcgctcacccaatgtttcctacatcccttccggcaacaacagccagatgctgcttgggctcagcactgcccgttgaatgaattgccacttatcttccagttgatcacagtactctagtcacttcagatgcccaattatccttcacttgattacaatacttgaataacttcagatgcttcgacatattagttatgattttacgattttatcgtagagtggagacttttattatggaggagtcattgaacaaatgttgta

SEQ ID NO: 4989 - DNA, 1215 bp, Secale cereale
cccgcaccgagaccaaatcctcgctagggtttactcccgcgccgccgtcccgaaatcccctccggtaggcgaccatgtccggcggtcccgcggcggtctcgctcctcaccaacatcgccaaggcggcggcgggcctcggcgccgcggcctccctcctctcggcgtcgctctacaccgtggacggcggcgagcgcgccgtcgtcttcgaccggttccgcggagtgctgccggacaccgtcggcgagggcacccacttcatcgtgccgtggctccagaagccctacatcttcgacatccgcacgcgcccgcacaacttctcctccaactccggcaccaaggacctgcagatggtaaacctcaccctccgtctcctctcccgccccgacgtcgtcaacctgcccaccatcttcacctccctcggcctcgagtacgacgacaaggtgctcccctccatcgggaacgaggtgctcaaggccgtcgtcgcccagttcaacgccgaccagctcctcaccgaccgcccccacgtctcggcgctcgtccgcgactccctcatcaaaagggcccgcgagttcaacatcatactcgatgacgtcgccatcacccacctctcctacggcgctgatttctctcaggccgtcgagaagaagcaggtcgcgcagcaggaggctgagcgctccaagttcctggtcgccaaggccgagcaggagaggcgcgctgccattgtgcgtgctgagggagaaagtgagtctgcacggctcatttctgaggccaccgccatcgcagggacagggctgatcgagctcaggaggatcgaggctgccaaggagatcgccgcggagctggcccgttcacccaacgttgcctacatcccctctggtgacaacggcaagatgctgctcggcctcaacgctgctggattcggtggccggtgatttaccactcccgttttacttgcccaaacatcatcttgcgtcatgacggactaaactatggtttggagagacaatgatatctgttgctgtaggatcttgttaagtttgaatatcttgggacaaaatctcgtagtctttgatccaaataaggtctggatctggatatcttgcttatgatttgtcagattaagctttctggtggtgttgaatttgcatgctagttacgcttatgatgctttggctttagtttgactttcagtttgggggttgaccttggacaaat

SEQ ID NO: 4990 - DNA, 1081 bp, Avena sativa
cggaaggcgaccatggccggcggtcccgcggcggtcaagttcctgaccaacatcgccaaggcggcggcggggctcggcgccgccggctccctcctctcggcgtcgctctacaccgtcgacggcggcgagcgcgccgtcatcttcgacaggttccgcggggtgctgcccgacaccgtcggcgagggcacccacttcatcgtgccctggctccagaagccctacatcttcgacatccgcacgcgcccccacaacttctcctccaactccggcaccaaggacctgcagatggtaaacctcaccctccgcctcctctcccgccctgacgtcgtcaacctgcccaccatcttcacctccctcggactcgagtacgacgacaaggtcctcccctccatcgggaacgaggtgctcaaggccgtcgtcgcccagttcaacgccgacgagctcctcaccgaccgccccgtcgtctcggcgctcgtccgcgaatccctcatcaagagggcccgcgagttcaacatcatactcgacgatgtcgccatcacccacctctcctacggcatcgagttctccctggccgtcgagaagaagcaggtcgcgcaacaggaggccgagcgctcaaagttcctcgtcgccaaggccgagcaggagaggcgtgctgccattgtgcgcgccgagggagaaagtgagtctgcacgcctcatttctgaggccaccgccatcgctgggactgggctgatcgagctcaggaggatcgaggctgccaaggagatcgctgccgagctggcacgctcacccaatgttgcctacattccctctagcgacaatggcaagatgctgctcggcctcaatgccgccgggtttggtggccggtgatttactactcttgtgttttactccttcaagttgcccaagcaacatattgtgttatgatgaggtactaaaactatgggttggagaacaattatctgttattctaggttgtgttaatgtctgtcttgggacaaaatgtggtagcctctgatccaaataaggtctgggtctggacatctatgatttgtcagattaagcttttttatggtgttgt

SEQ ID NO: 4991 - DNA, 1480 bp, Saccharum officinarum
acgaacacgcccgcgccagcccagcagagagggatcccgtcccgcatccatggaggtggtgggcggcgtgtcgctgaggccgtcgccagcgccggcgcgtatccggaccaccctgtcatcagtcgacgtaggcggacgcctcgctctcagggccccaggggcgccgcggggccagctgccggcgaggcgcgcgctggtagtggaggctcgggggaggagctggtcggaacggcagatgcagcagcagcggcgcatgccgcagctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagatgaggatgagattatagacacagcaaaagagcagtaccgggtgctgaagaccgaaaatgagtttcggtatggctacaaagttgtggagaaagggaacataaggtctgctctgacgacaagcaatgtgattgaacttccaaagaaagacgagctcaaaactgtggtcgacaaggtgaaggacttctttggcgatgtaactgctggcgccaaagaatcctttgcacagataacagggtctgctgtcagcaaagaggaagaggaagcagaaagcaaagagaagttccgctccaggagacgaaagaagcagcggaagtcaaaggagggcctcaagacggagaagtgattcagtcactcagcacattgtcagacaagtaaggggctgtttagttggcaaaatttttggcgaaacgctactgtagcagtttcgttgttatttggtaaatattgtccaatcatggtctaattaggcttaaaagatttgtctcgtccatttcgtctaaactgtgtaattagttttattttttatctatatttaatgcttcatgcatgtgttcaaagattcgatatgacggggaatctgaaaattttggcaaaatttttggcataacggtgcccaagcctagatgtacgtaccgtcctatggccgtatcttatgcagatgagatactcccttgccacaccagctgaactgcgaagcgaggatcccgctcctgctcgaagcggacagtcatggctcatcatcgcggagtcagggtcacgggactaccgggaacgaatcagattccgatcaccggtcatggtcggtctgcggggcctgccctcgtcgcgggagcatttctcggagatccgaaagaccggcgcaagcatgatgcatcgatcggctgcgatgacgcagggaggatgccggaggcgggggtgcggacaaccgcttgcgagcgggatccagtcatccagaggcgccctcgcgcggtcgcgcccctcttgtgttgactcttcccgtggcccgtacaccggggct

SEQ ID NO: 4992 - DNA, 1088 bp, Pennisetum glaucum
ccagataagctgcttgctttatcttctcccggtccctcgagggaacacgcagcagctccaagcagcgaggaatccatggaggtcgtgggcggcgtctcgctgaggccgccgtcggcgcgcatcgggcagctttcgcccgtcgacgtgggcgggcgcttcttgctcagggcggcgccgcggaggcagccggccgcgaggcgcgtgctggtggtggaagcccgggggaggaactggtcggagcggcagatgcagcagcagcggcgcatgccgcagctccccaagatcgaggacgacggcaacccgcgcttcgtgatcttcatccgcaccgccaatgtctacttctggtacccgctcaacatcatcaccggcggcacgacggcgaagatcatgctcgccgccaaggacaacttcctcggcaagtacatatacaaggacacgctcgccaggaacctcgctgccgtcatttacaaggatgaggatgagattatcgacaccgcaaaagagcagtaccgtgtgttgaagaccgaaaatgagtttagatatggctacaaagttgtggagaatgggaacgttaggtctgcgcttgccacaagtaatgtgatcgaacttccaaagaaagacgagctcaaaaccgtggttgacaaggtgaaagacttctttggtgacgttaccagtggcgctaaagaatccttcgcgcagatcacaggatctgctgtaaccaaagaggacgaggaagcagaaggcaaagggaagttccgctcaaagaggcgaaagaagcagcggaagtcgaagcaggggctcaaaacggagaaatgattgtatcactcagcagtcagcacacatgagggatcgttagaaaagtgaagcaccggccggagttttgttatctatgtccagagttactgtgtaatttgtcgagaatttttttttcaaagaatgtgtaacctcattgcgactaacgtgctatgacttctcactaaagctcgcaaaattgggtgaaggttacagctgtatattaatttcttggaagttccaaagttgtacagtgcggatacgaattgttcatatatcaattgaatttcttttgt

SEQ ID NO: 4993 - DNA, 1074 bp, Panicum virgatum
acgcgcagcgccaggcagcgaggcatcatccatggaggtggtgggcggcgtgtcgctgaggccgccgtcggcgcaggcgccggcgcgcatctggcagctgtcgtccgtcgacgtcggcgggcggtgcttcgtcctcagggcggcgccgcggaggcagccggcgaggcgcgcgctggtggtggaggcccgggggaggagctggtcggagcggcagatgctgcagcagcgccgcgcgccgcagcttcccaaggtcgaggacgacggcaacccgcgcttcgtcatcttcatccgcaccgccaatgtctacttctggtacccgctcaacgtcatcaccggcggcacgacggcgaagatcatgctcgccgccaaggataacttcctcggcaagtacatctacaaagacacgctcgccaggaacctcgctgccgtcatctacaaagatgaggatgagattatcgacacggcaaaagcgcaataccgtgtgctgaagaccgaaaacgagtttcgatatggctacaaagttgtggagaatggaaacattaggtctgcgcttacgacaagtaatgtgatcgaacttccaaagaaagacgagctcaaaactgtggttgacaaggtgaaggacttctttggagacgtaaccgctggagccaaagaatcctttgcacagatcacaggaactgctgaaaccaaagaagaggaagcagaaggcaaagaagagaagttccgctcaaagagacgaaagaagcagcggaagtcgaagcagagactcaagacggagaaatgattgtgtcactcagcacatcaggggtcgtcagacaagtgaagcacaggctgaagttttgccatctatgtcccggagttgctctttaatttctccagattttattttattttatttttgcaaagagacaatgtgtaacctccttgcgactaacgagtgtaatgacttctcactacatctcacaaaattcggtgaaggttgcaggtcttgcagctgtatattgatttaatttcttgggagttgaaagtgagttgttgtacagtgcggatatgaattgtatcttgttgcagttg

SEQ ID NO: 4994 - DNA, 953 bp, Sorghum bicolor
aggtgctgggaggagctgttgccggacgcgctgggcctcatcttccgcaacctgccgctgcaggagatgctcaccgtcgtgccgcgggtgtgcaagtcctgggggcgggtggtcgccggcccctactgctggcaggagatcgacatcgaggagtggagccagcagcagagcaagccggaccagatcggccgcatggtcgagctactcatcggccgcagcggcggctcgtgccgccggatcagcgtctccgggctgccctgcgatccgctcttctcgttcatcggagacaagtaagcgtgaaatctggcaatgctctgttggagattcccaggagtgagatcagcgactcgatcgtagaaaccgtggcgccgcggctatcaaacgtcactttcctagacatcagcagctgcaccaagatcggagcccgtgccctggaggctttcggcaagcactgcaagtccctggtggggctccggcgggtgatgcacccgatcgacctggtggacaaggtgtgccagcacgacgaggcgcacgccatcgcgtgcagcatgcccaagctccggcacctggagatggggtacatgctgatcgcgacggaggcggtgctggagatcctggggcagtgccgcgacctcaagttcctggacctgcgcggctgctggaccgtggacgacaagttcctgcgggagcgccacccggggctccgcgtcctgggcccgcgcgtcgacgactgctacgagaacagctactgggaggagtgctccgactactcggacgactcctccatctactcgtgggagttcatggacgacgactactacgccgtcggaagcgacgacgaggccatctgggacgacgggcagggactggagaacctcgaggtgaggttctacggcggcggattcagcgagagcttcgccggcttcgactggccaccgtcgccgtgagacctt

SEQ ID NO: 4995 - DNA, 1351 bp, Setaria italica
caatctgagctgcggcagttcatcttggtagttgaagcattcattcgtcaatcataatggatagcttgtaaggccggtcctttcactcgctgcaggggaagggaagggagtgatgggggagtgcgaggacgccgaggagtacaggtgctgggaggagctgttgccggacgcgctgggcctcatcttccgcaaccttccgctccaggaggtgctcaccgtcgtgccgcgggtgtgcaagtcctggggtcgggtggtcgccggcccctactgctggcaggagatcgacatcgaggagtggagccagcagcagagcaaaccggagcagatcggccgcatggtcgagatgctcgtcggccgcagcggcggctcgtgccgccgcatcagcgtctccgggcttccctgcgacccgctcctctcgttcataggagaccgcgcgcgagctcttcgggccctggagattccacggagcgagatcagcgactccatcgtggagaccgtggcgccgcggctctccaacgtcaccttcctggacatcagcagctgcaccaagatcggcgcccgcgccctggaggcgttcggcaagcactgcaagtccctggtggggctccggcgcgtgatgcacccgatcgacctggtggacaaggagtgccagcacgacgaggcccacgccatcgcccgcagcatgcccaagctccggcacctggagatggggtacatgctgatccggacggaggcggtggcggagatcctggggcagtgccgcgacctcaagttcctggacctgcgcgggtgctgggccgtggacgacaagctcctgcgggagcgccacccggggctccgcgtcctgggcccgcgcgtcgaggactgctacgagaacacctactgggaggagtgctccgactactcggacgacgactcctccatctactcgtgggagttcatggacgacgtcgacggctactacgccgtcggcagcgacgacgaggccatctgggacgacggccaggggctcgagaacctcgaggtcaggttctacggcggcgggttcagcgagagcttggccggcttcgactggccaccgtcgccgtgagatagatggcagcatatgcagttcttcttgcttctactgtatgtgtgcgtgtgtgcgtgtgctgttcctgagcttgcagctatgttgttgctgtactgtgtctgcgacaccactcgatctccccctctagcttgcagatatgtgttaagtggactgctgctaatagtacaatctagatgatgtaaactctggtgtttacatggagcaaatcaacatgcatcggtgagatttcaccggcgcaaatcaacactctgatctctg

SEQ ID NO: 4996 - DNA, 1847 bp, Panicum virgatum
gccttcttcagtctcctccttgtaccggcggccattctcccttgcagtgtcgccctctctctctcgattctctctccagtccagccggggcagtcccccctccatcaggtgttgcctcctgcagatccaaattggaatttgggccttcgtctccacatcaccaatccggtaaatacgggcaataaaccgcttccccccggatcctgacgctgtttcttgctgttttctctcgcaaattattatgggaagggaaagattatattcttcttccccttttgctttgctgagcccaaaaggctgaagcttttgcgttcttccccacaaatatctggagccatgccttttgttcggtttggccatggggtgaaatagtatgtgggatggccaccaattggcatgctgcccttttttcatccctgcaactgcaagaggccttctttttagatctgtgccttcctcttcctggctgccttctttgggtttgctcgcagcaaacacaagccattttactgcttggaggctgccacttttagtagctctggctcttgagtgatctccaaggggagggagggggaggggagtgatggggaagtgcgaggactcggaggagtacaggtgctgggaggagcttctgccggacgcgctgggcctcatcttccgcaacctgccgctccaggaggtgctcaccgtcctgccgcgggtgtgcaagtcctggggccgggtggtcgccggcccctactgctggcaggagatcgacatcgaggagtggagccagcagcagagcaagccggagcagatcggccgcatggtcgagctgctcgtcggccgcagcggcggctcgtgccgccgcatcagcgtctccgggctgccctgcgacccgctcctctcgttcataggagaccacgctcgagctcttcgcgccctggagattccacggagcgagatcagcgactccatcgtggaaactgtggctccccggctatccaacgtcaccttcctggacatcagcagctgcaccaagatcggggctcgcgccctggaggctttcggcaagcactgcaagtccctggtggggctccggcgggtgatgcacccgatcgacctggcggacaaggagtgccagcacgacgaggcccacgccatcgcgtgcagcatgcccaagctccggcacctggagatggggtacatgctgatcacgacggaggcggtggcggagatcctggggcagtgccgcgagctcaagttcctggacctgcgcggctgctgggccgtggacgacaagctcctgcgggagcgccacccggggctgcgcgtgctgggcccgcgcgtcgaggactgctacgagaacagcttctgggaggagtgctccgactactcggacgacgacgacgactccatctactcgtgggagttcatggacgacggcgacggctactacgccggcgtcggcagcgacgacgaggccatctgggacgacggccagggcctcgagaacctcgaggtcaggttctacggcggcggcttcagcgagagcttcgccggcttcgactggccgccgtcgccgtgaccgtgagatcaccgcagcagttaattagttgttcctgcttgctttctttctttctactctgtgcgcgtgcgcgtgtgttgttcgttcctgagctgagcttgcagatatgtcgctgcaccaccgagtttgcgacatcgctacttcatctcctcctccctctccatctagcttgcagatatgttaagtggactgctaatagtagtacaatctagatgtaaactctggtgtttacatgaagcaaatcaacatgcgtcggtgagatttcaccgttccattctag

SEQ ID NO: 4997 - DNA, 1095 bp, Pennisetum glaucum
ccttcgcttgcttcttggataggttgccttctttggggtttgctcacagcatacacaagccattttgttgcttggtggctgccacttttagcatctcgggctcttgagtgatctccaaggggagcggaagagaagggagtgatgggggagtgcgaggacgcggaggagtacaggtgctgggaggagctcttgccggacgcgctgggcctcatcttccgcaacctgccgctacaggaggtgctcaccgtcgtgccgcgggtgtgcaagtcctgggggcgggtggtcgccggcccctactgctggcaggagatcgacatcgaggagtggagccagcagcagagcaagccggagcagatcggccgcatggtcgagctgctcgtcggccgcagcggcggctcgtgccaccgcatcagcgtctccgggctgccctgcgacccgctcctctcgttcatcggagagcacgcgcgagctcttcgagccctggagatcccacggagcgagatcagcgactccatcgtggagaccgtggcgccgcggctgtccaacgtcaccttcctcgacatcagcagctgcaccaagatcggcgcccgcgccctggaggcgttcggcaagcactgcaagtccctggtgggtctccggcgcgtgatgcacccgatcgacctggtggacaaggagtgccagcacgacgaggcccacgccatcgcccgcagcatgcccaagctccggcacctggagatggggtacatgctgatcaggacggaggcggtggcggagatcctggggcagtgccgcgacctcaagttcctggacctgcgcgggtgttgggccgtggacgacaagctcctgcgggagcgccacccggggctccgcgtcctgggcccgcgcgtcgaggactgctacgagaacacctactgggaggagtgctccgactactcggacgacgactcgtccatctactcgtgggagttcatggacgacgtcgacggctactacgccgtcggcagcgacgacgaggccatctgggacgacggccaggggctcgagaacctcgaggtcaggttctacggcggcgggttcaacgagagcttcgccggc

SEQ ID NO: 4998 - DNA, 1599 bp, Zea mays
ttttttttcccttctcgaggacgaggacacacgcacacacggaagaagccactagctctccgcagtccgctctcgcctctcggccttctccttgtgccgccgaacaccctcacaagagtcggcctctcgatttctcagtccagccgcagcagcccccttccctccctcctccatcaggtgttgcctcccgcagatccaagtcggaattcggtccttcgtccccaaaccaccaatccggttgcattctttgggtttgctcacagcgcacacaaagccattttactgctgggaatggtggctggcacttagcgtctccggctcttgagtgatctccaagggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagagcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatcggggcccgcgggctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccgccggcagcgacgacgacgaggccgtctgggacgacgacggccagggcctggagaacctcgaggtcaggttctacggcggtggcttcggcgagaccttcgccggcttcgactggccgccgtcgccgtgacatgacgcctgctgcctgcgcttgcgctgcgtgcgtgggtgggtgagcctttgtgtgttgtccccaagctttgggttgctgtgctgctgtagtactgtgcctgcgacatcactcgatcttcctctacctcgcagatatgccatatgtgaagcgaactgctagtggtgcaatctaaaatgtagacgctggtgtttacatgaagcaatccccatcagcatgcaccggtgagattccaccggtgccaatccccatcc

SEQ ID NO: 4999 - DNA, 2167 bp, Zea mays
gccgtgcaatatctgcggattgcagctgcatccactgcgcgccgcgcgtttttttttctctcctcctcgacaacgagaagtcgagaacacacacgcacatacggaacggaagctactagcccgcagccttcttcagtctcccgtcttcttctggtgcccaacacatcctcattctcagggtcgccctctcgattctccctcaagtccagtccagccggatcagtccccttcccctcctccacaaggtgccgcctcccgcagatccgaattggaatctgggccttcgtctccgcaccaccaatccggtaaatatacgcgggcaataaaaatccctccctcccccccgaaccgtaatgatagatagctgcttgcctgctccggagtttcttccgctgttctctctcgcgcaaatttttatgctgggcaaagacggtgttcttcagcttcgacccccaaaaagggcgaagctttcgcgtccttccccacacacacaaattacctgggagccgtagcttctgtttggtgcggccacggggtggaagaaatggtatgcgggatgctcgccaattggcatgctgcgctttccgtccctgcagccgcaagaggccttctcttttagatctgtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaaggaaagggaagggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcaaagcaagccggagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggagcagtgcagcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggtggcggcttcggcgagagcttcgccggcttcgactggccgccgtcgccgtgacgcgtggcccgcgagagccgccgctgcgcttgcgttgcgcggaccgttttcggctcttgcttatataccgcgtgcgtgcctgagtcgttgtttgttgttcgtccccaagctttgcttgcagatgtaagctttcaatctttaagctctagcttgcagatatgtgaagtggactgctagtagtacactctagctgtaaactccggtgtttacctgaagcaaaccagcatgcaccggtgagatttcaccggcgccatccccatcctacta

SEQ ID NO: 5000 - DNA, 2534 bp, Oryza sativa
gtgggtgcctggcagaattatatttaaaaaaaagacaaggggaagatccttcctcttgctcaacgagattcttgcatatacactggagtactctctatacatttttctctcttgcgaacacatgcaaacacaaaaagctttaaccgtagctttgttcagtcttctactgctgctggccattctccctcccagtgtcacactctcaaagtctcctctcctccatcaggtgttacctcctgcagatcctgattggaatttggaccttctcctcctcctcctccaccacctcctccttcccagtctggtaaaatgtgcaggccataaagccctcgcaatcctagaacagttgcatttctaattcatgtatagtaggaaagaaatatatatattcctgctctgttctgttcttatcttttgctttgagccaaaaaggttagagcttttgtgttcttcccccacaaatatcccctagtgccttttgtttggccgtggtgtggaaaagcatatgaatgggggagcatctcaattggcatactgctgttgccccccagcttagctatccctttccatccctgcaagaacccttctttatagatctgtgcccttgctgttcatggaaccctgtgattgaggggtttcctcatttggtctctcactcgcggtgtaaacaaagtatatgctccaagtaagctgctacttttagctgcttctctgattcttgagtgatctccaagtgcagaaggagagggaggaggagatgggggagtgcggcggcggcgagtacaggtgctgggaggagcttctgccggacgcgctggggctcgtcttccggaacctgccgctccgggaggtgctgacggtggtgccacgggtgtgcaagtcgtggagccgggtggtggccgggccgtactgctggcaggagatcgacatcgaggagtggcggcagcagcagggcaagcccgagcagctcgtccgcatggtggagatgctcgtcgcacgcagctgcggctcctgccgccgcatcagcgtctccggcctccccggcgacccgctcttctccttcatcggagaccatgcacgggcactgaggacgctggagattccacggagcgagatcagcgacgcggcggtggagagcgtggcgccgaggctgcccaacgtgacgttcctggacatcagcagctgcaccaagatcggggcgcgcgcgctggaggcgttcggcaagaactgcaagtcgctggtggggctccggcgggtgatgcacccgacggacgtcgccggcaaggcgtgccagcgcgacgaggcgcgcgccatcgcctgcaccatgccgaggctccggcacctggagatgggctacatggtgatcgcgacggatgcggtgctcgacatcctcgcgcggtgccgcgacctccggttcctcgacctccgcggctgctgggccgtcgacgacaagttcctgcaggagaggcacccggggctgagggtgctcggccccggcgtcgacgactgcttcgagaacagctacctggaggagtgctccgactactccgacgactcctccatctactcgtgggagctcatggaggacgacgacgacgactactacgccgtcgggagcgacgacgaggccatttgggacgacggccagggcctcgagaacctggaggtcaggttctacggcggcggcttcagcgagagctatgctggcttcgattggccaccatcaccatgaccatgagagcagctcagctcagctcagtccctgacctcactgtccttgctcttcctctcgagccgtgtacctaagcttgcagttgcagtctcgcagatgtgttgttgtactctgtgtgtgtgcgcgtgtgccagtgtgtcatcagcatcactagcttgcagtgcagatatgtgtgagtgaacttctacggctagttgttactactactacatccagatgtaaactttggtgtttacatgaagaagcaatgcaaatgcaatatgtggtgaaaaatcacctgccctgctcatgtcctacaacgaatctacaaaaactgtagcttgtgtgatctgttggttgggagtgttttatggagagattggcagtacaacgagagatgggcaatctgctgcctcatctattggacaagatgtgcagcagcaggtgtggtgtggcctgccttgctatgccagggagagcagtggagaagagagagtagagtactgcatctgcatgcccttgatttacgttacatgtcaatgctgctcccaggacaagcaaaaccaacagttaaaaagcttactagtgatccacttttaggccggtcggaccacggtgaccactgatttcacagttgaaaacaatgtggtagtgtagctggtaaagcaggatctttttttcaccggcagatggattgtctcttgcgaggcaggttactacaagccctggcattcccatgcgcctatgggcctctctgcaacttttgccgctgcaacactagtgtaggattctgcagtgtattcccaattcccatatataccag

SEQ ID NO: 5001 - DNA, 2192 bp, Oryza sativa
cttcccctccatcctttttttcctctcttctccccgcatcctctgcgtctctccctcctccctctgcagcgccgagccggaggaatcctgaccggaggtcggcctcgccctcccctcctcgcgcgcgcgccgccgccgccgggaaggccggctggcgaggtagtcgaaaaatatcgcctctgaaggtcagcactgaggcatgggggagtgcagtgagcacaggtgttgggacgagctactaccggacgcactgggcctcatctttcgcaaactctcactcaaggatgtgctcaccgtggtgccgcgggtttgcaaatcctgggggcgggtggttgcagggccttactgctggcaggagatcgacatccaggagtggagccagcagcagagcaagccggaccagctcaagcgcatggttcgcatgctcgtcgcccgaagcggcggctcgttccaccgcattagcgtgtccggcctgcctggcgatccattgttcaccttcattggggaccatgcacggtcacttaaaaccatggagcttccaaggagtgatatcagcgactccttagtggaaaatgttgcgccaagattgtccaacgttacattcttggacataagcagctgtactaagatcggtgctcgtgctctagaagcattcggcaagcattgtaaatccctgatcggacttcggcgagtcatgcaccctacagatgttgtcggtagggccagtcaacatgatgaggctcgtgctattgcttgcaatatgccaaagctccgtcatcttgagatagggtacatgctcattgcaacgaaggctgttgttgagattgcctctcagtgtcatgatctcaaattcttagatctgcgtggctgctggaatgttgacgataaactattgcaagagagctatcctgggctgaaagtcgttggcccctatgtggacgactgctatgagaacagcttctgggaggagtgttccgatgactcggatgattccatctattgggagctcatggatgatgattattatgcggcggggagcgatgacgagggcatatgggacgatggtcaaggtcttgagggcttagaagtaaggttttatggtggtggatttagtgaaagccatgctggttttgattggccgccatctccatgaaagctgcatcaagatcttcagaaaagtgcctgtgtattcctgctgcttcctcttatgtgcttcaagttttaaacatcagcttccttagtactagtatgtgcttgtatttgtgtcatcccctagcttgcagatatttgaagccaactatctggtagtataaaatgtttggtgtttatacataaaaaatagcaacatggtctggtagtactgaaacaatgttgctacaaatttgtttcagtactagtaatttatttcagaggttttccatgcgcctgtaatcctgtactagttctcttttatactgcggttctatgacttctactactactatctccctttctattggacaagatgtggcctggtatgccagggactacagtattgaaggtgtagtactgcatgtcatagcaattccaagaagtaacagtgagatgcccaccctgcatttagaccagacaatggtggccactggtgccagatcctagattttgtcctaaaatcttgtgatgaagcagtgtttttttcttttgtcagatggattggaatcagttacatggcgtgtcagttgtctcttgcaaggcaagctacacctgacatttgccatgcatcactgcttccacggcgttctctttctgactctgcaactttggcaatgcacgcaccactgctgggcattccaatgggagcagctatcgatatgtacgtttggtgttttatcaggtctggtctgaatagtgaatgcccaatggacaatcccacattattctgtggcttttcctttgtttgaggtgggatcctgtgctaataatgaattttaaatcgttggattaagatgatatctttggcagttgatggaactttacaaatacttttgtgctcacagcattgcttctttcccaatctcttccatccccttataactgtaacagtgtgagcagcaaatgctttcagaaatacagggactttggtaaaaacaagcttcgactatgaaagaggtgaaagttttgtgaaatcttctactgtaattacttggggtgtg

SEQ ID NO: 5002 - DNA, 1390 bp, Zea mays
ctggggtttctctctctccacgttcgctccctctcttttgtgtcggggccgccgctgtgctggagccgccgcgagccgctgctggaggagccgccgccggcctccccaactcgccttaggtgccagaacgaccagaggccagagggcgttgctgcgctgcgttccgctctcccttttctgctgcgacgacggctggtcgagcgccgccacactttgcagcttccttggctcttcgcaggtgacgagcgcccaccagacatgggacaaggtggacaagagaagtcgttcaatttccttcaagttttgctagagggcagcatagctggaggaactgctggtgttgtggtggaaacagcactttacccgattgatactataaaaaccaggcttcaggccgctcgaggtggaagccggattgaatggaaaggcttgtattctggattagctggaaatctcactggcgtccttccggcctctgcgatatttgtcggggtgtatgagccaactaaaagaaaattactggaaacccttcctgaaaatctgagtgcagttgcccattttactgcaggggccattggaggtattgctgcttccctcgtccgtgtccctacagaggtggtcaaacaaaggatgcaaactggtcaattcaagtctgcacctgatgctgttcgtctcattgttgctaaagaaggatttaaaggactgtacgctggttatggttcctttctacttcgagatctaccatttgatgccatccagttctgcatttatgagcaacttcgaattggctacaaacttgtggcgaaaagggagttgaatgatccagagaatgcacttatcggtgcttttgctggcgccatcactggagctataacaactccccttgatgtcatgaagacaagattgatggttcagggacaagggaaccaatacactggaattgtaagctgtgctcagacaatcctcagagaggaaggccctaaggcattcttgaagggcattgagccgcgagtgctgtggattggcatcggtgggtccatcttctttggcatgctggagaaaaccaagtcgatgctagccgagaggaggaaccgcgagcttcgggccgtcaaggacgaatgagtggagatcagctcttttttggcgttgagtccttaccctgaaacaaaatacacatttttacttgccggggacaacctcgccggcccgtacttgtactccacggcgttcacgttatcacgtacgtagaaattatgagcatgactgacggtttctacagattgaaaaccaaaacttattacatgcgctggaaacctgccactcactgtttacgttgggagttaataacactatgcaacatttaaatgctatggtaagcctctaaaaccgc

SEQ ID NO: 5003 - DNA, 1374 bp, Sorghum bicolor
atttgagaggcaggcttatacaacagataaaacaatcagccatatcctggcaggcactggcatccatcctgagttcctgacggagtgacggctcgagagcgtcgctgctttgggttcttcggttctcccctccttttctttcccccgttcgcctcacgggcccccggctctcgcgcgcgcctttcttgccttgctgccacgactgggcgagcgccgccgcccttagccagttcttcgcaggcgacgaccaccccaccagtcagacatgggagaaggcggagaagagaagtcgttcaatttccttcaaattttgctcgagggaagcatagctggaggaaccgctggtgttgttgtggaaacagcattgtaccctattgatactataaaaaccaggcttcaggctgctcgtggtggaagccgaattgaatggaaaggcttgtattctggattggctggaaatctagctggtgtcctgccggcctctgcaatattcgtcggagtgtatgagccgactaaaagaaaactactggagacacttcctgaaaatttgagtgcagttgcccattttactgcaggggccattggtggtattgctgcttcccttgtccgtgtccctacagaggtggtcaaacaaagaatgcaaaccggtcaattcaagtctgcgcctgatgctgttcgtctcattgtcggtaaagaagggtttaaaggactgtacgctggttatggttcctttctacttcgagatcttccattcgatgccattcaattctgcatttacgagcagcttcgaattggttacaaacttgtggcaaggagggagttgaatgatccagagaatgcgcttattggtgctttttctggcgccatcactggagctataactactccctttgatgtcatgaagacaagattgatggttcagggacaagggaaccaatacactggaattgtaagctgtgctcagacaatcctcagagaggagggccctaaggcattcttgaagggcattgagccgcgagtgctgtggattggcatcggtggatccatattttttggtgtgctggagaaaaccaagtcgatgctagccgagaggaggaaacgcgagctacccgtcaaggacgaatgaacgaagatcagttaaataatttatgtccacgttgaatcattcttgtagttcttttttttcacgttgaatccttatcctgtgaaattagataaacagaatacacaattttacttgccagtagtgcttcagcctacaaaggattttaagacagattaagaaagaatacaagagaagcaatgtaccaactgaacacatcaaggctgctagttctggtgatagtgatcgatgaacctaagaatatgtggctt

SEQ ID NO: 5004 - DNA, 1567 bp, Sorghum bicolor
atttgagaggcaggcttatacaacagataaaacaatcagccatatcctggcaggcactggcatccatcctgagttcctgacggagtgacggctcgagagcgtcgctgctttgggttcttcggttctcccctccttttctttcccccgttcgcctcacgggcccccggctctcgcgcgcgcctttcttgccttgctgccacgactgggcgagcgccgccgcccttagccagttcttcgcaggcgacgaccaccccaccagtcagacatgggagaaggcggagaagagaagtcgttcaatttccttcaaattttgctcgagggaagcatagctggaggaaccgctggtgttgttgtggaaacagcattgtaccctattgatactataaaaaccaggcttcaggctgctcgtggtggaagccgaattgaatggaaaggcttgtattctggattggctggaaatctagctggtgtcctgccggcctctgcaatattcgtcggagtgtatgagccgactaaaagaaaactactggagacacttcctgaaaatttgagtgcagttgcccattttactgcaggggccattggtggtattgctgcttcccttgtccgtgtccctacagaggtggtcaaacaaagaatgcaaaccggtcaattcaagtctgcgcctgatgctgttcgtctcattgtcggtaaagaagggtttaaaggactgtacgctggttatggttcctttctacttcgagatcttccattcgatgccattcaattctgcatttacgagcagcttcgaattggttacaaacttgtggcaaggagggagttgaatgatccagagaatgcgcttattggtgctttttctggcgccatcactggagctataactactccctttgatgtcatgaagacaagattgatggttcagggacaagggaaccaatacactggaattgtaagctgtgctcagacaatcctcagagaggagggccctaaggcattcttgaagggcattgagccgcgagtgctgtggattggcatcggtggatccatattttttggtgtgctggagaaaaccaagtcgatgctagccgagaggaggaaacgcgagctacccgtcaaggacgaatgaacgaagatcagttaaataatttatgtccacgttgaatcattcttgtagttcttttttttcacgttgaatccttatcctgtgaaattagataaacagaatacacaattttacttgccagtagtgcttcagcctacaaaggattttaagacagattaagaaagaatacaagagaagcaatgtaccaactgaacacatcaaggctgctagttctggtgatagtgatcgatgaacctaagaatatgtggcttaccttgttttgcagtgttagtcatatcgaggccactcggttttcttggcccttggttcgtttagtttgttggagaatggaggggatccaggacttgtccagaccgagggaattggaagtggactttatcccctacaagtcaccccaccccctaaatcccctcaattcaagattaaccaaacaaggtcttaaga

SEQ ID NO: 5005 - DNA, 1241 bp, Panicum virgatum
agagccaacaagcaaagccattgcccgctccccgctcctgataataaaagcgataaaccccgagcagagcaggtcgggcccccctcccaaattcgccgtcccgcccgccgccagccgcgccgtagttccctgctccggctcctcgtctctaccggcactgggcatcccggctcgtactggtttcccctctccttggtggcttgctacgcccgccaccgaattcaggcatgggagaaggtggagaagagaaatcattcaatttccttcaggttttgctcgagggcagcatagctggaggaaccgctggtgttgtggttgaaacggcgctgtaccctattgacacgataaaaaccaggcttcaggctgctcgaggtggaagccgaattgaatggaaaggcctctattctggattggctggaaatcttgctggtgttctcccggcttctgcgatatttgtgggagtgtatgaaccgactaaaagaaaactattggagacacttcctgaaaatttgagtgctgttgcccattttactgctggggccattggaggtatcgctgcttctctcgtccgtgtccctacagaggtggtgaaacaaagaatgcaaactggccaattcaagaaagcacctgatgctgttcgcctcattgttgctaaagaaggattcaaagggctgtatgctggttatggttcctttctacttcgagatcttccattcgacgccattcaattctgcatatacgagcaacttcgaattggttacaaacttgtggcgaagagggagctgaatgatccagagaatgcacttattggtgcttttgctggtgccattactggagctattacaacgccccttgatgtcatgaagacaagactgatggtccagggacaaggaactcagtacgcaggaattgtaaattgtgctcagactatcctaagagaggaaggccccagggctttcttgaagggcattgagccgcgagtgctgtggataggcatcggtgggtccatcttctttggtgtgctggagaaaaccaagtctatgctagctgagaggaggaaccgcgatctcaaggacgaatgagtgaagctcggttcggttgattgatttacattgcacctgaattcctttttgccgatgaatcttcttctgtgtagctagtagatatataaaataaacagttttctagttggttcataacatttttgtacaacacttgttttataaatcattgcactcccc

SEQ ID NO: 5006 - DNA, 1092 bp, Setaria italica
ccgactggttccctctcttgctgctaagcccgccaccggagccaagtcagacatggggggaggggaaggtggacaagagaagtcgttcaatttccttcaggttttgctcgagggcagcatagctggaggaaccgctggtgttgtcgtggaaacagccctgtaccctatcgatactattaagaccaggcttcaggctgctcgaggcggaagccggattgaatggaaaggcttgtattctggattagctggaaatcttgctggcgtcctcccggcctctgcaatttttgttggagtgtatgaaccaactaaaagaaaactactggagacacttcctgaaaatttgagtgctgttgcccattttactgcaggggcaattggtggtattgcagcttcccttgttcgtgtccctacagaggtagtcaaacaaagaatgcaaactcgtcaattcaagtctgcacctgatgctgttcgcctcattgttgctaaagaaggatttaaaggactctacgctggttatggttcttttctacttcgggatcttccatttgatgccattcagttctgcatatatgagcaaattcgaattggttacaaacttgtggcaaagagggagttgaatgatccagagaatgcacttattggtgcttttgctggtgccattaccggagctgtaacaactccccttgatgtcatgaagacaagactaatggttcagggacaaggaaatcaatattctggaattgtaagctgtgctcagacaatcctcagagaggaaggaccaatggcatttttaaagggcattgagccacgagtgctgtggatcggcatcggtgggtccatcttctttggtgtgctggagaaaaccaagtcgatgctagctgagaggaggaaccgcgaggtagggaccctcaaggatgaatgagtgaagatcgctagattgatttatgttgcatctcatctcctttttgccgttgaatcttcttctgtgtaactagacatacaaaataaacagtttgctttacttggttgttagcattttgttgaaaacaattttggttgatacatcataacagagcattgtcggttgcatct

SEQ ID NO: 5007 - DNA, 1107 bp, Pennisetum glaucum
gccatcccaaactagactcgccggcggccgccgcgccctctctcccctgctctccgaccggtttctgctctagctgctaagcccgccactggagtggagtcaagtcagacatggggggaggagaaggtgggcaagagaattcgttcaatttctttcaggttttgctcgagggtagcatagctggaggaactgctggtgtggttgtggaaacagccctgtaccctattgatacaataaagaccaggcttcaggctgctcgaggtggaagccgaattgaatggaaaggcttgtattctggattagctggaaatcttgttggcgtcctcccggcctctgctatatttgttggagtgtatgaaccaagtaaaagaaagctactggagacacttcctgaaaatttgagtgctgttgcccattttactgcaggggcaattggaggtattgctgcttcccttgttcgtgtccctacagaggtggtcaagcaaagaatgcaaactcgtcagttcaagtcagcgcctgatgctgttcgtctcatcgttgctaaagaaggatttaaaggactctatgctggttatggttcctttctacttcgagatcttccattcgatgccattcaattctgcatatatgagcaacttcgaattggttacaaagttctggcgaagagggagttgaatgatccagagaatgcacttattggtgcttttgctggtgccattaccggagctataacaactccccttgatgtgatgaagacaagactaatggttcagggacaaggaagtcagtactctgggattgtaagctgcgctcagacaatcctcagagaggaaggaccaagggcattcttaaagggcattgagccgagggtgctgtggatcggcatcggtgggtccatcttctttggtgtgctggagaaaaccaagtcgatgctagctgagaggaggaaccgccaggtagggaccctcaaggatgagtgagtgaagatcgctagattgattcatttcctttttgccgttgaatcatcttctgtgtaactagttatacaaaataaacagttttctttacttggttcttaacattttgttgaaagcacttttggttgat

SEQ ID NO: 5008 - DNA, 1559 bp, Oryza sativa
gttgaaaaaataaaaaaaaatccaaggacggagggaaggaagcgtcgtggtcgatcgggctcggagacgtcgacgccgacgaggagctccgacgccgacgggcgacggctgccggtcgagctgccgatggcgggctcggggacggcgacggcgagctattctctcctcggcccggtggtctgactgacaggtgggcccagcccccaggcacgttctcgaccagcttgcttgacccgagtcgagagccaaatttgggctcattatctacttcctctacctcccctaatccactccactccaccgcagcttctcccgcggcgaggcggctcatcccatctccacagccgcagttgttgcagcaaggaggcatggcggtggggggtgaagaagagaagcccttcaacttcctccagattctgtgtgagggcgtcatagctggtggcaccgcgggtgtggtggtggaaacagctctgtacccgattgatacgataaaaaccaggcttcaggctgctcggggaggaagtcaaattcaatggaaaggattgtattctggattagctggaaatattgctggtgttctcccggcttctgctgtatttgtgggaatatacgaaccgacaaaaagaaaactactggagacttttcctgaaaatttgagtgctgttgcccattttactgccggggctattggaggaattgcggcttctctcattcgcgtccccacagaggttgtcaaacaaagaatgcaaacaggtcaattcaggtctgcacctgatgctgttcgtctcattgttggtaaagaaggattcagaggtctttacgctggatatggatcatttttacttcgagatctgccttttgatgccattcaattctgtatatatgagcaacttcgaattggttacaaagttgtggccaagagggagctgaatgatccagagaatgcacttattggtgcttttgctggtgccattactggggctataacaacaccactcgatgtgatgaagacgcggttgatggttcagggatcagcgaaccagtactccggaattgtaagctgcgcccagacaatcctgagggaggaaggacctggggcattcttgaaggggatcgagccgcgggtgctgtggattggcatcggcgggtccatcttcttcggcgtgctggagaagaccaagtcgatgctcgccgagaggaggagccgcgagccaccagccgggaaggatgagtgacagattttaccctcggccatggatggatgcttcaagttttgtgtttgttttgatcgatttcacatgagaagtagtgcatctctcgaggaggaagacaatgccactttgcgtcccaatgattaaattcccattcgtttaatgaattaatattatgttcaagttttttttaaaatctgattatactacattatagcttctctctctccctgcagtttacccatgctgtatgacttgtagatgtaacagtcggtcgttgccgatcaaattgtacctttgtcaatccagatagtattgcagcagtatttacaaatggtaagcttgtta

SEQ ID NO: 5009 - DNA, 2392 bp, Brachypodium distachyon
taatcaacccgctattagcttgcaacgcaatccccaaagctaagcttaaaacccttcttcctcctcaatccagtcccgacatcctcctcctctccctcccgcggctgctcctcagagtggtgttcttgccggagacgggagaggaaccaggcatgggcgggggcggagaagagaagccgttcaatttcctccaggttctgtgtgagggcgtcatagctggaggaaccgctggtgttgtggtggaaacggctctgtacccgattgacaccatcaaaaccaggcttcaggctgctcgagctggaagtcaaattcaatggaaaggcctgtattctggactgggtggaaatcttgtcggtgttctaccggcttctgctttgtttgtgggaatatatgaaccaacaaaaaggaaactactggatgtgtttcctgaaaatttaagcgcagttgctcatcttactgcaggagccgttggaggttttgctgcttctctcattcgtgtccccacagaggtggtcaaacaaagaatgcaaactggtcaattcaagtctgcgcctggcgctgttcgtctcatagttgggaaagaaggatttaaaggtctttacgccggttatggctcatttttacttcgagatcttccctttgatgccattcagttctgcatatacgagcagcttcgaattggctacaagcttgtggcaaagagggagctaaatgatccagaaaatgcacttattggtgcttttgccggtgcgattactggcgctataacaacaccccttgatgttctgaagacaaggctgatggttcaggggcaaacaaagcaatactctggaattgtaagctgtgctaagactatcttgagggaggaaggccccggggcattcttgaagggcatcgagccacgagtgctgtggatcggcatcggcggttccatcttcttcggcgtgctggagaagaccaaggcagtgcttgctgagaggagcagccgcaagacactggcgaacaaggacgagtgaaccgaccaacggtgcatctcctgttacagttccatagggcacacaatcaatcttgcttgattcgtctcgtaagttttgctctgattttatgtgctgggcttgtgtttcttgttccagaatcatagggaatacgatcagtatcagttctttttaatctgagaggagggacgtgctgtgccactcgtgtcaaattctgtgtagtactctttgtcgattactaattttacttacgccaaaagattccatcgtaggcactggttaattaccagtttaccacatacacttatggtccgaacacttgcccttacttcctgcacagaccactgctggtgtacaacacaacataatccatccatggtgggatgtggaaacacagcatgaaatgccctgcctagcctatacaaactatgtatcctcacctcacatgaaggaacgcatgcgcgggcggacgatggactgcgcgccgtcgacgaagatggtggtgccggtcatgaagcgggactcgtcgccgaccaggtacagcaccgtggacgccaggtctttctccgggtcgagccaccgccgcagcggcatcacctccccggtctccctctcggccttctcctcccccaccgagacggggaacttgtcccgcaggtgcaggccgcggcacaccgcgttcaccctgatcttgtgcttgccgagctccatcgccgacagctgaaaagaaggacgaacgttcatacaccactgtatatcttcatggtgaccaaaactagatggtaatctgaacttactctgacgagctggtgaacggcgcctagactcgtgccgtatgctgcagccccaggatacagccctctctcggcgccgatgatctgcgtcaagcatacgatggagccaccggatcctgcgtcccggaaccgcttggcgatcgccttgatgaggaaccatggtgtcatcacattggccttgatggtcttgctgtactcgtcttcagtcacgctgaggcaatcctgcacttcccctgctcgtacatacagacagacagccaaccaaaatgtatcctcaggtgtcgataagacgaattattctgcagatggattttggtgaagatgaacgaatacatgatcgatggatgcccagattaatttggaagatgtagtgaagaatcgtttgggttgggatggttagcatacataccctggaaggagtagcagttgacgagggcgtcgaggccgtcgtcgaagcagcgccaggccctgtccaccgccgcgccggcggccgcctcgtcgcaggcctcgagatccagccccaccaccgccgccgcgcccgctcccccaaaccgcctgacctcctccgccgtcgcagccagggcgccctcgtcgcccaacaga

SEQ ID NO: 5010 - DNA, 1237 bp, Brachypodium distachyon
attagcttgcaacgcaatccccaaagctaagcttaaaacccttcttcctcctcaatccagtcccgacatcctcctcctctccctcccgcggctgctcctcagagtggtgttcttgccggagacgggagaggaaccaggcatgggcgggggcggagaagagaagccgttcaatttcctccaggttctgtgtgagggcgtcatagctggaggaaccgctggtgttgtggtggaaacggctctgtacccgattgacaccatcaaaaccaggcttcaggctgctcgagctggaagtcaaattcaatggaaaggcctgtattctggactgggtggaaatcttgtcggtgttctaccggcttctgctttgtttgtgggaatatatgaaccaacaaaaaggaaactactggatgtgtttcctgaaaatttaagcgcagttgctcatcttactgcaggagccgttggaggttttgctgcttctctcattcgtgtccccacagaggtggtcaaacaaagaatgcaaactggtcaattcaagtctgcgcctggcgctgttcgtctcatagttgggaaagaaggatttaaaggtctttacgccggttatggctcatttttacttcgagatcttccctttgatgccattcagttctgcatatacgagcagcttcgaattggctacaagcttgtggcaaagagggagctaaatgatccagaaaatgcacttattggtgcttttgccggtgcgattactggcgctataacaacaccccttgatgttctgaagacaaggctgatggttcaggggcaaacaaagcaatactctggaattgtaagctgtgctaagactatcttgagggaggaaggccccggggcattcttgaagggcatcgagccacgagtgctgtggatcggcatcggcggttccatcttcttcggcgtgctggagaagaccaaggcagtgcttgctgagaggagcagccgcaagacactggcgaacaaggacgagtgaaccgaccaacggtgcatctcctgttacagttccatagggcacacaatcaatcttgcttgattcgtctcgtaagttttgctctgattttatgtgctgggcttgtgtttcttgttccagaatcatagggaatacgatcagtatcagttctttttaatctgagaggagggacgtgctgtgccactcgtgtcaaattctgtgtagtactctttgtcgattactaattttacttacgcc

SEQ ID NO: 5011 - DNA, 1518 bp, Triticum aestivum
ggcggggaagagaagcccttcaatttcctccagatcctctgcgagggcgtcatagccggaggcgccgccggggtcgtggtggagacggcgctctaccccatcgacaccatcaagaccaggctgcaggctgctcgagctggaagtcaaattcaatggaaaggcctgtattctggcttgggtggaaatcttgtcggtgttctcccggcttctgctctatttgtgggaatatacgaaccaactaaacggaagctactggacatgtttcctgaaaatttgagtgctgttgctcatcttactgcaggggctgttggagggttgggtgcttctctcattcgtgtccccacagaggtggtcaaacaaagaatgcaaactggtcaattcaggactgcgcctgatgctgttcgtctcatagttgccaaggaaggatttagaggtctttttgctggttatggttcatttttacttcgagatcttccgtttgatgccattcaattctgcatatacgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacgaagcaatactccggaatcgtaagctgtgctaagacgatcttgagagaggaaggcccaggggcattcttgaagggcatcgagccgcgagttctgtggatcggcatcggtgggtccatcttcttcggcgtgctggagaagaccaagtcggtgctcgctgagcggagcagccgcaaggctgcgctggcggagaaggacgagtgaaccaaccgaccaaaccaactgtgcatcctatgctgactcactctacaccattacccgttccttaaacctgaagttttgctccaagtttatgtggtgggctttgcatttctcgttccagaactataaggcatacaatcagtttcaagagtctgtcttgacgtcggcgatggttatgatcctttatgagtccctgtaaacattactctcctttaataaagtttagcagattgttcttcaaaaacttctaatctgaagaggggcctgctctgcccctcatgttgcttctgggtattctttgtcaattttgatctttactctaccattaattattgcattcacagagactgcttaattatcacacttgcgctctttgcacaaaccactgttattcaacaacaacatatcaggagtcatcctgatggaaagtggaaatccagacatggccaaccagtcccaggacaggcatgacaaacctacctacaggaaggagcgcatgcgagggcgcacgatggactgcgcgccgtcgacgtagatggtggtgcccgtcatgaagcgggagtcgtcgccgaccaggtacagcacagtggacgccaggtccttgtccgggtccagccaccgccgcagcggcatcacctccccggtcgccttctcggccttctc

SEQ ID NO: 5012 - DNA, 1500 bp, Oryza sativa
ccagagcacacctgcacggttgcatccctggtttcctggcggactccaaaaacccttcctcaaaccctcgcccccacaacgccccgcgacaggaggaagaagcttctcgtctgattttgttcctggtgactgaaagcagcagagaagcagataggctcgcggtgagccatgggagaaggcggagacgggaggtccttcaattttcttcaagttctgtttgagggtgtaatagctggaggtgctgccggtgttgttgttgagacagctctgtatcctattgatacaataaaaaccaggcttcaggctgcgaaaggtggaagtaaaattcaatggaaaggcttgtatgctgggttaggtggaaatattgctggtgttctcccggcttctgcaatctttataggagtgtatgaaccaaccaaaagaaaactgctagaaatgtttcctgaaaatttgagtgctgtggctcatttgactgcaggggcaattggaggtgctgcatcttctcttattcgtgttcccacagaggtggttaaacaaaggatgcaaatgagtcaattcaagactgcacctgatgctgttcgccttattatccgtaaagaaggattcaaaggtctttatgctggctatggttcctttctgttgcgagatctaccatttgatgctattcagttttgcatatatgagcaacttcgaataggctataaactggcggcaaagcgagacttgaaagacggagagaatgcacttattggtgctttcgctggcgcaattactggggctataacaacacccctcgatgttttgaagacaagattgatggttcagggacaagcaaaccaatataggggaatcataagctgtgctcaaacaattctacgagaggaaggtgctggtgcttttttgaagggtattgagccaagggtattatggattggcattggtggatccatcttctttggtgttttggagaaaacgaagtcaattctagctgagaggaacagccgtaaagtacgaatactatgaaagggggatgattttgcgtagatgctgctattttcccaggatgtctactgatatgtgtgctcgatcaattaattttaggagctccgattcacatccttgtcaatcccatccgaatcttgtattttgctagagcattacatggggttaaagttataatttctgaatttcttttcgtctggctagcttgttttgtacttgagctaaaaagataattttctggaagcgaaatgcttctgttcaaacggatgatctgttgtcattgcaaaaaagagaagttcattaggatagtttactgcacccatcgtcctaaaatataggccatagggtgctgtttgttatagctctagatgctggatttttggagttgggggtacttttagctctaaaaattcatagatctggatccgggattacattgataacatttagatgaattattttattcttatttaaactaaaacataaaattttaaacta

SEQ ID NO: 5013 - DNA, 1194 bp, Triticum aestivum
cgctcttcttctcccccgcggccggctcctcctccgctcctcagacctcggcgaaggtttcccggcggccggcgtgcagacatgggcggcggcggcggcggggaaggggaagagaagcccttcaatttcctccagatcctctgcgagggcgtcatagccggaggcgccgccggggtcgtggtggagacggcgctctaccctatcgacaccatcaagaccaggcttcaggctgctcgagctggaagtcaaattcaatggaaaggcctgtattctggattaggtggaaatcttgtcggtgttctcccggcttctgctctgtttgtgggaatatacgaaccaactaaacggaagctactggacatgtttcctgaaaacttgagtgctgttgctcatcttactgcaggtgctgttggagggttgggtgcttctctcattcgtgtccccacagaggtggtcaaacaaagaatgcaaactggtcaattcaggactgcgcctgatgctgttcgtctcatagttgcaaaggaaggatttagagggctttttgctggttatggttcatttttacttcgagatcttccgtttgatgccattcaattctgcatatacgagcaacttcgaattggttacaagcttatggcaaagagggagctgaaggatccagagaatgcactaattggcgcctttgccggtgcgattactggtgctataacaacccccctcgatgttctgaagacaaggttgatggttcaggggcaaacaaagcaatactctggaattgtaagctgtgctaagacgatcttgagggaggaaggtcccggcgcctttttgaagggcatcgagccgcgagttctgtggatcggcatcggcgggtccatcttcttcggcgtgctggagaagaccaagtcggtcctcgctgagaggagcagccgcaaggctgcgctggcggagaaggacgagtgaaccaaccaacccaccaagcaattgtgcatcctatgctgactcactccacatcattacccgttctttcacctgaagttttgctccaattttatgtgatgggctttgcgtatctcgttccagaactattaaggcatacaatcagtttcaagagtttgttttgatgtcggcgatgatggttatgatcctgtatgagtccctgtaaacattactctcctttaataaagtttagcagat

SEQ ID NO: 5014 - DNA, 1269 bp, Triticum aestivum
ccgaaagctaggctaggctaggctaggcttaaaaccctcttcttcttcctccccaatccaccgctcttcttctcccccgcggccggctcctcctccgctcctcagacctcggcgaaggtttcccggcggccggcgtgcagacatgggcggcggcggcggcggggaaggggaagagaagcccttcaatttcctccagatcctctgcgagggcgtcatagccggaggcgccgccggggtcgtggtggagacggcgctctaccctatcgacaccatcaagaccaggcttcaggctgctcgagctggaagtcaaattcaatggaaaggcctgtattctggattaggtggaaatcttgtcggtgttctcccggcttctgctctgtttgtgggaatatacgaaccaactaaacggaagctactggacatgtttcctgaaaatttgagtgctgttgctcatcttactgcaggtgctgttggagggttgggtgcttctctcattcgtgtccccacagaggtggtcaaacaaaggatgcaaactggtcaattcaggactgcgcctgatgctgttcgtctcatagttgcaaaggaaggatttagagggctttttgctggttatggttcatttttacttcgagatcttccgtttgatgccattcaattctgcatatacgagcaacttcgaattggttacaagcttatggcaaagagggagctgaaggatccagagaatgcactaattggcgcctttgccggtgcgattactggtgctataacaacccccctcgatgttctgaagacaaggttgatggttcaggggcaaacaaagcaatactctggaattgtaagctgtgctaagacgatcttgagggaggaaggtcccggcgcctttttgaagggcatcgagccgcgagttctgtggatcggcatcggcgggtccatcttcttcggcgtgctggagaagaccaagtcggtcctcgctgagaggagcagccgcaaggctgcgctggcggagaaggacgagtgaaccaaccaacccaccaagcaattgtgcatcctatgctgactcactccacatcattacccgttctttcacctgaagttttgctccaattttatgtgatgggctttgcgtatctcgttccagaactattaaggcatacaatcagtttcaagagtttgttttgatgtcggcgatgatggttatgatcctgtatgagtccctgtaaacattactctcctttaataaagtttagcagattgttcttcaaaaaa

SEQ ID NO: 5015 - DNA, 1291 bp, Hordeum vulgare
ggtccctaaccccccttccctcctctcctctcagctgcggctcaagcttccttcttttaccctccagaccccgcgcgcggaggcagcagagcggtcagctgcggctcaagcttccttcctttaccctccagacctcgcgcgcggaggcaccagagcggcggcgggcgggcaggcatgggcgccagcgggggcggggaggacaagccattcaatttcctccagatcctctgcgagggcgtcatagccggaggcaccgccggggtcgtggtggagacggcgctctaccccatcgacaccatcaagaccaggcttcaggctgctcgagctggaagtcaaattcaatggaaaggcctgtattccggattaggtggaaatcttgtcggtgttctcccggcttctgctctgtttgtggggatatacgaaccaactaaacggaagctactggacatgtttcctgaaaatttgagtgctgttgctcatcttactgcaggtgctgttggagggttgggtgcttctctcattcgtgtccccacagaggtggtcaaacaaaggatgcaaactggtcaatttaggactgcgcctgatgctgttcgtctgatagttgccaaggaaggatttagaggcctttttgctggttatggttcatttttacttcgagatcttccgtttgacgctattcaattctgcatatatgagcaacttcgaattggttacaagcttatggcaaagagggagctgaaggatccagagaatgcactcattggtgcttttgccggtgcaattactggcgctataacaacacccctcgatgttctgaagacaaggttgatgattcaggggcaaacaaagcaatactctggaattgtaagctgtgctaagacgatcttgagagaggaaggtcccggcgcctttttgaagggcatcgagccgcgagttctgtggatcggcatcggcgggtccatcttctttggcgtgctggagaagaccaagtcggtgctcgctgagaggagcagccgcaaggctgtgctggcagagaaggacaagtgaaccaaccaataaatgaattgtgcatcctatgctgagtgaacccaccatttacccgttcctttaacctcaagttttgctccaattttgtgttgggcagtgcttcttcttccagaaccatagagcatacaatcagtttcaagagtttgtttcagatgtcggttatcgttatgatcctgtatgagtccctgtaaacattactgtcctttaataaagttacccggttgttctaaaaaaaaaaaaaaaa

SEQ ID NO: 5016 - DNA, 1846 bp, Hordeum vulgare
ctggccaatccaatctaatccaatccgccaaggaaaacccttctcttcttcttcttcctcctcctcccaaatccacccttgtccctaaccccccttccctcctctcctctcagctgcggctcaagcttccttcttttaccctccagaccccgcgcgcggaggcagcagagcggtcagctgcggctcaagcttccttcctttaccctccagacctcgcgcgcggaggcaccagagcggcggcgggcgggcaggcatgggcgccagcgggggcggggaggacaagccattcaatttcctccagatcctctgcgagggcgtcatagccggaggcaccgccggggtcgtggtggagacggcgctctaccccatcgacaccatcaagaccaggcttcaggctgctcgagctggaagtcaaattcaatggaaaggcctgtattccggattaggtggaaatcttgtcggtgttctcccggcttctgctctgtttgtggggatatacgaaccaactaaacggaagctactggacatgtttcctgaaaatttgagtgctgttgctcatcttactgcaggtgctgttggagggttgggtgcttctctcattcgtgtccccacagaggtggtcaaacaaaggatgcaaactggtcaatttaggactgcgcctgatgctgttcgtctgatagttgccaaggaaggatttagaggcctttttgctggttatggttcatttttacttcgagatcttccgtttgacgctattcaattctgcatatatgagcaacttcgaattggttacaagcttatggcaaagagggagctgaaggatccagagaatgcactcattggtgcttttgccggtgcgattactggcgctataacaacacccctcgatgttctgaagacaaggttgatgattcaggggcaaacaaagcaatactctggaattgtaagctgtgctaagacgatcttgagagaggaaggtcccggcgcctttttgaagggcatcgagccgcgagttctgtggatcggcatcggcgggtccatcttctttggcgtgctggagaagaccaagtcggtgctcgctgagaggagcagccgcaaggctgtgctggcggagaaggacaagtgaaccaaccaacaaatcaattgtgcatcctatgctgagtgaacccaccatttacccgttcctttaacctcaagttttgctccaattttgtgttgggcagtgcttcttcttccagaaccatagagcatacaatcagtttcaagagtttgtttcagacgtcggttatcgttatgatcctgtatgaatccctgtaaacattactgtcctttaataaagttacccgtttgagcggccgctgcaagagctcccaccaaattcgaaaatactggacctactgaagagggcttctagctacgacatgcagttgagcctacggctcaacagccatgctgtgcacaacctgaaccaggagctgaagatggacgacgtgctggagctgattccttcaactccatgcaaatctggaggctacatgagggagctcaaccaaatgtctgatcaccgtctcgcggtttcgcagtcttgacagccgtaggccagcagatctttgtgaatacatatatgacaacgcagctaaacccgtctgaagtttaggtggctacattgacagaatcataacagatagtgtagcatttggtgtatatttgttgataagtttgttcaagtagagataaaaaaagtaccttgtaaatatgtggtacggagttcgagctcaggaaatttcttggttttagaacaagtatagagaactgaaatcacttatcctaaacaatgctttatttt

SEQ ID NO: 5017 - DNA, 1159 bp, Triticum aestivum
cggctcaagcttccgtttccctccaggcctcgcgcgcagaggcagggcggcggcgggcgggcgggcaggcatgggcgccagcgggggcggggaagacaagcccttcaatttcctccagatcctctgcgagggcgtcatagccggaggcgccgccggggtcgtggtggagacggcgctctaccccatcgacaccatcaagaccaggcttcaggctgctcgagctggaagtcaaattcaatggaaaggcctgtattccggattgggtggaaatcttgtcggtgttctcccggcttctgctctgtttgtgggaatatacgaaccaactaaacggaagctactggacatgtttcctgaaaatttgagtgctgttgctcatcttactgcaggtgctgttggagggttgggtgcctctctcattcgtgtccccacagaggtggtcaaacaaaggatgcagactggtcaattcaggactgctcctgatgctgttcgtctcatagttgccaaggaaggatttagaggtctttttgctggttatggttcctttttacttcgagatcttccgtttgatgccattcaattctgcatatacgagcaacttcgaattggttacaagcttatggcaaagagggagctgaaggatccagagaatgcactaattggtgcttttgccggtgcgattactggcgctataacgacccccctcgatgttctgaagacaaggttgatggttcaggggcaaacgaagcaatactccggaatcgtaagctgtgctaagacgatcttgagagaggaaggtcccggggcattcttgaagggcatcgagccgcgagttctgtggatcggcatcggcgggtccatcttcttcggcgtgctggagaagaccaagtcggtgctcgctgagaggagcagccgcaaggctgcgctggcggagaaggacaagtgaaccaaccaaccaaccaattgtgcatcctatgctgaacaccacactattgcccttcacctgaagttttgctccaattttatgtgctgggccttgtgtttcttcttccagaactataagtcatacaatcagtttcaagagtttgttttgacgtcggcgatggttatgatcctgtatgagtccctgtaaacattactcctttaataaagtttagcagat

SEQ ID NO: 5018 - DNA, 1171 bp, Triticum aestivum
cggctcaagcttccgttcccctccaggcctcgcgcgcagaggcagggcggcggcgttcggttgtcttctcggcggcgggcgggcaggcatgggcgccagcgggggcggggaagacaagcccttcaatttcctccagatcctctgcgagggcgtcatagccggaggagctgccggggtcgtggttgaaacggctctgtaccccatcgacaccatcaagaccaggcttcaggctgctcgagctggaagtcaaatccaatggaaaggcctgtattccggactaggtggaaatcttgtcggtgttctcccggcttctgctctgtttgtgggaatatatgagccaactaaacggaagctactggacatgtttcctgaaaatttgagtgctgttgctcatcttactgcaggtgctgttggagggttgggtgcttctctcattcgtgtccccacagaggtggtcaaacaaaggatgcaaactggtcaattcaggactgcgcctgatgctgttcgtctcatagttgccaaggaaggatttagaggtctttttgctggttatggttcatttttacttcgagatcttccgtttgatgccattcaattctgcatatatgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacaaagcaatactctggaattgtaagctgtgctaagaccatcttgagagaggaaggtcccggcgcctttttgaagggcattgagcctcgagttttgtggatcggcatcggcggatccatattcttcggcgtgctggagaagaccaagtcggtgctcgctgagaggagcagccgcaaggctgcgctggcggagaaggacgagtgaaccaaccaaccaaaccaattgtgcatcctatgctgacttgcggctcctcactccacaccattacccgttcctttcacctgaagttttgctccaaatttatgtgatgggctttatgtttctcgttccagaactgtaaggcatacaatcagtttcaagagtttgttttgacgtcggcgatggttatgatcctgtatgagtccctgtaaacat

SEQ ID NO: 5019 - DNA, 1185 bp, Secale cereale
gcgggggaggagaagcccttcaatttcctccagatcctctgcgagggcgtcatagccggaggagctgccggggtcgtggtggaaacggcgctgtaccccatcgacaccatcaagaccaggctgcaggctgctcgagctggaagtcaaattcaatggaaaggcctgtattccggactaggtggaaatcttgtcggtgttctcccggcttctgctctgtttgtgggaatatatgagccaactaaacggaagctactggacatgtttcctgaaaatttgagtgctgttgctcatcttactgcaggtgctgttggaggcttgggtgcttctctcattcgtgtccccacagaggtggtcaaacaaaggatgcaaactggtcaattcaggactgcacccgatgctgttcgtctcatagttgccaaggaaggatttagaggtctttttgctggttatggttcatttttacttcgagatcttccatttgatgccattcaattctgcatatacgagcaacttcgaattggttacaagcttatggcaaagagggagctgaaggatccagagaatgcactaattggtgctttcgccggtgcaattactggcgctataacaacccccctcgatgttctgaagacaaggttgatggttcaggggcaaacaaaacaatactctggaattgtaagctgtgctaagacgatcttgagagaggaaggtcccggcgcctttttgaagggcatcgagccgcgagttctgtggatcggcatcggcgggtccatcttcttcggcgtgctggagaagaccaagtcggtgctcactgagaggagcagccgcaaggctgcgctggcggagaaggacgagtgaaccaaccaaccaaaccaaatgtgcatcctatgctgacccactccacaccattacccgttcctttcacctgaagttttgctccaattttatgtgctaggctttgcgtttcttattccagaactgtaagtcagtttcaagagtttgttttgacatcggtgattgttatgatcctgtatgagtccctgtaaacattactctcctttaatgaagtttagcagattgttacttaaaacaaaaaaaaaaaaaaaaaaaaaactaaaaaaaaaaaaaactaaaaacgaagaactagtacgaacgacgacaacgacggaaggtagagcccccccc

SEQ ID NO: 5020 - DNA, 1694 bp, Brachypodium distachyon
acccttcctcctcctcggtccactctgcttccccccgcggctcctcttggggttgctctcaggcgcgaaatccctctcttctcgtctcattccccgaatacctccaaccactggaagctttcctgcccggcgcaggtccaactcctcttgccccgctaaagtttgtcatttttcttttcttttcgaggggccgggggcaaggggggctgcaacttcagctttcgttttcctcggttcctcctcacaggagagaaatcaggcatgggcgggtgcggacaagagaggccgttcaatttcctccaggttctgtgtgagggcgtcatagctggaggagccgctggtgttgtggtggaggcggctctgtacccgattgacaccatcaaaaccaggcttcaggctgttcaagctggaagtcaaattcaatgggaaggcctctattctggattaggtggaaatcttgtcggtgttctaccggcttctgctttgtttgtgggaatatatgaaccaacgaaaaagaaactactagatgtgcttcctgaaaatttaagtgcagttgctcatcttactgcaggggccgttggaggttttgctgcctctctcttccgtgtccccacagaggtgatcaaacaaagaatgcaaactggtcaattcaggtctgcgcctaatgctgttcgtctcatagttcgcaaagaaggatttaaaggtctttacgctggttatggttcatttttacttcgagatcttccctttgatgccattcagttctgcatatacgagcagcttcgaattggttacaagcttgtggcaaagagggagttgaatgatccagagaatgcacttattggtgcttttgccggtgcgattactggcgctataacaacaccccttgatgtcctgaagacaaggttgatggttcaggggcaaacaaagcaatactctggaattgtaagctgtgctcagactatcttgagggaggaaggccctgtggcattcttgaggggcatcgagccacgagtgctgtggatcggcattggcggttccatcttcttcggcgtgctggagaagacaaaggcagtgctcgccgagaggagcagccacaaaacgctggcggacaaggaccagtgaaccaaccaaagatgcttcgcctgttactccatggggcacagaatcaatcctctgtctctaagtatggatcgagtgtgccctgttgcactgcagtgctgcatgacaagaagcaacctgacctgcagctcaaaagttgagcaccatttctgctgagggaggatccagtggtctgatagcctagtactccgtagtagtagtaagatcgaagcttttcctatgatgagtagatgttgagaagtgacactcagattaagctgatatggctcaagctgctagatggaattgctgaaatcggaatggatgggcgtccattctagtattgacacagtcacacagaccctttaaagagaaataagtactccgtagtagtacagtactccatactcccttcggagtagtacttattgacacgagcatatgtctatcgttatccttaatctattgtctaatgtgtgacatttgttgttcggggccatagatcacacattggttgtctaatggatgcacgtacattctatacatctaatgtgtgatagtttttttagtttgattcttgtccggcaggtacg

SEQ ID NO: 5021 - DNA, 1530 bp, Brachypodium distachyon
gcttccccccgcggctcctcttggggttgctctcaggcgcgaaatccctctcttctcgtctcattccccgaatacctccaaccactggaagctttcctgcccggcgcaggagagaaatcaggcatgggcgggtgcggacaagagaggccgttcaatttcctccaggttctgtgtgagggcgtcatagctggaggagccgctggtgttgtggtggaggcggctctgtacccgattgacaccatcaaaaccaggcttcaggctgttcaagctggaagtcaaattcaatgggaaggcctctattctggattaggtggaaatcttgtcggtgttctaccggcttctgctttgtttgtgggaatatatgaaccaacgaaaaagaaactactagatgtgcttcctgaaaatttaagtgcagttgctcatcttactgcaggggccgttggaggttttgctgcctctctcttccgtgtccccacagaggtgatcaaacaaagaatgcaaactggtcaattcaggtctgcgcctaatgctgttcgtctcatagttcgcaaagaaggatttaaaggtctttacgctggttatggttcatttttacttcgagatcttccctttgatgccattcagttctgcatatacgagcagcttcgaattggttacaagcttgtggcaaagagggagttgaatgatccagagaatgcacttattggtgcttttgccggtgcgattactggcgctataacaacaccccttgatgtcctgaagacaaggttgatggttcaggggcaaacaaagcaatactctggaattgtaagctgtgctcagactatcttgagggaggaaggccctgtggcattcttgaggggcatcgagccacgagtgctgtggatcggcattggcggttccatcttcttcggcgtgctggagaagacaaaggcagtgctcgccgagaggagcagccacaaaacgctggcggacaaggaccagtgaaccaaccaaagatgcttcgcctgttactccatggggcacagaatcaatcctctgtctctaagtatggatcgagtgtgccctgttgcactgcagtgctgcatgacaagaagcaacctgacctgcagctcaaaagttgagcaccatttctgctgagggaggatccagtggtctgatagcctagtactccgtagtagtagtaagatcgaagcttttcctatgatgagtagatgttgagaagtgacactcagattaagctgatatggctcaagctgctagatggaattgctgaaatcggaatggatgggcgtccattctagtattgacacagtcacacagaccctttaaagagaaataagtactccgtagtagtacagtactccatactcccttcggagtagtacttattgacacgagcatatgtctatcgttatccttaatctattgtctaatgtgtgacatttgttgttcggggccatagatcacacattggttgtctaatggatgcacgtacattctatacatctaatgtgtgatagttttttt

SEQ ID NO: 5022 - DNA, 1184 bp, Secale cereale
tcagcaaaaaaaaccctcgctctcttcttcctccccaactaccaccgctcttctctcttctccccttccacctcagacctcggcgcaggcttctcggcggccggcgggcagacatgggcggcggcgccggcggcggggacggggaagagaagcccttcaatttcctccagatcctctgcgagggcgtcatagccggaggcgccgccggggtcgtggtggagacggcgctctaccccatcgacaccatcaaaaccaggctgcaggctgctcgagctggtagtcaaatccaatggaaaggcctgtattccggattaggtggaaatcttgtcggtgttctcccggcttctgctctgtttgtgggaatatatgaaccaactaaacggaagctactggacatgtttcctgaaaatctgagtgctgttgctcatcttactgcaggggctgttggagggttgggtgcttctctcattcgtgtccccacagaggtggtcaaacaaaggatgcaaactggtcaattcaggactgcacctgatgctgttcgtctcatagttgccaaggaaggatttagaggtctttttgctggttatggttcatttttacttcgagatcttcctatttgatgccattcaattctgcatatatgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacaaaacaatactctggaattgtaagctgtgctaagacgatcttgagagaggaaggtcccggcgcctttttgaagggcatcgagccgcgagttctgtggatcggcatcggcgggtccatcttcttcggcgtgctggagaagaccaagtcggtgctcgctgagaggagcagccgcaaggctgcgctggcggagaaggacgagtgaagcaaccaactccacaccattacccgttccttccacctgaagttttgctccaagtttatgtgctaggctttgcgtttctcgttccagaactgttaaggcatatacaatcagtttcaagagtttgttttgacatcggcgatggttctgatcctgtattactccctgtaaacattactcccctttaataa

SEQ ID NO: 5023 - DNA, 1049 bp, Secale cereale
accgctcttctctcttctccccttccacctcagacctcggcgcaggcttctcggcggccggcgggcagacatgggcggcggcgccggcggcggggacgacaagcccttcaatttcctccagatcctctgcgagggcgtcatagccggcggcgccgccggggtcgtggtggagacggcgctctaccccatcgacaccatcaaaaccaggctgcaggccgctcgagctggaagtcaaattcaatggaaaggcctgtattccgggctaggtggaaatcttgttggtgttctcccggcttctgctctgtttgtgggaatttacgaaccgactaaacggaagctactggacatgtttcctgaaaatttgagtgctgttgctcatcttactgcaggggctgttggagggttgggtgcttctctcattcgtgtccccacagaggtggtcaagcaaaggatgcagactggtcaattcaggactgctcctgatgctgttcgtctcatagttgccaaggaaggatttagaggtcttttgctggttatggttcatttttacttcgagatcttccgtttgatgccattcaattctgcatatatgagcaacttcgaattggttacaagctaatggcaaagagggagctgaaggatccagagaatgcactaattggtgcttttgccggtgcgattactggcgctataacgacccccctcgatgttctgaagacaaggttgatgattcaggggcaaacaaaacaatactctggaattgtaagctgtgctaagacgatcttgagagaggaaggtcccggcgcctttttgaagggcatcgagccgcgagttctgtggatcggcatcggcgggtccatcttcttcggcgtgctggagaagaccaagtcggtgctcgctgagaggagcagccgcaaggctgcgctggcggagaggacgagtgaagcaaccactccacaccattacccgttccttccacctgaagttttgctccaagtttatgtgctaggctttgcgtttctcgttccagactgttaaggcatatacaa

SEQ ID NO: 5024 - DNA, 1072 bp, Secale cereale
gacaagcccttcaatttcctccagatcctctgcgagggcgtcatagccggaggagccgccggggtcgtggtggagacggcgctctaccccatcgacaccatcaaaaccaggctgcaggccgctcgagctggaagtcaaattcaatggaaaggcctgtattccgggctaggtggaaatcttgtcggcgttctcccggcttctgctctgtttgtgggaatttacgaaccgactaaacggaagctactggacatgtttcctgaaaatttgagtgctgttgctcatcttactgcaggtgctgttggagggttgggtgcttctctcattcgtgtccccacagaggtggtcaaacaaaggatgcaaactggtcaattcaggactgcgacctgatgctgttcgtctcatagttgccaaggaaggatttagagggctttttgctggttatggttcatttttacttcgagatcttaccgtttgatgccattcaattctgcatatatgagcaacttcgaattggttacaagcttatggcaaagagggagctgaaggatccagagaatgcactaattggtgctttcgccggtgcgattactggcgctataacgaccccccttgatgttctgaagacaaggttgatgattcaggggcaaacaaaacaatactctggaattgtaagctgtgctaagacgatcttgagagaggaaggtcccggcgcctttttgaagggcatcgagccgcgagttctgtggatcggcatcggcgggtccatcttcttcggcgtgctggagaagaccaagtcggtgctcgctgagaggagcagccgcaaggctgcgctggcggagaaggacgagtgaaccaaccaacccaccaagcaattgtgcatcctatgctgacttgctccacaccattgcccgttccttcacctgaagttttgctccaagtttatgtgctaggctttgcgtttcttattccagaactgtaagacatatacaatcagtttcaagagtttgttttgacatcggcgatggttatgatcctgtatgagtccctgtaaacattattctccgttaataaa

SEQ ID NO: 5025 - DNA, 1046 bp, Secale cereale
gagaagcccttcaatttcctccagatcctctgcgagggcgtcatagccggaggagctgccggggtcgtggtggaaacggcgctgtaccccatcgacaccatcaagaccaggctgcaggctgctcgagctggaagtcaaattcaatggaaaggcctgtattccggactaggtggaaatcttgtcggtgttctcccggcttctgctctgtttgtgggaatatatgagccaactaaacggaagctactggacatgtttcctgaaaatttgagtgctgttgctcatcttactgcaggtgctgttggaggcttgggtgcttctctcattcgtgtccccacagaggtggtcaaacaaaggatgcaaactggtcaattcaggactgcacctgatgctgttcgtctcatagttgccaaggaaggatttagaggtctttttgctggttatggttcatttttacttcgagaacttccgtttgacgccattcaattctgcatatacgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacaaagcaatactctggaattgtaagctgtgctaagaccatcttgagagaggaaggtcccggcgcctttttgaagggcatcgagcctcgagttctgtggatcggcattggcgggtccatcttcttcggcgtgctggagaagaccaagtcggtgctcgctgagaggagcagccgcaaggctgcgctggcggagaaggatgagtgaaccaaccaacccaccaagcaattgcccgttccttcacctgtaagtttgcctccaagtttatgtgctaggctttgcgtttcttattccagaactgttaagacatatactatcagtttcaagagtttgttttgacatcggcgatgatggttatgatcctgtacgagtccctgtaaacattattctcctttaataaagtt

SEQ ID NO: 5026 - DNA, 1235 bp, Triticum aestivum
ggcgggcgggcaggcatgggcgccagcgggggcggggaagacaagcccttcaatttcctccagatcctctgcgagggcgtcatagccggaggagctgccggggtcgtggttgaaacggctctgtaccccatcgacaccatcaagaccaggcttcaggctgctcgagctggaagtcaaatccaatggaaaggcctgtattccggactaggtggaaatcttgtcggtgttctcccggcttctgctctgtttgtgggaatatatgagccaactaaacggaagctactggacatgtttcctgaaaatttgagtgctgttgctcatcttactgcaggtgctgttggagggttgggtgcttctctcattcgtgttcccacagaggtggtcaaacaaaggatgcaaactggtcaattcaggactgcgcctgatgctgttcgtctcatagttgccaaggaaggatttagaggtctttttgctggttatggttcatttttacttcgagatcttccgtttgatgccattcaattctgcatatatgagcaacttcgaattggttacaagcttatggcaaagagggagctgaaggatccagagaatgcactaattggtgcttttgccggtgcgattactggcgctataacgacccccctcgatgttctgaagacaaggttgatgattcaggggcaaacgaagcaatactccggaatcgtaagctgtgctaagacgatcttgagagaggaaggcccaggggcattcttgaagggcatcgagccgcgagttctgtggatcggcatcggtgggtccatcttcttcggcgtgctggagaagaccaagtcggtgctcgctgagcggagcagccgcaaggctgcgctggcggagaaggacgagtgaaccaaccaacccaccaagcaattgtgcatcctatgctgactcactccacatcattacccgttctttcacctgaagttttgctccaaatttatgtggtgggctttgcgtttctcgttccagaactataaggcatacaatcagtttcaagagtttgttttgacgtcggcgatggttatgatcctgtatgagtccctgtaaacattactctcctttaataaagtttagcagattgttcttcaaaaacttttaatctgaagaggggcctgctgtgccgctcatgttgcttctgggtagtccttttcaaatttgatctttactctgccattaattattgcattcacagagac

SEQ ID NO: 5027 - DNA, 1298 bp, Hordeum vulgare
gcgattgtatccaagggtttacctaaccccttcctcctcttctcagctgcgctgccccctccagccagcccacctccacccccgcggctcaagcttccagcccacctcctcccccgcggctcaagcttccgtctccctccaatcctcgcgcgcagaggcagggcggcggtgtccgtctctcggcggcgggaagacatgggcggcgcgtcagctcctcctcccgtggaagagaagccattcaatttcatccagatcctttgcgagggcgtcatagccggaggcgccgccggggtcgtggtggagacggcgctctaccccatcgacaccatcaagaccaggcttcaggctgctcgagctggaagtcaaattcaatggaaaggcctgtattctggattaggtggaaatcttgtcggtgttctcccggcttctgctctgtttgtgggaatatacgaaccaactaaaaggaagctactggacatgtttcctgaaaatttgagtgctgttgctcatcttactgcaggtgctgttggagggttgggttcttctctcattcgtgtccccacagaggtggtcaaacaaaggatgcaaaccggtcaattcaggactgcgcctgatgctgttcgtctcatagttgccaaggaaggatttagaggtctttttgctggttatggttcttttttacttcgagatcttccgtttgacgccattcaattctgcatatacgagcaacttcgaattggttacaagattatggcaaagagggagctgaaggatccagagaatgcactcattggtgcttttgccggtgccattactggcgccataacaacacccctcgatgttctgaagacaaggttgatgattcaggggcaaacaaagcaatactctggaattgtaagctgtgctaagacgatcttgagagaggaaggtcccggcgcctttttgaagggcatcgagccacgagttctgtggatcggcatcggcgggtccatcttcttcagcgtgctggagaagaccaagtcggtgctcgctgagaggagcagccgcaaggctgcgctggcggagaaggacgagtgaaccaaccaaccaagacaattgtgcatcctatgctgactcgctccacaccattacctgttcctttcacctcaagttttgccccaattttttatgtgttgggcagttccggtttcaagagttcgttttgatgtcggcgattgttacgatcctgtatcattccctgtaaacattactatcctttgataaaacttagcagtttgttctaaaaaaaagggagttta

SEQ ID NO: 5028 - DNA, 1360 bp, Manihot esculenta
agacgaaaggctgctcagctctgctctgccgccttctccactctcattatttctggacacctctgatgggtccttttacattagctattgatgcaaaaggctcttccaaggtgccttcaggttttgcagatgccccaattaggaaaatgcaaaactcttctcatctgaaagcaagaaaggcttttgcatcaatgagcgtgcaagaagaaaaaccattcgattttttgcgtactttatttgagggagttatagcaggaggtacagctggtgttgtagttgaaacagcattatatccaattgacacgataaagacaaggcttcaggcagctcgtggtggtgggaaaataattctgaagggtctttactctggactggctggaaatcttgctggtgttttaccggcttctgcattatttgttggagtatatgagcctacaaagcagaaattattgcgaatgtttcctgaaaatcttagtgctgtagctcatctaactgcaggtgccattggaggggttgctgcttctctaattcgtgttcccacagaggttgttaagcaaagaatgcagactgggcaatttacctcagccccagatgctgtccgccttattgtctctaaggaaggttttaaggggctctatgcaggatatggatcatttctgttgcgagatttgccatttgatgcaattcagttttgtatctatgaacaacttcggataggttataaagcagcggcacggcgagaattgaatgatccagaaaatgctatcattggtgcttttgcaggtgcactgactggagctataactacaccacttgatgtgattaagacaaggttaatggttcagggttcagctaaccggtacaaagggatctttgattgtgttcaaactgttgttagagaagaaggacctgctgctcttctcaagggaatagagccaagagttctgtggataggcattggaggttcaatattttttggtgtattagaaagcacaaagcgttatctggttcagaggcgtcctacccctactcaagatcaaaaacaagattaaaattaggtgaatttttctgcttatggatgcatcatcattaaacattcccttaaaacataaatgagaagcattcatataagaataccttgatgacatgatattgctatacttgctggcttgctgcgactggcttcccaatccaaggcttcattgggactctgattcaactgaggatttatgaaggaatccatcaatccctttcaatgggccatgctcattctaattgatgtaggttgattttttttttttgcccatgagaaagcaatttgtatttcacagtatcagttaatctctatcaacatttctgt

SEQ ID NO: 5029 - DNA, 1518 bp, Vitis vinifera
atgaaaataaggaaaaaagaaagggaaaaaaaaattcacgcatcctttcctatcaacccgcttcttcatttgaaaccagactggaacttctcactgttttggagttgttgggtctcaatgggtccttttacgttagccattgatgcgaagaagtcttcactggcggtttcagattcatccaataggaaagtgcaaaatgcgcagcttggaaaaaagaaattttttgcatccatcagcacgggggaggaaaaagaattcaactttttacgtgttctacttgagggcattgtagcaggaggtacagctggtgtggttgttgaaacagctttatacccaattgataccataaagactcgactgcaggcagttcgaggaggaggtaaaatagtttggaatggcctttactctgggttggctggaaaccttgctggggtcttgccggcttctgccatatttgttggtgtttatgagcctacaaagcaaaaactgttacagatatttcctgaaaatcttactgctgttgctcatttgactgcgggtgccattggagggcttgccgcttctctcgttcgtgttccaacagaggttgttaagcaaaggatgcagactggccaatttgcttcagctccagatgcagtacgcatgatcgtttccaaagagggctttaaaggtctctatgctggatatcgatcttttctattgcgagatcttccatttgatgcgattcagttttgcatttatgagcagatgcggataggttacaagttggcagcaaagagagatttgaatgatcctgagaatgccctcattggtgcttttgctggggcgttaactggagctataactacaccccttgatgtgattaagacaaggctaatggttcagggacctgcaaaccagtataatggtatcattgactgtgttcagactattgttagggaagaaggacctcctgctcttttgaagggcattggaccgagagtactgtggataggcattggaggttcaatcttttttggtgtgctggagaggacaaagcgggcgcttgctcagaggcggccttcacctaatcaacactccgacagcccaaagcaggattgaaactacccaagctctaccaatctgaatacctctcttctagactccttggaaagacgaggtgctgaataggcttcctgcaggtagtcctgcagtttttggtatggctagcttagaatggaaagaaaattcagagtaacttcccagttctcacaaataataaagtcattttcctttatttagacgacagataaaagagtcctttgccaaggagatgctgctaatgtactattggtttgccttgtacatgaaaaaccctaaattttctttttagggttcaaaatcaaggaaaggattacttaattctctatataatctataaggactcgagtggcttctaaactggggggaaaaccgatgttcaaccgctgggttctcgacttatttcagaaatgcattgtcttactggatcacatcaaa

SEQ ID NO: 5030 - DNA, 1366 bp, Gossypium raimondii
attgggttatagtttggataaaaaataacataataaaacaattcctaaaaataaaacaaaaaactgaaaaaccagaagagaattttcctatctctttctctttgtattgcagtctgccaaacggaacaatttaccactctcccaataaggaaattcttcttcagtccagtgatagtattatagtggagagtcgaaaagtgtttggtttggttaacatgggtccatttacactggctgttgacaccaagagctcttctctagtatcttctgatgtatcaaataggaagattaaaaacttacagctgcaaacaaagaagtgctttgcatcagtcagcatggaagaggaaaagccttttgattttcttcgtattttatttgagggaatcatagccggaggtacagctggtgttgtggttgaaactgctttatacccaattgatacaataaagacacggctgcaggcagctcgcggtggaggtaaaatagttttgaaggggctttattctggattagctggtaatcttgctggtgtcctaccggcttctgctgtatttgtaggtgtgtatgaacctactaagcagaaactattgaagcttttcccagaaaatcttagtgccgttgctcacttgactgcaggagccataggaggaattgccgcttcacttattcgtgttccaactgaggttgtaaagcaaaggatgcagactgggcagtttacttctgcatctaatgctgttcatgttattgcatcaaaggagggatttaagggcctctatgcgggttatggatcttttttattacgagatttgccatttgatgccattcaattctgcatctacgagcaaattagaattggttacaaggcagcggctcgaagagatttaaatgatcctgagaatgctattattggtgcttttgctggtgcgttgactggagcaataacaactcccctggatgttattaaaacgaggttaatggttcagggatcagcaaaccagtacaagggaatctttgattgtgttcaaactattattagggaggaaggcccctctgctcttcttaagggcattcagccaagagtgttgtggatcggtattggcggttcaatcttttttggcgtccttgaaagcacgaaacgactacttgcagagaggcgtcccaaacccactcagcaatcacaacatgattaactcctctgaccgatctcagatgtttctgagttttaagttgttttctgttttaacattcgttaaaagttcatgcagaagggggaaaatgttaatggtgaagaaagcattttgtaaggatcgattttcgtttaacaagaaaaatgatttttttttattacctaatttttactcttcta

SEQ ID NO: 5031 - DNA, 1368 bp, Theobroma cacao
caaatgaaaatacttgtcattcattttctttcaaaataaattcaccaaaaaatgaaaattttaccgttaccggttagggccaatggcccacgttacaaaatgggctcatctgttgactttggcccatttctgctgctgtcattacagcattagaaaaaccgaaccgagcagggttcttgttctatctctttccttgtacactgccaaacttaccagaattgccactctgccaaagagggaaattcttcttcagtgaaagtatagtggaaagttgaaaagtgtttggtttggtcctctagacatgggtccttttacactggccattgacaccaagagctcttctattgtctcttcagatgtatccaataggaagatccaaaacttacagctggaaacaagaaagtgctttgcatcagtcagcatggaagaggaaaaacctttcaatttcctacgtattctatttgagggtatcatagcaggaggtacagctggtgttgtggttgaaacagctttatacccaattgatacgataaagacacggctgcaggcagctcgtggtggaggcaaaatagttttgaaggggctttattctggattggctgggaatcttgctggtgtcctaccggcttctgccttatttgttggtgtctatgagcctacaaaacagaaactattgaagctcttccctgaaaaccttagtgcttttgctcacttgactgctggggccgtaggaggaattgctgcttcacttattcgtgttccaactgaggttgtaaagcaaaggatgcagactgggcagtttacttctgcttctgatgctgttcgtcttattgcatcaaaggagggatttaagggtctttatgcgggttatggatcttttttattacgagattttccatttgatgccattcaattctgcatctacgagcaactcaggattggttataaggcagcggctcggcgagatttaaatgatcctgagaatgctattattggtgcttttgctggtgcattaacaggagcaataacaactcctcttgatgttatcaagacaaggttaatggttcagggatctggaaaccagtataaggggatctttgattgtgttcaaacaattgttagggaggaagggcctcctgctcttcttaagggcattggaccaagagtcctgtggattggtatcggcggttcaatcttttttggcgtccttgaaagcacgaaacggttccttgcacagacgcgtccgccacccagtcaacactcaaaacatgattagaatttattgactgggcgaaataactgcttcatatttcactgtttttaacattttttacggttcaatatcgacaataaaaggggaaaattttt

SEQ ID NO: 5032 - DNA, 1519 bp, Citrus clementina
gactcaaatcaattgtctagccacaaattggccattccgggatttcggctggactgtttgtgattgaacccacaatttttttcaccaaaacaaaaaacgagcgcctccttctatctcttccctcgacgagtctagaagacaaagctcttgttgtataactgtcaccggctgttgttgagttacatattgtcactattcagttagctactatcattgaattgggagttattgaaccctaatggctcctttgacactaggcgtcgatgcaaaaacctcttcagatgtatccaattggaaaatgcaaaacttgcagctagagacaaaaaagctatttgcatctgttagcatgggtgaagaaaaaccatttgatttctttcgaattttgtttgagggtgttatcgcaggaggtacagctggtgttgtggttgaaacagctttgtatcctattgataccataaagacacggctacaggctgttcgtggtggagggaaaataaatttcaagggtctttattctggattggctggaaatcttgctggtgtcttaccggcttctgcgttgtttgtcggtgtgtatgaacctacaaagcagaaattgttgcagatctttcctgaaaatcttagtgctgctgctcatctgacagcgggtgccataggaggatttgctgcttcccttgttcgtgttccgacagaggttgtaaagcaaagattgcagactgggcaatatgcttcagctcctgatgcagtccggcttattgcttctaaggaaggatttaagggtctttatgcgggatatggatcttttctattgcgggatttgccctttgatgcaattcaattctgcatctacgagcagcttcggatcagttataaggctgcagcacgtagagatttgaatgatcccgaaaatgctatcatcggtgcttttgctggtgcgataaccggggctataactactcctctggatgtgattaagacaaggttaatggttcagggatcagcaaaccagtacaaaggaatctttgattgtgttcaaactattgttagagaagaaggacctcctgctcttctaaagggcattgggccgagagtaatgtggataggcattggcggttcaatcttctttggagtcctagaaagaacaaaacggatgcttgctcagaggcgtcctgtacatgatcaaaattcaaaggaggattaaaatttcaatgtcagtcctgagacattttctatggtacgtttattcatttctccgacattgcttaaaacccgaaaccatatgtctcctgctcttctgtttttccccttgtagattctcgagcagtggactttcggaagagaagattagatgggaccttactaatccactgaattaggcatctcaaacattattaataacagaaatgtatcctcggtgaaaattttaagctatatatgatgagctaggctcgaacattcatttgattctttgtacaaacatagtttctcctatagggaaatgcattctacttttagcgct

SEQ ID NO: 5033 - DNA, 1509 bp, Citrus sinensis
caattgtctagccacaaattggccattccgggatttcggctggactgtttgtgattgaacccacaatttttttcaccaaaacaaaaaacgagcgcctccttctatctcttccctcgacgagtctagaagacaaagctcttgttgtataactgtcaccggctgttgttgagttacatattgtcactattcagttagctactatcattgaattgggagttattgaaccctaatggctcctttgacactaggcgccgatgcaaaaacctcttcagatgtatccaattggaaaatgcaaaacttgcagctagagacaaaaaagctatttgcatctgttagcatgggtgaagaaaaaccatttgatttctttcgaattttgtttgagggtgttatcgcaggaggtacagctggtgttgtggttgaaacagctttgtatcctattgataccataaagacacggctacaggctgttcgtggtggaggaaaataaatttcaagggtctttattctggattggctggaaatcttgctggtgtcttaccggcttctgcgttgtttgtcggtgtgtatgaacctacaaagcagaaattgttgcagatctttcctgaaaatcttagtgctgctgctcatctgacagcgggtgccataggaggatttgctgcttcccttgttcgtgttccgacagaggttgtaaagcaaagattgcagactgggcaatatgcttcagctcctgatgcagtccggcttattgcttctaaggaaggatttaagggtctttatgcgggatatggatcttttctattgcgggatttgccctttgatgcaattcaattctgcatctacgagcagcttcggatcagttataaggctgcagcacgtagagatttgaatgatcccgaaaatgctatcatcggtgcttttgctggtgcgataaccggggctataactactcctctggatgtgattaagacaaggttaatggttcagggatcagcaaaccagtacaaaggaatctttgattgtgttcaaactattgttagagaagaaggacctcctgctcttctaaagggcattgggccgagagtaatgtggataggcattggcggttcaatcttctttggagtcctagaaagaacaaaacggatgcttgctcagaggcgtcctgtacatgatcaaaattcaaaggaggattaaaatttcaatgtcagtcctgagacattttctatggtacgtttattcatttctccgacattgcttaaaacccgaaaccatatgtctcctgctcttctgtttttccccttgtagattctcgagcagtggactttcggaagagaagattagatgggaccttactaatccactgaattaggcatctcaaacattattaataacagaaatgtatcctcggtggaaatgttaaactatatatgatgagctaggctcgaacttttatttgattctttgtacaaacatagtttctcctatagggaaatgcattctgcttttagcgct

SEQ ID NO: 5034 - DNA, 979 bp, Platanus occidentalis
atacattcaagaataaaatgcgtaactcccaattggagccaccgaagctttttgcctcggttagcatggaggaggaaaagccattcgatttcttacgtgttttatttgagggtgtcatagcaggaggtactgctggtgttgtcgttgaaacggctttgtacccaattgatacgattaagactcgcctgcaggcagctcgtggtggaggacaaattcttttgaagggcctttattctggacttgctggaaatcttgctggtgtcttaccggcttctgccatatttgttggtgtatatgaacctacaaagcagaaattgttaaggatcttccccgaaaaccttactgcttttgctcatttgactgcaggtgccatcggaggagctgctgcttctcttgtccgtgtaccaacagaggttgtcaagcaaaggatgcagactgggcaatttgcttctgctcctgatgctgtccgccttatagttgctaaggaggggtttaaaggcctttatgcgggatatgggtcttttttattgcgagatttaccatttgatgccatccagttttgcatctatgagcagcttcgtctagggtgtaagctagcggcaaagagggatttaaatgatcctgagaacgctatcattggtgcttttgcgggtgcactaactggagctataactacacctcttgatgtgattaagacaagactaatggttcagggatcagcaaaccagtacaaaggcgtttttgattgtgttcagaccattgttagagaagaaggatctcttgctcttttgaagggaattgggccaagagtactttggataggtattggtggttcaattttctttggtgttcttgagaggacaaagcgtttgcttgctgaaaggcgacctggggctcaaagctcggactccaacaagcaggactgatatttgctagttcatgtctatgctcagtctagtttttctttatgtttctttta

SEQ ID NO: 5035 - DNA, 1154 bp, Saccharum officinarum
ccagagtcgcaaaacctgtcctccactcttcctcagagcccaagccaaagtaactcgacgcttgcgctcgctcatttcccaacgcgcacggcgcacccgaacatggccgctccgaccgccgccgtcgacaccaccgccccgcctcttcctccctcggcagagcccgcgactgcacccgcaccggatcaaaaggtctctcctcctcctcatgcccctcagcccgatgcgcctgcgcccgcgccagccccggctcccgcgcccgtgcccgcgcccgcgccagcgccagcgccagcgccagcgccgaggaagcggaagctcgaggaagcgggtttccacgcctccgaatactacaagatccgtgccgtcgttgccgacctgcgtgtccgcttcttccaggtttaccaagctactgatttccgcaacacggatgctgctcgtgatattttgaaagaaataaatgtggtcatggatctatccaagaaaatgaggctcaagcttggtgctacgtctgatcctgtgaaaccattggagaaaccttcagctggacttgtgaaggatgagcttgtgaaaccatcagagaagccttctgctggacctgtgacggaagagcctgtgaagccacaagagaagccttcagctggacctgtgaaggacgagcctgtgaaaccatcggagaagccttctgctgaacctgtgaaaaatgaacccactgagccagttccagctggagaaaacaatcaagctcccggggtaagccagactacaatttctccaaataatgcaggtgttggtgcaccagtagtcaagcatgataactcagaggcgaagtgaagatgatagaggagacccaaagccccgatccattcagatggcatattatggagatctgctcgacaaaaatgcagggtggccggttgatcccctatgggcccagatgttcttgcctctcctgtaggtaaaattgtttgcttttgggctaatcgacgaagagtgttcacattcagatggcatatcaagatccaaattagatggtgttcagtggttcacattcattcattctgtactgtgttgctattgcccatggaaaattaatcttaaatagtaactctgtaatggatcattcttacatcacattgcccttttgtatgaagtat

SEQ ID NO: 5036 - DNA, 1216 bp, Zea mays
acaaaacgtgcctttcctcatagcccaagcccaccgtcagcacgcttacactcgctcgtttcccaacgcgcacccaacatggccgctccgaccgccgccgtcgacactgccgccccgcctcctcctccctcggcagaggccgcggctgcacctgtactggatcaaaaggtctctcctgctgctgcccctcagcccgatgcgcccgcgcccgcgcccgcgccgaagaagcggaagctcgaggaagcggggttccacacctccgaatactacaagatccgtgccgtcgtcgccgatctgcgtgttcgcttcgtccaggttcacgaagctactgatttccgcaacacggatgctgcacgtgagattatgagagaaataaatgtggtaatggatctatccaagaaaatgaggctcaagcttggtgctacttctgaacctgtgaaaccattggagaagccttcagttggacttgtgaaggatgagcttgtgaaaccatcagagaagccttcatctggacctgtgacgggggaacctgtaaagccaccggagaagccttcagctggacctgtgaaggacgagcctatgaaaccatcggagaagccttctgctgaacctgtgaagaacgaacccagtgagccagctctagctggagaaaacaatcgagctcccagggtaagccagactacaagttctccaaataatgcaggtattgatgcaccagtagtcaagcatgataactcagaggcacggaagtgaagacgatagaggaagcccaaagtaccgatccatcgagatagcatatcacgcaaatctgctggacaaaaatgcagagtgaccggttgattccataggggctcagatttttcttgcccctatcgggggtaaaattattcgctttgggctaatggacgaagagtcgtggacacatcgagatccaaactagattgtcttcagttgttcatatccattcattcagtactatgttgctaatttcccatgaacaattttatcttcaaatagctactctctaactgcatcattctatacatcacattggcctgcagcctgctgtatgaagttaattgccagtcaatttcaagtcgtgcttgagaagaggtgatggaattgcaagcgagttgtaaggctttctggctcacctcacatttcaaacttcattctatgtgcagtccatggtgtaaaacagtattttgcacaacca

SEQ ID NO: 5037 - DNA, 983 bp, Zea mays
cacgaacaccgtcaccacacggcgcacccaaacatggccgctccgaccaccgccgtcgacaccaccgccccgcctcctcctcctcccacggcagagcccgcggctgcacccgcaccggatcaaaaggtgtctccgcctcctcctgcccctcagcctgataccgctgctcccccgcccgttcccgcgccagcgccgaggaagcggggttgcacacctccgaatgctacaagatccgtgccgtcgtcgccgacctgcgtgtccgcttcgtccaggtttgccaagctactgatttccgcaacacggatgcagctcgtgagattttgaaagaaataaatgtggtcatggatctatccaagaaaatgaggctcaagcttggtgctacttctgagcctgtgaaaccactggagaaaccttcagctgggtttgtgaaggatgagcttgtgaaaccatcagagaagccttcagctggacctgtgaacgacgagcctgtgaaaccatcggagaagccttctgctggacctgtgaaaaatgaacccactgagccagctccagctggagaaaacaatcaagctcccactgtcggtcagactacagtttctccaaataatgcaggtgttggtgcaccagtagtcaagcatgataattcagaggcgcaaaagtgaaggtgatagaggaaacctgaagtcccgatccattgagatggcatatcgtgcacatctgctcgacaaaaatgtagagtggccggttgatcccctgtgggctcatattatctttcttctactgtaggtaaaattgtttgctttgggctaatcgaagaagagtggtgggcatatcatggtccaaatttggttgtgttcagttgttaacatccatccattctgtactatgtcgctaattgcccatgaatagtttaatctttaaatagttactctataataactggatcattctatacatcgtattgccctgttgtacgaagtatt

SEQ ID NO: 5038 - DNA, 2975 bp, Saccharum officinarum
aggagagggagcgagagggaggcggaggccatcatcccattcgccggctggtcctgatccttgtccgggtctatttgggcggcgccgcacgcagcaggaggaaaagatcagcgcggggcgaggcgtcaaacccatctccgccgcgggaaccactggcatttaggatggtggacaagaatgatgggtcagagggtcttaaattcaacacgtcaaacctcattcaaacaaccgaagaggttgcaagagcgtttattgctgcggcttcggccgccactgcacagtctgcacgaccatctgtagtgtattcatccaaagatgagagtggcagcccaatgcagaagcttcagcagcaattttcgaaaatcatgaaagggttttcgtcctcaccagacctgtcaggaacttacaatccagaagtgcttacaacacaaaagcggcagtggtcgagggtgataggtgcatcagagaaccatcacatctgttcgagagcatagtgattgttgggcttccacctcacgcagatatccaggagctggaaaacattgcactagggagaaatgatgaagatggaaagagatcaagaaatttatttagcaatagccaccaagttcacgcaatatcaaatttggaaccacaggttctttttgcataccctccagagaaacctcttccactcaagtacaaggataccctctctttctgccttcccggaggtgtacaggttcatgctgtcgaacgtactccttcattcagtgagctgaatgaaattctcctgggacaggaacagcttaaagaaagcaaccaatcatttgtgttccgcctacaggtcgctgataactctgcattatatggatgctgtgtgctggttgaagagatcgtacagagaccatcaaagttggtatcgatgctcatgaatgacaaacccgtctttccacgccggagtcgatacgtgataactacgccccggtgttattgcatcctgtccaggcttccgttctttgaactgcattttggggtgttgcagagtattcttatggaagacgtctcgagtggctcacagatggtgttagcatgctaacttccttatcgcttgaggaatcctgtgagaatgatatctgtgaaggaactgaagttacagcacagaaacagtatttagatagtaacacaagtgatgtggataaatcatctgaatctagcatgggagtttcatcaaaggagctctctgacactgacagcagttctgggtgtagagagaaccagcttgactctgtttctaaagaacaacagcaaaatagttcttgtgataaagagcagagtgatcttaaaagagcaattgtcacttgttgtgatgcttctgaagtgtctgatcattttgttcccgaagatacatcatctggtcagtctggagctaagcatcatgaacttgattctgcatcaggtatccaggatgaatctggtgcaaagaactgtgatgattctccgaagggaaatgtggatgatgaggagcttgaactcttcattactgatactattttaccacttatgcgatctcgcctttgtgaagattgtgaatcatctccaagttcacagggttctccttctgaaggcagaaatttcgacacccaggaatcggattcagaggagccatcttccatcggcgatggagacttagttagacacaacaacatactgcagtgggctaaggcaaagaaatatggttctttgcaagttgtctgtcaatactaccagttacagtgtcctgctaggggttcatcacttacttttcatcccttggagcatttgcatcctttgagttttcaccggccaggtgaaacagttcttcacattgctggttctactattgagcttaggtcacgtgatacaagcttagaggttgctgagatgcggaattcactctttgctgaggaggaatcgactgctttatccacatgggcggtggcatccatttgtggatgcctaaggttggaacatgtaatgacactttttgctgccgcactcctggagaaacagattgttattgtctgttctaatctgggattgttgtcggcttcagttttgtccatcttacctctaatacgaccgtataggtggcatagtctcctcacgacggttttgcctaatgacatgatggattttctggatgccccagttccatacatagtgggtgtacaaaacaagacatctgatttgctcaacaggctaccaaatgccgtggtcgttgatgccaacaggaatcagattaaatcttcttcagttccgcaactaccacagcacagagagttgctttctgccttgcgcccatatcattcaatacttgttggcgaaagttatctagcaagaaaacgtcctgtttacgaatgcacagattcccaggtggaagcggccaaaggtttcttggcggtgcttagagactaccttgacacgctatgctcgaacttgagatctcatacaattactaatgtgcaatctaacaatgacaaggtttccttacttttaaaagagagctttattggttctttcccaatccgggataggccttttatgaagctttttgtggacacgcagttgttctcagtacagacagacctagttctctctttttatcagaaggactaagtgtctgacagacttgaatgtctgtctcatcttgccatgcctttagatgttgagctaaactgtacatatcggcttagaaagaatgagttgccttcgtcactttggcagctcagtgtttgtgttaagagctggaaggagaagccatatactgtcaggaaaaattggtagatgtcaggatccagttatgggtattgaagaagaatgcctatagctgttgtaagttagtctggtgcggtgatccgcaatctaaggttttgtaggctgtagtaggtgccccaataaagaagccttctggattgttcctgcaatgcctgtgctgtaaggaaccatgtctgcgg

SEQ ID NO: 5039 - DNA, 3210 bp, Zea mays
gaggaggccatcgcatccgccggctggtcctgatcccggtcccgggtcgtatttgggcgccgccgcacgcagcaggaggaagacatcagcgcggggcatttaggatggtggacaagaatgatgggtcagagggtattaaattcaacacatcaaacctcattcaaacaaccgaagaggttgcaagagcgtttatcgctgcggcctcggctgccactgcacagtctgcacggacatctgtagtgtattcatccaaagatgagagtggcagcccaatgcagaagcttcagcagcatttttcgaaaatcatgaaagggttttcgtccgcaccagacctgtcaggaacttacaatccggaagtccttacaacgcaaaagcggcagtggtcgaggtaccagatgaagtcattgggtgataggtgcatcagagaaccatcacatctgttcgagagcatagtgattgttgggcttccacctcacgcagatatccaggagctggaaaacattgcattagggagaaatgatgaagatggaaaaagatcaaaaaatttatttggcaatagtcaccaccaagttcacgcaataacaaatttggaaccacaggttctttttgcataccctccagagaagcctcttccactcaagtacaaggataccctctctttctgccttcccggaggtgtacaggttcatgctgtcgaacgtactccttcgttcagtgagctgaatgaaattctcctgggacaggaacagcttaaagaaagcaaccaatcatttgtgttccgcctacaggtggctgataactctgcattatatggatgctgtgtgcttgttgaagagatcgtacagagaccatcaaagttggtatcgatgctcatgaatgaaaaacccgtctttccacgccggagtcgatatgtgataactacgccccggtgttattgcatcctatccaggcttccattctttgaactacattttggggtgttgcagagtattcttatggaagaacgtcttgaatggctcacagatggtgttagcatgctaacttccttatcgcttgaggaatcctgtgagaacgatatctgtgaaggaactgcagttacagcacagaaacattatttagatagcaacacaactgatgtggataaatcatctgaatctagcaatggagtttcgtcaacggagctgtctgatactgacagcagttctgggtgtagagaaaaccagcttgactttgtttctaaagaacaacagcaaaatagttcttgtgaagaacagagtaattttaaaagagaaatagtcacttgttctgatgcttccgaagtgtctgatcattttgttccagaagatacatcatctgatcagtctggagttaagcaccatgaacttcattctgcaccaagtatcccggatgaatctggtgcaaggaactgtgatgattccccgaaggaaaatgtggatgatgaggagcttgatctcttcattatagatactattttaccacttatgcgatctcgcctttgtgaagattgtgaatcatctccaagttcacagggttctccttctgaaggcagaaattttgacacccaagaatcggattcagaggagccatcttccattggtgatggagacttagttaaacacaacaacatactgcagtgggctaaggcaaaaaaatatggttctttgcaagttgtctgtcaatactaccagttacagtgtcctgctaggggttcaacacttgcttttcatcccttggagcatttgcattctttgagttttcaccggcctggtgaaacagttcttcacattgctggttctactattgagcttaggtcacgtgatacaagcttagaggttgctgagatgcgcaatgcactctttgctgaggaggaatcgactgctttgtccacatgggcagtggcatccatttgtggatgcctcaggttggaacatgtaatgacactttttgctgccgcactcctggagaaacagattgttattgtctgttctaatctgggaatgttatcggcttcagttttgtccatcttacctctaatacgaccgtatcagtggcagagtctcctcatgacggttttgcctaatgacatgatggattttctggatgccccagttccatacatagtgggcgtacaaaacaagacatctgatgtgctcaaccggctaacaaatgccgtagtcattgatgccaacaggaatcagattaagtcctcttcagtcccacaactaccacagcacagagagttgctttctgccttgcgcccgtatcattcaatacttgttggcgaaagttatcttgcaagaaaacgccctgtttatgaatgcacagatgcccaggtggaaggggctaaaggtttcttggcagtgcttagagactaccttgacacactatgctcgaacttgagatctcatacaattaccaatgtgcaatctaacaatgacaaggtttccttacttttaaaagagagctttattggttctttcccaagccgggataggccttttatgaagctttttgtggacacccagttgttctcagtacatacagacctagttctctctttttatcagaaggactaagtgtctggcagacttgaatgtctgcctcgtcttgccaagcctttagatgttgagctaaactgtacatatcggcagctcagtgtttgtgcaaagagctcgaaggagaagccatataccgtcagaaaaaagtggtagattgccaggatccagttatgggtattgaagaagaatgcttgtagctgcttaagttagtctggtgcggtaatccaaggttttgttggctgtagttggtgcccccataagaagccttgtatggattgttcctgcaaatgcctgtgctgtaacggaaccgtgtctgtggcaaaatctccgaacatgaatgcgtccatttggcaaatctaagcgtgcaatgagacatcgaagaaaatgtaataattcgtggtactccctccaggccgaatcagttgacgctatggtatttaataacggtcgagctttcttattttaaactagatttgtagaaatattaacaatatttgtattattagaaaagtttattactaaaacagattcagagatttatataacaatactagttatgtgctttgagacagtgaaataggggaatgattgattattgagagcaagtctcagtacatataggcaaggaaat

SEQ ID NO: 5040 - DNA, 3209 bp, Panicum virgatum
attaaaccagggaaaaaaaagaggggagcaggcgcaaggacgagggagggaggccatcccattcgcgggctggttcgggtccatttgggcggcgccgcacacgcagcaggcagagatcagcgtgggggcgaagcgtcaaacccatctcctccgccgccaccgtcgcgggcaccactggcatttaggatggtggacaagaatgatgggtcagagggtcttaaattcaatacatcacatctgattcaaacaaccgaagaggttgcaagagcatttatcgctgcagcttcagctgccactgcacagtctgcacggccatctgttgtgtattcttccaaagatgagagtggcagcccaatgcagaagcttcatcagcaattttcaaaaattatgaagggtttttcatcctcaccagacctgtccggaccttacaatccggaagtgctcacaacgcagaaaaggcagtggtcgaggttccagctgaagtcattgggtaataggtgcatcagagaaccatcacatctgtttgagagcatagtgattgttgggcttccacctcaggcagatatccatgagctggaaaacattgcactagggacaaatgatgaggatggaaagagaccaagaaatttatttggcaataaccaccaccaagttcatgcaatatcaaatttggaaccacaggttctttttgcataccctccagagaagcctcttccactcaagtacaaggataccctctctttctgccttcccggaggtgtacaggttcatgctgtcgaacggactccttcatttagtgagctgaatgaaattctcctgggtcaggaacagcttaaagaaagcaaccaatcatttgtgttccgcttacaggttgctgatgactctacattatatggatgttgtgtgctagttgaagagatcgtacagagaccatcaaagctgctatcgatgctcatgaatgaaaaacccatctttccacgccggagtcgctatgtgataactacaccccggtgttattgcatcctgtccaggcttccgttctttgaactgcattttggggtgttgcagagtattctcatggaagaacggctcgaatggctcacagatggtgttagcatgctaacttcattatcgcttgaggaagcctgtgaggagaatgatatctgtgaaggaactgaagatacagtacagaaacagtacttagatggtagcacgactgaggtggataaatcatctgaatcaagcacgggaggtttcttcaaaggagctgtctgacactgacagcagttctgggtgtaaggagacccaacttgactttgtttctaaagaagggcaccggcaggatagttcttgtgctaaagaacagagtgatgttgaaatggaaactgtcactcgttgtgattcccctaaagtgtctgaccattgtgttccagaagatatatcatctgatcaatctggagttaagcatcatgaacttgattctgcacctgatatccagaatgaatcctgtgcaaggaagaattgtgatgattctccacagggaaatgtggatgatgagcagcttgatctctttattactgatactattttaccacttatgcgatctcgcctttgtgaagattgtgaatcatccccaagttcacaggattctccttctgaaagcagaaatctcagaagtgacacccaggaatcggattcagaggagccatcttccattggacatggggacttagttagacacaacaacatactgcagtgggctaaggcaaaaaaatatggttctctgcaagttgtctgtcagtactaccagctacagtgtcctgccaggggttcatcacttaattttcatccattggagcatttgcatcctttgagttttcaccggccaggtgaaacagttcttcatattgctggttctactattgagcttaggtcacgggatacaagcttagaggttgctgagatgcgtaatgcactttttgctgaggaggaatcaactgctttatccacatgggcagtggcatccatatgtggatgcctcaggttagaacatgtaatgacactttttgctgctgcgctcctggagaagcagattgttattgtctgttctaatctgggaatgctatcggcttcaattttgtccatcatacctctaatacgaccgtatcagtggcagagtctgctaatgccgattttgcctattgacatgatggattttctcgatgctcctgttccttacatagttggtgtacagaacaagacatctgatgtgctcaacagactatcaaatgctgtagtcattgacgccaacaggaatcagattaagtcttcttcagtcccacaactaccgcagcacagagagttgctttcttcattgcgtccataccattccatacttgttggagaaagttatcttgcaagaaagcgtcctgtttatgaatgcacggatgcccaggtggaagcggccaaaggtttcttggcagttcttagagactaccttgatacactgtgctcgaacttgagatcccatacaattaccaatgtgcaatctaacaatgacaaggtttccttacttttaagagagagctttattggttcattcccgagccgggataggcccttcatgaagctttttgtggacacacaactgttctcggtacacacagacctagttctctccttttatcaaaaggactaagtgtctgttacagacttgaatgtctgtctcattggcaagtctttaggtgctgagcttaactgtacatatcggtttagaagaatgagctgccttcatcactttggcagctcagagatgggttaagagctgcaacggacgactcatatactgtctgaaagatgttagattctcaggatccagttatggatactgaagaaaaatgtccctataggtgttgtaaattagtcttgtgtggtgatcggccatctaagattttgtaggcagcagtaggtgcccatatgaagcctcctatggactgttcctacaatgcctgctgcaaaaactccaggcgcaaatatgttcgtttggcaattaatccagcatgcaacgcttcataacttatgctgtaatttgaagaatgtcaagaatcccaagacagtttccaaagtgcagcttgtatctcgtttagcttgatctgtaatttaacgtgcgctatttttcttctaagcatcagtggcaaagtgcatcttgt

SEQ ID NO: 5041 - DNA, 3567 bp, Setaria italica
gccaaatcgccaccacttaaatctgcgcgattcataacgaatcgccatagttaatcgaagcattaaaccagggaaaaaaaagagaggaaaaaaaaaagagggaggggagcaggcacgaggacgagacttggagagggagggaggccatcccattcgcgggctggtttcgggtccattcgggcggcgccgcacacgcagcaggcagagatcagcgcggggcgaagcgtcaaacccatctccgcagcagccgccgccgcgggcatcactggcatttaggatggtggacaagaatgatgggtcagagggtcttaaattcaacacgtcgcacctgattcaaacaacggaagaggtcgcaagagcatttatcgctgcggcttcagctgccactacacagtctacacggccatctgttgtgtattcttccaaagatgagagtggcagcccaatgcagaagcttcagcagcaattttcgaaaatcatgaaaggtttttcatcctcaccagacctgtctggaccttacaatccagaagtgcttacaacgcaaaaacggcagtggtcaaggttccagctgaagtcattgggtaataggtgcatcagagaaccatcacatttgtttgagagcatagtgattgttgggcttccacctcaggcagatatccatgagctggaaaacattgcactagggagaaatgatgaggatggaaagagatcaagaaatttatttagcaatagccaccaccaagttcatgcaatatcaaatttggaaccacaggttctttttgcataccctcccgagaagcctcttccactcaagtacaaggataccctctctttctgccttcccggaggtgtacaggttcatgctgtcgaacggactccttcattcagtgagttgaatgaaattctcctggggcaggaacagcttaaagaaagcaaccaatcatttgtgttccgcttacaggttgctgatgactctacattatatggatgctgtgtactagttgaagagatcgtacagagaccatcaaagctggtatcgatgctcatgaatgaaaaacctgtctttccacgccggagtcgctacatgataactacgaaccggtgttattgcatcctgtccaggcttccattttttgaactgcattttggggtgttgcagagtattcttatggaagaacggcttgaatggctcacagatggtgttagcatcctaacttccttatcacttgaggaagcctgtgaggagaatgatatctgtgaaggaaccgaagttacagcgaaacagtacttagatgctaacacaactgatatggataaatcatctgaatcaagcacgggagtttcgtcgaaggagctttctgatactgacagcagttctgggtgtaaggacacccaacttgactttgtttctaacgaaggggaacagcaagataattcttgtgttaaagaacagagtgatcttgaaacggaaactgccattcattgtgatacccccaaagtgtctgatcattgtgttccagaagatacatcatcggatcagtctgaagttaagcctcatgaacttgattctggtgcaaggaagaattgtgatgattcgccacagggaaatgagggtgatgagcagctggatctctttattacagatactattttaccacttatgcgttctcgcctgtgtgaagattgtgaatcatctccaagttcacaggattctccttctgaaggcagaaatctcagatgtgacacccaggactctgattcggaggagccatcttccattggtcacggagacttagttagacacaacaacatactgcagtgggctaaggcaaaaaaatatggttctctgcaagttgtctgtcagtactaccagctacagtgtcctgccaggggttcatcacttacttttcatcccttggagcatttgcatcctttgagttttcaccggccaggtgaaacagttcttcatattgctggttctactattgagcttaggtcacgggatacaagcctagaggttgctgagatgcgcaatgcactatttgccgaggaggaatcgactgctttatccacatgggcagtggcatccatatgtggatgcctcagattggaacatgtaatgacactttttgctgctgcactcctggagaaacagattgttattgtctgttctaacctgggaatgctatcggcttcagttttgtccatcatacctttaatacgcccgtatcagtggcagagtctgctcataccggttttgccgattgacatgatggattttctggacgcaccagttccctacatagttggtgtacagaacaaggcatctgatgtgctcaacaggctagcaaatgctgtagtcattgatgccaacaggaatcagatcaagtcttcttcagtcccacaactaccgcagcacagagagttgcttgcttccttgcgtccatatcattccatacttgttggagaaagttatcttgcaagaaagcgtcccgtttacgaatgcacggattcccaggtggaagcggccaaaggttttttggcagtgcttagagactaccttgatacactgtgctcgaatttgagatctcatacaattaccaatgtgcagtctaacaatgacaaggtttccttacttttaagagagagctttattggttctttcccgagccgcgataggccgtttatgaagctttttgtggacacacaattgttctcagtacatacagacctagttctctccttttatcaaaaggactaagtgtctgttacagacttgaaagtctgcctcatattgccaagcctttaggcgctgagctcaactgtacatatcggtttagaaagaatgagctgccttcatcactttggcagctcagagatgggttaagagctgcaatggacaactcatatactgtccagaaaatggtagattatcaggatccagttatggatattgaagaagaatgcccctgtagctgttgtaaattagtctagtgtggtgacccgccatctaagattttgtaggcagtactaggaggtgccataagaagccttctactgaacctacaatgcctgtgctgtaaactgtaatggagccatgcctgcagcaaatgtccagaggcgaatgtattcgtttggcgagtaatcaagcctgcaacgtgtcatccaagaacttgctgtaatctgaagaatgtcaagaatccaagacacatacagttccaaactggggcttgtagctctttttgcttgagctgtaagttaacgtgtggtattttttctcctaagcatcagtgtcaaagtgcagcttgtaccccattttcttacatgtgatacaatgtttgacgtcagtctatatgtggtaatttggtaatatccacttgtgcgtcagtgtaatgttctgatttcgctgtcagcaatgtaaatcgaacgatgtggtaagttccaaccatacaatatggcagcagaccagcagtgccttcctttgaactggtcattgtagtgtcaagggcgctatgtcagcaatgtaaattgaacgatgtggcaagttccaagcataccatattgcag

SEQ ID NO: 5042 - DNA, 2915 bp, Pennisetum glaucum
gatgagagtggcagcccaatgcagaagcttcagcagcaattttcgaaaatcatgaaaggtttttcgtcctcaccagacctgtctggaccttacaatccagaagtgctcacaacgcaaaaacggcagtggtcaaggttccagctgaagtcattgggtaataggtgcatcagagaaccatcacatttgtttgagagcatagtgattgttgggcttccacctcaggcagataccaatgagctggaaaacattgcactagggagaaatgatgaggatggaaagagatcaagaaatttatttggcaatagccaccaccaagttcatgcaatatcaaatttggaaccacaggttctttttgcataccctccagagaagcctcttccactcaagtacaaggataccctctctttctgccttcccggaggtgtacaggttcatgctgttgaacggactccttcattcagtgagctgaatgaaattctcctggggcaggaacagcttaaagaaagcaaccaatcatttgtgttccgcttacaggttgctgatgactctacattatatggatgctgtgtactagttgaagagatcgtacagagaccgtcaaagctggtatcgatgctcatgaatgaaaaacctgtcccacgacggagtcgctacgtgataactacgccccggtgttattgcatcctgtccaggcttccgttttttgacctgcattttggggtgttgcagagtattcttatggaagaacgccttgaatggctcacagatggtgttagcatgctaacttccttatcacttgaggaagcctgtgaggagaatgatatctgtgaaggaaccgaagttacagcaaaacagtacttagatgccaacacaactgatatggataaatcatctgaatcaagcacgggggtttcatcaaaggagctttctgatactgacagcagttctgggtgtaaggacacccaacttgaccttgtttctaacgaagaggaacatcaagatcattcttgtgttaaagaacatagtgatcttgaaacggaaactgtcattcattgtgatacccccagagtgtctgatcattgtgttccagtacatacatcatcggatcagtctaaagttaagcctcatgaacttgattctggtgcaaggaagaattgcgatgattctccacagggaaatgagggtgatgagcagcttgatctctttattacagatactattttaccacttatgcgttctcgcctgagtgaagattgtgaatcatctccaagttcacaggattctccttctgaaggcagaaatctcagaagtgacacccaggactctgattcagaggagccatcttccattggtcacggagacttagttagacacgacaacatactgcagtgggctaaggcaaaaaaatatggttccctgcaagttgtctgtcagtactaccagctacagtgccctaccaggggttcatcacttacttttcatcccttggagcatttgcatcctttgaattttcaccggccaggcgaaacagttcttcatattgctggttctactattgagcttaggtcacgggatacaagtctagaggttgctgagatgcgtaatgcactctttgccgaggaggaatcgactgctttatccacatgggcagtggcatccatatgtggatgcctcagattggaacatgtaatgacactttttgctgctgcactcctggagaaacagattgtgattgtctgttctaatctgggaatgctatcggcttcagttttgtccatcatacctttaatacgcccgtatcagtggcagagtctgctcatgccggttttgcctattgacatgatggattttctggatgcaccagttccctacatagttggtgtacagaacaggacatctgatgtgctcaacaggctaacaaatgctgtagtcattgatgccaacaggaatcagattaagtcttcttcagtcccacaactaccacagcacagagagttgctttcttccttgcgtccataccattccatacttgttggagaaagttatcttgcaagaaagcgtcccgtgtacgaatgcacggatgcccaggtggaagcggccaaaggtttcttggcagtgcttagagactaccttgatacattgtgctcgaatttgagatctcatacaattaccaatgtgcagtctaacaatgacaaggtttccttacttttaagagagagctttattggttctttcccaagccgggataggccgtttatgaagctttttgtggacacacaattgttctcggtacatacagacctagttctctccttttatcaaaaggactaagtgtctgttacagacttgaatgtctgtctcatattgctaagcctttaggcgctgagctcaactgtacatatcgggttagaaagagtgagctgccaacgacacataggcagctcagagatgggttacgagctgcaatggacaactcatatactgtccggaaaatggtagattatcaggatccagttattgatattgaaggatggccctatggctgttgtaaattagtctggtgtggtaacccgccatctaagattttgtaggcactaggagttgccataagaagccttctacggaacctacaatgcctgtgctgtaaaatgtaatggggccatgcttgcagcaaatgtctagacgcgaatgtattaatcatgcctgcaacgtgtcatccaaaaacttgctgtaatctgaagaatgtcaagaatccaagagacttgcagttccaaagtgggggcttgtatctcttttttgctcgagctgtaatttaaattgtggtattttgttctcctaagcatcagtgccaagtgcagcttgtatgccattttgttacgtgtgacgtgttacaatgtttgacgtcaatctatatg

SEQ ID NO: 5043 - DNA, 4984 bp, Oryza sativa
gacagatcgccccccagttccagcagactcccactcgtccacgaaaaactcgccttctcaaaatctctcctcccccctcgtccagtccagcccaagcgccgaaccaaatcacgccacttaattttttttccgcgacgaatcgcctctggttttaatcgaacggatcgacgcattaaaccacaaatccgaaggggaaaaaaaaaggagaggaggaggaggaggaggagaggggaaggggaggaggccgccatcccattcgttgctagttcggcgggtccatttcgacggcggcggcggcgcgcgcgcgcgcagcggggagaggagagccgaggcgaggagatcttcgcggggtgaagcttcaaagccctcccctccgccgccgcgtcaggtgaggaagcatttagaatggtggacaagaacgatggatctgaagggctcaaattcaacacatcacacctgatgcaaacaactgaagaggtagcgagagcatttattgctgcagcttctgcagccactgtacagtcaacacgaccatctgtggtgtactcttccagagaagagagtggcagcccaatgcagaagctgcaacaacaattttcgaagatcctgaaagggttttcaacgtcacctgaagtgtctggatcttacaacccggaggttctcacaacacaaaagcgccagtggtccaggttccaactaaagtcgctgggtaataggtgcatcagagaaccatcacatcttttcgagagcattgtgattgttggactccctcctcaggcagatatccatgagctagaaaacattgcactagggagcaatgaggaagatgtaaagaaaccgagaaatatattcggtaacaatcaccaccaagttcatgcattgtcaaatttggaacctcaggttctttttgcataccctccagagaggcctctaccactcaagtacaaggatatcctctcgttctgtcttcctggaggtgtacaggtccatgcggttgaacggaccccctcattcagtgagctgaatgaaatcctcctaggacaggagcaacttaaagaaagcaaccagtctttcgtgttccgtttacaggttgctgatgactctacactatatggatgctgcgtgttagttgaagagattgtacagagaccttcgaagctggtttctatgctcacaagtgaaaaacctgtctttccacgccggagtcgttatgtaataactacaccgcgatgctattgcatcttttccaggctcccattctttgaactgcactttggggtgctacagagtattcttatggaagagcgtctcgaatggctcactgatggggttagcttgcttacatcattatcacctgaggaaacctgtgaggatgatgttgtctgcgaaggaactgaacttgcaacagaaaaacaatatttcgatggtcatgcagtagatctggaaaaatcctctgaatcaagtgtgggagtttgttcaaaggagctgtctgacactgacagcagttctgaatgtagagataaccaattggacttaaactgcaaagaagttcaacaggaatgtgtagtacaggatgatcttgtaacaggaacagctcctcagtgtgatactcttgaaaggcctgacaattgtttatcagaagatacaactgccgatcaatctgggattgagcttcatgaactggattctgtaccagttatcctgaaggaatctgataccacagaaaattgtggctattctttacaggatgatgtgaacgatgaacagcttgacatctttgttaatgatactattctacctctcatgcgctctcgcctttgtgaaggttctgaattatctccaggttcccaggactctccttctgaaggcataaatttcagaagcgatagccatgaatcggatttggaggagccatcatcaattggtcatggagacttagttggccacaacaatatatcgcaatgggctaaggcaaaaaaatatggatctctgcaagttgtttctcagtactatcagctgcagtgtcctgccaggggttcatcccttacttttcacccgttggatcaccttcatcctctaaggtttcaccggccaggtgaaacagttcttcatattgctggttctactattgatctgcggtcatgtgatacaagtttagaggtggctgagatgcgcaatgcgctatttgccgaggaggaatcgactgctttatcaacatgggctgtggcatccatttgtggatgcctcaggttggagcatgtaatgacactttttgctgcagcactgctggagaaacagattattattgtttgttctaatttgggaatgctttctgcttcagttttgtccatcatacctctgatacgcccatatcagtggcagagtctactcataccggtcttgccaaacgacatgatggactttcttgatgcacctgttccatacatagttggtgtgcagaacaagacatccgatgtacattccaggctagtgaacgccgtggttattgatgccaacaagaatcagatcaagtctacttctgtcccgcaactcccgcagcagaaggagttgctttctgccctgcgtccataccattccagactagtgggagagagttttctagcaagaaagaggcccgtttatgaatgtacagatgcccaggtggaagctgccaaaggtttcttggcagtgcttagatcctaccttgattcgctgtgttccaacttgagatctcatacgattactaatgtgcaatccaacaatgacaaggtttccttgcttttaagagagagcttcatcggttctttcccgacccgtgagaggccctttatgaagctctttgtggacacgcaattgttctcagtacatacagacctagttctctccttttatcagaaggactaagtctcttttaagaatttaaccatcttcagtgagctgatttgccaaggtacattctctccttttgttatggcaattctggcatggatattttctgaggcaataactgttaatgttactgctatacttagttcctgtgcacaagtctaaagtgatttgtatgtagaatcgaatggaaatcactttctctggcactatgatgcacctgactttgctaccctcctgatcattgtgtgggggaaggaaagtcctaaaagaaaatcatatgttgatgatttgcagagtccagcaaccaattcatgattattaggtgtgcagtgcaattaagtgcagtgcctaggtaccaattttgcctttatgtatcttgtgtgcaactgatctaatagcatggtgtcttatttcggatatctttctttcggacatttttccctccttttgaaacagtgaagctaccaacagttacagcttgaaagttgaaacctaccgcaagttaaaaccgtgctcaaatgtccatgagataacattgcctttgatattaacactttatgaaatactctatccgtcccagaatatagcaacctaagaccggacttgactcaacctagtactatgaatttggacatgtcttctgtccagattcatagtgcataggttgagccccatctgatccaagattgctatattttcggacggagggagtatgtagccaagtatatttcgatccttaggtgtctactgcatgatgatttattctagtgctcattttaactctctctctctctctctctctctctctttgcattacagtgttagatcccgatctcaactgtacatattgatcttgaaaagatgagctgcctttttattacattggcagctcaacgttgggttaccaaactgtatgggtgttcatatgtggttccaaagaaaccatactgaaccagacaaagagtccagttcatggctatgttaaggtactggcacggctcccataaaaatgaatacggctggtttggacgaaaccaccgatgactgttggagaaatggtatattattgagatccagatatggataattagccaaaatgatgttctagtagttatacattaatttggcatggctgttgcacacagcttgccatttaagattttgtaggtagtagttgtcccataggaaaacctcccaggtctctcccttcaacagtgactactaaatatgttaattctgcgttgcaaaatgtctgtaatctgaagtgttcattttgcagctgtaatgtaatctgtatatgagggggaaacaaaaatacgtactgttatttgaagatcgggttctttgaacctcgatctgttgagtgatggcatagtgtagagaagagttcggtatgtccagtagctttggaatcttgacatgaatcttgacggaggatattgttatgctggacgctcatgcatttttccatgtttaatctagtgttaggtggttatattttgggagcgagtgagcgagaccttgtgtttgatggcaggtggcagcagacggtccaatcctggccagtggacatgagcatgataaattcattaaaagcaatgcatattccgatgccgtctcttgttggcggagtttaaattgtctgacagatcgtcgttatagcctttgcatattggactatatcggcgtcatttacccattggctcttagagcagctacaataatagcagactataagccagctgtaaacagataaatgaggagagagaagagcagcgggctatagatttgtagccagctgtagcacggactccaagacacagtgtgtatgataggtgggaccatgtattaatagtgtagtatgtaactattgtatgaatgagctattagattggatatagatgaattggagccagtagttggctatactattaaacttgctcttagccatcccagttacagctccttttttggctcttagccatcagttacagctgtgggacatagttttacctcctttttacttcctggatgaagaacgaagggctggtttagtttgtgacctaaattggtcttactaatttttgtcgatgct

SEQ ID NO: 5044 - DNA, 3280 bp, Brachypodium distachyon
caggcatttaggatggtggacaagaatgatgggtccgaagggctcaaattcaacaagtcgcacctgatgcaaacaactgaagaggttgcgagagcatttattgctgctgcttcagctgccaccgtgcagcccacacgtccatctgtggtatactcatctggagaagagagtggcagcccaatgcagaagctgcagcaacaattttcaaaaatcctgaaaggtttttcaaattctcctgaagtgtctggaccgtacaatccagaagttcttacgacacacaagcgacagtggtcaaggttccagctgaagtcattgggtaataggtgcatcagagaaccttcacatctttttgagagcatagtgattgttgggcttcctcctcaggcagatatccatgagcttgaaaacattgctctagggaggaatgatgacgatacaaagaaatcaagaaatctatttggcaacaaccaccaccaagttcatgccatatcaaatttggaacctcaggtcctttttgcatatcctcctgagaagtctcttccactcaagtacaaggatattgtctcattctgccttcccggaggtgcacaggttaatgctgttgaacggactccttcattcagtgagctgaatgaaattctcctggggcaggaacagcttaaagaaagcaatcagtctttcgtattccgtctacaggttgctgatgaccctacactatatggatgctgtgtattggttgaggagattgtacaaaggccttcaaagcttgtttccatgctcacgaatgaaaagcctgtatttcctcgccggagtcgttatgtagtaaccacaccccggtgttattgcatcctgtccaggctcccattctttgaactgcattttggggtactgcagagtattcttatggaagaacggcttgaatggctgacggatggtgttagcatgctaacttcgttatcaccggaggaaacctgcgaggatgatgatattcatgaagacactgaaattgcaggagcagaacagtatttggatggtacaacactagaaaaatcctctgaaacaagtgtggaagcttctccaaaggagctatctgacacggacagcagttctgggtgtggggataaccaactggtcacctcccaagaagtacaaccagaaagttgttctcctgtcaaagaggaacagaacagtcctgtaacagggatgattactcaatatgataaagcagaagagtctgataattgcgtttcaggagaaacagtgatagacatgtccagtgttaagctccatgaactggattctgtgccgtttgtttcgaatgaaaattgttgtaatttctcacatgaaaatgtgattgatggggaacttgatatctttgttaatgatactattttgccgcttatacgatctcgtctcagcgaaggttctgaatcgtctccaagttcccaagattctccttctgagggcataaatttgagaagtgataccaatgaattggatttggaggagccatcttccattggtcacggagatgtagttgggcacagcagtatattgcaatgggctaaggcaaaaaaatatggatctcttcaagttgtttgtcagtactaccagttgcagtgtcctgccaggggttcatcacttaattttcatcccttggagcacttgcatcctttgaggtttcaccggcctggtgaaaccgctcttcatattgctgggtcaactattgatcttcggtcacgtgatacaagcttagaggtggctgagatgcgtaatgccctctttgctgaggaagaatcaactgctttatccacatgggctgttgcatccatatgtggatgcctcaggttggaacatgttatgacactttttgctgcagcactcctggagaaacagattgttattgtctgttctaatttgggaatgctttccgcttcagttttgtctgtcatacctctaatacgaccataccactggcagagtctactcataccggttttgccaaacgacatgctggattttctggatgcacctgtcccatacattgttggtgtgcacaacaaaacatccgatctgcaatccaggctaggaaatgcagtaattattgatgccaacaagaatcagattaagtctacttcggtcccacaatttccgcaacaaagggagttgctttctgccttgcggccgtatcattcaagacttgtgggcgaaagttttcttgcaagaaaacgtcccgtttatgaatgcacagatgcccaggtggaagcggccaaaggtttcttggcagtgcttagatcctatcttgattctctgtgttccaacctgagatctcacacgattaccaatgtgcaatccaacaatgacaaggtttccttaattttaaaagagagcttcattggctctttccctgccagagataggccctttatgaagctttttgtggacacacagttgttctcggtacatacagacttggttctctcctattatcagaaggactgagtctctcttaagtcttaacgacttgactgtcattagtggcatgatttttccaagccttatgttgagctcaactgtacataccgttgcagtaaatatgagctgccttatcacttgggcagctctgaggtggatcaagaagctgcaataggcagctcatatactgttagagaagttgtagattattgggatccaggtttgaacaagaatgctcttctagctgttgtaaattagttctgcgcttctgtgcatgctgcgcctctccataaaaaagattttgtaggcagtatacaagtagtagttgcccataagaaaccttctggttgttcttcctacattgacgtacttaaatggtccatgtgtgctgcaaaatctctgtacgtgagatcccaaagctcatatcgcagctagttcgtaattagggagaaaagcaaaaacatatgcaatataatttaagaacagaggcaagctgatgcaatgtcaaaggagccgtacctcaatttgtttacttgtgacgtcttgtgtagatttgagtgtcatatacagagtgcaatcatcaaatcatcaccgttttcttcagattcttgtaccgggaatgaataggaattaggatatcagtctcaacttctgtaagataatgtcccgtctgcccttatctgttctactttttttcttttgcgaagaaccttgtctgttctgctgtctaacgtgaacatcaaaagagtgcttgaaggcagtaggtgctcttggggtctgcaggggaacatgaacatgatagcat

SEQ ID NO: 5045 - DNA, 3175 bp, Brachypodium distachyon
caggcatttaggatggtggacaagaatgatgggtccgaagggctcaaattcaacaagtcgcacctgatgcaaacaactgaagaggttgcgagagcatttattgctgctgcttcagctgccaccgtgcagcccacacgtccatctgtggtatactcatctggagaagagagtggcagcccaatgcagaagctgcagcaacaattttcaaaaatcctgaaaggtttttcaaattctcctgaagtgtctggaccgtacaatccagaagttcttacgacacacaagcgacagtggtcaaggttccagctgaagtcattgggtaataggtgcatcagagaaccttcacatctttttgagagcatagtgattgttgggcttcctcctcaggcagatatccatgagcttgaaaacattgctctagggaggaatgatgacgatacaaagaaatcaagaaatctatttggcaacaaccaccaccaagttcatgccatatcaaatttggaacctcaggtcctttttgcatatcctcctgagaagtctcttccactcaagtacaaggatattgtctcattctgccttcccggaggtgcacaggttaatgctgttgaacggactccttcattcagtgagctgaatgaaattctcctggggcaggaacagcttaaagaaagcaatcagtctttcgtattccgtctacaggttgctgatgaccctacactatatggatgctgtgtattggttgaggagattgtacaaaggccttcaaagcttgtttccatgctcacgaatgaaaagcctgtatttcctcgccggagtcgttatgtagtaaccacaccccggtgttattgcatcctgtccaggctcccattctttgaactgcattttggggtactgcagagtattcttatggaagaacggcttgaatggctgacggatggtgttagcatgctaacttcgttatcaccggaggaaacctgcgaggatgatgatattcatgaagacactgaaattgcaggagcagaacagtatttggatggtacaacactagaaaaatcctctgaaacaagtgtggaagcttctccaaaggagctatctgacacggacagcagttctgggtgtggggataaccaactggtcacctcccaagaagtacaaccagaaagttgttctcctgtcaaagaggaacagaacagtcctgtaacagggatgattactcaatatgataaagcagaagagtctgataattgcgtttcaggagaaacagtgatagacatgtccagtgttaagctccatgaactggattctgtgccgtttgtttcgaatgaaaattgttgtaatttctcacatgaaaatgtgattgatggggaacttgatatctttgttaatgatactattttgccgcttatacgatctcgtctcagcgaaggttctgaatcgtctccaagttcccaagattctccttctgagggcataaatttgagaagtgataccaatgaattggatttggaggagccatcttccattggtcacggagatgtagttgggcacagcagtatattgcaatgggctaaggcaaaaaaatatggatctcttcaagttgtttgtcagtactaccagttgcagtgtcctgccaggggttcatcacttaattttcatcccttggagcacttgcatcctttgaggtttcaccggcctggtgaaaccgctcttcatattgctgggtcaactattgatcttcggtcacgtgatacaagcttagaggtggctgagatgcgtaatgccctctttgctgaggaagaatcaactgctttatccacatgggctgttgcatccatatgtggatgcctcaggttggaacatgttatgacactttttgctgcagcactcctggagaaacagattgttattgtctgttctaatttgggaatgctttccgcttcagttttgtctgtcatacctctaatacgaccataccactggcagagtctactcataccggttttgccaaacgacatgctggattttctggatgcacctgtcccatacattgttggtgtgcacaacaaaacatccgatctgcaatccaggctaggaaatgcagtaattattgatgccaacaagaatcagattaagtctacttcggtcccacaatttccgcaacaaagggagttgctttctgccttgcggccgtatcattcaagacttgtgggcgaaagttttcttgcaagaaaacgtcccgtttatgaatgcacagatgcccaggtggaagcggccaaaggtttcttggcagtgcttagatcctatcttgattctctgtgttccaacctgagatctcacacgattaccaatgtgcaatccaacaatgacaaggtttccttaattttaaaagagagcttcattggctctttccctgccagagataggccctttatgaagctttttgtggacacacagttgttctcggtacatacagacttggttctctcctattatcagaaggactgagtctctcttaagtcttaacgacttgactgtcattagtggcatgatttttccaagccttatgttgagctcaactgtacataccgttgcagtaaatatgagctgccttatcacttgggcagctctgaggtggatcaagaagctgcaataggcagctcatatactgttagagaagttgtagattattgggatccaggtttgaacaagaatgctcttctagctgttgtaaattagttctgcgcttctgtgcatgctgcgcctctccataaaaaagattttgtaggcagtatacaagtagtagttgcccataagaaaccttctggttgttcttcctacattgacgtacttaaatggtccatgtgtgctgcaaaatctctgtacgtgagatcccaaagctcatatcgcagctagttcgtaattagggagaaaagcaaaaacatatgcaatataatttaagaacagaggcaagctgatgcaatgtcaaaggagccgtacctcaatttgtttacttgtgacgtcttgtgtagatttgagtgtcatatacagagtgcaatcatcaaatcatcaccgttttcttcagattcttgtaccgggaatgaataggaattaggatatcagtctcaacttctgtaagataatgtcccgtctgcccttatctgttctactttttttcttt

SEQ ID NO: 5046 - DNA, 1561 bp, Zea mays
tttttctttttttgattgattcgatttctccacacgtgctacacctacacgacgcagaattgcagccgaatccatcggagcccacggccgcacgcccgcagcccggccagcggccaccgcatcgcctcgtatgctccgcgcttgcacacgcgtcggcggcgcgggcgcgggcggctgcggccgacgagaacgcctcatggcctccctcatccccttcctccctccctcaccttactccactcacctcccgcgccagccccagtcccagccgccgacagccgctacccagcccgccgcagcggcgcgcccatcccggttccgcctcctgttcgcgcgcgccgcggcgcagcggcagcgcgactccgagccggcgccggcggccgaggagaggcggtcgctggccgtcagaacgggggagctgttcctggggctggcggcgctgctgctgcgcgggaccggggccgagcgtagcggtggggccgcggtggaggagatggaggcgagggacggggtagtgtgggagcagcgcccccaggacgtggacgcggagcggcggcgacgggagctcactagcccaggtttcagcttctccgccgcggggctgctcttcccctaccacctcggcgccgcgcagtgcctcatggaccgcggatacatcaccgagacaactccgttagctggctcatcagctggtgccataatctgtgcagtgatcgcatctgggaacacaatgcaagatgctctgcaggtgaccaaagttctagctgacaactgccgaagtaaaggcacggcgtttcgccttggggctgtactcaaggatgtccttgttgagtttctcccagatgatcttcacattagatgcaatggaagaattcgtgttgctattactcagctatcctggaggcctagggccttgctggtggaccaatttgactccaaagaagatgtcattaatgcagtaattacatcctcctttattcctggatacttagcacccaggccagctaccttcttccgtaataggctcggcattgatgggggccttacattgtttatgccgcccacttctgctgcagaaacagtccgaatatgtgcttttccagccagccgtttgggattgcaagatattgggatcagtcccgattgcaatccagagaacagggctagcccaagacagctgtttaactgggctctggaacctgctgctgatgaaactctagacaaattatacgagcttgggtacctggacgcagctgtatgggctgagcagaattatgctgagcttatcgccaagaatgatcaatcccttgtcgctgattgaattgagttcagtttgcccagaagtaattttggtatccaaagctgagttcatgagaatccatgcctgtaatatattgtaaagatagcaccgtcattgtcgaaggtggcattgttctgcattggatttgggtgtttatgccagcattttcgtagctgtgacaatagtgtagaacaggttgctagcatggccataaaaactgatcagcataatcaaatgtatagattatagatgatgaggttt

SEQ ID NO: 5047 - DNA, 2163 bp, Setaria italica
gaggccccgtatgcttcgcgcgtgcgcgcgagtcggcggcggcggcggccggcaaggaggagccctcatggcctccctcatcaccttcctgccttcctcctccttctcctcctcccatctccctcgcaagccccagctgccgccaacccctcccactcccgctcccaccgcggcgcgcccgtcccggttcaacctcctgttcgcgcgcgccgccgcccggcgggacccggagccctcgccggctccggcggaggcgcctccggatgccgccgtcccggcggccgaggagaggaggtcgctggcggtgaggacgggggagctgttcctggggctggccgcgctgctgctgcgcgggaccggggcgcggcgcgggggcggcggcgcggcggtggaggaggtggaggcgagggacggggtggtgtgggagcagcggcccgaggacgtggaggccgagcggaggaggagggagctcaccacccccgggttcagcttctccgccgcggggctgctcttcccctaccacctcggcgccgcgcagtacctcatggataaaggctacatcactgagagaaccccgttagctggctcatcagctggtgccataatctgtgcagtgattgcatccgggaacacaatgcaggatgctctgcaggtgaccaaagatctagctgacaactgccggagtaacggtactgcatttcggcttggggctgtgctcagggatgtccttgacaagtttctcccagatgatttgcacatcagatgcaatggaaggattcgtgttgctattactcagctatcatggaggcctaggggcttactagttgaccaatttgactcgaaagaagatgtcattaatgctgtcattacatcctcttttattcctggatacttagctcccaggccggcaactttcttccgtaacaggctatgcattgatgggggccttacattatttatgccacccacttctgcttctgaaactgtccgaatatgtgcttttccagccagccgactgggtttgcaagggattgggattagtccagactgcaatccagagaacagggctagtccaagacagctgtttaactgggctctggaaccggcggaagatgaaattctcgacaagttatatgagcttgggtacagggatgcagctgtatgggctgagcagaattctactgagttgacttcgaagaatgatcaacctcttgccgttgattgaatcaagagaatcaaatacctttagttctatacttgatatattgtaaagatggcactgcctgtctatgaagaatgaaggtggcaatgtactgcattgggttccatggatttgttagggagaagcaaatgaaaaggcaccccagtcattaggtgtgtcaatgatactggaggcaagttggtattagggtttacaaactgatcagcataatcaaatgtatatattgtaggcaacgaggtataacctgagaacttgttctgtaatggcacaggggagtgatgtttgcgccttgtgaacagacaactccagcaaaaacaactttcaaaactcaacttgttatgtaatgttgtattcaaaattttcctttctcattgattcaatagttaaggtccaactttgtgattcttaacgaaaacttgcatccttcgactcaattagggggaaccagtctgtcaatgcacggttcgccagtttcatacaggatgcgatcaagcaccagagaatatgcaaccaccaaacaaaacagttatgtacattgtcataaataatttgcaccatctcagcctcctatctgaagtctacatcaaacccgaaccattactcctgcggtaacgcataaaatcgcgcacttcttcaacagccttatgtaaccttgtaataggggcattgaaccgctaaaaattatcaaagaagtaactttggaacattcttgctccaataaatcacttgtcttctggggcctgggcataagccaaaagaaacaagaaaatgctattccctcttgtcctcttcagcctcatcttccaaactgtaagcattgctaacaccaacgttcctgtccttgtctatctttaccatccctacttcaccatctccctttgtcagggattgagcttcctcatcatcatcgtcagcagcttcaccagaatatgcatatctgg

SEQ ID NO: 5048 - DNA, 1571 bp, Panicum virgatum
cgagccccacctccgctccgcctcgtatgcttcgcgcgtgcacgcgggtcggcggcggcggcgtgggcgccggcggccggcgaggaggagccctcatggcctccctcatccacttcctcccttcctccgcctactactcctcccatctcccgcccaagccccagccccagccccagccgcggccagctcccactcccgctcccgccgccgccgccgcggcgcgcccgtcccggctccgcctcctgttcgcgcgcgccgccgcgcggcgcgacccggagcctctgccgttcccgacggaggcgcctccggatcccgcggtcggggagaggaggtcgctggcggtgaggacgggggagctcttcctcgggctggcggcgctgctgctgcgcgggaccggggccgtgcgcgggggcgggggcggcggggcggcggcggtggaggaggtggaggcgagggacggggtggtgtgggagcagcggcccgaggacgtggaggccgagcggcggcggcgggagctcaccagccccgggttcagcttctccgcggctgggttgctcttcccctaccacctaggcgtcgcgcagtgcctcatggacaaaggatacatcactgagagaactccgttagctggctcatcagctggtgccataatctgtgcagtgattgcatctagaaacacaatgcaagatgctttgcaggtgactaaagatctagctgacaactgccggagtaaggggactgcatttcgtcttggggctgtgctcagggatgtccttgacaagtttctaccagatgatttgcacatcagatgcaatggaaggattcgtgttgctattactcagctatcctggaggcctaggggcttactagttgaccaatttgactccaaagaagatgtcattaatgctgtcattacatcctcttttattcctggatacttagctcccaggccggcaacatacttccgtaatcgcctatgcattgatgggggtcttacgttgtttatgccacccacttctgcttccgaaacagtccgaatatgtgctttcccagccaacagactgggtttgcaaggaattgggattagtccagactgcaatccggagaacagggctagcccaagacagctgtttaactgggctctggaaccggcggaagatgaaattctcgacaagttatacgagcttgggtacatggacgcagctgtatgggtcgagcagaaatctaccgagttgaatgcaaagaatgaaccccttgccgttgaatgaatcgaacccctttagtttgctcaaaactgctgggttcatgttcatggaagttctatacttgtaatgtattataaagattagatttctttaggagaagtgcatgaaaagatgtcagaactggccatcagtcgttaggcatgacaacattgctggaggcaagttgatattggggtttacaggctgatcggcatattcaaatgtatatattagacgagatttgacctgagagctcgttttgtaatggtacatgggagtaatgtttgcaatttgcggacaggcaactccaataaaaacaactttcac

SEQ ID NO: 5049 - DNA, 1766 bp, Oryza sativa
aggagaaaatttgtcgaaaaatatataggtgataccgaaactaaatactacttccgatcagagccataccaatgccacgacacgaaaaattcctgcatacggagttctactatccaaagctacgacgtacatcgacttgggcagcgacacgtgtcgtttcgtttgcccacggaaaataaaatcgaaaacaaaaggacagaaacaagaaaactacatcgattttttaattttttttccacgcacctaaacgaattaacgacgtagcagatgcttcgccgcgcgtgcacacgtgtcgtcgtcggcggccgccggcgagcccccatggcctcctccctcctctcctccgccgcctccggcctccctcccaagccgcagccaccttcctccacccctccctcctccgcctccgcgcggccgcggggcttccgtcgcttcatgctcgcccgcgccgccgcgggccgcgacccggagccgccgccgctgcccgaggggaccgagaagaggtcgctcgcggtgaggacgggggaggtgttcctggggctggcggcgctgctggtgcgcgcggggaggggcgggggggcggcggtggaggaggtggaggcgaaggacggggtggtgtgggagcagcggcccgaggacgtggaggcggagcggcggcggcgggagctgaccggccccgggttcagcttctccgccgccgggctgctcttcccctaccacatcggcgtcgcgcagtgcctcatcgacaggggctacctcacggaaagaactccgttagctggttcatcagctggtgccataatctgtgcagtgattgcatctgggaacacgatgcgagatgctttgcaagtgaccaaggatctagctgataactgtcggagcaatgggacagcctttcgccttggggctgtactcaaggatgttctagacaggtttctcccagatgatgtgcacattaggtgcaacggaaggatccgtgttgctattactcagctgtcctggaggcctaggggcttactggttgaccaatttgactcaaaagatgatgtaatcagtgcagttattacatcctcttttattcctggatatttagctcccaggcctgcaactttcttccggaacaggctgtgcattgatgggggccttacgttgtttatgccaccaacttctgcttccgaaacagttcgaatttgtgctttcccagccagtcgactaggattgcaagggattggtattagtccagactgcaatccggagaacagagctagcccccgacagctgtttaactgggctctggaacccgccgaagacgaggttctagacaaattatatgagcttgggtatctggatgcagctgtatgggctgaccagaatcaagttgagttgattgtgaagaatgaacagccactccgcgtcacagattgagaagacaccaacaagaagaccctgagttcttgaacctaacagtatttggtttgctcaaaagctaacatctgaatctgtttgccccagctgtgctcagaagtctctcacgtacaactgcatcagctgtatttcttttcccaaattttgccagctctaggttaccagttcaatactacaatggtttgtaaagtgtgactgctgcaaccacacgagagctttactatgctactcgttgccttgattttgcagtaaatattgttttgtcctccattgcaaggaagagtagattttgtaagaagttagtaaaaaaaaaggaagagcaaaatccattacaagatgca

SEQ ID NO: 5050 - DNA, 2231 bp, Panicum virgatum
ccgattcgttttccttcccgctgcctgcgaaatctcgccgtttttttgtgtgttggcgcggccctgaggccagaggactccaatccttatcccccacacgcatcctccgccacacgttccgcgcctccgcccctcgaaccatctccactcgtctctccccctggattttttcccttcctgcgctgggcttccttgtaggctcactgggtggtactccctgagcatccaacgagggagtgagcccgttcgcgttccccattaccggcgactggcgagagagattttggtgtgacccaagagtcccaatcttatacccaaaactcttctcttgcatcttcccttcccttcccctccgccggaatcgatttttgcgtcgtgaattcgttgggagtatcgagcaattccgagttcgcgcggcgggattgctgcggaaaaaccgcgttttagcggattccgtggcgaaagattggatctttaattttctgaggattctgcgccggcggaatccggttgcccggcggagatgtcggcgctccttgatctgttgatggggatcttccgccagcagaccctcggcggcgccgccctcgacctcgccgcgctggccgcgccgctctgggtcgccgcgctcgtaggcctgctcatcggttgggcgtggcgcccgaggtgggcgggcgtcgtcgtcggcgacaacacccaacaggcggcgccgcctccgcccgcgcgcgtcaccgccacggccgaggcctctcgcctcgagtcggcggccgtcgtaccaaggaccgtggtggctcctgtggcgccggaggaagagcaattggtggtcaacaccggtgacttgatgcacctctggcggctcgtcgaggagaaggacggtggcccatcgtggattcatatgatggagcgcactctgccgaccatgagatatcaggcttggcggagagacccaccgaatggtccaccgcagtaccgcagtagcactatctttgaggatgcgtcgccagaggttgtgagggatttcttctgggatgatgaattccggattaagaacagctgggacgacatgcttcttcagcatgagacactggaggagtgcaccaaaactggaaccatggttgtccggtgggtcaggaagttcccattcttctgtagtgacagggagtacatcatcggtcgcagaatatgggcatctggaaagacgttttactgtgtcaccaagggtgtgcctcgtccctctgttccaagacaaaacaaacctcgtcgtgtggacttgtactactctagctggtgcatccgtccagttgaatcaagaaaaggtgatggtgcaatgactgcatgtgaagtgctcttattccatcatgaagatatggggattccatgggaaattgcaaaacttggtgtccggcaggggatgtggggctgcgtcaaaaggattgaacctggccttcgggcataccaagttgcaaggacagcaggagagcctatttcaaaatgcgctgccatggcacatgttaccaccaaattcaatgctgatgagctcaacacagaagacaacaccgaggctagttcgtccaacaacaacatggagattgagaagccaaagcactggacaaacaacatacccaaggttctcatgataggtggtgctgtcgccctggcttgcacctttgacggtggattattgaccaaggctgtcatattcggcaccgcaagaaggtttgcaggtccaggaaggcggtaggagaatgaagctgatcaccatagagcaatagcgtgcctatcatgtagcgaagctatgtgtggaagtgtcgtatagaatcttttttcgtagcaatgcacagcagaggagaggatgccagtcataccttatcttgttgttccgtctagatatcctcatgctgcagataaggtggtctgctcatgttaggtcagttgagaaaataggtcttgcagcattcagagaaggaaagtaggaaaagatctagcgcgacaaagaagtatctttagcagatcgactagggcatatacttctgttgctgcagtttctgaggcttagagccagctggttaggttagaactatagaattatgagacagcgagaagagttgggaaaaactataattgtatgatgtacaatgtacaaggttcatctcagaggtgctataaaatatagtgctatttatttagcagttaataacaagagttcttgcttttgtcgctatggcaccatc

SEQ ID NO: 5051 - DNA, 2223 bp, Panicum virgatum
agcttgtcttcttcctccccccgcccgattcgttttccttcccgctgcctgcgaaatctcgccgtttttttttgtgcgttggcgcggccctgaggccagaggactccgatccttatcccccgcacgcatccctcccgccacacgttccgcgcctccgcccctcgaaccatctccactcgtcccgtctcgccccctcctggatttttccctccctgcgctgggcttccttccttgtaggctcactgggtggtactggtacgagtactccgtgagcctccaacgagggagtgagccccttcgcgttccccattaccggcgagagagattttggtgtgactcaaagagtcccaatcttgtacccaaatcgatttttgcgggttgaattcattgggagtatcgggcaattccgagctcgcgcggcgggattgctgcggaaaggccgcgttttccgcggattccgtggcgaaagattggattggatctttgattttgtgaggattctgcggcggcggattggaatccggttgcccagcggagatgtcggcgctcctcgatctgttgatggggatcttccgccagcagaccctcggcggcgccgccctcgagctcgccgcgctggccgcgccgctctgggtcgccgcgctcgtcggcctgctcatcggctgggcgtggcgccctcggtgggcgggcgtcgtcgtcggcgacaacgcccaccaggcggcgcagcttcccgcgcatcctccgcccgcgcgcgccaccgccgcggccgaggcctctcgcctcgagtcggccgccgtcgtaccgaggaccatggtggctcctgtggcgcccggaggaagagcaattgcccggtcaacaccggtgacttgatgcacctctggcggctcgtcgaggagaaaggacggtggccatcgtggattcacatgatggagcgcactctaccgaccatgagatatcaggcttggcgaaaggacccaccgaatggtccaccgcagtaccgcagtagcactatctttgaggatgcgtcgccagaggttgtgagggatttcttctgggacgatgagttccggattaagaacagctgggacgacatgcttcttcagcatgagacactggaggagtgcaccaagactggaaccatggttgtccgatgggtcaggaagttcccattcttctgtagtgacagggagtacatcatcggtcgcaggatatgggcatctggaaagacgttttactgtgtgaccaagggtgtacctcgttcctctgttccaagacaaaacaaacctcgtcgtgtggacttgtactactcgagctggtgcatccgtccagttgagtcaagaaaaggtgatggcgcaatgactgcatgtgaagtgctcttattccatcatgaagatatggggattccgtgggagattgcaaaacttggcgtccggcaggggatgtggggctgtgtcaaaaggattgagcctggccttcgagcataccaagttgcaaggaccgcaggagagcctatttcaaaatgtgctgccatggcacatgtcaccaccaaattcaatgctgatgagctcaacacagaagataacaccaaggccagttcgtccaacaacaacatggagattgagaagccaaagcactgggcaaacaacatacccaaggttctcatgataggtggtgctgtcgccctggcttgcacctttgacggtggattattgaccaaggctgtcatattcggcacggcaagaaggtttgcagggccaggaaggcggtaggaggatgaagctgatcaccatagagcgacaacgtgcctatcatatagcgaagctatgtgcagaagtgtcctataaaatcttttttcatagcaatgcacagcagaggacaggatgcaagtcataccttgtattgttccgtctagatatcctcatgctgcagataaggtggtctgctcatgttaggttagttgagaaaataggtcttgtagcattcaatgaaggaaaaggaggaaaagatctagcgcgacagagaagtatctgtagcagatcgactagggcatacttctgttgctgcagtttctgaggcttagtgccagcttggttaggttagaactatagaattatgagacagcgtgaagagttgggaaagataacaattgtatgatgtacaatgtacaaggttcatttcagaggtgctataaaatacagtgctatttatttagcagttaataac

SEQ ID NO: 5052 - DNA, 2124 bp, Zea mays
atcgccaccacagaccacaccaacaatcccctcccttctccccggggccgggcttgtcttcttcctcccgattcgttttctttttcttttcttccgctgctgcaaaatctcgcgctggcgcggcccgaggccagaggactccgatccttatccctcacgcatctcccgcctcgcctccgccacacgttccgcgcctctacagctctcgacctcgtctggatttttttccccgacccgattttcgcatcagctccttctgcccaccgggctcgtctcctcccctggtttctttttcgtcacttgtcaccgctagttcctttagagaaggtgtacccccaatattccattaccggcccactgacgagagagagagagagagattttggcgtgactatccagagtccccaatcttacacctaaaaactcttctcagctaccggtgcggcatatcgcccctatcggcggcgaacatttgagttctcgcgacgtgtcctcgaggattctgtggtggaagatcggatcttttgctgcgggttccagttgccaaccagagatgtcggctctcctcgatctactgatggggatctttcgccagcagaccctcggcggcgccgccctggagctcgccgcgctggcggcgccgctctcgctcgccgcgctcgtcggccttctcatcgggtgggcgtggcgcccgaggtgggcgggggtcgtcgtcgtcgacaacgcccaacagatggcgcagctccccgcggcggcggcgcctccggaccgcgccaccgccaccgcggtggtatctcgcaacgaggcggccgccgtcgtaccgagaactgtggtggctcatgcggcggccgaggacgagcagcagcagctggcggtcaacaccggtgacttgatgcacctctggcggctcgtcgacgagaaggacggtggcccgtcgtggattcacatgatggaccgcaccttaccaaccatgaggtaccaagcctggcggagagacccaccgagtggtccaccacagtaccgcagcagcacaatcttcgaggacgcgtcaccggaggttgtgagagatttcttctgggacgatgagttccggatgaagaacagctgggacgacatgcttcttcagcacgagacgctggaggagtgcaccgagactggaaccatggtggtccggtgggtcaggaagttcccgttcttctgcagcgacagggagtacatcataggccgcaggatatgggcgtctgggaagacattttactgtgtgaccaagggtgttcctcgtccctccgttccaagacaaaacaaacctcgccgtgtggacttgtactactctagctggtgcatccgtccagttgagtcgagaaaaggcgacggtgcaatgagtgcatgcgaggtgctcttgttccaccacgaagacatggggattccatgggagatcgcgaagcttggcgtccggcaggggatgtggggctgcgtcaagaggatagagcctggccttcgggcgtaccaggttgggaggaccgccggagaggctgtttccaagtgtgctgccatggcacaggtcaccaccaggttcagtgccgacgagctcgtcatcgcagggccgggcaacacggaggccagttcttcttcgtccggcgacggcgcagaggttggcaaggcgacgaagcactgggcgaacagcatacccaaggttctcatggtcggtggcgctgtggccctggcctgctgcaccttcgacggtgggttgttgaccaaggccgtcatcttcggcactgccaggaggtttgcaggagggccaggaaggcggtaggtacggtgtaacggtggacggaaagatccagcggcacaacacaaaacaagtgttgctgcactgcagcccgctgcgggttaataggttagaaatatagcatttgttacgaggacacatatagaagtattatgcaagaaaaccgctgttagataagaaatacactgctgtgtattagtagttaataacaagaattcttggtttttgtatgtaaccatattgtggatcggatccattgttcttccccatggacactactactaccagatcgatgttgaccttgtggcagttgctgcagtttttttttgacagag

SEQ ID NO: 5053 - DNA, 1004 bp, Saccharum officinarum
caacaaggccacaaatcccaattccaaaaccctctctccccgtcccgtcctaccccattgccggcgatctcctccttcgccgccaatggatctctccgccgtccaggccgccctctccgacaagtcctactccgccctggcccccctctgcgacgagctcctcctgcaggccgcgtccaagggagccaccaccgacgaatggccctactccgtccacctgctcgcccacctctacatcaatgacctgaacagcgcgcggttcttctggaagtcgttgccgcaggaggtgaaggacacgcggccggagctcgccgcggtctggaggattggtcagtgcctctggaacagagattatgctggcgtcaacacggctgcacaggggttcgagtggggccctgacctcgctgacttcatcactgccttcctagagagctacagacagaggatattcaagctgttgacttctgcgtattccacaatcagcgttgctgatgtggctcatttcatggggatgagtgaggaggatgctacaaactatgctgtgcaaaacggttggagcttggatgcagcgaccaggatgcttactgtcaaaaagccaaaggctcagaccaaccagaagcttgacgcgagcaagctgcagcgtttgactgagtgtgttttccacctggagcactgatgctcactgtcaatcgtgtcgcatccccgttggctctctactccacattttatgaagcatgtttattaattatcatgtgatagctagatgcctgaacgactggttgcttttggctgagaagtgagatctttcagtgcagaatctgactaaggcctcgattagttcggtgaatcggagagaaaaacactgtatcagaattcctgtagcatttcgtttgtatttggtaaagcagatccacattttgactaactatgcttataatgttcatctggcacagtacaacaaatctgtgcaattagattttgatttcatcaccattttgtttacc

SEQ ID NO: 5054 - DNA, 1005 bp, Zea mays
gttgcccgcaaaggggactgctccgaattccccaccaggccacaagtcctagttccaaaaccctctctcctccccgtcctactcgtaccccatagccaatttccctccttcgctgccaatggacctctccgccgtccaggccgccctctccgacaagtcctacaccgccgtcgcctccctctgcgacgagctcctcctacaggccgcgtccaagggaaccaataccgacgaatggccctactctgtccacctcctggcccacctctacatcaatgacctgaacagcgcgcggttcttctggaaatcgctgccgcaggaggtgaaggacacgcggccggagctcgccgcggtctggaggattggtcagtgcctctggaacagagactatgctggtgtcaacacggccgcacaggggttcgagtggggccctgacctcactgaattcatcactgccttcctagagagctacagacaaaggatattcaaactgttgacttctgcatattcgacaattagcgttgctgatgtggctcatttcatggggatgagtgaggaggatgctacaaactatgctgtgcaaatcggttggagtttgggcgcagcgaccaagatgcttactgtcaaaaagccaaaggctcagatcaaccagaagcttgatgcgagcaaactgcagcgcctgactgagtgtgttttccaccttgagcactgatgctcagtgtcaatcgtgttgcatccccgtcacttctctactctgcacattttaagaaccatgtttaccatggctgaaaaggggtgatctctcagtactgaatttgcttctgtaagtggtttctgatagcgtgctagctgttactgcgcctatgggttgttcgtatggtggcccttcgtgccagaggcgcattgaaatgcgtcacactttgtcattactctggaccttaaccagggaagtcttgattgcataaaaatgctaacaagttggtcatgctcatgcccacggttgtccat

SEQ ID NO: 5055 - DNA, 1045 bp, Zea mays
ggaactgctccgaaatccgaattcaagagtccccgagtcgacaggccacaaatcccaattccaaaaccttttctccgtcccatcgccggcgatcttctccttcgccgccaatggatctctccgctgtccaggctgccctctccgacaagtcctactccaccctcgcctccctctgcgacgaacttctcctccaggccgcgtcccagggattcaccaccgacgaatggccctactctgtccacctgcttgcccacctctacatcaatgacctgaacagcgcgcggttcttctggaagtcgttgccgcaggaggtcaaggacacgcggccggagctcgccgctgtctggaggattggtcagtgcctctggaaaagagattatgctggcgtcaacacggctgcacaggggttcgagtggggtcctgacctcgctgacttcatcactgccttcctagagagctacagacagaggatattcaagctgttgacttctgcatattccacaattagagttgctgatgtggctcatttcatggggatgagtgaggaggatgcgacaaactatgctgtgcaaaacggttggagtttggatgcagcggccaagatgcttactgtcaaaaagccaaagtctcagaccaaccagaagcttgatgctagcaaactgcagcgtttgactgagtgtgttttccaccttgagaactgatgttcactgtcaatcgtgttgtgtccctgtttcttctctgctccacattgtaagaagcatgtttaccatgtgacagctatatgcctgagcgacttggcccctttcggccgaaaaggggtgatctctgaatttgcatcttatgtgatttctgacagcgtgctatgggttaatgtgcctattggtgacccctcctgccagtggctcattgaaatgagtcacactttgtcattagggcaagtataataacagcctataagccggctaaatgctgggttgtatgagagagaagagagaaaaaacgggctgtaaacttatagttaccttagacagaagaacaaaaaaaa

SEQ ID NO: 5056 - DNA, 978 bp, Panicum virgatum
ggaggcttagggacgcccaaaaaaccctccggcccttcctccccaccgtcgtcggcgatctccacctccgtcgccgccgatggatctctccaacgtctaggccgccctctccgacaagtcctactcctctctagcccccctctgcgacgaactcctcctccaggccgcgtccaggggaaccaccaccgacgaatggccccacgccgtccacctcctcgcccatctgtacctcaacgacttgaacagcgcgaggttcttctggaagtcgctgccgcaggaggtgaaggacgcgcgtccggagctcgccgccgtctggaggatcggccagtgcctctggaatcgcgactacgctggtgtctacacggctgcacaggggtttgagtggggccctgaccttgctgacttcatcactgccttcctagaaagctacagaaagaggatattccagcttttaacttctgcgtattccacaatcagcgttgctgatgtggctcacttcatgggcatgagtgaggaggattctacaaactatgctgtgcaaaatggttggagtttggatgcagggaccaagatgcttaccgtcaagaaaccaaaggctcagaccaaccagaagcttgatgcaagcaaactgcagcgtttgacagagtgtgttttccatctggagcactgatgcacactggcaattgcaatgcatcccgggtgcttttctacaccaaaccttaaggatcatgcttattatgtgatagctagatgcctgaacgactaggttggttttggctggaaaggggagatctctcagtactgaatttttggcatctgtatgtgttttctgatagtaccctcgcggaaccgtccctgttgcgtgttcatatggtggcccagcgccccttcatgccaacgagaggcgcattcctctttgggttaatggcatccgtgccattacaatttttcaaaaaattgatagcgttacggcagaag

SEQ ID NO: 5057 - DNA, 918 bp, Setaria italica
caaagccacaatccccaattcccaattgccacaaaaccctctccgtgccctccaccgccggcgatctcctcctccttccccgccgatggatctctccgccgtccagaccgctctcgccgacaagtcctactcagccctcgcccctctctgcgacgacatcctccttcaggccgcgtccaggggagccaccaccgacgagtggccctacgccgtccacctcctcgcccacctctacctcaacgatctgaacagcgcgaggttcttctggaagtcgttgccgcaggaggtgaaggacgcgcggccggagctcgctgccgtctggaggatcggccagtgcctctggaaccgtgactatgccggtgtgtacacggctgcgcaggggttcgagtggggtactgacctcgctgatttcatcacttccttcctagaaagctacagaaagagaatattccagctgttaacttctgcgtattctacaatcatcgttgctgatgtggctcacttcatggggatgagtgaggaggatgctacaaactatgctgtgcaaaacggttggagtttggatgctgcgaccaatatgcttactgtcaagaaaccaaaggctcagaccaaccagaagctcgacgcaagcaaactgcagcgtttgactgagtgtgttttccacctggagcactgatatgctcactattaatcaccttgcgtctctgaaactcctctctgcagaacagatatcatgtgagacctgagggactgggtcagtttttggctggaaaggggagatctatctatactgaattctcagtaacttttggttggtgtgctaacggttaccatacctattgcctgttcatatgatgattcttcctgaagtctgaactaaaatggtagcagttgctcgtggacacggccccagcatat

SEQ ID NO: 5058 - DNA, 800 bp, Panicum virgatum
ttcttccccaaccggtgtcggcgatatccacctcctgcgccgccgatggatctctccgccgtccaggccgccctctccgacaagtcctactccactctagcccccctctgcgacgaactcctcctccaggccgcgtccaggggaaccaccaccgacgaatggccccacgccgtccatctcctcgcccatctgtacctcaacgacttgaacagcgcgaggttcttctggaagtcgctgccacaggaggtgaaggacgcgtctccggagctcgccgccgtctggaggatcggccagtgcctctggaatcgcgactacgctggtgtctacacggccgcacagggatttgagtggggccctgaccttgctgacttcaccactgccttcctagaaagctacagacagaggatattccagcttttgacttctgcatattcaacaatcagcgttgctgatgttgctcacttcatgggaatgagtgaggaggattctacaaactatgctgtgcaaaagggttggagtttggatgtggggaccaagatgcttactgtcaagaaaccaaaggctcagaccaaccagaagcttgacgcaagcaaactgcagcgtttgacagagtgtgttttccacttggagcactgatgcccactggcaatggcattgcatcccgggtgcttttctacaccgaaccttaaggatcatgtttactatgtgatagctagatgcctgggcgactagctcggttttggctggaaagggcagaactctcactactgaatttttggcatacgtatgtgttttctgat

SEQ ID NO: 5059 - DNA, 769 bp, Cenchrus ciliaris
  misc_feature (128)..(128): n is a, c, g, or t
  misc_feature (140)..(140): n is a, c, g, or t
  misc_feature (200)..(200): n is a, c, g, or t
ctcctgctccttcgccgccgatggatctctccgtcgttcaggccgcgctcgcccacaagtcctactccgctctcgcccccctctgcgacgacctcctcctccaggccgcgtccaggggaaccgccacngacgagtggccntacgccgtccacctcctcgctcacctctacctcaacgatctgaacagcgcgaggttcttntggaagtcgttgccgcaggaggtgaaggacgcgcggccggagcttgttgccgtctggaggatcggccagtgcctttggaaccgggactacgctggtgtctacacggctgcgcaggggtttgagtggggtcctgacctcgctgatttcatcacttccttcctagaaagctacagaaagaggatattccagctgttgacttctgcgtattccacaatcattgttgctgatgttgctcacttcatggggatgagtgaggaggatgctacaaactatgctgttcaaaacggttggagtttggatgctgcgaccaatatgcttactgtcaagaaaccaaaggttcagaccaaccagaagctggacgcaagcaaattgcagcgtctgactgagtgtgttttccacctggagcactgatatgctcactattgatagccgtgtgtctctgaaactcctctctgcagaactagatatcatgtgagacctgagggactaggtcggtttttggctggaaagggtagatcgctcggtactgaattctcagtaacttttggttgatgtgctagcggttacca

SEQ ID NO: 5060 - DNA, 850 bp, Pennisetum glaucum
ccccccccccccgcctgctatctccttctccttcgccgccgatggatctctccgccgttcaggccgcgctcgccgacaagtcctactccgctcttgcccccctctgcgacgacatcctcctccaggccgcgtccaggggagccgccaccgatgagtggccctacgccgtccacctcctagctcacctctacctcaacgatctgaacagcgcgaggttcttctggaagtcgttgccgcaggaggtgaaggacgcgcggccggagctcgctgccgtctggaggatcggccagtgcctctggaaccgggactacgctggtgtctacacggctgcgcaggggtttgagtggggtcctgacctcgctgatttcatcgcttccttcctagaaagctacagaaagaggatattccagctgttgacttctgcgtattccacaatcattgttgctgatgttgctcacttcatggggatgagtgatgacgatgctacaaactatgctgttcaaaacggttggagtttggatgctgcgaccaatatgcttaccgtcaagaaaccaaaggttcagaccaaccagaagctcgacgcaagcaagctgcagcgtttgactgagtgtgttttccatctggagcactgatatgctcactattaatcgccttgcgtctcagaaactcctctctgcagaactagatatcacgggagacccagggactaggtcagtttttggctggaaaggggagatctctttgttgctgaaatctcaataacttttggttggtgtgctagttgttaccatacctattgcctgttcatatgattcttcttcctgctggaggtgcaatgaaatgagtcacg

SEQ ID NO: 5061 - DNA, 923 bp, Panicum virgatum
  misc_feature (68)..(68): n is a, c, g, or t
  misc_feature (848)..(848): n is a, c, g, or t
ggtgcctcccccggtcctccctcaccgccgccgatcccctccaccttcgccgccgatggatctctccnccgtccaggccgcgctctccgacaagtcctactccggcctcgcccccctctgcgatgacctcctccttcagaccgcgtccaggggagccaccaccgacgaatggccctacgccgtccacctcctcgcccacctctacctcaacgacctgaacagcgcgaggttcttctggaagtcgttgccgcaggaggtgaaggacgcgcggccggaactcgtggctgtctggaggatcgttcagtgtctatggaaccgcgaccatgccggcgtctacacagcggcgcaggggttcgagtggggccctgacctcgctgacttcatcactgccttcctagaaagctacagaaagaggatattccaactgttgacctctgcgtattccacaatcagtgttcctgatgtggctcacttcatggggatgagtgaggaggatgctaccaattatgcagtgggaaatggttggagtttggatgcatcaaccaagatgcttactgtcaagaaaccaaagactcagaccaaccagaaactcgacgcaagcaaactgcagcgtttgactgagtgtgttttccacctggagcactgatgcccactgttagtggtgtgatgtcccttttgctacgcccaatgttaagaagcctctttgtcatgatagctagatacctgaatagatctttggttgcaaaggggagttctatcagtactgaattcctgaaagtctagcttgtccatatggtttcttgtcctgccagtggtgcattgaaatgagttatgcattgctcttgttncaactagcaagttcatgtttttgtttctacttgactggagttggaaattgtttagtggttagcattgcagtggag

SEQ ID NO: 5062 - DNA, 700 bp, Avena sativa
gagtcgaacaatccagaggccaaaaccctcctcctcccgtcccctcagcgccggcgatctcctccgatggatctctccaccgtccacgccgcgctctccgccaagtcctaccccgacctcgcccccctatgcgacgacctcttcctccaggtcgcgtcccagggcgccgccaccgacggctggccctacgcggtccacctcctcgcccatctctacctcaacgacctgaacagcgcgaggtttctgtggaagacggtgcctcaggaggtgaaggacgctcatccggagcttgccgcagtctggaagattggccagtgcctctggaatcgtgacaacgctggcgtctacacgactgcccagggattcgagtggggccctgaaattgctgattttgtgtccgccttcatagaaagctacagaaagaggatatttgagctgttgacttctgcgtattccacaatcagcgttgcggatgtggctcacttcatggggatgagcgaggaggatgctactaattatgccatgcaaaatggttggagtctggatgcggcaaccaagatgcttactgtcagaaaacagaaggcgcagacgaaccagaagctcgatgcaagcaaactgcagcgtttaactgaatgtgttttccacctggagcactgacgtcctctgttcctggcatccctgggccttttctattcttaag

SEQ ID NO: 5063 - DNA, 1103 bp, Brachypodium distachyon
gtaattaagacgcccaaactccccggaatttactcgaacgccggagctcccaaaaccctccttccccgcccccgctccccctaccgccggcgatctcctcttcctcggacgagatggatctctccgccatacacgccgcgctctccgcgaagtcctactccaccctcggccctctctgcgacgacctcctcctccaggtcgcatcccggggcgccgccaccgacgactggccctacgccgtccacctcctcgcccacctttatctcaacgacctgaacagtgcgaggtttctgtggaagacggtgccacaggaggtgaaggacgcccgtccggagctcgctgctatctggaagattggccagtgcctctggaaccgtgactatgccggtgtctacacgactgcacatgagttcgagtggtcccctgaaatcgctgattttgtggccggcttcctagaaagctacagaaagaggatattcgagctgctgacttctgcgtattccacaatcatcgttgcagatgtgtctcacttcatgggcatgagtgaggaggatgctactaactatgccgtgcaaaatggttggagtctggatgcggcaaccaagatgcttactgtcagaaagcaaaaggcacagacgaaccagaagcttgatgcaagcaaactgcagcgtttaactgaatgtgttttccatttggagcactgatgtaactccagtgcttgcattccttttctacttttacccttaaggaacctattaatcttaaatggtgacatgataccgtacgtgtagattgaaatttggctggaaaggcagcggtcagtactgaatcagcgcatgcaagtgtttactcgttagtgagcttacaattctgttttgcatgtgttgcatgttaatatggcagtcggtccaacctgatttgaatgatgtcgtttttagtttgaaccgaccgtatgccttgtttttagtgtgaagctgtgaattgttttggtggaataggaattcctgctaaatctctttaaaaccgattgccgagctaattgtgtgtttggactgcgaggcttccacagattggacgtcggaatttaatctaggtttccattg

SEQ ID NO: 5064 - DNA, 1109 bp, Triticum aestivum
cgtcgaaagttgcccggattttactgaaatcgcacaatctcagaggccaaaaccctcgcccccaaacaccccaccgccggcgatctcctcctcctcctccgatggatctctcagccgtccacgccgcgctctccgccaagtcctactccgccatcgccaccctctgcgacgacctcctcctccaggttgcgtcccggggcgtcgccaccgacgactggccttacgccgttcatctcctcgcccatctctacctcaacgacctgaacagcgcgaggtttctgtggaaaacggtgccgcaggaggtgaaggacgctcatccggagctgggcgccatctggaagattggccagtgcctctggaaccgtgactacgctggggtctatacttccgcacaggggttcgagtgggggcctgaaatcgctgattttgtggccgccttcctagaaagctacagaaagaggatatttgagctgttgacttctgcgtataccacaatcagcattgcagatgtggctcacttcatggggatgagcgaggaggatgctactaactatgcggtgcaaaatggttggagtctggatgtggcaaccaagatgcttactgtcagaaaacagaagccccagactaaccagaagcttgatgcaagcaaactgcagcgtttgaccgaatgtgttttccacctggagcactgatgccatccgttccgcttttaaggcacctattaatcgtacatggtggtagcttaatactgcacggctagattgtgttttggctggaaaggagagatcgctctgtactgaatatgcgtcttctggttgagcgagcttgccatttctgtctcgtttgcttgttaacaaggagtgcgtgaattgaagttaagcgagatattactgtgcctatgttgaacctattagttgttttaagtgatgtgaagtttgaaattattctgggtgtaatagcaagtcactgcaaattctccatggatcgctgttgaacatatgtctgattgtgaaagtcctcttctgcagatgagcacatatgcacctgccgtgaacagtaataaattggaaagaaatgataaagaattttaaaagaatgatatttttgag

SEQ ID NO: 5065 - DNA, 874 bp, Brachypodium distachyon
ccccggaatttactcgaacgccggagctcccaaaaccctccttccccgcccccgctccccctaccgccggcgatctcctcttcctcggacgagatggatctctccgccatacacgccgcgctctccgcgaagtcctactccaccctcggccctctctgcgacgacctcctcctccaggtcgcatcccggggcgccgccaccgacgactggccctacgccgtccacctcctcgcccacctttatctcaacgacctgaacagtgcgaggtttctgtggaagacggtgccacaggaggtgaaggacgcccgtccggagctcgctgctatctggaagattggccagtgcctctggaaccgtgactatgccggtgtctacacgactgcacatgagttcgagtggtcccctgaaatcgctgattttgtggccggcttcctagaaagctacagaaagaggatattcgagctgctgacttctgcgtattccacaatcatcgttgcagatgtgtctcacttcatgggcatgagtgaggaggatgctactaactatgccgtgcaaaatggttggagtctggatgcggcaaccaagatgcttactgtcagaaagcaaaaggcacagacgaaccagaagcttgatgcaagcaaactgcagcgtttaactgaatgtgttttccatttggagcactgatgtaactccagtgcttgcattccttttctacttttacccttaaggaacctattaatcttaaatggtgacatgataccgtacgtgtagattgaaatttggctggaaaggcagcggtcagtactgaatcagcgcatgcaagtgtttactcgttagtgagcttacaattctgttttgcatgtgttgcatgtta

SEQ ID NO: 5066 - DNA, 1275 bp, Oryza sativa
gtcagatgggccagagagatacacgattacacgtgggttttttcttccccccgtttatttcctttcctgaaatttctccaaatctgccccaaattccgaattttactcgaactccaaaaacccttcccctcttctcccctcgcctcggcccgccggcggccggccaccaccgccacctcctcctccgatggatctcgccgccgtccacgccgccctcgccggcaagtcctactcctccgtcgccccgctctgcgacgacctcttcctccaggccgcgtcccggggcgccgccaccgacggctggccctacgccgtgcacctcctcgcccacctctacctcaacgacctgaacagcgcgaggtttctgtggaagtcgacgccgcaggaggcgaaggacgcgcggccggagctcgccgccgtctggaggatcgggcagtgcctctggaaccgcgattacgcgggcgtctacgcggccgcgcaggggttcgagtggagccctgaaatcgccgacttcgtggccgccttcctagaaagctacagaaagaggattttccagttgttgacttctgcatattccacaatcagcgttgctgatgtggctcacttcatggggatgaatgaggaggatgctactaactatgccatgcaaaacggttggagcttggatgcggcagccaggatgcttactgtcgtaaaaccaaaggttaagactaaccagaagctcgatgcaagcaaacttcagcgattaactgaatgcgtcttccacctggagcactaaagtccagcattacgggcatcccgcatgactcttaagaaacctatttatcatatgatgccaagccgagattgccttttctccggaaatcagagttagttcagtgttgaatttccatctgcaattgatttctggttagcgaccttagcctttctctgtaatggttgcttgttgatatggttggtggtggttcttgccagacttacactgaagtaaatgacactgcttagtgtcaactcgtaagttaacgttgttttttgaagtatgagttgaaaattgtttcccgttttacagaaagtcactgttagtgttgttcttgattagttgtggcctttatgcttgtgcttcattagctgcatagctgccaattgggcatctattgtctggattttaatgagattgttatcctagacaaaacctgtagttgtaatgcgtacattactgtacgccgtatgcttgttagtatatttttgataatggattttctttgattagtatta

SEQ ID NO: 5067 - DNA, 920 bp, Hordeum vulgare
cgcacaatctcagaggccaaaaccctcgcctccaacaccccaccgccggcgatctcctccccctccttctccgatggatctctcagccgtccacgccgcgctttccgccaagtcctactccgccatggccaccctctgcgacgacctcctcctccaggtcgcgtcccggggcgtcgccaccgacgactggccctacgccgttcatctcctcgcccatctctacctcaacgacctgaacagcgccaggtttctctggaagacggtgccacaggaggtgaaggacgctcatccggagctgggcgccatctggaagattggacagtgcctctggaaccgtgactatgctggggtctatacttccgcacaggggttcgagtggggccctgaaatcgctgattttatggctggcttcctagaaagctacagaaagaggatatttgagctgttgacttctgcgtataccacaatcagcattgcagatgtggctcacttcatggggatgagcgaggaggatgctactaactatgctgtgcaaaatggttggagtctggatgcggcagccaagatgcttactgtcagaaagcaaaagccccagacaaaccagaagcttgatgcaagcaaactgcagcgcttgaccgaatgcgttttccacctggagcattgatgccctccgttcctgcccctcacccctctatgttttatgcttttaaggcacctattaatcgtacatggtggtagcttaacactgtacggctagattgtgttttggctggaaaggagatcgctctgtactgaatatgcatcttctggcttagcgagcttgctatttctgtctcgttcctttgttaacaagggagtgcttgaatcaaagttaagcgaatgattactgtgcctatgttgaacccaaaaaaaaaaaaaaa

SEQ ID NO: 5068 - DNA, 1105 bp, Hordeum vulgare
acaagacgtcgaaagctgcccggaatttattggaatcgcacaatctcagaggccaaaaccctcgcctccaacaccccaccgccggcgatctcctccccctccttctccgatggatctctcagccgtccacgccgcgctttccgccaagtcctactccgccatggccaccctctgcgacgacctcctcctccaggtcgcgtcccggggcgtcgccaccgacgactggccctacgccgttcatctcctcgcccatctctacctcaacgacctgaacagcgccaggtttctctggaagacggtgccacaggaggtgaaggacgctcatccggagctgggcgccatctggaagattggacagtgcctctggaaccgtgactatgctggggtctatacttccgcacaggggttcgagtggggccctgaaatcgctgattttatggctggcttcctagaaagctacagaaagaggatatttgagctgttgacttctgcgtataccacaatcagcattgcagatgtggctcacttcatggggatgagcgaggaggatgctactaactatgctgtgcaaaatggttggagtctggatgcggcagccaagatgcttactgtcagaaagcaaaagccccagacaaaccagaagcttgatgcaagcaaactgcagcgcttgaccgaatgcgttttccacctggagcattgatgccctccgttcctgcccctcacccctctatgttttatgcttttaaggcacctattaatcgtacatggtggtagcttaacactgtacggctagattgtgttttggctggaaaggagatcgctctgtactgaatatgcatcttctggcttagcgagcttgctatttctgtctcgttcctttgttaacaagggagtgcgtgaatcaaagttaagcgaatgattactgtgcctatgttgaacctattagttgttccaagtgatgtaaagtactccctccgtcccaaaataactgtctcaagcttagcacaattttgtattagaactagtacaaagttgagacacttattttgggacggagggaatatgaaattattctgcttgtaatagcaaatcactgtgaattctc

SEQ ID NO: 5069 - DNA, 1096 bp, Setaria italica
cttccctcatcaaaaccccatccaattcgaaacccctctcgcctcgccatttcagcttcacctacgcccctcctccacttcgcggccggccaacccacctcttccctcggcagccatggccaccgcagcgcgcgccgtcgtcgccgcccgcccggcgcggccgctcctcccgtctcggcgcctcccgtcctattcctccgcccgccccccgcggcaaagcggcggcggagtcgggtccgtccgctgcatggcacggcggccggactcctcctactcgccgctgcgttcggggcagggaggtgaccgtgcgccgacggagatggcgccgctgttccccgggtgcgactacgagcactggctcatcgtcatggacaagcccgggggcgagggggccaccaagcagcagatgatcgattgctacatacagacccttgcccaggtcgtagggagtgaggaggaggcgaagaagaggatatacaacgtgtcctgcgagcgctacttcgggttcgggtgcgagattgacgaggagacttccaacaagctcgaaggccttccaggtgttctttttgtgcttcctgactcttatgttgatgctgagaacaaagactatggtgctgagttattcgtaaatggggaaatcgttcagcgatcaccagagaggcagagaagggtggagccagtacctcagagagcccaagataggccacggtacagcgaccggacccgctatgtgaagcggagggagaaccagtcttaccagcggtgatgttgccctttttgaagatagaagatgttgtcatttccacaaagtgtctaaatgcaatgctggaggtgcagcagcaacttccacaaggccacaacccacatgacaatcactattcactcccattgtgttagctggcccttgtaacgttgcgtgcttatgcatttggacttgtatccctagtctatatgaagttattatgaactcctgaatgtttttaacctctgtctgtctgcctccttgtcaccctcccttttgtgtacttgcatttgcatgttgtagcaagtattaataataatcagatattcagatgacatgctttcgatactgagc

SEQ ID NO: 5070 - DNA, 1017 bp, Zea mays
atctccgatcgtccgtgtccctcaccaaaagttcaaaaccccatccaattccaaatcccacttctcgccagttcacctccgcctccgctcctcccctccccctcccgtcctgccatggccaccgcagcacgcgccctcgtcgccgcacgcccggcacggccgctgctgccgtctcggcgcctcccgtcctcctcttccatccgtcccgcgcggcaacgtgctggcgtcgggtgcgtccgctgcatggctcggcggccggattccacctattccccgctgcgttcgggccagggcggtgaccgtgcaccgactgaaatggcgcctctgttccctggctgcgactacgagcactggctcatcgtcatggacaagcccgggggcgagggcgccaccaagcagcaaatgatagattgttacatccagacccttgcccaggtggtagggagtgaagaggaggcgaagaagaggatatataatgtgtcctgcgagcgctattttggattcggatgcgaaattgacgaggagacctccaacaaactcgaaggccttccaggggttctttttgtgcttcctgactcttacgttgatgctgagaacaaggattatggtgctgagttatttgtgaacggtgaaatcgttcagcgatctccagaaaggcagagaagggtggagccagtgcctcagagagctcaggatcgaccacggtacagtgaccggacccgctatgtgaagcggagggagaaccaatcttaccagagatgatgtttccgtctctgaagatgtaaaatgtcacggtttccacaagtgtccaaatgcggtactgaagatgcagcagcaactccccactactcatatgagaatggcatccgttctgtttgccgcgcattttaagctgtatatgcttattatgcatttgggcttgtacctcagtcgatatgaacgatgtatcctttgaactaacgcattataatttttgaaaccgttttagccagaaattaatcaactgttgatgattat

SEQ ID NO: 5071 - DNA, 1195 bp, Zea mays
cacactaaaacttgatactagcctattcaaacttgttaccgccggtaatcgaacgtaaatcattactattatgatttgcgttacatttttttttaaccaaacagcaacgggcccatcggagtgtcaacgagctcaagcacagcaaatatctcccgtcgtccgggtcgctcagcaaaaccccatccaattccaaacaactcttctcgccatttcaccaccgcctccgcccccatcctctccccctcccgtcgcgccagtcaacagcctgtctgcctcttccctcgccacccatggccaccgtagcgcgcaccctcgtcgccgcatgcccggcacgctctctcctccgcttccggtctcggcgcctcccgtcctcctcttccatccgtcccgcgcggcaacgtgccggcgtcgggtctgtccgctgcatggctcggcgaccggattcctcctattccccgctgcgttcggggcagggcggtgaccgtgcaccgactgaaatggcgccgctgttccctggttgcgattacgagcactggctcatcgtcatggacaaacccgggggcgagggcgccaccaagcagcaaatgattgattgctacatccagacccttgcccaggtgctagggagtgaagaggaggcgaagaagaagatatacaatgtgtcctgcgagcgctattttggattcggatgcgaaattgatgaagagacctccaacaaactcgaaggtcttccaggggttctttttgtgcttcctgactcttatgttgatgctgagaacaaggattatggtgctgagttattcgtgaacggtgaaatcgttcagcggtcgccagaaaggcagagaagggtggagccagtgcctcagagagctcaggatcggccacggtacagtgaccggacccgctatgtgaagcggagggagaaccaatcttaccagagatgatgtctccgtttctggagatggaaaatgccagggtttccacaggtgtgccatactggagatgcaggagcaacccccactacccacatgagaatgacatccgttgtgtttgctgcgctttctaagcttgacaagttgacattgcttatgcgtttgggcttgtacctctagttgatatgacggtgtatccttttaactccgcataacattgtgtttgaagtcttctttagtcagaaaatattgacgattatcag

SEQ ID NO: 5072 - DNA, 1048 bp, Brachypodium distachyon
gcaaatatctcgtggtggccttctctgttctctcccaaaccccatccaaacctcctcgccatttcactgcgctctgctcctctcctcggccagcaacctcctctgctccgttcccccgccatggccaccgccgcgcgcgctatcgcggccgcccgcctggcgcagccgctcctcgtatcgcggcgcctgccttcctcctcggctcgccccacgcggcctcgtggcggcggcggttccgccgtccgctgcatggcgcggcggcctgacgcctcgtactcgccgctgcggtcggggcagggcggcgaccgcgcgcccacggagatggcgccgctgttccccggctgcgactacgagcactggctcatcgtcatggacaagcccggcggcgagggcgccaccaagcagcagatgatcgactgctatatccagaccctcgccaaggttgttgggagcgaggaggaggcgaagaagaagatctacaacgtgtcctgtgagcgctattttgggtttgggtgtgagattgacgaggaaacatccaacaagctggaaggcctccccggcgttctttttgtgcttccggattcctatgttgatgcagaaaacaaggactatggcgctgagttatttgtgaacggagaaattgtccagcgatcaccagaaaggcagaggagggtggagccggtgcctcagagagctcaagatagaccaaggtacagtgaccggactcgctatgtgaagcggagggagaaccaggcctatcaacggtgacatgcccctgcatttactgcaagtgtcaatcgctcttgttctagatatagcagcagctcccacatgagaaagtgttgttcgtcctgtttgctgcagtgtaaccttgtcatactttcgcatctattttctgcatgaactgtaggttaagattttgtaggagacttgctccgttatctcagtttggtggccctcgtttggtagtaaaagaatgaagttcactcgagccgtttgtctcttgcagtatttcaactctatgaactcccgctactaccttcatgtt

SEQ ID NO: 5073 - DNA, 1070 bp, Triticum aestivum
cgacccacgcgtccgcccccaaccaaaaccccatccattccggttccacctcctcctccgctcgtctcctttcgacagcggccactcccgccatggccaccgcagcgcgcgccgtcgccgccgccgcgcgcccggcgcggccggtgctcctgtcgcggcgcctcccgtgcccctccgctcgccccgcgcggcctcgcgtcggccgcgccgtccgctgcatggcgcggcggcccgacgcctcgtactcgccgctgcggccggggcagggcggggaccgcgcgcccacggagatggcgccgctgttccccggctgcgactacgagcactggctcatcgtcatggacaagcccggcggcgagggcgccaccaagcaccagatgatcgactgctacatccagaccctcgccaaggtcgtgggcagcgaggaggagtcgaagaagaggatctacaacgtgtcctgtgagcgctactttgggtttgggtgcgagattgacgaggaaacgtccaacaagctggaaggcctcccgggtgttctttttgtgcttccggattcctatgttgatgctgagaacaaggactatggtgccgagttatttgtgaacggagagatcgtccaacgatcaccggaaaggcagagaagggtggagccggtgcctcagagagctcaagatagaccgcgttacagcgaccggactcgctatgtgaagaggagggagaaccaggcctaccaacggtgacatgtccccgtcggtgtaccgcacaagtggcccactgctatcgctccttgccctagatatagcaactgctccacgcccgaaatgcccctcgtcgtctttgctgcattgtagcctcgccatatctgggcgtttattttcttcacgaactgtaggttaaggactgcatgtactactgtgagtgacttgttccgttgttttggtaacggtatcttggtttgcggcggaaagagtaaaagaagttgtaagagagcatttaaacttgatgaactctccttgctctgtttctgcaccgtttgtcccctgcagttacctggcgtaggtagtattgagctc

SEQ ID NO: 5074 - DNA, 936 bp, Triticum aestivum
ttcgacagcggccactcccgccatggccaccgcagcgcgcgccgtcgccgccgccgcgcgcccggcgcggccagtgctcctgccgcggcgcctcccgtgcccctccgcccgccccgcgcggtggcctcgcgtcggccgcgccgtccgctgcatggcgcggcggcccgacgcctcgtactcgccgctgcggccggggcagggcggggaccgcgcgcccacggagatggcgccgctgttccccggctgcgactacgagcactggctcatcgtcatggacaagcccggcggcgagggcgccaccaagcagcagatgatcgactgctacatccagaccctcgccaaggtcgtgggcagcgaggaggagtcgaagaagaggatctacaacgtgtcctgtgagcgctactttgggtttgggtgcgagattgacgaggaaacatccaacaagctggaaggcctcccgggtgttctttttgtgcttccggattcctatgttgatgctgagaacaaggactatggtgccgagttatttgtgaacggagagatcgtccaacgatcaccggaaaggcagagaagggtggagccggtgcctcagagagctcaagatagaccgcgttacagcgaccggactcgctatgtgaagcggagggagaaccaggcctaccaacggtgacccgtcgttctactgcaagcgccccattgctatcgctcctgccctagatgtagccactgctccacgcccgaaatgcccctcatcgtctttgctgcattgtagcctcgccatatctgggcgtttattttcttcacgaactgtaggttaagaactgcatgtactactgtaagtgacttgttccgttgttttggtaacggtatcttggtttgcggcggaaagaaaaaaaaagttcatgtgtttggagctctgaaaaaaaaaaaaaaaag

SEQ ID NO: 5075 - DNA, 898 bp, Brachypodium distachyon
caacctcctctgctccgttcccccgccatggccaccgccgcgcgcgctatcgcggccgcccgcctggcgcagccgctcctcgtatcgcggcgcctgccttcctcctcggctcgccccacgcggcctcgtggcggcggcggttccgccgtccgctgcatggcgcggcggcctgacgcctcgtactcgccgctgcggtcggggcagggcggcgaccgcgcgcccacggagatggcgccgctgttccccggctgcgactacgagcactggctcatcgtcatggacaagcccggcggcgagggcgccaccaagcagcagatgatcgactgctatatccagaccctcgccaaggttgttgggagcgaggaggaggcgaagaagaagatctacaacgtgtcctgtgagcgctattttgggtttgggtgtgagattgacgaggaaacatccaacaagctggaaggcctccccggcgttctttttgtgcttccggattcctatgttgatgcagaaaacaaggactatggcgctgagttatttgtgaacggagaaattgtccagcgatcaccagaaaggcagaggagggtggagccggtgcctcagagagctcaagatagaccaaggtacagtgaccggactcgctatgtgaagcggagggagaaccaggcctatcaacggtgacatgcccctgcatttactgcaagtgtcaatcgctcttgttctagatatagcagcagctcccacatgagaaagtgttgttcgtcctgtttgctgcagtgtaaccttgtcatactttcgcatctattttcttgcatgaactgtaggttaagattttgtaggagacttgctccgttatctcagtttggtggccctcgtttggtagtaaaagaatgaagttcactcg

SEQ ID NO: 5076 - DNA, 841 bp, Pseudoroegneria spicata
cgcagcgcgcgccgtcgccgccgccgcgcgcccggcgcacccggtgctcctgtcgccgcgcctcccgtgcccctccgctcgccccgcgcggcctcgcgtcggccgcgccgtccgctgcatggcgcggcgacccgacgcctcgtactcgccgctgcggccggggcagggcggggaccgcgcgcccacggagatggcgccgctcttccccggctgcgactacgagcactggctcatcgtcatggacaagcccggcggcgagggcgccaccaagcagcagatgatcgactgctacatccagaccctcgccaaggtcgtggggagcgaggaggaggcgaagaagaggatctacaatgtgtcctgtgagcgctactttgggtttgggtgcgagattgacgaggaaacatccaacaagctggaaggcctcccgggtgttctttttgtgcttccggattcctatgttgatgctgagaacaaggactatggtgccgagttatttgtgaacggagaaatcgtccagcgatcaccggaaaggcagagaagggtggagccggtgcctcagagagctcaagatagaccgcgttacagcgaccggactcgctatgtgaagcgtagggagaaccaggcttaccaacggtgacacgcccccggccggtctactgcaagcgccccattgctgtagctcttgccctagatatagcaactgctccacgcctgaaatgcccctcgtcgtgtttgctgcattgtagcctcgccatatctgggcgtttattttcttcatgaactgtaggttaagaactgcatgcactaaggtaagtgacttgttccgttgttttggttaaga

SEQ ID NO: 5077 - DNA, 1004 bp, Oryza sativa
cccaatcaaaaccccatccgattcctctccatttcaccaccaccaccaccaccacctccgcctcctctcctccccttctcttcgccggcagccatggccaccgccgcagcagcagcgcgcgccgtcgcggccgccgggcgcccggcgcagggggttccgttgtcgcggcgcctcacgacggcgtcgtcctcctccgctcgcccgctgcggcctcgcggcggccgcgctgccgggtccgtccgctgcatggcgcggcggccggagtcgtcgtactcgccgctgcggtcggggcagggaggggaccgcgcgcccacggagatggcgccgctcttccccgggtgcgactacgagcactggctcatcgtcatggacaagcccggcggcgagggcgccaccaagcagcagatgatcgactgctacatccagaccctcgccaaggtcgtgggaagtgaggaggaggcgaagaagaagatatacaacgtgtcatgcgaacggtactttgggttcggttgcgagattgacgaggaaacatccaacaagctggaagggctaccaggtgttctatttgtgcttcctgattcctatgttgatgccgagaacaaggactatggcgctgagttgtttgtaaacggagaaattgttcaaagatcaccagaaaggcagagaagggtggagccagttcctcagagagcacaagatagaccccggtacagtgaccgaactcgctatgtgaagcggagggagaatcaggcgtaccagcggtgaaggctcaccttacctgcaactggctagatgcatcgactcctgcgtttagaacagcagctcctgcacgagaaatgccttagattttttgtatgctgctgctgtgtaatctggtaatgttttatgcatctgggcatgtatgttttgtctacttcaatcgactaatctattgaactatggcatatgaatttgaagccccactttttggccatttttagcatagctccagatttcaggttcac

SEQ ID NO: 5078 - DNA, 951 bp, Triticum aestivum
ttcgacagcggccactcccgccatggccaccgcagcgcgcgccgtcgccgccgccgcgcgcccggtgcacctggtgttcctgtcgcggcgcctcccctgcccctccgcgcgccccgcgcggcctcgcgtcggccgcgccgtccgctgcatggcgcggcggcccgacgcctcgtactcgccgctgcggccgggggtgggcggggaccgcgcgcccatttttatggcgccgctcttccccggctggactaagagcactggctcatcgtcatggacaagcccggcggcgagggcgccccaagcagcagatgatcgactgctacatccagaccctcgccaaggtcgtggggagcgaggaggacgcgaagaagaggatctacaacgtgtcctgtgagcgttactttgggtttgggtgcgagattgacgaggagacatccaacaagctggaaggcctcccgggtgttctttttgtgcttcctgattcctatgttgatgctgagaacaaggactatggcgccgagttgtttgtgaacggagaaatcgtccaacgatcaccggaaaggcagagaagggtggagccggtgcctcagagagctcaagatagaccgcgttacagcgaccggactcgctatgtgaagcgtagggagaaccaggcctaccaacggtgacatgcccccgtcggtgcaccgcaagcgccccactgctatcgctcttgccctagatatagcaactgctccacgcccgaaatgcccatcgtcgtctttgctgcattgtagccacgccatatctgggcgtttattttcttcattcacgaactgtaggttaagaactgcatgtactactataagtgagttgttttggtaacggtatcttggtttgcggcggaaagagtaaaagaagttgtaagagagcatttaaacttgatgaactctccttgctctgttaaaaaaaaaa

SEQ ID NO: 5079 - DNA, 829 bp, Secale cereale
atccggtgctcctctcgcggcggctcccgtgcccctccgctcgccccgcgcggcgtcgcgtcggctgcgccgtgcgttgcatggcgcggcggcccgacgcctcgtactcgccgctgcggccggggcagggcggggaccgcgcgcccacggagatggcgccgctgttccccggctgcgactacgagcactggctcatcgtcatggacaagcccggcggcgagggcgccaccaagcagcagatgatcgactgctacatccagaccctcgccaaggtcgtggggagcgaggaggaggcgaagaagaggatctacaacgtgtcctgtgagcgttactttgggtttgggtgcgaaattgacgaggaaacatccaacaagctggaaggcctcccgggtgttctttttgtgcttccggattcctatgttgatgctgagaacaaagactatggtgccgaattatttgtgaacggagaaatcgtccaacgatcacctgaaaggcagagaagggtggagccggtgcctcagagagctcaagatagaccgcgttacagcgaccggactcgctatgtgaagcgcagggagaaccaggcttaccaacggtgacatgtccccgtcggtgtaccgcaagtggcccactactgctatcgctcttgccctagatatagcaactgctccacgcccgaaatgcctctcgtctgctttgctgcattgtagccttgccatatctgggcgtttattttcttcattcacgaactgtaggttaagaactgcatgtactactgtaagtgacttgttccgttgttttggtaacgatatcttggtttgcggcggaa

SEQ ID NO: 5080 - DNA, 961 bp, Festuca arundinacea
ggcacgagggtcgtctcctttgccagagcgctgctcccccgccatggccaccgcagcgcgcgccgtagccgccgcccgcccggcgcagccagtgctcttgttcaggcgcgtcccgtcctcctccgcccgccctacgcggcctcgcggcggccgcgggggcgttggctgcgccatccgctgcatggcgcggcggcccgacgcctcgtactcgccgctgcggtcgaagcagggaggggaccgcgcgcccacggagatggcgccgctgtttccaggatgcgactacgagcactggctcatcgtcatggacaagcccggcggcgagggcgccgccaagcagcagatgatcgactgctacatccagaccctcgccaaggtcgtggggagcgaggaggaggcgaagaagaggatctacaacgtgtcctgtgagcgctactttgggttcgggtgcgagattgacgaggaaacatccaacaagctggaaggcctcccaggcgttctttttgtgcttcctgattcctacgtcgatgctgagaacaaggactatggtgctgagttgtttgtgaatggagagatcgttcagcgatcaccggaaaggcagaggagggtggagccggtgcctcagagagctcaagataggccacgatacagcgatcggactcgctacgtgaagcggagggagaaccaggcttaccaacgttgacatgttcccgtgtggttctactgcaagtgtcccatggctatggctcttccccctagatatagcagcagctccgacgccgaaatgccctcgtcgtgtttgctgttctgtagcatcgccacaattcggcatttactttccacatgaactgtaggttaagattttgtacgtgacttgttctgttattctgatcacggattccagtttgtggaactcgtttgaaagaaaacagaaaaaaaaggatgtccatcctgtaagaagcta

SEQ ID NO: 5081 - DNA, 1104 bp, Panicum virgatum
  misc_feature (308)..(308): n is a, c, g, or t
  misc_feature (647)..(647): n is a, c, g, or t
aattccgaaccccctcgcctcgccatttcaccttcacctccgcttccctccgccccttcccttcgcggccaaccaaccaaccgcctcatccctcgccggccatggccaccgcagcgcgcgccgtcgtcgccgcccgccctgcgcggcctctcctcccgtctcggcgcctcccgtccttttcctccgcccgcgccccgcttcagcgcggcggcgtcgggtccgtccgctgcatggcgcggcggccggactcctactcgccgctgcggtcgggtcagggcggtgaccgagcgccgacggagatggcgccnctgttccccgggtgcgactacgagcactggctcatcgtcatggacaagcccggtggggagggcgccaccaagcagcagatgatcgattgctacatccagaccctggcccaggtcgtggggagtgaggaggaggcgaagaagaggatatacaacgtgtcgtgcgagcgttatttcggattcggatgcgagattgatgaggaaacatccaacaagctcgaaggccttccaggtgttctttttgtgcttcctgactcttatgttgatgctgagaacaaggattatggtgcggagttatttgtgaatggggaaattgttcagcgatcaccagaaaggcagagnagggtggagccagtacctcagagagcccaagataggcccaggtacagtgaccggactcgctatgtgaagcgcagggagaaccagtcttaccagcgatgatgttgccatctttggagatagaagatgccgtcatttccacaaagtgtctaaatgcaatgctgaaggaaccggagttactcccacaaggccacaacccacatgacaattaacaattgctccattgtattggctgggcctgtaacctcgcatgcttatgcatttggacctgtatctgtagtctacacgaagttgttatgaactcgtgaatgtttttaacctaaacctccgtctatctgcctcctagtgaccctcccttttgtgtacttgtaccccgagtctgtatggcaattattttggtaatgatcagatattcagacgacatgctttcgacactgagctcaaacaaacacatgccgtg

SEQ ID NO: 5082 - DNA, 871 bp, Hordeum vulgare
gcggcctcgggtcggccgcgccgtccgctgcatggcgcggcggcccgacgcctcgtactcgccgctgcggccggggcagggcggggaccgcgcgcccacggagatggcgccgctcttccccggctgcgactacgagcactggctcatcgtcatggacaagcccggcggcgagggcgccaccaagcagcagatgatcgactgctacatccagaccctcgccaaggtcgtggggagcgaggaggaggcgaagaagaggatgtacaacgtgtcctgtgagcgctactttgggtttgggtgcgagattgacgaggaaacctccaacaagctggaaggcctcccgggtgttctttttgtgcttccagattcctatgttgatgctgagaacaaggactatggtgccgagttatttgtgaacggagaaatcgtccagcgatcacctgaaaggcagagaagggtggagccggtgcctcagagagctcaagatagaccgcgttacagcgaccggactcgctatgtgaagcggagggagaaccaggcctaccaacggtgacatgcccctgtcggtctacggggtctaccgcaagcaccccattgctatcgctcttgccctagatatagcaactgctccacgcccgaaatgcccctcggcgtctttgctgcattgtagcctccatgcctgggcgtttattttcttcatgaaccgtaggttaagaactgcatgtactacttgtaagtgactttgttccgttgttttggtaacggtatcttggtttgcggcggaaaggaaaaaaaaagttcatgtgtttggagctgtgggagactgtttccactcgtgatgaactctctctgttccagctccattagtcccctg

SEQ ID NO: 5083 - DNA, 770 bp, Saccharum officinarum
cacgagccggaggcgggcgtccaactcctgggccgccgtctgcgataccttcttctccaccaagcaagtgttcgagaaccaccgcatcgtcttcacagtcggcacctccatcgcctccgtcctcacggcttgggccggctattcacttcgccaggtgcatcaatcaaggattgaaaggaggcttgagtcaattgaatcatctctgaagggaaaccacaaagttgaacatgaagagataaaaaagattgtcacttccagcaatattagcgctccagcctgtgtagccacggcgatgaccacaatggttgttgggtacacgctgggatggcgaggcggtgcttggtatgctcaaagggccttcagaagagagcaacaaaagatgatgatgggtcacatgaagtcacataacagatggcactggcggcccttcaacagactcagaaacaggcttaggaacagcaggttagcctccaagaacaagagcgccgacgcccatccgtcggtgggtcaaagcagcgaggccccctcaacctcaagcatcggggcctctgcgaacgttagcagtgcttctcagccggcagcgggcagtgcatgaactatatatgcatactacatggactaagatgtgaacttgagggcgcgtagtccacacgtcttgctagaacagatcatgtgacttgtaggtacttagctcgatctgtggtggattatttttgtagcatattaaggtcataatgcacccaaatacatgcgttgaacaattgactgac

SEQ ID NO: 5084 - DNA, 918 bp, Zea mays
aaggaaagcggaggaggaagaggagccaagccgctcgcctcaacacacccccacccaagcaacacgcggaaaaggcgaggcgatggtggtgcggcggctgggcggcgcggggcgcgcgctgctcacgctccccaacatccggaggcgggcgtccaactcctgggccgccgtctgcgacaccttcttctccactaagcaagtgttcgagaaccaccgcatcgtcttcaccgtcggcacctccatcgcctccgtcctcacggcttgggcaggctattcacttcgccacgtgcaacaatcaaggattgaacagaggcttgagtcaattgaatcatctctgaagggtaaccacaaagttgaacatgaagagataaaaaagatcgtcacttccagcaatattagcgcccccagcctgtgtagccacggcaatgaccacaatggttgttgggtccgcggtaggctggcgaggtggtgcttggtacgctcgaaggggcttgagaaaagagcaacaaaagctggtggggatgggtcacatgaagtcgcacgacagatggcactggcggcccttcaacaggctcaggaacagcaggttagcctccaagaacaagcgcgccgacgcccatccaagcaccgaggccccctcgacgtcaagcaacgcggcctctgcggacgttagctgtgcttctcagccggcagcgggcagtgcatgagcttatatatccacaacaatggactaggattagtccatacgacttggtagaacagacaatgtgagtcagctcgatctgtggtggatcgtttttacatgcgtgaaccagtacagtgtacatacaaatgtacaatcatatgtactttgataaaccattacataagctattcacctttttttttctaatacaactgcgattatttgtactgtta

SEQ ID NO: 5085 - DNA, 1137 bp, Setaria italica
gccgcaactcgcaaccggcatcaccggcgttcgtcccgttcgtttcgtaccccgcaagttggtcgcgctccctccgccgtgaaggcgaggagaaacaggggaagccaagcacaagccgactcggccgctcgcctcccgaatccccccgaaaacacgcgaaatcccccacccccagacagagcagaagcagctcccgaaaaggcgaggagcaccgagatcggggggcgatggtggtgcggcggctgggcggcgcggggcgcgcgctgctcacgctccccaacatccggaggcgggcgaccaactcctgggccgccgtccgcgacaccttcttctccaccaagcaagtgttcgagagccaccgcatcgtcttcaccgtcggcacctccgtcgcctccgtcctcacggcgtgggccggttattcactccgccatgtgcagcaatcaaggattgacaggaggcttgagtcaattgaatcttctttgaaggataatcacaaagttgaacatgaagagataaaaaagattgtcacttccagcaatattagcacgccagcttgtgtagccacagcgatgaccacaatggtggttgggtatgcgctagggtggcgtggtggagcttggtatgctcgaagggccttccgaagagagcaacaaaagctgatgatgggtcacatgaagtcacaaggtagatggcactggcggcccttcaatagacttaaaaacaggctcagaagagcgtccaagaacaagagtgaggacgcccatcgatcgttggctcaaagcactgacgccccctcaagcagcggggcatctgcgaacattagcaatactgctcagccagcagcgggcaacgcatgaagtacatagatggactatgatgtgtagtagcgagtgcataatagtccatatgctttgcaacagaccgtatgactagtaggaggtagtgccaacccaatggtggttcatttttgtagctttaaggtcataatgcacgcagtttgcggattcagctgtgacacggagaaaactaattgatggattagagacagggaacctgtctactgctgctggtgttcagcttgcccgtccaagatatacttcctttctgccatgctattttgagaattgagacagcatt

SEQ ID NO: 5086 - DNA, 2195 bp, Zea mays
aggaaacgcggccgaggacgagagtgggccagcggggtcgaggaggtaaagaaaactaatggcagcgaaggagggaggcagtggggaaggtgggaagcggctgcccaaagccacctccaccaccaggccttcttctacccccatcccaacgcccaggccacaccagcgcagcgagctctctcctcgtagcggagtcccagcccctcacgccctcccgatcgcgctcgtcggcgcccttgtcgactcgagcccgcttctgggccgatcgacagcgagagcgagagcagcggcgcgccgaggagagctctttcggtgctgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcacctcccgccctcctgccaacctgcccgcgcccacgcccacgtgcagctcaagctccaccgtcgagtcctccagcgggccccgggccggggtgcccagggcgggcaggcgcgctgctgggaagccgcgtgccccgcggcaggcggccgcgcccgccgacgccgactgccgtagcgactgcgcctcgtcggcctccgtcgtggacgacggcgacgacgcctccacggtccggtcgcgcccggcgctcgacctcaatctccccgcgccgctcgacgtcgacgatggtcatgacctcgagctttgcacggacctgcggctctgaataggcgaccggatccacggacggatcgggacgaagggagagaaggcggtttttgctttggtcttcttttcttgatcagattctgccttgctttgacttgtcgtgctcgagggagcttgtaccagtgctgcactgtactactcgatacgaatggcaatagaattggatgacgattcctgcaacgctatgcagactgcggatccgttcagaggaggctccgctcggcgctcctgacaccatcggccatcgcgcttcgcgcccgcaactgctcgaccgagccgggaccgggcggcgcccgttcgttgcgtatcccgcaagttggccggcctccctccgccttgggaggggaaagcggaggaggaagagggagccaagcggtcaagccggctcggccgatcgcctcccaccaaaatacccccgaatccccatccccaagcaacacccagaaaaggcgacaagtgccgaggtctggggagcgatggttgtgcggcggctgggcggcacggggcgcgcgctgctcacgctccccaacatccggaggcgggcgtccaactcctgggccgccgtctgcgacaccttcttctccaccaagcaagtgttcgagagccaccgcatcgtcttcaccgtcggcacctcaatcgcctccgtcctcacggcttgggccggttattcacttcgccatgtgcaacaattaaagattgaaaggaggcttgagtcaattgaatcatctctgaaggataaccacaaagttgaacatgaagagataaaaaagatcgtcacttccagcaatattagcgctccaggctgtgtagccacggcgatgaccacaatggttgttgggtacgcgttaggctggcgaggcggtgcttggtacgctcgaagggccttcagaagagagcagcaaaagctgatgatgggtcacatgaagtcgtcacagaacaggtggcactggcggcccttcaacaggctcaggaacagcaggttaaccgcctccaagaacaagagcaccgatgccctctcaacctcacgcagcggggcctctgcgaacgttggcagcgcagcgggcagtgcttgagctatacgcataatggactaggatgtggacttagggcgcgtagtagtccatacaactttactacgtagaacagatcatgtgactggtaggtacgcagattgatctacatgcgcgcagtggatcatttttttgtgtagtatattaaggtcataatgcacccaactgcatgcatggaacaactgactgacgataggattgagttgagacagccatatggtggc

SEQ ID NO: 5087 - DNA, 1010 bp, Pennisetum glaucum
gcgcggggcgcgcgctgctcacgctccccaacatccggaggcgggcgaccaactcctgggccgccgtccgcgacaccttcttctccaccaagcaagtgttcgagaaccaccgcatcgtcttcaccgtcggcacctccgtcgcctccgtcctcaccgcctgggccggttattcactccgccatgtgcagcaaacaaggattgacaggaggcttgagtcaattgaatcttccttgaaggataatcacaaagtcgaacatgaagagataaaaaagattgtcacttccagcaatattagcacaccagcctgtgtagctacagcgatgaccacaatggtggttgggtatgcgctagggtggcgtggtggagcttggtacgctcgaagggccttccgaagagagcaacaaaagctgatgatgggccacatgaagtcgcaaggtagatggcactggcggcccttcaacagacttaaaaacaggctcagaagggcgtccaagaacaagagtgaggacgcacaaggattggctcaaagcaccgacgccccctcaagcagcggggcgtctgcgaacattagcaatactgctcagccagcagcaggcagcgcatgagctatatacatagacgggacttgtgctttgtgaagttgcaaatgcgtagtccttatgctttgcgacagatcgtatgactaagtaggaggtagtgccaacccaaatagccaatggcggttcatttttgtagcctaaggtcatataatgcacgcagtttgcagatgcagctgtggaagggagaaaactaattgatggactagagacagggaagaggggatctgtctactgctgatggcgttctgctttgcccctcccaagttcatacttcctttctgtcatgctattttgaaaactgagacagccttgtatcatgttgccgttctgtcttctttgatctgtaatctgttcatcagaacgttgcgtttctgcgagctggaacatatatcatatcgcgtttgagcgact

SEQ ID NO: 5088 - DNA, 1187 bp, Zea mays
ctcccacacaaataggacggagaagtcgggaacatgctaaggggaacggcgccaccgagaggaacgcgaggtcgccatcaccatggggggaggagtcatgcgcaccgccgcgaaggtgggcatcgccaggggcgccgcggcggtggcagcggcgaaaggcggccggttccgccacgccgcgccggccttcgccacggcccccgccgccacgggttccgatgcggcgccgcttgtctccgcctccggtggcgaggtgccccccgccgcggcgcagtgggcggcgtcctgggagctggacgattgggaattcgcagactgcggggacgttgccccggcggctgtggtggcggagagggaggcgacggcagcggccgcgaagcccaggctggtcttcgcgccgccgtcgagggaggaggccgaggaggctacgactgagctcagggacgccataggcagggcttatttcaacgaatcaccagttgaggttgttaaggaacaagataaagagtttaataaactggcaactgatgccataattccttctatgcctggacatgtggttcaagcttttacattgctgaaatcaagcacagaggctcagagtgttgtcgcctcccttgcatcagatagaaatgtctgggatgcagtattgaagaatgagaaggttatggaattttataagactcaccagacaactccagttcagacattccctgaggaagcagccacagcagagtcgcctgggaagtttgaagatgccacctctgaaaatgcatccaacagcgaactccccacgggctcaggcgcaagtttcgcagatttcgtggacaatgcgaagaagaaagtgatggatgtggtccacaatataaccgactttttcagggacttgttcaatgactcagccgaggcccagaccggagcaggcccttcagctgagaagggcttttctgcaacagagatggctgtgggaggatccttcatggctctgaccatagcggtcatcctagttgttctgttcaagagggcatgatagctcaagagtcatgggtaccttctgggacccatcgtgctttaaatctgtcgaaaattactcgtctgtcgtatggtcaataattccgaatgcaatgtatagcttgtccgtttctttggaaacagtacaataaaggatttatctaaagtatgctcct

SEQ ID NO: 5089 - DNA, 1274 bp, Zea mays
accgatcaacttcaaaagatttcttctgcagtttctcaagtcgagaagctagtgggggacgacgccaccgagagggaacgcgacacgagatcgccatcgccatggggggaggagtcatgcgcaccgccgcgaaggtcagcatcgccgggggcgcggcggcggcgaaaagcggccggttccgcaacgccgctccggtcttcgccacggcccccgccgccgcgggttccgaagcggcgccgcttgtctccgtctcgagtggcgaggtgccccccgccgcggcgcagtgggcggcgtcctgggagctggacgactgggagtttgcggactggagggacgacgccgcggcggcggcggcggtagtggagagggaggcaacggcggccgccgccaagcccaggctggtcttcgcgccgccgtcgagggaggaggccgaggaggccacgaccgagctcagggacgccgtagagagggcttatttcaacgagtcgccagttgaggttgttaaggaacaagataaagagtttaataaactggcaactgatgccatgattccttctatgcctggacatgtggttcaagcttttacgttgctgaaatcaagcacggaggctcagagtgttgtcgcctcccttgcatcagatagaaatgtctgggatgcagtattgaagaacgagaaggttatggagttttataagactcaccagacaactctagttcagacatcccctaacgaagccgtcacagtagagttgccggggaagctggaagatgctgcctctgaaaacacatccagcggcgaactccccgctggctcaggcccgagtttctccgatttcgtggacaatgcgaagaagacagtgatggacgtggtccataacataaccgacttcttcaaggacttgttcgacgactcagccaagacccagactggggcaggcccttcagcagctgagaagggcccttctacggcagatatggctgtcggcggatccttcatggctctggccatagcggtcatcctagttgttatgttcaagagggcatgatatagccatgagtatcttctgggatccacggtgctttaaatctgtcgaaaattactcgtctatcgtttggtcaagaactcctgactgtaatgtaatgtacagcttgtgtccttgtccttggaaacagtacactaaaaggctatctatgatatacaacggtgtgtatcttggtttctcaacctctgatgtgcagacatgacaagagcgtgcaacgcgttttgatgacgt

SEQ ID NO: 5090 - DNA, 1365 bp, Setaria italica
accaaacaactccaaggtttctcctgcattttgccccccacacatataggacgagaaaggtgcggggaactagggggaggggagacgccaccggagagaggggtaccgccaacgccaacgccaacgccaacgccatccgccatggggggaggtgtcatgcgcaccgcagcgaaggtcggcatcgccggtggcgccgcggcggcgtcggcggcaaagggcggccggttccgccacgccgcgccggccttcgccacggcccccgccgcggcctcgggtgccgaggccgcgccgctggtctcctccgcctcgggcgccgaggtgccccccgcggcagcgcagtgggcggcgtcctgggagctggacgactgggagttcgcggactggagggacgacgcggcgtccgtcgtggtggcggagagggaggcggcggcggccgccgcgaagcccaggctggtcttcgcgccgccgtcgagggaggaggccgaggaggccaccaccgagctcagggacgccatagagagggcgtatttcaatgagtcgccagttgaggttgttaaggaacaagataaagaactgaataagctggcaacagatgcaataattccttctatgcctggacatgtagtccaagcctttacattgctgaaatcaagcccagaggctcagagtgttgtcgcctcccttgcatcagatagaaatgtctgggatgcagtattgaagaatgagaaagttatggaattttacaagactcaccagacaactctagttcagacattccctgaggaagctgccacagtagaatcgcctgagaagtttgaagatgccacctctgaaaatgcacccaccggctcacctttcgcagactttgtggacaaggcgaagaagacgatgatggacgtggtcgataatataacccacttcttccaggacttgttgcatcccccagcggaagcccaggctggagcaggctcctcagctgagaagggcccttctttggcagagatggctgtcggcggttccttcatggctctgaccattgcggtcatcctagttgttctgttcaagagggcatgatagctcatgaggcgcctcttctgggacctatcctacttcaaatctgtcgaaaattactcggtcaagaatactacgaacgtaatgtacagcttgtgtccttggtttcatgccggttccgatgagtcgtcgagacagtacaataaaagacttatctatcctataacaatgtttttgtgcgtgtattgggttgtctaatttattttactggcttgtggtgttatatgatatgctaggttatcccataacaagttgaattgaagaaaaataatgtgtaaagaaaacgtgataaaa

SEQ ID NO: 5091 - DNA, 1171 bp, Panicum virgatum
aggcggaggggagacgcgaccgagaggtggggaaggaacgccatcgccatggggggaggagtcatgcgcaccgccgcgaaggtcggcatcgcggggggcgccgccgcggcggcggcggccaagggcggccggttccgccacgccgcgccggccttcgccacggcccccgcgggcgccgaggccgcgccgctggtctccgccgggggcgccgaggcgccccccgcggcggcgcagtgggcggcgtcctgggaggtggacgactgggagttcgcggactggagggacgacgcggcggccgtcgcggtggcggagagggaggcggccccgaagccccggctggtcttcgcgccgccgtcgagggaggaggccgaggaggccaccacggaactcagggacgccatagagagggcttatttcaatgagtcgccagtcgaggttgttaaggaacaggataaagagatcaataagctggcaacggatgcaataattccttctatgcccggacatgtagtccaggcatttacactgctgaaatcaagccctgaggctcagagtgttgtcgcctcccttgcatcagatagaaatgtctgggatgctgtattgaagaatgagaaggttatggaattttacaagactcaccagacaactctagttcagacattccctgaggaagttgccaccggagaatcacctgagaagtttgaagatgctgcctctgaaaatgcatccgccgcttcacctttcgcagactttgtggacaacgcaaagaagacagtgatggatgtcatcgataatattacccacttcttccaggacttgttcggtcacccgacgggggcccaggctggggcaggctcatcagctgagaaggggccttctgtaggagagatggctgttggcggttccttcatggctctaaccatagcagtcatcctagtagttctgttcaagagggcatgatgagggcctctcctgggacctaccagacttcaaatctgtcgaaaattacttcgtcaagaactactaatgtaatatacagcttgtgtgtccttggtatcatgagttgtggagacagtacaataaaagactatctatgctataacaagcttgtgaaatgttgatgatgtctcttagtactgggtaaaggaaattgcgttctattctgtatggc

SEQ ID NO: 5092 - DNA, 3491 bp, Setaria italica
gatcgagcacgagcagggtgaggccaagcagagcagaggagagcagcggggatatgctgcgaggacggcaggggcgtcaggaagcgtagcggccatgtgggcgccgtcgcgggggtcgtcgtcggggagcgggcggcggacctggcgccggcgcatcgtggactacctcgccgacgatcagaccgacgcgtccgacaatgagtccttcatcacggcgcacagcgacgagctcgggttcggcgccgcctcggtgtcgtccgccgcggggggcggcggcggtgtcggtggcggcggcgcggaggggatgctgccggcgttcctcgcggaccagggcgacctggtggaggtcatgctggagctggacgaggagtccatggtggtgcgcagcgtcacgcccaccgccgccgcgctctacgggcccacgtcgctggccgccggcgccggggcggggggcgccagcgcgcgcacgccggacggcgcgcggagcctgagccggtgctcgtcgacgtcgtcccggatacgcaggaagttcgcctggctgcgctcgccgtccccttcgccgtcgcagcggcacccggtccccgcgtcggcggcgtccgaccagcaggcggtccgggaggcggcgctcgcggcccgcgagcggcggcgcgtccaggcgcggctgaatcggtcgcggtccggggcgcggcgcgcgctcaagggcctccggttcatcagccgcaccacgggcgacgacgccgctggcggcggcgacctctggcgccgcgtcgaggagcgcttcaacgcgctcgcgcgcgacggcctcgtctcccgcgacgacttcggcgactgcatcgggatgaaggactcgaaggatttcgcggtgggcatcttcgacgcgctggcgcggcggcggcggcagaacctggagcggatcagcaaggaggagctctacgatttctggctccaaatctccgaccagagcttcgacgcgcgcctccaaatcttcttcgacatggtggacaccaacgtggacggcaggatcacgagggaggaagtgcaagagctgatcgtcctgagcgcgtcggcgaacaagctggcgaagctcaaggagcaggcggaggagtacgcctccctcatcatggaggagctcgacccggagaacctcggctacatagagctgtggcagctggaggcgctgctcctgcagcgcgacgcgtacatgacctacagccggccgatgagcagcggcagcgcggggcagtggagccagggcctcagcgcaggcgccggggccggcgcgggcgcgggcgggcagcagcgggacggcgtggcgtcgcaggttcggcggcggttgagcccgcgtcgcgcggcggcgagggcgcgcgtggcggcggcggaggggtggcgtcgcgcgtgggtgctggcgctgtggctcgcggcgatggcggcgctgttcacgtggcggttcgtgcagtaccggcggtcgtcggcgttccgggtgatggggtactgcctcccgacggcgaagggcgccgccgagacgctcaagctcaacatggcgctcgtgctcctcccggtgtgccgcaacacgctgacgtggctccgctccacctgggcccgcttcttcgtccccttcgacgacagcatcgccttccacaagatcatcgcgacggcgatcgcgctgggcatctgcctgcacgcggggaaccacctggcgtgcgacttcccgcggctgatcgcgtcggggcccgacgagtaccgcctcgtggcgcgcttcttcggccgggacaagcccacctaccgggccctcctcgccggcgccgagggggtcacggggatcgtcatggtcacgctcatggccgtctccttcaccctcgccacgcgccccttccggaagcgggaggagatggccaagggcgccgccgcagccgccgccggcggtggcggccggcggctcctccggtggtcgttcccgctcggccacctcgccggcttcaacgccttctggtactcgcaccacctcctcatcgtcgtctacctcctgctgctcgtccacggctggttcatgttcctcgtcgacaggtggtaccagaggacgacatggatgtacatttctgtaccattggtgctttacgttggggagcggacgctacgtgccttcagatccaaggcgtatgctgttaagatcctcaaggtgtgccttctaccgggaaatgtcttgaccataacaatgtcgaaaccatatggatttcgctacagaagtgggcagtatatatttctccagtgtccaacaatctctccatttgaatggcatcctttttccatcacttcagctcctggagatgactacatcagtgtccacatccagaccaggggggactggacccaagagctcaagcgcatcttcgttgagaactacttcacgccatgcgtgcccatacgagctgcattcggggagctaggcgcggcggagcagaagagtccgccaaggttgctggtcgatggcccctatggtgcccctgcgcaggatttcaggaactatgatgtgctactcctcgtcggtcttgggatcggcgccacaccttttatcagcatcctgagggatctgctgaacaatatcaagctggctgatgagctgatggacctggcaatggagaccagcaagtctgaggacagtgccaacagcttgtcgaccgcgagcagcagcaacaagaggcgggcgtacaggacgagctgtgcgcacttctactgggtcacaagggagccaggatcattcgagtggttcaagggggtgatgaatgaggtcgctgaaatggacaagaagggtgtcattgagctgcacaactatctgacaagcgtgtatgaggagcgtgatgcaaggacaacgctactgtcaatggtgcaagccctgaaccatgccaagcatggcgtagacattgtatcaggcaccagggtcaggacacattttgcaagaccaaactggaaggaagtcttcgcaagaatcgcttccaagcacccgaattccacagttggggtgttctactgtgggagacctacacttgccaaagaattgaagaaactgtcacttgacatgagccacaaaacgggaacacgcttcgattttcacaaggagtacttctgatggagaatacactcctgaattccatagtagtagtagatacggataaaacagccacaaattttgcatagaagcaaactgaccctcttcaccatatgtaaatgtacatagtacaaggcggagggtagttagaagcatttttattaacaaaacgggagggtaaagatatttcgtgtgttctcagacaggcattggttactggtttactacaggtatacatgtatagctcatagctactcattgtatgctaagcatacaagagactgaggccaccaatctgaatgtatatcattcaattagtagttcatcgttactttattactcactggcattgtgtagaaatcatgtattgttaattggttcttcactt

SEQ ID NO: 5093 - DNA, 3590 bp, Zea mays
tgctttcgcatcgtcctcttggctggaagcgtccgcggctcggcgcaccgaatcccaaccaccggtagtgccgcatatacatcgccctgccgctcggcccggctcgcgacaagcaagctgatcacctgagcaagctcggtgaggccaagcagagcggcgctccagttccagccaggccccggagatatgcagatgcggcggtgagggccgggccggcagcagtggtgcctagctagaagcgtacgtaggggcgggcccagccatgtgggcgccgtcgcgggggtcgtcgtcggggagcgggcgaaggacctggcgccggcgcatcgcggactacctcgccgacgaccagaccgacgtgtcggacaatgagtccttcatcacggcgcacagcgacgagcacgccgccccggcgtccggcgccgggggaatgctgccggcgttcctcgcggaccagggcgacctcgtggaggtgatgctggagctggacgaggagtccatggtggtgcgcagcgtcacgcccaccgccgccgcgctgtgcgggcccacgtcgctgcccctgcccggcgcgcggagcctgagccggtgctcgtccacgtcgtcgcggattcgccggaagttcgcgtggctgcggtcgccgtcgccgcgccccccggccgcgaccgcggcgtccgaccagcaggtggtggtgcgggaggcggcgctggcggcccgcgagcggcgccgcgcccaggcccgcctggaccggtcgcggtccggggccaggcgcgcgctcaagggcctccggttcatcagccgcaccacgggctcctccgacgccgacgccggcgccggcgccgggctctggcgcggcgtggaggagcgcttcaacgcgctcgcgaccgacggcctcctcgcccgcgacgacttcggcgactgcatcggtacgtacgttcgtccgaacaaacaaacaaagcagcctccgtacgtctgttgctacgggagccatgaacgacgacatcgacgccgatcgtccgttgcagggatggtggactccaaggagttcgccgtgggcatcttcgacgcgctggcgcggcggcggcgccagaacctggagcggatcagcaaggacgagctctacgagttctggctgcaaatctccgaccagagcttcgacgcgcgcctccaaatcttcttcgacatggtggacaccaacgtggacggtaggatcacgagggaggaagtgcaagagctgatcgttctgagcgcgtcggcgaacaagctgtcaaaactcaaggagcaggctgaggagtacgcgtccctgatcatggaggagctcgatccggagaaccttggctacatagagctgtggcagctggaggcgctgctcctgcagcgcgacgcgtacatgacctacagccggccgatgagcagcggcagcgcggcgcagtggagccagggcctgagcggcggcgcgggcgcgggcgggcagccgtcggcgcagcagcagcagggcgtcgcgtcgcggtggcggcggtggagcccgcgtcgcgcggcggcgcgggcgcgcgtggcggcggcggagagctggcggcgcgcgtgggtgctggcgctgtgggtcgcggccatggcggcgctgttcgcgtggcggttcgtgcagtaccggcggtcggcggcgttccgggtgatggggtactgcctccccacggccaagggcgccgccgagacgctcaagctcaacatggcgctcgtgctcctccccgtgtgccgcaacacgctgacgtggctccgctccacctgggcgcgcttcttcgtccccttcgacgacagcatcgccttccacaagatcatcgcgacggcgatcgcgctgggcatctgcctgcacgcggggaaccacctggcgtgcgacttcccgcggctgatcgcgtcggcgcccgaggagtaccgtctggtggcgcgcttcttcgggcgggacaggcccagctaccgcgggctcctggcgggcgcggagggcgtgacggggatcgtcatggtcacgctcatggccgtgtccttcaccctggccacgcggccgttccggaagcgggaggaggccagcagggacaagaagaaggcggcggcctgcgcatgcaggggcgtcccgctcgccggcttcaacgccttctggtactcgcaccacctgctcatcgtcgtctacctcctgctcctcgtccacggctggttcatgttcctcgtcgacaagtggtaccagaggacgacgtggatgtacatttctgtgccgctggcgctttacgtcggggaacggacgctacgggccttccgatccaaggcctacgcagtcaagattctcaaggtgtgcctcctgccggggaacgtcctgaccgttaccatgtcgaagccctacgggttccgctacaggagcgggcagtacatattcctccagtgtccaacaatctccccgttcgagtggcaccctttctccatcacctcagctcccggagacgactgcgtcagcgtccacgtccagaccaggggcgactggacacaggagctcaagcgcatcttcgtcgagaactacttcacgccgtgcgtgcccagacgggctgccttcggggacctaggcgcggtggaccacaagaccaagagcccgccgaggttgctggtcgacggcccctacggcgcccccgcgcaggacttcaggaactacgacgtgctgctcctcgtcggcctcgggatcggcgccacgcccttcatcagcatcctcagagacctcctcaacaacatcaagctggccgacgagctcatggacctggcaatggagaccggccgggccgaggacagcgccagcaacctgagcgcgtcgacggcgagcggcggcggcaacaagaggagggcgtaccgaacgacctgcgcccacttctactgggtcacgagggagcctgggtcgttcgagtggttcaagggggtgatgaacgaggtcgccgagatggacaataagggtgtcattgagctgcacaactacctgacaagcgtgtacgaggagcgagacgcgaggacgactctgctgtccatggtgcaggccctcaaccacgccaagcatggcgtcgacattgtgtcagggacaagggtcaggacacattttgcaaggcctaactggaaagaagtatttacgaggatagcgtccaagcacccaaattctacagtcggggtattttactgtgggagacctacacttgccaaagaactgaagaaactgtcacttgacatgagccacagaacgggaacccgatttgatttccacaaggagtacttctgatggaaaatacaagtgcccctgatttcttttagtactagaagatacagataaaaaaattcacaaattttgcgtagaagcgaactgatcctctttcacagtatgtaaatgtacatggtataaagcagagagtagttagaaacgtttttttttctttcttaaccaaatgggagggtgaaaatatgtcctgcgctttcagacagccattggttactgcagatataactgtatagatcatatcattgtatgctaagcatgcaagagacttgaggccaacaatctgaatgcgtatcactcaatt

SEQ ID NO: 5094 - DNA, 1589 bp, Saccharum officinarum
ccgacgccgaggagcaagaagcaggaggaagcacgagcagcatatgtcacagagggccagcgtcccacactcctcctgcatagccttcgcgctccattcccatctcctggtctccagtgagatgtgccccagctcctattggcagcaatagcctctaatctctcccttcctttttccttttcttcccccttggttttcgtttcggtttgctcgagctaaagctttgagcttccgtttttagttttggcctttctttctccctgattcctcctgacaaaaagagagagggaggaaaccgaggcgacaagcaagcaagcaatgggtgtcaagggattcgtcgagggcggcatcgcctccatcgtggccggctgctccacccacccgctggacctcatcaaggtccgcatgcagctgcagggggaagccgccgcggcgccgcagccagcgctacgcccggcgctcgccttccacgccggtggccacgccgtcgcgctcccgcaccaccacgacatccccgtgccgccaccgaggaagccggggccgctggccgtgggcgcgcagatcctgcgttccgagggcgcgcggggcctcttctcgggggtgtccgccaccatgctgcgccagacgctctactccaccacgcggatggggctgtacgacatcctcaagaccaagtggacgcccccggacaacaacggcgtcctcccgctgcaccgcaagatcgcggcggggctcgtggcgggcggcgtcggcgcggccgtgggcaacccggccgacgtggccatggtgcggatgcaggcggacgggcgcctgcccctggccgagcgccggaactacgccggcgtcggcgacgccatcggccggatggcgcgcgacgagggcgtccgcagcctctggcgcgggtcgtcgctcacggtgaaccgcgccatgatcgtgaccgcgtcgcagctcgccacgtacgaccaggccaaggaggccatcctggcgcgccggggacccggcgccgacgggctcgccacgcacgtcgccgccagcttcaccgcgggcatcgtggccgccgccgcgtccaacccggtggatgtcgtcaagacgaggatgatgaacatgaaggtggcgcccggcgcgccaccgccgtacgccggcgccgtcgactgcgccctcaagacggtaaggtcggaagggcccatggcgctgtacaaggggttcatccccaccgtgatgcgccagggacccttcaccgtcgtgctcttcgtcacgctcgagcaggtgcgcaaggtcttcaagggcgtcgagttctgagaccgacgacgaagaagatgatgatgaaaatcgccgctgcggtaccagttcgtcaccgcgttcgctgctacgaataagccgctgctgcttcctagaggcggcgactattacgcctttgcttgcttcccgtgtcggccttgtgttcatcccttctcgcatcctgttccgttctatctggatggatttgaccaaatgctcaatgcaatttaccaacattttattaaaaattgcgcgctggactgggctacttcaaacttcaacttgcggtttcagactctacgacgtaatag

SEQ ID NO: 5095 - DNA, 1781 bp, Zea mays
acagctcgggcggccaggtcgccttcctctcccacccgcccgcgccgcgccgcgactgcgaatctgccttccccagtccgaccgcgagcgcgaggccgtggaagcggaaccccaaccgcggagcctccccctgttcgtctccttccctggcccttcccgcaccgcgccacccagctataaattgcgtcccctccctgccgccttcttcccccacccacacatccgacgccgaggaagtaggaagcacgaccagcatatgtcacagagggccagcgtcccacactcctcctgcatagccttcgcgctccattcccatctcctggtctccagtgagatgtgccccagctcctattggcagcaatagctattctccgccttcctttttttcttcttcttcttcctttcctcccgtctggatttcgtttccgtttgatcgagctggctctcagcttccgtttttagttttgttggcatctttgctctcggatccgtctctccctaactcctgaaacccaaaaggagagaagaaaccgggcaagcaagcgatgggtgtcaagggattcgtcgagggcggcatcgcctccatcgtggccggctgctccacccacccgctggacctcatcaaggtccgcatgcagctgcagggggaggcggcggccgccgtggcgccgcagccggcgctgcgcccggcgctcgccttccacgccgggggccacgccgtcgcgctcccgcaccaccacgacatcccggcgccgccgcggaagcccgggccgctggccgtcggcgcgcagatcctgcggtccgagggcgccgcgggcctcttctcgggggtgtccgccaccatgctgcggcagacgctctactccaccacgcggatggggctgtacgacatcctcaagaccaggtgggcccgggagaacggcggcgtcctcccgctgcaccgcaagatcttggccggcctcgtcgccggcggcgtcggcgccgccgtgggcaacccggccgacgtggccatggtgcggatgcaggcggacgggcgcctgcccctcgcggagcgccggaactaccgcggcgtcggcgacgccatcggccggatggcgcgcgacgagggcgtgcgcagcctctggcgcgggtcctcgctcaccgtcaaccgcgccatgatcgtcacggcgtcgcagctggccacgtacgaccaggccaaggaggccatcctggcgcgccgcggcccgggcgccgacggcctcgccacgcacgtggccgccagcttcaccgccggcatcgtcgccgccgccgcgtccaaccccgtcgacgtcgtcaagacgaggatgatgaacatgaaggtggcgcccggcgcgcccccgccctacgccggcgccgtcgactgcgccctcaagaccgtcaggtcggagggacccatggcgctgtacaaggggttcatccccaccgtgatgcgccaggggcccttcaccgttgtgctcttcgtcacgctcgagcaggtgcgcaaggtcttcaagggcgtcgagttctgagaccggcgacgaggaaagatgatgacgacaacaaacgctgcgctgccagttcgtcaccgcgttcgctgccaagaataataacccgctgccaccctagaggccgcgactactattacgccctttgcttgcattgcatcccgtgttagacttgtgctcatgcgcttcactgcatcctgttgtatctggatggatttgaccaaatgcaaattgccaacatttttattaattaaaattgctactgcaatgtctcaactc

SEQ ID NO: 5096 - DNA, 1568 bp, Cenchrus ciliaris
ccgaggaacaaggaagccacgagcagcatatgtcacagagggccagcgtcccacactcctcccgaatagccttcgcgctccattcccatctcctggtctccagtgagatgtgccccagctcctattggcagcagtagctagctagctagatctcgtcgcatttttccttctttttttcgtttcccgggttgctcctcaacccgacccaagctttcttgagcttccgtttttagttttcggctttctttggtctcgctcgaatccgtccatccctctccgataagagggaggcgaaggggaaggaaggaaccaaccgcggcgcggcgaggagcaagcaaccgagcagcaatggggctcaagggattcgtcgagggcggcatcgcgtccatcgtggccggctgctccacccacccgctcgacctcatcaaggtccgcatgcagctgcagggcgaggcggcggcggcgccgcagccggcgctgcgcccggcgctcgcgttccacgcgggcggccacaccgtcgcgctccctcaccacccccacgacatcccggcgccgccgaggaagcccggccccgtcgccgtcggcgcgcagatcctgcgctccgagggcgccgcggcgctcttctccggtgtctccgccaccatgctccgccagacgctctactccaccacgcggatggggctctacgacatcctcaagaccaagtggacccgggagaacggcggcgtcctgcccctccaccgcaagatcgcggcggggctcgtcgcgggcggagtcggcgcggccgtcggcaacccggccgacgtcgccatggtgcggatgcaggccgacgggcggctgcccctcgccgagcgccggaactaccgcagcgtcggggacgccatcggccggatggcgcgcgacgagggcgtccgtagcctctggcgcgggtcgtcgctcacggtcaaccgcgccatgatcgtcacggcgtcgcagctggccacgtacgaccaggccaaggaggcaatcctggcgcgcaggggacccggcgccgacggcctcgccacccacgtcgccgccagcttcaccgcgggcatcgtggccgccgcggcgtccaaccccgtcgacgtcgtcaagacgcggatgatgaacatgaaggtggcgcccggcgcgcccccgccgtacgccggcgccgtcgactgcgcgctcaagaccgtgcggtccgaggggcccatggcgctctacaagggcttcatcccaaccgtgatgcgccaggggcccttcaccgtcgtgctcttcgtcacgctcgagcaggtgcgcaaggtcttcaagggcgtcgagttctgagacccgcaggccaccgccgcgacgacgacgacgaagataatgacgacagccaccgccacgaccgtgtctaccaccgcgtccgctgctacgaataatcgctgctaccctctagaagtcaagaccatcacgcctcggcttgcatcccgtgtcagccttgcgttgatcccttcctgcatcctgttgtccgtggatggatttgagtatttgaccaaatgttcaatggaaatttcaattttttatta

SEQ ID NO: 5097 - DNA, 1928 bp, Setaria italica
ggcggcccggtcgccgctcccaccccacccacctcccccccgcggcaccgcccgcgtccttgactacgacgaatctgccttccccagtccgaccgcgaggccgtgggtgggagccccggccgcgaagctagccaccacctcccccgcccgttcggcagtccgtccgtctccttccttgacccttccgccccgcccgggcaccccagctataaatagcgcccccgccgccgcctcctccccacacacaatccccacaccgaggaagcaggaagccacgagcagcatatgtcacagagggccagcgtcccacactcctccagaatagccttcgcgctccattcccatctcctggtctccagtgagatgtgccccagctcctattggcagtagtagctagctaatctcgcgtttttcttcttcttttcgtttcgggtgggtttgctcccctgagctttcttgagcttccgtttttagttttcggctttccttggtctcgaatccatccctctccgataaggaggctgctaaggggaagaaggaaggaaccaaccgcggcgaggagcaagaaatcaagcaatgggggtcaagggattcgtcgagggcggcatcgcgtccatcgtggccggctgctccacccacccgctcgacctcatcaaggtccgcatgcagctgcagggagaggcggccgccgcggtgccgccgcagccggcgctgcgcccggcgctcgcgttccacgcgggcggccacaccgtcgcactcccgcaccaccacgacatcccggcgccgccgaggaagcccgggcccgtcgccgtcggcgcgcagatcctgcgctccgagggcgccgcggcgctcttctccggggtctccgccaccatgctgcgccagacgctctactccaccacgcggatggggctctacgacatcctcaagacaaagtggacccaggagaacggcggcgtgctgccgctccaccgcaagatcgcggcggggctggtcgcgggcggagtcggggccgccgtcggcaacccggccgacgtggccatggtgcggatgcaggcggacgggcggctgcccctcgccgagcgccggaactaccgcagcgtcggggacgccatcggccggatggcgcgcgacgagggcgtccgcagcctgtggcgcgggtcgtccctcacggtgaaccgcgccatgatcgtcacggcgtcgcagctggccacatacgaccaggccaaggaggccatcctggcgcgccggggccccggcgccgacggcctcgccacgcacgtcgccgccagcttcaccgcgggcatcgtggccgccgcggcgtccaaccccgtcgacgtcgtcaagacgcggatgatgaacatgaaggtggcgcccggcgcgcccccgccgtacgccggcgccgtcgactgcgcgctcaagaccgtgcggtccgaggggcccatggcgctctacaaggggttcatccccaccgtgatgcgccaggggcccttcaccgtcgtgctcttcgtcacgctcgagcaggtgcgcaaggtcttcaagggcgtcgagttctgagacccgccagccaccgcgacgacgacgacgaagatgatgacgacagccaccaccaccgtgttaccaccgcgtccgctgctacgaataatcgctgctaccctctagaagtcggagactatttacgcctcggcttgcattgcatcccgtgtcagcctttgcgttaatcccttcctgcattctattgtccgtggatggatttgagtatttgaccaaatgttcaatggaaatttcaaatttttattaaatcgctgctgcaatatctcgcaatttcacgctgtcatctcggcgagctccagagatgttggaactcgaaagaactgaatatagacaattggcaggtagcgggatcgccatcaacaatcaattgcccc

SEQ ID NO: 5098 - DNA, 1489 bp, Pennisetum glaucum
gaaagacacgagcagcatatgtcacagagggccagcgtcccacactcctcccgaatagccttcgcgctccattcccatctcctggtctccagtgagatgtgccccagctcctattggcagcagtagctaagctagtttagatctccgtcgcattttttccctttttcccgagctttcttgaacttccgtttttagttttcggctttctttggtctcggctcgaatccatccctctccctctccggtaaggaggcgaagaggaaggaaggaaccaaccgcggcgaggagcaagcaaccgaccagcaatggggctcaagggattcgtcgagggtggcatcgcgtccatcgtggccggctgctccacccacccgctcgacctcatcaaggtccgcatgcagctgcagggcgaggtggcagcgccgcagccggcgctgcgcccggcgctcgcgttccacgccggcggccacaccgtctccctcccgcaccaccaccaccacgacatcccggtggcaccgccgaggaagcccgggcccgtcgccgtcggcgcgcagatcctgcgctccgagggcgccgccgcgctcttctccggtgtctccgccaccatgctccgccagacgctctactccaccacgcggatggggctctacgacatcctcaagaccaagtggaccaaggagaacggcggcgtcctcccgctccaccgcaagatcgcggcggggctcgtcgcgggcggtgtcggcgcggccgtcggcaacccggccgacgtcgccatggtccggatgcaggcggacgggcggctgcccctcgccgagcgccggaactaccgcagcgtcggggacgccatcggccggatggcgcgggacgagggcgtccgcagcctctggcgcgggtcgtcactcacggtgaaccgcgccatgatcgtcacggcgtcgcagctggccacctacgaccaggccaaggaggccatcctggcgcgctggggctccggcgccgacggcctcggcacgcacgtcgccgccagcttcaccgcgggcatcgtggccgccgcggcgtccaaccccgtcgacgtcgtcaagacgcggatgatgaacatgaaggtggcgcccggcgcgcccccgccgtacgccggcgccgtcgactgcgcgctcaagaccgtgcgcgccgaggggcccatggcgctctacaagggcttcatccccaccgtgatgcgacaggggcccttcaccgtcgtgctcttcgtcacgctcgagcaggtgcgcaaggtattcaagggcgtcgagttctgagacccgccgccggccaccgccgcgacgaccacgacgaagatgatgacgacagccgccaccaccaccgaccaagtctaccacaacgcgtccgctgctacgaataatcgctgctaccctctagaagtcagacgattacgcctcggcttgcatcccgtgtcagccttgcgttaatcccttcctgcatcctgctgtcccgtccgtgg

SEQ ID NO: 5099 - DNA, 1563 bp, Panicum virgatum
gcacgaggcagcatatgtcgccgaggaccagcgtcccacactcctcccgcgtagccgcctccgcgccctccatttccacctcctggtctccagtgagacgtactagaagctagctaaatctcgcgtttttgttttccttttcgtttcgtttcgggggtgtgctcgagcttcctggagcagcttccgtttttggttgccggcttcctttggtctcggatccatcctccccgataaaagggaggcggggagggaggaaggaggagccgcggcgaggaagaaagcgagggagcgagcaatgggaggggtcaagggattcgtcgagggcggcatcgcctccatcgtggccggctgctccacccacccgctcgacctcatcaaggtccgcatgcagctgcagggggaggcggcggcgccgcagccggcgatgcgcccggcgctcgcggtccccgcgggcggccagaccgtcgcgctcccgcaggacgtcccggtggcgccgccgaggaagcccggcccgctcgccgtcggcgcgcagatcctgcgctccgagggcgccgcggggctcttctccggggtgtccgccaccatgctccgccagacgctctactccaccacgcggatggggctctacgacatcctcaagaccaagtggacccaggacaacggcggcgtgctccccctgcaccacaagatcgccgcggggctcatcgcgggcggcatcggcgcggccgtcggcaacccggccgacgtggccatggtgcggatgcaggcggacgggcgcctgcccctcgccgagcgacgcaactaccgcagcgtcggggacgccatcggccggatggcgcgcgacgagggcgtccgcagcctgtggcgcggctcgtcgctcacggtgaaccgcgccatgatcgtcacggcgtcgcagctggccacctacgaccaggccaaggaggccatcctcgcgcgccggggccccggcgccgacggcctcgccacgcacgtcgccgccagcttcaccgcgggcctcgtcgccgccgcggcgtccaaccccgtcgacgtggtcaagacgcggatgatgaacatgaaggtggcgccgggggcgcccgcgccgtacgccggcgccgtggactgcgcgctcaagaccgtgcggtccgaggggcccatggcgctgtacaaggggttcatccccaccgtgatgcgccaggggcccttcaccgtcgtgctcttcgtcacgctcgagcaggtgcgcaaggtcttcaagggcgtcgagttctagagagacacgcccgccaccaccaccacgacgatgatgacgacaaccgccgccgccgccgccgccgtgttgttaccggtctaccaccgcgtcggctgctacgaattatcgctgctgccgtgcccgccttagcttgcatcccgtgtcagcctagcgctaatcccttcctgcatcctgttgcctgcggatggaaataggggaatattcaattgagtacttgatcagatgtatacaatggaaatttcagataatttatataaaaaaaattcgctgctgcaatgcctagcagttattcacgc

SEQ ID NO: 5100 - DNA, 1520 bp, Avena sativa
gcaccccagggaaagaggaagcacgagcagcatatgtcacagagggccagcgtcccacactcctcctgcatagccttcgccctccattcccatctcctggtatccagtgagatgtgccccagctcctattgggaatagcttctgcccaaatccggcaccttttttttttggcttttattaagctttctttctaggttctagtttctggatctttagggatctcgaatccatccgtctgagcaggggaaggaagaagcaccaagcaaccgaatcaaatgggcatgaagggatttgtcgagggcggcatcgcctccatcgtcgccggctgctccacccacccgctcgaccttattaaggtcaggatgcagctgcagggggaggcggcggccgccgccgccgcgccgcagcccgccctgcgtccggcgctcgcgttccaatccgggacgcacaccgtctccctcccggcccacgacatccctgcgccgaggaagcccggcccgatatccatcggcacgcagatcctgcgcgcggagggcgccgccgggctcttctccgggatctccgccaccgtcctgcgccagacgctctactccaccacgcgtatgggcctgtacgacatcctcaagaagaggtggacccaggagaacggcggcgtgctgccgctgcaccgcaagatcgccgccgggctcatcgccggcggcgtcggcgccgccgtgggcaacccggccgacctggccatggtgcggatgcaggcggacgggaggctcccgctggccgaccgccggaactaccgcagcgtcggggacgccatcgccaggatgacgcgcgacgagggcgtgcgcagcctctggcgcggctcgtcgctcaccgtgaaccgcgccatgatagtcaccgcctctcagctggcgacctacgaccaggccaaggaggccatcctggcgcgccgtggccccggcgccgacgggctggtcacgcacgtggcagccagcttcgccgcgggaatcgtggccgccgcggcgtccaaccccgtcgacgtggtcaagacgagggtgatgaacatgaaggtggcgcccggcgcgcccccgccgtacgccggcgccatggactgcgccctcaagacggtgcggtcggagggcgtcatggccctgtacaaggggttcatccccacggtgtcgcgccaggggccattcaccgtcgtgctcttcgtcacgctcgaacaggtgcgcaaggtcttcaaggacgtggacttctaagaccaaggccaccattgatgcaccggccaccattgatgatgacgaaaacaagcatactgcttgctgctgctctgaataattactactactagtacgtactacctgagcccctcctcccggtggctcggttagccggagattgtaccctgcatcccccttgtcagcctcagttcctgcatcccattgggagtatttggttggattcgatcgatttctaatgaaattttccatttttaattctatgaatttcagaatcttctgagatac

SEQ ID NO: 5101 - DNA, 3223 bp, Oryza sativa
attcatttagtatcataaaatttaattcgaagttgagggaggacatatagacttaatagctaattcttaggcccgttggcccatttagatggagggatatataaacctaaccctagtttctcccacacctcccaatctcctcccagccgccaccctttcctcccggctcccgcgaccaccacgggggcggggcccgcgtgcggcggacggcgacggcgacgacgggggcggggccgcgtgcggcggacggcgacggcgacgtcgggggcagggcctcgtgcggcggacggcaggggctcggcggcgcgaggcgacgacgtgcagcgaacggcgacaagcggaaccagccgcgccggcctcggggcggccgggtcgtggcgacggcgggaactcgacagcacgaggcgacggcgtgtggcggacggcgacgccggactcggggcggccggatccggggtcgacagcccagcagttgcgggattcgacgtcgtgaggcgacggcgacggatggggctcggcggcgcgaggggacgacgtgcggcgaacggtgacgagcggatccggcgtgcgacgtgcgacggtgtgcggcggacggcgacgagcgtttttcgatgtttgttaatttggattttgttgtttattttgattcggatatctggcaaaaaaaggtcggatagtttccgaccgaatccaatttccgacggataccatcgctactgtattcgaatttgtatccgagaaaaactatccgaattcgtatccgaatccgagaatatccgaaaaaaattcgaccgcaacaatccgcatccgaaaaaccgggatcggaactcagaaattatccgtaccactttcatcctactcaccaccagcaagcaaggcatcctgttcccagctatacttgcctactattcccttccttcttttgcccgcctcgaccccaatacgccgcaaaaaaaactttccgagcagacacacaaggaaacccgaaacccacccccccccccccccaagcgagtcatctgccgtccatcctcaccaacggacggcccacgacgcgtccaaaccacggaataattagggcaaacccaacaagagccctgtccgcccacgcgccgtcatactcgcccccccttccccttttctcatcctcctctccgcgtcaagtccaagcgaccaccagagatctctctcgcggggcggccaggtcctccccatcccgcggccaccacccacctccgaatctgccttccccagaaccaccgcgacccctctttctttccttcttcctcctcctcctcgtgccgtctccaagctccctccagcttgcgaggcgaactataaatagcggcttgggagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctcctcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaatggggttcaagggatttgtggagggtggcatcgcgtccatcgtcgctgggtgctcgacgcacccgctcgatttgattaaggtgaggatgcagctgcagggagaggcgtcggcggcggcggcggcggtcgcgccggcgcaggctgcgctgcggccggcgctggcgttccacgcggggcaggccgtggcgatcccgcatgacgtgattgcgccgccgaggaagcccgggccgatagccgtcggcgcgcagatcctgcgggcggagggcgcggcggggctcttctccggcgtgtcggccaccatgctgcgccagacgctctactccaccacccggatggggctctacgacatactgaagaagaagtggacccaggagaacggcggcgtgctgccgctccaccgcaagatcgccgctgggctcatcgccggcggggtcggcgccgccgtggggaacccggccgacgtcgccatggtgcggatgcaggccgacgggcggctcccgctcgccgagcgccggaactaccgcagcgtcggggacgccatcggccggatggcgcgcgacgagggcgtccgcagcctgtggcgcgggtcgtcgctgacggtgaaccgcgccatgatcgtcacggcgtcgcagctggccacctacgaccaggccaaggaggccatcctggcgcgccgcggccccggcgccgacgggctgggcacgcacgtcgtggccagcttcgccgcggggctcgtcgccgccgcggcgtccaaccccgtggacgtggtgaagacgagggtgatgaacatgaaggtggcgcccggcgcgccgccgccctactccggcgccatcgactgcgcgctcaagacggtgcggtcggagggcgtcatggcgctgtacaaggggttcatccccaccgtgtcgcgccagggccccttcaccgtcgtgctcttcgtcacgctcgagcaggtgcgcaaggtcttcaacggcgtcgagttctaaaggccaccgccacgatgatgacgacgaacaatccacctctagtattacttctgctagtactacctctgctgctgatgctgctgctatgaataattactactacagcctggttgagagattgtaccttagcctgcctccccatggcatatgttccttctgttcctgcattcgaacgaatttggatggatttgatcaaaaacttcaatggaatccgcatttttatatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcg

SEQ ID NO: 5102 - DNA, 1813 bp, Triticum aestivum
gcacgaggcccgtccgtccacctacaaatagcgcctcctcctcccccccacagatcccgcacccacccagggcaagaagaagcaagcagcacgagcagcacatgtcacagagggccagcgtcccacactcctcctgcatagccttcgccctccattcccacctcctcgtgtcctccgagatgtgccccagctcctactgggaatagaatagcctcgcccaaatccgacacctttttggtttttgtttcctctcttctttaggttttctttctagatctttgcgggtctcgaattcgtccagggattgtaggaaggagggaaaagatgggcgtcaagggattcgtcgagggcggcatcgcctccatcgtcgccggctgctccacccacccgctcgacctcatcaaggtgcggatgcagctgcagggggagtcctccgcggcggcggcggcgccccagcccgcgctccgcccggcgctcgccttccaggccggggcgcacaccgtgacgctcccgcacgcgcccgcgccggtgcccaagcccggcccgattggcatctgcacgcagatcctgcgcgccgagggcgccgccgggctcttctccgggatctcggccaccatgctgcgccagacgctctactccaccacgcggatggggctctacgacatcctcaagaagcgctggacccaggagaacggcggcgtgctgccgctgcacctcaagatcgccgccggcctcatcgccggcggcgtcggcgccgccgtcggcaacccggccgacctggccatggtgcggatgcaggccgacggccgcctcccgctcgccgaccgccggaactaccgcagcgtgggcgacgccatcgcccggatgacgcgcgacgagggcgtgcgcagcctctggcgcggctccgcgctcaccgtcaaccgcgccatgatcgtcaccgcctcgcagctggccacctacgaccaggccaaggaggccatcctggcccgccgcggcccggccgccgacgggctgggcacgcacgtggccgccagcttcgccgcgggcatcgtggccgccgccgcgtccaaccccgtcgacgtggtcaagaccagggtgatgaacatgaaggtggcccccggcgcgcccccgccgtacgccggggccctggactgcgcgctcaagacggtgcggtcggagggcgtgatggcgctctacaaggggttcatccccacggtgtcgcgccaggggcccttcaccgtcgtgctcttcgtcaccctggagcaggtgcgcaaggttttcaaggacgccgagttctaatgcagtgcagaccaccgcgcggcaccatgaatccatgatgatgatgacgacaagaggccgccattgatgccgctgctgctaagaataactagtagtaccgctggagagattcctccagttcctgcctcccgttgtattcggatggatttgctcgattttgaatgaaattctcatttttaaatcttcggctatgaatgtcaactttgagaatcttccgctaggaattggcagcattgacaatgtaccaattactgaatagactattactggcatgctttcaattataagtatactaatttgagaattctgaaacggtagtatagtataagcaacagggatgtgctggcagtgcaagctggaggattgtttagcagtaagtaagatgtgctgacgactttgcccctcgacttattacaaaatagagtactccactgctgtaatacgtacaaggggagatctcttcctctctcgatcagctttaacaaggatattcttgatagttcctccacggctc

SEQ ID NO: 5103 - DNA, 1818 bp, Oryza sativa
aacacaagaaatttaaaaatgcggattccattgaagtttttgatcaaatccatccaaattcgttcgaatgcaggaacagaaggaacatatgccatggggaggcaggctaaggtacaatctctcaaccaggctgtagtagtaattattcatagcagcagcatcagcagcagaggtagtactagcagaagtaatactagaggtggattgttcgtcgtcatcatcgtggcggtggcctttagaactcgacgccgttgaagaccttgcgcacctgctcgagcgtgacgaagagcacgacggtgaaggggccctggcgcgacacggtggggatgaaccccttgtacagcgccatgacgccctccgaccgcaccgtcttgagcgcgcagtcgatggcgccggagtagggcggcggcgcgccgggcgccaccttcatgttcatcaccctcgtcttcaccacgtccacggggttggacgccgcggcggcgacgagccccgcggcgaagctggccacgacgtgcgtgcccagcccgtcggcgccggggccgcggcgcgccaggatggcctccttggcctggtcgtaggtggccagctgcgacgccgtgacgatcatggcgcggttcaccgtcagcgacgacccgcgccacaggctgcggacgccctcgtcgcgcgccatccggccgatggcgtccccgacgctgcggtagttccggcgctcggcgagcgggagccgcccgtcggcctgcatccgcaccatggcgacgtcggccgggttccccacggcggcgccgaccccgccggcgatgagcccagcggcgatcttgcggtggagcggcagcacgccgccgttctcctgggtccacttcttcttcagtatgtcgtagagccccatccgggtggtggagtagagcgtctggcgcagcatggtggccgacacgccggagaagagccccgccgcgccctccgcccgcaggatctgcgcgccgacggctatcggcccgggcttcctcggcggcgcaatcacgtcatgcgggatcgccacggcctgccccgcgtggaacgccagcgccggccgcagcgccgcctgcgccggcgcgaccgccgccgccgccgccgacgcctccccctgcagctgcatcctcaccttaatcaaatcgagcgggtgcgtcgagcacccagcgacgatggacgcgatgccaccctccacaaatcccttgaaccccattgctcctcctcttcacaaatcggacggaaagaaaccaaatcaaaaggaaagaagaccaaaattgcaagaaagctcaaaagaaaggagcaatcttttctattcctattgctgccaataggagctggggcacatctcactggagacgaggagatgggaatggagggcgaaggctatggaggaggagtgtgggacgctggccctctgtgacatatgctgctcgtgcgttcctctttcctggggcttggcttccgatgtgctgtttgtttgctgcgtcttggcagaggaagaggctcccaagccgctatttatagttcgcctcgcaagctggagggagcttggagacggcacgaggaggaggaggaagaaggaaagaaagaggggtcgcggtggttctggggaaggcagattcggaggtgggtggtggccgcgggatggggaggacctggccgccccgcgagagagatctctggtggtcgcttggacttgacgcggagaggaggatgagaaaaggggaagggggggcgagtatgacggcgcgtgggcggacagggctcttgttgggtttgccctaattattccgtggtttggacgcgtcgtgg

SEQ ID NO: 5104 - DNA, 1373 bp, Secale cereale
gactagagaagcaagcacgagcagcacatgtcacaaagggccagcgtcccacactcctcctgcatagccttcgccctccattcccacctcctcgtgtcctctgagatgtgccccagctcctactgggaataaaatagcctcccccgcccaaatccgacgcctttttcgttttttcctctcttcttttagattttgtttctagatctttgggggcctcgaattcgtccgtccgcgaggagcaagatgggcgtcaaggggttcgtcgagggcggcatcgcctccatcgtcgccggctgctccacccacccgctcgacctcatcaaggtccggatgcagctgcagggggagtcgtccgcggcggcggcggccgtcccgcagccggccctccgcccggcgctcgccttccagaccggggcgcacaccgtgacgctcccgcacgcgccgacgccggtgcccaagcccggcccgatcggcatctgcacgcagatcctgcgcgccgagggcgccgccgggctcttctccgggatctcggccaccatgctgcgccagacgctctactccaccacgcggatgggcctctacgacatcctcaagaagcgctggacccaggagaacggcggcgtgctgccgctgcaccgcaagatcgccgccggcctcatcgccggcggcgtcggcgcggccgtcggcaacccggccgacctggccatggtgcggatgcaggccgacggccgcctcccgctggccgaccgcaggaactaccgcagcgtgggcgacgccatcgcccggatgacgcgcgacgagggcgtgcgcagcctctggcgcggctccgcgctcacggtcaaccgcgccatgatcgtcaccgcgtcgcagctggcgacctacgaccaggccaaggaggccatcctggcacgccgcggcccggccgccgacgggctgggcacgcacgtggccgccagcttcgccgcgggcatcgtggccgcggccgcgtccaaccccgtcgacgtggtcaagaccagagtgatgaacatgaaggttgcgccgggggcgccgccgccgtacgccggggccctggactgcgcgctcaagacggtgcggtcggagggcgtgatggcgctctacaaggggttcatccccaccgtgtcgcgccaggggcccttcaccgtggtgctcttcgtcaccctggagcaggtgcgcaaggtgttcaaggacgtcgagttctaatgcagacggcgcggcaccatggatccatgatgatgacgacaagaagctgctcattgatgccgctgctgctaagaataactagtagtaccgccggagagatttctccagttcctgcctcccattgtatttggatgaatttgatcgattttgaa

SEQ ID NO: 5105 - DNA, 1507 bp, Secale cereale
aagcaagcacgagcagcacatgtcacagagggccagcgtcccacactcctcctgcatagccttcgccctccattcccacctcctcgtgtcctctgagatgtgccccagctcctactgggaatagaaccgcccaaatccgacgccttttccttttttcctctcttcttttttaaattttgtttctagatcttgggggtctcgccccgaattcgtccgtctgcgaggaggaagggaagatgggcgtcaagggattcgtcgagggcggcatcgcctccatcgtcgccggctgctccacccacccgctcgacctcatcaaggtccggatgcagctgcagggggagtcgtccgcggcggcggcggccgtcccgcagccggccctccgcccggcgctcgccttccagaccggggcgcacaccgtgacgctcccgcacgcgccgacgccggtgcccaagcccggcccgatcggcatctgcacgcagatcctgcgcgctgagggcgccgccgggctcttctccgggatctcggccaccatgctgcgccagacgctctactccaccacgcggatggggctctacgacatcctcaagaaacgctggacccaggagaacggcggggtgctgccgctgcaccgcaagatcgccgccggcctcatcgccggcggcgtcggcgcggccgtcggcaacccggccgacctggccatggtgcggatgcaggccgacggccgcctcccgctggccgaccgcaggaactaccgcagcgtgggcgacgccattgcccggatgacgcgcgacgagggcgtgcgcagcctctggcgcggctcggcgctcacggtcaaccgcgccatgattgtcaccgcgtcgcagctggcgacctacgaccaggccaaggaggccatcctggcacgccgcggcccggccgccgacgggctgggcacgcacgtggccgccagcttcgccgcgggcatcgtggccgcggccgcgtccaaccccgtcgacgtggtcaagaccagagtgatgaacatgaaggttgcgccgggggcgccgccgccgtacgccggggccctggactgcgcgctcaagacggtgcggtcggagggcgtgatggcgctctacaaggggttcatccccacggtgtcgcgccaggggcccttcaccgtggtgctcttcgtcaccctggagcaggtgcgcaaggtgttcaaggacgtcgagttctaatgcagacggcgcggcaccatggatccatgatgatgacgacaagaagaagctgctcattgatgccgctgctgctaagaataactagtagtaccgccggagagatttctccagttcctgcctcccattgtatttggatgaatttgatcgattttgaatgaaattctcatttttaaatcttgggctgtgattgtcaactttgagaatcttctgctgtgaattgtcagcattgacaatataccaattaccgaatagactattactggcatgctttcagagtgtgctaaatttaaaag

SEQ ID NO: 5106 - DNA, 1464 bp, Secale cereale
agcacgagcagcacatgtcacagagggccagcgtcccacactcctcctgcatagccttcgccctccattcccacctcctcgtgtcctctgagatgtgccccagctcctactgggaatagaaccgcccaaatccgacgcctttttccttttttcctctcttcttctttagattttgtttctagatctttgggggcctcgaattcgtccgtccgcgaggagcaagatgggcgtcaaggggttcgtcgagggcggcatcgcctccatcgtcgccggctgctccacccacccgctcgacctcatcaaggtccggatgcagctgcagggggagtcgtccgccgcggcggcggccgtcccccagccggccctccgcccggcgctcgccttccagaccggggcgcacacggtgacgctcccgcacgcgccgacgccggtgcccaagcccgggccgatcggcatctgcacgcagatcctgcgcgccgagggcgccgccgggctcttctccgggatctcggccaccatgctgcgccagacgctctactccaccacgcggatggggctctacgacatcctcaagaagcgctggacccaggagaacggcggggtgctgccgctgcaccgcaagatcgccgccggcctcatcgccggcggcgtcggcgcggccgtcggcaacccggccgacctggccatggtgcggatgcaggccgacggccgcctcccgctggccgaccgcaggaactaccgcagcgtgggcgacgccatcgcccggatgacgcgcgacgagggcgtgcgcagcctctggcgcggctccgcgctcacggtcaaccgcgccatgattgtcaccgcgtcgcagctggcgacctacgaccaggccaaggaggccatcctggcacgccgcggcccggccgccgacgggctgggcacgcacgtggccgccagcttcgccgcgggcatcgtggccgcggccgcgtccaaccccgtcgacgtggtcaagaccagagtgatgaacatgaaggtggcgccgggggcgccgccgccgtacgccggggccctggactgcgcgctcaagacggtgcggtcggagggcgtgatggcgctctacaaggggttcatccccaccgtgtcgcgccaggggcccttcaccgtggtgctcttcgtcaccctggagcaggtgcgcaaggtgttcaaggacgtcgagttctgatgcagtgcggaccaccgcacggcgcggcaccatggatccatgatgatgacgacaagaagctgctcattgatgccgctgctgctaagaataactagtagtaccgccggagagatttctccagttcctgcctcccattgtatttggatgaatttgatcgattttgaatgaaattcttaaattttaaaaaaaaaaaaaagaaaaaaaactaaaaaaaaagaagaaactaagaaccaaacgaacgaacaaccaagggaagtaaggag

SEQ ID NO: 5107 - DNA, 1606 bp, Triticum aestivum
tccaccggctggcggccgtctacccatgggggggggggctccaggaatcggcacgaggcagcagcacgagcagcacatgtcacaaagggccagcgtcccacactcctcctgcatagccttcgccctccattcccacctcctcgtgtcctctgagatgtgccccagctcctactgggaatagaatagcctcgcccaaatccgacaccttttttttgtttttgtttcctctcttctttagattttgtttctagatctttgggggtctcgaattcgtccgtctgcgagggggaagatgggcgtcaagggattcgtcgagggcggcatcgcctccatcgtcgccggctgctccacccacccgctcgacctcatcaaggtccggatgcagctgcagggggagtcgtccgcggcggcggcggccgtcccgcagcccgcgctccgcccggcgctcgccttccaggccggggcgcacaccgtgacgctcccgcacgcgccgacgccggtgccgaagcccggccccataggcatctgcacgcagatcctgcgcgccgagggcgccgccggcctcttctccgggatctcggccaccatgctgcgccagacgctctactccaccacgcggatggggctctacgacatcctcaagaaacgctggacccaggagaacgccggcgtgctgccgctgcaccgcaagatcgccgccggcctcatcgccggcggcgtcggcgcggccgtcggcaacccggccgacctggccatggtgcggatgcaggccgacggccgcctcccgctggccgaccgccggaactaccgcagcgtgggcgacgccatcgcccggatgacgcgggacgagggcgtgcgcagcctctggcgcggctcggcgctcacggtcaaccgcgccatgattgtcaccgcgtcgcagctggcgacctacgaccaggccaaggaggccatcctggcccgccgcggcccggccgccgacgggctgggcacgcacgtggccgccagcttcgccgcgggcatcgtggccgccgccgcgtccaaccccgtcgacgtggtcaaaaccagagtgatgaacatgaaggtggcgccgggcgcgcccccgccgtacgccggggccctggactgcgcgctcaagacggtgcggtcggagggcgtgatggcgctctacaaggggttcatccccacggtgtcgcgccaggggcccttcaccgtcgtgctcttcgtcaccctcgagcaggtgcgcaaggtcttcaaggacgtcgagttctaatgcagtgcagaccaccgcacggcgcggcgccatggatccatgatgatgacgacaagaagctgcccattgatgccgctgctgctaagaataactagtagtaccgctggagggatttctccagttcctgcctctcattttattcggatgaatttgatcgattttgaatgaaattctcatttttaaatcttcggctatgaatgtcaactttgagaatcttctgctaggaattgtcagcattgactatataccaattactgaatagactattactggcatgctttcaaattataaagtatactaatttgagtaaattctgaaaacggttagtatagtaat

SEQ ID NO: 5108 - DNA, 1581 bp, Triticum aestivum
gcacgaggcccgtccgtccacctacaaatagcgcctcctcctcccccccacagatcccgcacccacccagggcaagaagaagcaagcagcacgagcagcacatgtcacagagggccagcgtcccacactcctcctgcatagccttcgccctccattcccacctcctcgtgtcctccgagatgtgccccagctcctactgggaatagaatagcctcgcccaaatccgacacctttttggtttttgtttcctctcttctttaggttttgtttctagatctttgcgggtctcgaattcgtccagggattgtaggaaggagggaaaagatgggcgtcaagggattcgtcgagggcggcatcgcctccatcgtcgccggctgctccacccacccgctcgacctcatcaaggtgcggatgcagctgcagggggagtcctccgcggcggcggcggcgccccagcccgcgctccgcccggcgctcgccttccaggccggggcgcacaccgtgacgctcccgcacgcgcccgcgtcggtgcccaagcccggcccgattggcatctgcacgcagatcctgcgcgccgagggcgccgccgggctcttctccgggatctcggccaccatgctgcgccagacgctctactccaccacgcggatggggctctacgacatcctcaagaagcgctggacccaggagaacggcggcgtgctgccgctgcacctcaagatcgccgccggcctcatcgccggcggcgtcggcgccgccgtcggcaacccggccgacctggccatggtgcggatgcaggccgacggccgcctcccgctcgccgaccgccggaactaccgcagcgtcggcgacgccatcgcccggatgacgcgcgacgagggcgtgcgcagcctctggcgcggctccgcgctcaccgtcaaccgcgccatgatcgtcaccgcctcgcagctggccacctacgaccaggccaaggaggccatcctggcccgccgcggcccggccgccgacgggctgggcacgcacgtggccgccagcttcgccgcgggcatcgtggccgccgccgcgtccaaccccgtcgacgtggtcaagaccagggtgatgaacatgaaggtggcccccggcgcgcccccgccgtacgccggggccctggactgcgcgctcaagacggtgcggtcggagggcgtgatggcgctctacaaggggttcatccccacggtgtcgcgccaggggcccttcaccgtggtgctcttcgtcaccctggagcaggtgcgcaaggtcttcaaggacgccgagttctaatgcagtgcagaccaccgcgcggcaccatgaatccatgagatgatgacgacaagaagccgccattgatgccgctgctgctaagaataactagtagtaccgctggagagattcctccagttcctgcctcccattgtattcggatgaatttgatcgattttgaatgaaattctcatttttaaatcttcggctatgaatgtcaactttgagaatcttccgctaggaattggcagcattgacaatgtaccaattactgaatagactattactggcatgctttcaatt

SEQ ID NO: 5109 - DNA, 2021 bp, Brachypodium distachyon
agcgtcgagggcggccagggccaggtctcctctttccttcttcacccaaccccagcctgcctgcctgccgcgaatctgccttccccagtcggaccgcgagccggtccgccccgaaggcgaagccacctctcctctttccttgctctccaccgtccgcgtctctccccggccgggccacctataaatagcgcctccgctccccaaggcctcctcccacacatcccgcacccgaggaaagaggaagcacgagcagcatatgtcacagagggccagcgtcccacactcctcctgcatagccttcgccctccattcccatctcctggtttccagtgagatgtgccccagctcctactgggaatagcctcgcctcgcctgaatccaggccctccccctcctcctccgatttttttcccctttaatttgagattttcttcttcttcttcttcttcgagtttttcgtttttctagatctttgggggtctcgattccgtcccgtcggagaggtactaggacaaaggggggatttttgatttttttagaggaaggagatggggatgaagggatttgttgagggcggcatcgcgtccatcgtggccggctgctccacccacccactggaccttatcaaggtccggatgcagctgcaaggggagtcggcggcggcggctgccgtgccgcaggctgccgcgctgcgcccggccctcgcgttccaagccggcggcgcgcacacggtgtctctcccgcacgtgcacgacgtcgcgccgccgccggtcaggaagcccgggccgattgccatcggcacgcagatcctgcgcgctgagggcgccgcggggctcttctcgggggtgtcggccaccgtgctgcgccagacgctctactccaccacgcggatggggctctacgacatcctcaagaagcggtggagccaggagaacggcggggtcctgccgctgcaccgcaagatcgccgcggggctcatcgcgggcggcatcggcgccgcggtcggcaaccctgccgacctggccatggtgcggatgcaggccgacgggcgtctccccctcgccgagcgccgcaactaccgcagcgtgggcgacgccatcggcaggatggcgcgcgacgaaggcgtgcgcagcctgtggcgcgggtcggcgctcacggtgaaccgcgccatgatcgtcacggcgtctcagctggccacgtacgaccaggccaaggaggccatcctggcgcgccggggcccggcagccgacgggctcgccacgcacgtggccgccagcttcgcggcggggatcgtggcggcggccgcgtccaacccggtcgatgtggtgaagacgagggtgatgaacatgaaggtggcgcccggcgcgccgccgccgtacgcgggcgccatggactgcgcgctcaagacggtgcggtccgagggcgtcatggcgctgtacaaggggttcatccccaccgtgtctcgccagggccccttcaccgtcgtgctcttcgtcacgctcgagcaggtgcgcaaggtcttcaaggacgttgagttctgagaacaggccaccacgatgatgacgaaaagaagcttatttgctgctgctatgaataaatttgttactgctggagcctcctcctcgtagcttggatggagattataccttgcctgttgcgtcccctcgtcagacttgtttcctctgttcttgcatccccattgtatttggatggatttgatatcgaatctcaatgaaattctagttttaaaatcttatgtcccatatgacagcctccgcagaggttggaacttgaacatggcttcctttgttacagaacagactattgggaactgggatgttttcaacctagtagcactagttttagactccaaatggaagtgaagaataaaattgacatccatgaacccaccccggttccaacctgctcgatactgggcacggcacatcataggatcccgcgtatctgaatattcagctagaagcaacgtgtctgacgagcggcaaaatctttagcattgg

SEQ ID NO: 5110 - DNA, 1565 bp, Brachypodium distachyon
agcgcctccgctccccaaggcctcctcccacacatcccgcacccgaggaaagaggaagcacgagcagcatatgtcacagagggccagcgtcccacactcctcctgcatagccttcgccctccattcccatctcctggtttccagtgagatgtgccccagctcctactgggaatagcctcgcctcgcctgaatccaggccctccccctcctcctccgatttttttcccctttaatttgagattttcttcttcttcttcttcttcgagtttttcgtttttctagatctttgggggtctcgattccgtcccgtcggagaggtactaggacaaaggggggatttttgatttttttagaggaaggagatggggatgaagggatttgttgagggcggcatcgcgtccatcgtggccggctgctccacccacccactggaccttatcaaggtccggatgcagctgcaaggggagtcggcggcggcggctgccgtgccgcaggctgccgcgctgcgcccggccctcgcgttccaagccggcggcgcgcacacggtgtctctcccgcacgtgcacgacgtcgcgccgccgccggtcaggaagcccgggccgattgccatcggcacgcagatcctgcgcgctgagggcgccgcggggctcttctcgggggtgtcggccaccgtgctgcgccagacgctctactccaccacgcggatggggctctacgacatcctcaagaagcggtggagccaggagaacggcggggtcctgccgctgcaccgcaagatcgccgcggggctcatcgcgggcggcatcggcgccgcggtcggcaaccctgccgacctggccatggtgcggatgcaggccgacgggcgtctccccctcgccgagcgccgcaactaccgcagcgtgggcgacgccatcggcaggatggcgcgcgacgaaggcgtgcgcagcctgtggcgcgggtcggcgctcacggtgaaccgcgccatgatcgtcacggcgtctcagctggccacgtacgaccaggccaaggaggccatcctggcgcgccggggcccggcagccgacgggctcgccacgcacgtggccgccagcttcgcggcggggatcgtggcggcggccgcgtccaacccggtcgatgtggtgaagacgagggtgatgaacatgaaggtggcgcccggcgcgccgccgccgtacgcgggcgccatggactgcgcgctcaagacggtgcggtccgagggcgtcatggcgctgtacaaggggttcatccccaccgtgtctcgccagggccccttcaccgtcgtgctcttcgtcacgctcgagcaggtgcgcaaggtcttcaaggacgttgagttctgagaacaggccaccacgatgatgacgaaaagaagcttatttgctgctgctatgaataaatttgttactgctggagcctcctcctcgtagcttggatggagattataccttgcctgttgcgtcccctcgtcagacttgtttcctctgttcttgcatccccattgtatttggatggatttgatatcgaatctcaatgaaattctagttttaaaa

SEQ ID NO: 5111 - DNA, 1547 bp, Hordeum vulgare
gggcaagcaagcaagcaagaggaagcagcagcagcagcgagcacgagcagcacatgtcacagagggccagcgtcccacactcctcctccatagccttcgccctccattcccacctcctcctgtcctccgagatgtgccccagctcctactgggaatagaattaggaggcccaaatccgacaccttttcctcccaaggttcctcctttcttctcccggatctatatacgtagttcggttctccaacccatccatccatccatccatccgctagcgggaagaggatatgggcgtcaagggattcgtcgaggggggcatcgcctccatcgtcgccggctgctccacccacccgctcgacctcatcaaggtccggatgcagctgcagggggagtcgtcggcggcggccgtgccccagcccgcgctgcgcccggcgctcgccttccaggccggggcgcagacggtggcgctcccgcacgcgccgacgccggcgtcggtggccaagcccggcccgattggcatctgcacgcagatcctgcgcgccgagggcgccgccgggctcttctccgggatctcggccaccatgctgcgccagacgctctactccaccacgcggatgggcctctacgacatcctcaagaagcgctggacccaggagaacgccggcgtgctgccgctgcacctcaagatcgccgccggcctcatcgccggcggcgtcggcgccgccgtcggcaacccggccgacctggccatggtgcggatgcaggccgacggccgcctcccgctcgccgaccgccgcaactaccgcagcgtcggcgacgccatcgcccggatgacgcgcgacgagggcgtgcgcagcctctggcgcggctcggcgctcacggtcaaccgcgccatgattgtcaccgcctcgcagctggccacctacgaccaggccaaggaggccatcctggcccgccgcggtccgggcgccgacggcctgggcacgcacgtggccgccagcttcgccgcgggcatcgtggccgccgccgcgtccaaccccgtcgacgtggtcaagaccagagtgatgaacatgaaggtggcgccgggggctcccccgccgtacgccggggccctggactgcgcgctcaagacggtgcggtcggagggcgtcatggcgctctacaagggcttcatccccaccgtgtcgcgccaggggcccttcaccgtcgtgctcttcgtcaccctcgagcaggtgcgcaaggtcttcaaggacgttgagttctaatgcagacatgcagtgcagaccaccgcgcggcaccatggatccatgatgatgacgacaagaagctgcccattgatgccgctgctgctaagaataactagtagtagtagtactactggcgatttggagagatttctccagttcctgcgccccgttgattgtagtaattcggatggatttgatcgattttgaatgcaatttatatttttaaatcttgggctatgaatgtcaactttgagaatcttccgctaagaattgtcagcattgacaatgtaccagttactgaat

SEQ ID NO: 5112 - DNA, 1612 bp, Hordeum vulgare
accccaaccagggcaagcaagcaagcaagaggaagcagcagcagcagcgagcacgagcagcacatgtcacagagggccagcgtcccacactcctcctccatagccttcgccctccattcccacctcctcctgtcctccgagatgtgccccagctcctactgggaatagaattaggaggcccaaatccgacaccttttcctcccaaggttcctcctttcttctcccggatctatatacgtagttcggttctccaacccatccatccatccatccatccgctagcgggaagaggatatgggcgtcaagggattcgtcgaggggggcatcgcctccatcgtcgccggctgctccacccacccgctcgacctcatcaaggtccggatgcagctgcagggggagtcgtcggcggcggccgtgccccagcccgcgctgcgcccggcgctcgccttccaggccggggcgcagacggtggcgctcccgcacgcgccgacgccggcgtcggtggccaagcccggcccgattggcatctgcacgcagatcctgcgcgccgagggcgccgccgggctcttctccgggatctcggccaccatgctgcgccagacgctctactccaccacgcggatgggcctctacgacatcctcaagaagcgctggacccaggagaacgccggcgtgctgccgctgcacctcaagatcgccgccggcctcatcgccggcggcgtcggcgccgccgtcggcaacccggccgacctggccatggtgcggatgcaggccgacggccgcctcccgctcgccgaccgccgcaactaccgcagcgtcggcgacgccatcgcccggatgacgcgcgacgagggcgtgcgcagcctctggcgcggctcggcgctcacggtcaaccgcgccatgattgtcaccgcctcgcagctggccacctacgaccaggccaaggaggccatcctggcccgccgcggtccgggcgccgacggcctgggcacgcacgtggccgccagcttcgccgcgggcatcgtggccgccgccgcgtccaaccccgtcgacgtggtcaagaccagagtgatgaacatgaaggtggcgccgggggctcccccgccgtacgccggggccctggactgcgcgctcaagacggtgcggtcggagggcgtcatggcgctctacaagggcttcatccccaccgtgtcgcgccaggggcccttcaccgtcgtgctcttcgtcaccctcgagcaggtgcgcaaggtcttcaaggacgttgagttctaatgcagacatgcagtgcagaccaccgcgcggcaccatggatccatgatgatgacgacaagaagctgcccattgatgccgctgctgctaagaataactagtagtagtagtactactggcgatttggagagatttctccagttcctgcgccccgttgattgtagtaattcggatggatttgatcgattttgaatgcaatttatatttttaaatcttgggctatgaatgtcaactttgagaatcttccgctaagaattgtcagcattgacaatgtaccagttactgaattgaatagactattattttttctgaacttgaatagactattattggcatgctttca

SEQ ID NO: 5113 - DNA, 5690 bp, Sorghum bicolor
gtgctggttggttccgtcgcgtcgcgtcgcgactcgccccggccccctcccctcccctcccctcccctcctcagatcagatctctcccccgaccccgactggaggcaccgcgccgcgcgacgccgcctccgcgctctcccccttccgctccaggctagccgggagagatctcggcaccgccgcccgtcgccatggcggcggccaacgcccccatcgccatgcgcgaggcgctcacgctcaccagcctgggcatcgcgccgcagttcgtcaccttcacccacgtcaccatggagtcggagaagtacatctgcgtccgcgagacctccccgcagaacagcgtcgtcatcatcgacatggccatgcccatgcagccgctccgccgccccatcaccgccgactccgccctcatgaaccccaacaccaggatcctcgccctcaaagcccaaatacctggaacaacacaggatcaccttcaaatatttaacattgaggccaagactaagatcaagtctcatcagatgcccgagcaggttgtattctggaaatggatcacacccaagttgttgggtttagtaacacagacatctgtttaccattggtcaattgaaggtgattctgagcccaccaagatgtttgataggacagctaatttggcaaacaaccagattatcaactacagatgtgacccagcggagaagtggcttgtgcttattggcattgcacctggtgccccggagaggccacaactggtgaagggaaatatgcaacttttttctgtcgatcaacagcgtagccaggcccttgaagcccatgcagcgtcttttgcaacatttaaggttgttggtaatgagaacccatcaacccttatttgtttcgcctcaaagacaactaatgctggacagatcacttcaaaattgcatgttattgaactgggtgcacagccagggaaacctggcttttctaagaaacaagccgacctcttcttcccaccagatttccaggatgattttcctgtagctatgcaggtttcacaaaagtatgggcttatctatgtaattacaaagcttggccttttgtttgtatatgacttggaaactgctgcggcagtttacagaaatagaatcagtccagaccctatattcttgacggcagaatcttcctctactggtggattttatgctatcaacagaagagggcaggttttacatgccacagttaatgacgcaactgttgtaccttttgtcagtggccaattaaacaaccttgagcttgctgtgaatctggccaagagagctaaccttcctggtgctgagaacttggttgtgcaaagattccaggaactgtttgcacagacaaaatacaaggaagcagctgagctggctgcggaatctccccagggtctcctgaggacgcctgagaccgtggcgaaatttcagagtgttcctgtgcaagctgggcaaacgcccccactcttgcagtactttggcacattgctaactcgagggaagctcaatgcctttgagtctcttgagctatctcgacttgtcgtcaatcagaacaaaaagaatcttctggaaaattggttggcagaagacaagctagagtgtagtgaagaactaggagatcttgtcaagactgtggacaatgatcttgcactgaaaatatacataaaggctagggcaacccctaaagttgttgctgcttttgctgaaaggagggagtttgacaagatactgatatactcaaagcaggtcgggtacacgccagattatctcttcctcctccagaccatcttgcgtacagatccacagggagctgtgaactttgctctcatgatgtcacaaatggagggaggctgcccagtagattataatacaataactgatcttttccttcagaggaatatgatacgagaggcaacagcttttctgttggatgttctgaaaccaaacttgccagagcatgcttttcttcaaaccaaggttttggagataaacttagtgacttacccgaatgttgctgatgccattcttgctaatggtatgttcagtcattacgaccgccctcgtattgctcagctgtgtgaaaaggctggtctgtacttgcgagctctccagcattactcagagttgcctgatatcaagcgtgtcattgtaaatacccatgccattgaaccacaggcacttgttgagttctttggtaccttgtcaagggagtgggctttggagtgcatgaaagaccttctactggttaatctgaggggaaatcttcagattgttgtgcaggctgcgaaagaatactctgagcagctaggggttgacgcttgcatcaaattatttgaacaattcaaatcttatgagggcctttactttttcttgggatcctatctgagctccagtgaggacccagatatccatttcaagtacatagaagcagctgcaaggactggacagatcaaagaagttgaacgtgtaactagagagtcaaacttctatgatgccgagaagacaaagaactttttgatggaagcaaaactacctgatgctcgtccactgattaatgtttgtgaccgctttggttttgtgccagatctcactcactatctgtacaccaacaacatgcttcgatatatcgaaggctatgttcagaaggtgaatcctgggaatgctccattggtagtggggcaactacttgatgatgagtgccctgaagattttatcaagggtttgattctctctgttcgttctctccttcctgttgagcctctggttgatgaatgtgagaagaggaaccgcctacgtttgctcactcaattcttggagcacttagtgagtgaaggtagccaagatgtgcatgtccataatgctcttgggaaaatcatcattgacagcaacaacaatcctgagcatttccttactaccaacccattttacgattctcgtgttgtgggcaaatattgtgaaaagcgggatcctacacttgccgttgttgcttacagacgtgggcagtgtgatgatgaacttattaatgtcactaacaaaaactcattattcaagctgcaagctaggtatgtggttgagagaatggatggtgatctgtgggataaagttcttcagcctgagaatgaatatagaaggcaactcattgaccaagtggtttcgactgcattacctgagagcaagagccctgagcaagtgtctgctgctgttaaggctttcatgactgctgacctgccacatgaactgattgagcttcttgaaaagattgttcttcagaattctgctttcagtggaaatttcaatctgcagaacctgctcatcttgactgctatcaaggcagatccatccagagtcatggactatgtcaacagactcgataactttgatgggcctgctgttggagaagttgctgttgaagcacaactgtatgaggaggcttttgctatattcaagaagttcaacttaaatgtgcaggctgtcaatgttctcttggacaacatccggagcatagaaagagccgaggaatttgcttttcgtgttgaagaagatgctgtttggagccaggttgccaaagcccagttacgtgaaggtctggtcagtgaagcaattgagtccttcattcgcgcagatgatgctgcacacttccttgatgtcatccgtgctgctgaagaagctaatgtgtacgatgatttagtgaagtaccttctgatggtaaggcaaaaagcacgggaacccaaagtcgatggagaactcatctttgcatatgctaagattgacaggctcagtgacattgaggagttcattcttatgccaaatgttgccaaccttcaaaatgtcggtgaccgtctgtatgatgaagaactatatgaagctgcaaagatcatctatgctttcatctcgaactgggctaagctggctgttaccctggttaagctgaagcagttccaaggtgctgtggatgctgctcgcaaggctaacagtgccaaaacatggaaggaggtctgctttgcttgtgttgacgctgaggagttccgtcttgcacaaatatgtggtctcaatattattgttcaggttgatgacttggaagaagtcagtgaatactaccagaatagaggatgcttcaatgaacttattgctctcatggagagtggtcttggacttgaacgtgcacacatgggcatcttcacagaattgggagttctatatgctagataccgccctgagaagcttatggagcacatcaaacttttctccacccgtcttaatattcctaagcttattcgagcttgtgatgaacagcagcactggaaagaacttacctacctgtacatacagtatgatgaatttgacaatgctgccaccaccattatgaaccactctccagatgcatgggatcatatgcagttcaaggatgtttgcgttaaagttgcaaatgttgagctatattacaaggcagttcacttctatttgcaagagcatcctgatctcattaatgatatgctaaatgtgcttgcacttcggttagatcataccagagttgtagacataatgcgcaaggctggccaattgcatcttgtgaaaccatatatggttgcagttcagagtaacaatgtctctgctgtgaatgaagccttgaatgagctttacgttgaagaggaggactatgagagactccgggaatcagttgatatgcacgacaactttgaccagataggtcttgcccagaagcttgagaagcatgaattgcttgaaatgaggaggattgctgcctacatttacaagaaggctggcaggtggaagcaatccattgctctatcaaagaaagacaacatgtacaaggattgcatggagacatgctcacaatctggcgaccgtgaactgtcagaggacttgcttgtctatttcattgagcagggtaagaaagaatgctttgcatcctgcctcttcatttgctacgacttgatccggccagatgtcgctcttgagcttgcatggatgaacaacatgttggactttgccttcccatacctgttgcagttcatccgtgagtacactagcaaggtggatgatttagtgaaggacaaaattgagtcgcagaaggaagaaagagccaaagagaaggaggagaaagatcttgtggctcagcagaacatgtatgcccaactgcttcctcttgctttgcctgctccgccaatgcctggcatgggtggtccacctccgatgggtgggatgggcatgcctccaatgggtggaatgggtatgccgccgatgggccctggtccgatgccagcattcgggatgccaccaatgggaagctactgagagttgttttgcagagagcttagatgatctgaattgttccaatgtaagcaaaagtggaacttctttggaattgtatgtagatgattacagtttgcaatcaatattctttatggcaccaggaaatttttggcgagtgaaatcttagccagagtttgagatttgtaacctgttataccgtacgatgggataggatgaggatggttgagcaagaggtaccatttgtatagtgtgataatctttgtagacacattttggttgtattaatacttgaaggacaaacaaatgtatgtcacgacctgttgatttctattgttaggccttgtttagttcaccccaaaaaccaaagatattgtggtacatgcatggagc

SEQ ID NO: 5114 - DNA, 5741 bp, Sorghum bicolor
ttcccacgcaccgctgtgctggttggttccgtcgcgtcgcgtcgcgactcgccccggccccctcccctcccctcccctcccctcctcagatcagatctctcccccgaccccgactggaggcaccgcgccgcgcgacgccgcctccgcgctctcccccttccgctccaggctagccgggagagatctcggcaccgccgcccgtcgccatggcggcggccaacgcccccatcgccatgcgcgaggcgctcacgctcaccagcctgggcatcgcgccgcagttcgtcaccttcacccacgtcaccatggagtcggagaagtacatctgcgtccgcgagacctccccgcagaacagcgtcgtcatcatcgacatggccatgcccatgcagccgctccgccgccccatcaccgccgactccgccctcatgaaccccaacaccaggatcctcgccctcaaagcccaaatacctggaacaacacaggatcaccttcaaatatttaacattgaggccaagactaagatcaagtctcatcagatgcccgagcaggttgtattctggaaatggatcacacccaagttgttgggtttagtaacacagacatctgtttaccattggtcaattgaaggtgattctgagcccaccaagatgtttgataggacagctaatttggcaaacaaccagattatcaactacagatgtgacccagcggagaagtggcttgtgcttattggcattgcacctggtgccccggagaggccacaactggtgaagggaaatatgcaacttttttctgtcgatcaacagcgtagccaggcccttgaagcccatgcagcgtcttttgcaacatttaaggttgttggtaatgagaacccatcaacccttatttgtttcgcctcaaagacaactaatgctggacagatcacttcaaaattgcatgttattgaactgggtgcacagccagggaaacctggcttttctaagaaacaagccgacctcttcttcccaccagatttccaggatgattttcctgtagctatgcaggtttcacaaaagtatgggcttatctatgtaattacaaagcttggccttttgtttgtatatgacttggaaactgctgcggcagtttacagaaatagaatcagtccagaccctatattcttgacggcagaatcttcctctactggtggattttatgctatcaacagaagagggcaggttttacatgccacagttaatgacgcaactgttgtaccttttgtcagtggccaattaaacaaccttgagcttgctgtgaatctggccaagagagctaaccttcctggtgctgagaacttggttgtgcaaagattccaggaactgtttgcacagacaaaatacaaggaagcagctgagctggctgcggaatctccccagggtctcctgaggacgcctgagaccgtggcgaaatttcagagtgttcctgtgcaagctgggcaaacgcccccactcttgcagtactttggcacattgctaactcgagggaagctcaatgcctttgagtctcttgagctatctcgacttgtcgtcaatcagaacaaaaagaatcttctggaaaattggttggcagaagacaagctagagtgtagtgaagaactaggagatcttgtcaagactgtggacaatgatcttgcactgaaaatatacataaaggctagggcaacccctaaagttgttgctgcttttgctgaaaggagggagtttgacaagatactgatatactcaaagcaggtcgggtacacgccagattatctcttcctcctccagaccatcttgcgtacagatccacagggagctgtgaactttgctctcatgatgtcacaaatggagggaggctgcccagtagattataatacaataactgatcttttccttcagaggaatatgatacgagaggcaacagcttttctgttggatgttctgaaaccaaacttgccagagcatgcttttcttcaaaccaaggttttggagataaacttagtgacttacccgaatgttgctgatgccattcttgctaatggtatgttcagtcattacgaccgccctcgtattgctcagctgtgtgaaaaggctggtctgtacttgcgagctctccagcattactcagagttgcctgatatcaagcgtgtcattgtaaatacccatgccattgaaccacaggcacttgttgagttctttggtaccttgtcaagggagtgggctttggagtgcatgaaagaccttctactggttaatctgaggggaaatcttcagattgttgtgcaggctgcgaaagaatactctgagcagctaggggttgacgcttgcatcaaattatttgaacaattcaaatcttatgagggcctttactttttcttgggatcctatctgagctccagtgaggacccagatatccatttcaagtacatagaagcagctgcaaggactggacagatcaaagaagttgaacgtgtaactagagagtcaaacttctatgatgccgagaagacaaagaactttttgatggaagcaaaactacctgatgctcgtccactgattaatgtttgtgaccgctttggttttgtgccagatctcactcactatctgtacaccaacaacatgcttcgatatatcgaaggctatgttcagaaggtgaatcctgggaatgctccattggtagtggggcaactacttgatgatgagtgccctgaagattttatcaagggtttgattctctctgttcgttctctccttcctgttgagcctctggttgatgaatgtgagaagaggaaccgcctacgtttgctcactcaattcttggagcacttagtgagtgaaggtagccaagatgtgcatgtccataatgctcttgggaaaatcatcattgacagcaacaacaatcctgagcatttccttactaccaacccattttacgattctcgtgttgtgggcaaatattgtgaaaagcgggatcctacacttgccgttgttgcttacagacgtgggcagtgtgatgatgaacttattaatgtcactaacaaaaactcattattcaagctgcaagctaggtatgtggttgagagaatggatggtgatctgtgggataaagttcttcagcctgagaatgaatatagaaggcaactcattgaccaagtggtttcgactgcattacctgagagcaagagccctgagcaagtgtctgctgctgttaaggctttcatgactgctgacctgccacatgaactgattgagcttcttgaaaagattgttcttcagaattctgctttcagtggaaatttcaatctgcagaacctgctcatcttgactgctatcaaggcagatccatccagagtcatggactatgtcaacagactcgataactttgatgggcctgctgttggagaagttgctgttgaagcacaactgtatgaggaggcttttgctatattcaagaagttcaacttaaatgtgcaggctgtcaatgttctcttggacaacatccggagcatagaaagagccgaggaatttgcttttcgtgttgaagaagatgctgtttggagccaggttgccaaagcccagttacgtgaaggtctggtcagtgaagcaattgagtccttcattcgcgcagatgatgctgcacacttccttgatgtcatccgtgctgctgaagaagctaatgtgtacgatgatttagtgaagtaccttctgatggtaaggcaaaaagcacgggaacccaaagtcgatggagaactcatctttgcatatgctaagattgacaggctcagtgacattgaggagttcattcttatgccaaatgttgccaaccttcaaaatgtcggtgaccgtctgtatgatgaagaactatatgaagctgcaaagatcatctatgctttcatctcgaactgggctaagctggctgttaccctggttaagctgaagcagttccaaggtgctgtggatgctgctcgcaaggctaacagtgccaaaacatggaaggaggtctgctttgcttgtgttgacgctgaggagttccgtcttgcacaaatatgtggtctcaatattattgttcaggttgatgacttggaagaagtcagtgaatactaccagaatagaggatgcttcaatgaacttattgctctcatggagagtggtcttggacttgaacgtgcacacatgggcatcttcacagaattgggagttctatatgctagataccgccctgagaagcttatggagcacatcaaacttttctccacccgtcttaatattcctaagcttattcgagcttgtgatgaacagcagcactggaaagaacttacctacctgtacatacagtatgatgaatttgacaatgctgccaccaccattatgaaccactctccagatgcatgggatcatatgcagttcaaggatgtttgcgttaaagttgcaaatgttgagctatattacaaggcagttcacttctatttgcaagagcatcctgatctcattaatgatatgctaaatgtgcttgcacttcggttagatcataccagagttgtagacataatgcgcaaggctggccaattgcatcttgtgaaaccatatatggttgcagttcagagtaacaatgtctctgctgtgaatgaagccttgaatgagctttacgttgaagaggaggactatgagagactccgggaatcagttgatatgcacgacaactttgaccagataggtcttgcccagaagcttgagaagcatgaattgcttgaaatgaggaggattgctgcctacatttacaagaaggctggcaggtggaagcaatccattgctctatcaaagaaagacaacatgtacaaggattgcatggagacatgctcacaatctggcgaccgtgaactgtcagaggacttgcttgtctatttcattgagcagggtaagaaagaatgctttgcatcctgcctcttcatttgctacgacttgatccggccagatgtcgctcttgagcttgcatggatgaacaacatgttggactttgccttcccatacctgttgcagttcatccgtgagtacactagcaaggtggatgatttagtgaaggacaaaattgagtcgcagaaggaagaaagagccaaagagaaggaggagaaagatcttgtggctcagcagaacatgtatgcccaactgcttcctcttgctttgcctgctccgccaatgcctggcatgggtggtccacctccgatgggtgggatgggcatgcctccaatgggtggaatgggtatgccgccgatgggccctggtccgatgccagcattcgggatgccaccaatgggaagctactgagagttgttttgcagagagcttagatgatctgaattgttccaatgtaagcaaaagtggaacttctttggaattgtatgtagatgattacagtttgcaatcaatattctttatggcaccaggaaatttttggcgagtgaaatcttagccagagtttgagatttgtaacctgttataccgtacgatgggataggatgaggatggttgagcaagaggtaccatttgtatagtgtgataatctttgtagacacattttggttgtattaatacttgaaggacaaacaaatgtatgtcacgacctgttgatttctattgttaggccttgtttagttcaccccaaaaaccaaagatattgtggtacatgcatggagcattaaatatatataaaaacaaaaactaattgcacag

SEQ ID NO: 5115 - DNA, 5585 bp, Zea mays
cccggctccccgcggcccgcaccgctgtgttgtgctggttggttccgtcgcgtcgcttgcttagatcagatctctccttctctccccggatcccgactgcctccctcccccttccacctcaggctagccgagagagatctcggcaccgccgcccgttgccatggcggcggccaacgcccccatcgccatgcgcgaggcgctcacgctcacgagcctgggcatcgcgccgcagttcgtcaccttcacccacgtcaccatggagtcggagaagtacatctgcgtccgcgagacctccccgcagaacagcgtcgtcatcatcgacatggccatgcccatgcagccgctccgacggcccatcaccgccgactccgccctcatgaaccccaacaccaggatcctcgccctcaaagcccaaatacctggaacaacacaggatcacctccaaatattcaacatcgaggctaagactaaggtcaagtcccaccagatgccggagcaggttgtattctggaaatggatcactcccaaattgttgggtttagtgacacaaacatctgtttaccactggtcgattgaaggtgattctgagcccttgaagatgtttgataggacagctaatctggcaaacaatcagatcatcaactatcgatgtgacccagcggagaagtggcttgtacttattggaattgcacctggagccccagagaggccacaactggtgaagggaaatatgcaacttttttctgtcgatcaacagcgtagccaggcacttgaagcccacgcagcatcttttgcaacatttaaggttgttggtaatgagaatccatcaactcttatttgtttcgcctcaaagacaactaatgctggacagatcacttcaaagttgcatgttattgaactgggtgcacagccagggaaacctggtttttctaagaaacaagccgacctcttcttccccccagatttccaggatgattttcctgtagctatgcaggtttcacaaaagtatgggcttatctatgtaattactaagcttggccttttgtttgtatatgacttggaaactgccgcggcagtttacagaaatagaatcagtccagaccctatattcttgacggcggaatcttcctctactggtggattttatgccatcaacagaagagggcaggttttacatgccacagttaatgatgcaactgttgtaccttttgtcagtggccaattaaacaaccttgagcttgctgtgaatctggccaagagagctaaccttccaggcgctgagaacttggttgtgcaaagattccaggaactgtttgcacagacaaaatacaaggaagcagctgagcttgccgcagaatctccccagggtctcctgaggacgcctgagactgtggcaaaatttcagagtgttcctgtgcaagctgggcaaacgcccccactcttgcagtactttggcacattgcttactcgagggaagctcaatgcctttgagtctcttgagctatctcgacttgtcgtcaatcagaacaaaaagaatcttcttgaaaactggttggcagaagataagctggagtgtagcgaagaactaggagaccttgtcaagactgtggacaatgatcttgcactgaaaatatacataaaggctagggcaacccctaaagttgttgctgcttttgctgaaaggagggagtttgacaagatactgatatactcaaagcaggttgggtacactccagattatctcttcctcctccagaccatcttgcgtacagatccacagggagctgtgaactttgctcttatgatgtcacaaatggagggaggctgcccagtagattataatacaataactgatcttttccttcagagaaatatgatacgggaggcaacagcttttctgttggatgttctgaaaccaaacttgccagagcatgcttttcttcaaaccaaggttttggagataaacttagtgacttacccgaatgttgctgatgccattcttgctaatggtatgttcagtcattatgatcgccctcgtattgctcagctgtgtgaaaaggctgggttgtacttgcgagccctccagcattactcagagttgcctgatatcaagcgtgccattgtaaatacccatgtcattgaaccacaggcacttgttgagttctttggcacattgtcaagagagtgggctttggaatgcatgaaagaccttctactggttaatctgaggggaaatcttcagattgttgtgcaggccgcgaaagaatactctgagcagctaggggttgatgcttgcatcaaattatttgagcaattcaaatcttatgagggcctttactttttcttgggatcctatctgaagctccagcgaggacccagatatccatttacaagtacatagaagcagcagcaaggactggacaaatcaaagaagttgaacgtgtaaccagagagtcaaacttctatgatgctgagaagacaaagaactttttgatggaagcaaaactacctgatgcccgtccactgattaatgtttgtgatcgctttggttttgtgccagatctcactcactatctgtacacaaacaacatgcttcgatatatcgaaggctatgttcagaaggtgaatcccgggaatgctccattggtagtggggcaattacttgatgatgaatgccctgaagattttatcaagggtttgatcctctctgttcgttctctcctccctgttgagcctttggttgatgaatgtgagaagaggaaccgcctacgtttgctcactcaattcttggagcacttagtgagtgaaggtagccaagatgtgcatgtccataatgctcttggtaaaatcatcattgacagcaacaacaatcctgagcatttccttactaccaacccattttacgactctcgtgttgtgggtaaatattgtgaaaagcgggatcctacacttgctgttgttgcttacagacgtgggcagtgtgacgatgaacttattaacgtcactaacaagaattcgttattcaagctgcaagctaggtatgtggttgagagaatggatggtgatctgtgggataaagttcttcagcccgagaatgaatatagaaggcaactcattgaccaagtggtttcgactgcattacctgagagcaagagccccgagcaagtgtctgctgctgttaaggctttcatgactgctgacctgccacatgaactgattgagcttcttgaaaagattgttcttcagaattctgctttcagtggaaatttcaatctgcagaacctgctcatcttgactgctatcaaagcagatccatccagagtcatggactatgtcaacagacttgataacttcgatgggcctgctgttggagaagttgctgttgaagcacaactgtatgaggaggcttttgctatattcaagaagttcaacttaaatgtgcaggctgtcgatgttctcttggacaacatccggagcatagaaagagctgaggaatttgctttccgtgttgaagaagatgctgtttggagccaggttgccaaagcccagttacgtgaaggtctggtcagtgaagcaattgagtccttcattcgtgcagatgatgctgcacacttccttgatgtcatccgtgcagccgaggaagctaatgtgtacaatgatttagtgaagtaccttctgatggtaaggcaaaaggcacgggaacccaaagtcgatggagaactcatttttgcatatgctaagattgacaggctcagtgatattgaggaattcattcttatgccaaacgttgccaaccttcaaaatgttggtgaccgtctgtatgacgaagaactatatgaagctgcaaaaatcatctatgctttcatctcaaactgggctaagctggctgttaccctggttaagctgaagcagtttcaaggtgctgtggatgctgctcgcaaggctaacagtgccaaaacatggaaggaggtctgctttgcttgtgttgacgccgaggagttccgtcttgcacaaatttgtggtctcaatattattgttcaggttgatgacttggaagaagtcagtgagtactaccaaaatagaggatgcttcaatgaactcattgctctcatggagagtggtcttggacttgaacgtgcacacatgggcatcttcacagaattgggagttctatatgctagataccgctctgagaagcttatggaacacatcaaacttttctccacacgtctcaatattcctaagcttattcgagcttgtgatgaacagcagcactggaaagaacttacctacctgtacatacaatatgatgaatttgacaatgctgccaccactattatgaaccactctccagatgcatgggatcatatgcagttcaaggatgtttgtgttaaagttgcaaatgttgagctatactacaaggcagttcacttctatttgcaggagcatcctgatctcatcaatgatatgctgaatgtgcttgcacttcgtttagatcataccagagttgtagacataatgcgcaaggctggtcaattgcatcttgtgaaaccatatatggttgcagttcagagtaacaatgtctctgctgtgaatgaagccttgaacgaactttatgttgaagaggaagactacgagagactccgtgaatcagttgatatgcatgacaactttgaccaaataggtcttgcccagaagcttgagaagcatgaattgctggagatgaggaggattgctgcctacatttacaagaaggctggcaggtggaagcaatccattgctctatcaaagaaagataacatgtacaaggattgtatggagacatgctcacaatctggtgaccgtgaactgtcagaggacttgcttgtctatttcatcgagcagggtaagaaagaatgctttgcttcctgcctcttcatttgctacgacctgatccggccggatgtcgctcttgagcttgcatggatgaataacatggtggactttgccttcccgtacctgttgcagttcatccgtgaatacactagcaaggtggatgatttagtgaaggacaaaatcgagtcacagaatgaagaaagagccaaagagaaggaggagaaagatcttgtggctcagcagaacatgtatgcgcaactgcttcctcttgccctgcctgctccgccaatgcccggcatgggtggccctccacctccgatgggcggaatgggcatgcctccgatgggcgggatgggcatgccgccgatgggccctggtccgatgccagcattcgggatgccaccaatgggaagctactgagatgttttttttggcagagagcttagatgatgatttgatatgttcctgtgtaagcagaggcggaaacctcattggagttgtagatggttacattttggaattaatattctttatggtaccaggaaatttttggcgagtgaaatcttggccagagtcatcggataggacggggatgattaggttggttgagcatgagctggtgaaagctggtaccatttgtatagtgtgatgaaatctttgtagacattttgcttgtgtaataataatacttgttcgcacagcgaaggaca

SEQ ID NO: 5116 - DNA, 5664 bp, Setaria italica
cgtcttcgacaagctcagatcagatctctcccacgggacgagcggaggcaccaccacccctcgccaccgccgctgcctccgtcccctcccacccccgactccagggagatccgccgcccgtcgccatggcggcggccaacgcccccatcgccatgcgcgaggccctcacgctcaccagcctgggcatcgccccgcagttcgtcaccttcacccatgtcaccatggagtcggagaagtacatctgcgtccgcgagacctcgccgcagaacagcgtcgtcatcatcgacatggccatgcccatgcagccgctccgacgccccatcaccgccgactccgcgctcatgaacccaaacaccagaatcctcgccctcaaagcccaaatacctgggactacacaggatcaccttcaaatatttaatattgaggctaagactaaaataaagtctcatcagatgccagagcaggttgtgttttggaagtggatcactcccaagttgttgggtttagtaacacaaacatcagtttatcactggtcaattgaaggtgattctgagcccaccaagatgtttgataggacagcaaacttagcaaacaatcagatcatcaactaccgatgtgacccagcggagaagtggcttgtgcttattggaattgcacctggtgccccagagaggccacaactggtgaaggggaacatgcaacttttttctgttgagcaacagcgtagccaggcacttgaagcccatgcagcatcttttgcaacatttaaggttgctggtaatgagaacccatcaacccttatttgttttgcctcgaagacaactaatgctggacagattacttcaaagttacatgttattgaactgggtgcccagccagggaaacctggcttctctaagaaacaagccgacctcttcttcccacctgatttccaggatgattttcctgtagctatgcaggtttcacaaaagtatggacttgtctatgtaattacaaagcttggccttttatttgtatatgacttggaaactgctgcagcagtttacagaaatagaattagtccggaccctatattcttgacagcagaatcttcttcaactggtggattttatgccatcaacagaagagggcaggttttgcatgccacagttaatgatgcaactgttgtgccttttgtcagtggtcaattaaacaaccttgagctagctgtgaatcttgccaagagagccaaccttcctggtgcagagaacttggttgtacaaagatttcaggaactgtttgcacaaacaaaatacaaggaagccgctgagctggccgcagagtctcctcaaggcctcctgagaacacctgagactgttgcaaaatttcagagtgttcctgtgcaagctgggcaaacacccccactgttgcagtactttggtacattgctaactcgagggaagcttaatgccttcgagtctcttgagctatctcgacttgtcgtcaatcagaacaaaaagaaccttctggaaaattggttggcggaagacaaactagagtgcagtgaagaacttggagatcttgtcaagactgtggataatgatatggcactaaaaatatacataaaggctagggcaacccctaaagttgttgctgcttttgctgaaaggagggagtttgacaagatacttatatattcaaagcaggttgggtacactccagattatctgttcctcctccagaccattttacgtacagatccacagggagctgtgaactttgctctcatgatgtcacaaatggagggaggttgtccagtagattataatactataactgatcttttccttcagaggaatatgatacgggaggcaacagcttttctgttggatgttctcaaaccaaatttgccagagcacgcttttcttcaaaccaaggttttggagataaacttggtgacttatccaaatgttgctgatgccattcttgctaatggtatgttcagtcattacgaccgccctcgtattgctcagctgtgtgaaaaggctggcttgtacttgcgagctctccagcattactcagaattacctgatatcaagcgtgtcattgtcaatacccatgccattgagccacaggcactcgttgagttctttggcaccctgtcaagagagtgggccttggagtgcatgaaggaccttctagtagtcaatctgaggggaaatcttcaaatcgttgtgcaggctgcaaaagaatactccgagcagttaggagttgacgcctgcataaaactatttgagcaattcaaatcttatgagggactttactttttcttgggatcctatctgagctccagtgaggacccagatatccatttcaaatacatagaagcagctgccaggactggacagatcaaagaagttgaacgtgtaactagagagtctaacttctatgatgctgagaagacaaagaatttcttgatggaggcaaaactacctgatgcccgtccactgattaatgtttgtgaccgctttggttttgtgccagatctcactcactatctgtacacaaacaacatgcttcggtatatcgaaggctatgtgcagaaagtgaatcctgggaatgctcccttggtagtgggacaactacttgatgatgagtgtcctgaagattttattaagggtttgattctttctgttcgttccctccttcctgttgagccactggttgatgaatgcgagaagaggaaccgcctacgtttgctcactcagttcttggagcacttagtgagtgaaggtagccaagatgtacatgtccacaatgctcttgggaaaatcatcatcgacagcaacaataatcctgagcatttccttactactaacccattttatgactcacgtgttgtgggtaaatactgtgaaaagcgggatcctacacttgctgttgttgcttacagacgtgggcagtgtgacgatgagcttattaatgtcactaacaaaaactctctgttcaagctgcaagctagatatgttgttgagaggatggatggtgatctgtgggataaagttcttcagcctgagaatgaatacagaaggcaactcattgaccaggtggtttcgactgcattacctgagagcaagagccctgagcaagtatctgctgctgttaaggctttcatgactgctgacctccctcatgaattgatcgagcttcttgaaaagattgttcttcagaattccgcattcagtggaaacttcaatctgcagaatctgctcattttgactgccatcaaggcagacccatccagagtcatggactatgttaacagactagacaactttgatggacctgctgttggagaagttgctgttgaggcacaactgtatgaggaggcttttgctatattcaagaagttcaacttaaatgtgcaggctgtcaatgttctcttagataacatccggagcatagaaagggctgaagagtttgctttccgtgttgaagaagatgctgtttggagccaggttgccaaggcccagttacgtgagggtctagtcagcgaagcaatcgagtccttcattcgtgcagatgatgccgcacatttccttgatgtcatccatgctgctgaggaagcaaatgtgtacaatgatttagtgaagtaccttctgatggtaaggcaaaaggcacgggagcccaaagtcgatggagaactcatctttgcatatgctaagattgacagactcagtgacattgaagagttcattcttatgccaaatgttgccaaccttcaaaatgtcggtgaccgtctgtatgatgaagaactatatgaagctgcaaagatcatctacgcgttcatctcaaactgggctaagctggctgttaccctagttaagctgaagcagttccaaggtgctgtggatgctgctcgcaaggctaacagtgctaagacatggaaggaggtctgctttgcttgtgttgacgctgaggagttccgtcttgcacaaatttgtggtctcaacattattgtccaggttgatgacttggaagaagtgagtgaatactaccaaaatagaggatgtttcaatgaacttatagctctcatggagagtggtcttggacttgaacgtgcacacatgggcatcttcacagaacttggagttctgtatgctagataccgctatgagaagcttatggagcacatcaaacttttctccacccgtctcaacattcctaagcttatccgggcttgtgatgaacagcagcactggaaagaacttacgtacctctacatacagtatgatgaatttgacaatgctgccaccactattatgaaccactctccagatgcatgggatcatatgcagttcaaggatgtttgtgttaaagttgcaaatgttgagctatattacaaggcagttcatttctatttacaagagcaccctgatctcatcaatgatatgctaaatgtgcttgcgcttcgtttggatcataccagagttgttgacataatgcgcaaggctggtcagttgcatcttgtgaaaccttatatggttgcagttcagagtaacaatgtctctgctgtgaatgaagcgttgaatgagctttatgttgaagaggaagactatgagagactccgtgaatcagttgacatgcatgataactttgaccagataggtcttgcccagaagcttgagaagcatgagttgcttgagatgaggaggattgctgcctacatttacaagaaggctggcagatggaagcagtccattgctctatcgaagaaagacaacatgtacaaggattgcatggagacatgctcgcagtctggtgaccgtgaactgtcggaggacttgctagtctatttcattgagcaggggaagaaagaatgctttgcttcttgcctcttcatttgctatgacttgatacgaccagatgttgcccttgagcttgcatggatgaacaacatgatagactttgcttttccatatctgttgcagttcattcgtgaatacagcagcaaggttgatgatttagttaaggacaaaattgagtcgcaaaatgaggaaagagcgaaagagaaagaggagaaagatcttgttgctcagcagaacatgtacgcccagctgcttcctctcgctttgcccgctccgccgatgccaggcatgggcggtcctccacctccgatgggtggaatgggcatgcctccgatgggtggaatgggtatgcctccaatgggccctggtccgatgccagcatttgggatgccaccaatgggaagctactaggttggttttgcagagcgcttagatgatgattcggatttttccagtgtaagcagaagttgaactatggggttgtagatgatcacagtttggaattaatattctttatggtatcaggaaattttggcgagtgaaaatctctagccagagtttgagaaatgctacctgttgctatatatatatacatgttataatcggataggatgaggatgaggatgattaggttgattgagctggagctgttgaaagctggtaccatttgtatagtgtgataaatatttgtagacattttgcttgtatacctgatggcctcagtggcagacaaacaatgtatgttatttacattttttacgccctactgactgtttgtaattgttgtcaatttccggttacattacgtgaatgtttt

SEQ ID NO: 5117 - DNA, 5616 bp, Setaria italica
ggttcccgtcccgtcttggacaagctcagatcagatccgaccatctcccctacccccccgactccagagagatctcggcaccgccgcccgtcgccatggcggcggccaacgctcccatcgccatgcgcgaggccctcacgctcaccagcctgggcatcgccccgcagttcgtcaccttcacccatgtcaccatggagtcggagaagtacatctgcgtccgcgagacctcgccgcagaacagcgtcgtcatcatcgacatggccatgcccatgcagccgctccgacgccctatcaccgccgactccgcgctcatgaacccgaacaccagaatcctcgccctcaaagcccaaatacctgggactacacaggatcaccttcaaatatttaacattgaggctaagactaagataaagtctcatcagatgccggagcaggttgtgttttggaaatggatcactcccaagttggtgggtttagtaacacaaacatcagtttatcactggtcaattgaaggtgattctgagcccaccaagatgtttgataggacagcaaacttagcaaacaatcagatcatcaactaccgatgtgacccagcggagaagtggcttgtgcttattggaattgcacctggtgccccagagagaccacaactggtgaaggggaacatgcaacttttttctgttgaccaacagcgtagccaggcacttgaagcccatgcagcatcttttgcaacatttaaggttgttggtaatgagaacccatcaacccttatttgttttgcctcgaagacaactaatgctggacagattacttcaaagttacatgttattgaactgggcgcccagccagggaaacctggcttttctaagaaacaagccgacctctttttcccacctgatttccaggatgattttcctgtagctatgcaggtttcacaaaagtatggacttatctatgtaattacaaagcttggccttttatttgtatatgacttggaaactgccgcagcagtttacagaaatagaattagtccggaccctatattcttgacagcagaatcttcttcaactggtggattttatgccatcaacaggagagggcaggttttacatgccacagttaacgatgcaactgttgtgccttttgtcagtggtcaattaaacaaccttgagctagctgtgaatcttgccaagagagccaaccttcctggtgcagagaacttggttgtacaaagatttcaggaactgtttgcacaaacaaaatacaaggaagcagctgagctggccgcagagtctcctcaagggctcctgagaacacctgagaccgttgcaaaatttcagagtgttcctgtgcaagctgggcaaacacccccactgttgcagtactttggtacattgctaactcgagggaagcttaatgccttcgagtctcttgagctatctcgacttgtcgtcaatcagaacaaaaagaaccttctggaaaattggttggcagaagacaaactagagtgcagtgaagaacttggagatcttgtcaagactgtggataatgatatggcactaaaaatatacataaaggctagggcaacccctaaagttgttgctgcttttgctgaaaggagggagtttgacaagattcttatatactcaaagcaggttgggtacactccagattatctgttcctcctccagaccattttacgtacagatccacagggagctgtgaactttgctctcatgatgtcacaaatggagggaggttgtccagtagattataatactataactgatcttttccttcagaggaatatgatacgggaggcaacagcttttttgttggatgttctcaaaccaaatttgccagagcacgcttttcttcaaaccaaggttttggagataaacttggtgacttatccaaatgttgctgatgccattcttgctaatggtatgttcagtcattacgaccgccctcgtattgctcagctgtgtgaaaaggctggcttgtacttgcgagctctccagcattactcagagttacctgatatcaagcgtgtcatggtcaatacccatgccattgagccacaggcactcgttgagttctttggcaccctgtcaagggagtgggccttggagtgcatgaaggaccttctagtagtcaatctgaggggaaatcttcaaatagttgtgcaggctgcaaaagaatactccgagcagttaggagttgacgcttgcataaaactatttgagcaattcaaatcttatgagggcctttactttttcttgggatcctatctgagctccagtgaggacccagatatccatttcaaatacatagaagcagctgccaggactggacagatcaaagaagttgaacgtgtaactagagagtctaacttctatgatgctgagaagacgaagaactttttgatggaggcaaaactacctgatgcccgtccactgattaacgtttgtgaccgctttggttttgtgccagatctcactcactatctgtacacaaacaacatgcttcggtatatcgaaggctatgtgcaaaaagtgaatcctgggaatgctcccttggtagtggggcaactacttgatgatgagtgtcctgaagattttattaagggtttgattctctctgttcgttccctccttcctgttgagccactggttgatgaatgtgagaagaggaaccgcctacgtttgctcactcagttcttggagcacttagtgagtgaaggtagccaagatgtacatgtccacaatgctcttgggaaaatcatcatcgacagcaacaataatcctgagcatttccttactactaacccattttatgactcacgtgttgtgggtaaatactgtgaaaagcgggatcctacacttgctgttgttgcttacagacgtgggcagtgtgatgatgaacttattaatgtcactaacaaaaactcactgttcaagctgcaagctagatatgttgttgagaggatggatggtgatctatgggataaagttcttcagcctgagaatgaatacagaaggcaactcattgaccaggtggtttcgaccgcattacctgagagcaagagccctgaacaagtatctgctgctgttaaggctttcatgactgctgacctccctcatgaattgatcgagcttcttgaaaagattgttcttcagaattccgcattcagtggaaacttcaatctgcagaacctgctcattttgactgccatcaaggcagacccatccagagtcatggactatgttaacagacttgacaactttgatgggcctgctgttggagaagttgctgttgaggcacagctgtatgaggagggttttgcaatattcaagaagttcaacttaaatgtgcaggctgtcaatgttctcttagataacatccggagcatagaaagggctgaagaatttgctttccgcgttgaagaagatgctgtttggagccaggttgccaaggcccagttacgtgagggtctagtcagcgaagcaatcgagtccttcattcgtgcagatgatgccgcacatttccttgatgtcatccatgctgctgaggaagcgaatgtgtacaatgatttagtgaagtaccttctgatggtaaggcaaaaggcccgggagcccaaagttgatggagaactcatctttgcatatgctaagattgacagactcagtgacattgaagagttcattcttatgccaaatgttgccaaccttcaaaatgtcggtgaccgtctgtatgatgaagaactatatgaagctgcaaagatcatctacgcgttcatctcaaactgggctaagctggctgttaccctagttaagctgaagcagttccaaggtgctgtggatgctgctcgcaaggctaacagtgctaagacatggaaggaggtctgctttgcttgtgttgacgctgaggagttccgtcttgcacaaatatgtggtctcaacattattgtccaggttgatgacttggaagaagtgagtgaatactaccaaaatagaggatgcttcaatgaacttatagctctcatggagagtggtcttggacttgaacgtgcacacatgggcatcttcacagagcttggagttctgtatgctagataccgctatgagaagcttatggagcacatcaaacttttctccacccgtctcaacattcctaagcttatccgggcttgtgatgaacagcagcactggaaagaacttacgtacctctacatacagtatgatgaatttgacaatgctgccaccactattatgaaccactctccagatgcatgggatcatatgcagttcaaggatgtttgtgttaaagttgcaaatgttgagctatattacaaggcagttcacttctatttacaagagcaccctgatctcatcaatgatatgctaaatgtgcttgcgcttcgtttggatcataccagagttgttgacataatgcgcaaggctggacagttgcatcttgtgaaaccttatatggttgcagttcagagtaacaatgtctctgctgtgaatgaagcgttgaatgagctttatgttgaagaggaagactatgagagactccgtgaatcagttgacatgcacgataactttgaccagataggtctggcccagaagcttgagaagcatgagttgcttgagatgaggaggattgctgcctacatttacaagaaggctggcagatggaagcagtccattgctctatcaaagaaagacaacatgtacaaggattgcatggagacatgctcgcagtctggtgaccgtgaactgtcggaggacttgcttgtctatttcattgagcaggggaagaaagaatgctttgcttcttgcctcttcatttgctatgacttgatacgtccggatgttgcccttgagcttgcatggatgaacaacatgatagacttcgctttcccatatctgttgcagttcattcgcgaatacagcagcaaggttgatgatttagtgaaggacaaaattgagtcgcaaaatgaggaaagagcgaaagagaaagaggagaaagatcttgttgctcagcagaacatgtatgcccagctgcttcctctcgctttgcccgctccgccgatgccaggcatgggcggtcctccacctccgatgggtggaatgggcatgcctccgatgggtggaatgggcatgcctccgatgggccctggtccgatgccagcatttgggatgccaccaatgggaagctactaggttgattttgcagagcgcttagatgatgattcggatttttccagtgtaagcacaagttgaactatggggttgtagatgatcacagtttggaattaatattctttatggtaccaggaaattttggcgagtgaaatctctagccagagtttgagaaatgttataatcggataggatgaggatgaggatgattaggttgattgagctggagctgttgaaagctggtaccatttgtatagtgtgagaaatatttgtagacattttgcttgtatacctgatggcctcagtggcaggcacaaacaatgtatgttatttacattttttacgacctactgactgtttgtaactgttgtcaacttccggttacattacatgaatgttttccttttac

SEQ ID NO: 5118 - DNA, 5622 bp, Zea mays
ctgtttggttccgtcgcgtcgcgtcccgtgctcagatcagatctctcctctcccccgaccccgagtggagtgcctccctccccccctcccgctccagactagcggagagagatctcggcaccgccgttcgtcgccatggcggcggccaacgctcccatcgccatgcgcgaggcgctcacgctcaccagcctgggcatcgcgccgcagttcgtcaccttcacccacgtcaccatggagtcggagaagtacatctgcgtccgcgagacctccccgcaaaacagtgtcgtcatcatcgacatggccatgcccatgcagccgctccgacggcccatcaccgccgactccgccctcatgaaccccaacaccaggatcctcgccctgaaagcccaaatacctggaacaacacaggatcaccttcaaatatttaacattgaggctaagactaagatcaagtctcaccagatgccggagcaggtcgtattctggaaatggatcactcccaaactgttgggtttggtgacacaaacatcagtttaccactggtcgattgaaggtgattctgagcccaccaagatgtttgataggacggctaatctggcaaacaatcagatcatcaactatcgatgtgacccagcggagaagtggcttgtacttattggaattgcacctggagccccagagaggccacaactggtgaagggaaatatgcaacttttctctgttgatcaacaacgtagccaggcacttgaagcccatgcagcgtcttttgcaacatttaaggttgttggtaatgagaatccatcaacccttatttgtttcgcctcaaagacaactaatgctggacagatcacttcaaagttgcatgttattgaactgggtgcacagccagggaaacctggtttttctaagaaacaagccgacctcttcttccccccagatttccaggatgattttcctgtagctatgcaggtttcacaaaagtatgggcttatctatgtaattactaagcttggccttttgtttgtatatgacttggaaactgctgcggcagtttacagaaatagaatcagtccagaccctatattcttgacggcagaatcttcctctactggtggattttatgccatcaacagaagggggcaggttttacatgccacagttaatgatgcaactgttgtaccttttgtcagtggccaattaaacaaccttgagcttgctgtgaatctggccaagagagctaacctccctggtgctgagaacttggttgtgcaaagattccaggaattgtttgcacagacaaaatacaaggaagcagctgagcttgctgcagaatctccccagggtctcctgaggacgcctgagaccgtggcaaaatttcagagtgttcctgtgcaagctgggcaaacacccccactcttgcagtactttggcacattgctaactcgagggaagctcaatgcctttgagtcgcttgagctatctcgacttgttgtcaatcagaacaaaaagaatcttctggaaaattggttggcagaagacaagctggagtgtagtgaagaactaggagatcttgtcaagactgtggacaatgatcttgcactgaaaatttacataaaggctagggcaacccctaaagttgttgctgcttttgctgaaaggagggagtttgacaagatactgatatactcaaagcaggttgggtacactccagattatctcttcctcctccagaccatcttgcgtacagatccacagggagctgtgaactttgctcttatgatgtcacaaatggagggaggctgcccagtagattataatacaataactgatcttttccttcagagaaatatgataagggaggcaacagcttttctgttggatgttctgaaaccaaacttgccagagcatgcttttcttcaaaccaaggttttggagataaacttagtgacttacccaaatgttgctgatgccattcttgctaatggtatgttcagtcattacgatcgccctcgtattgctcagctgtgtgaaaaggctggtttgtacttgcgagccctccagcattacgcagagttgcctgatatcaagcgtgccattgtaaatacccatgccattgaaccacaggcacttgttgagttttttggcaccttgtcaagagagtgggctttggaatgcatgaaagaccttctacttgttaatctgaggggaaatcttcagattgttgtgcaggctgcgaaagagtactctgaacagctaggggttgatgcttgtatcaaattatttgagcaattcaaatcttatgagggcctttactttttcttggggtcttatctgagctccagtgaggacccagagatccatttcaagtacatagaagcagcagcaaggactggacaaatcaaagaagttgaacgtgtaaccagggagtcaaacttctatgatgctgagaagacaaagaactttttgatggaagcaaaactacctgatgcccgtccactgattaatgtttgtgaccgctttggttttgtgccagatctcactcactatctgtacacaaacaacatgcttcgatatatcgaaggctatgttcaaaaggtgaatcccgggaacgctcctttggtagtgggccagttacttgatgatgaatgccctgaagattttatcaagggcttgatcctctctgttcgttctctccttcctgttgaaccactggttgatgaatgtgagaagaggaatcgcctacgtttgctcactcaattcctggagcacttagtgagtgaaggtagccaagatgtgcatgtccataatgctcttggtaaaatcatcattgacagcaacaacaatcctgagcatttccttactaccaacccattttacgactctcgtgttgtgggtaaatattgtgaaaagcgggatcctacacttgctgttgttgcttacagacgtggacagtgtgatgatgaacttattattgtcaccaacaaaaactcattattcaagctgcaagctaggtatgtggttgagagaatggatggtgatctgtgggataaagttcttcagcctgagaatgaatatagaaggcaactcattgaccaagtggtttccactgcattacctgagagcaagagccctgagcaagtgtctgctgctgttaaggctttcatgactgctgacctgccacatgaactgattgagcttcttgaaaaaattgttcttcaaaattctgctttcagtggaaatttcaatctgcaaaacctgctcatcttgactgctatcaaggcagatccatccagagtcatggattatgtcaacagacttgataactttgatgggcctgctgttggagaagttgctgttgaagcacaactgtatgaggaggcttttgctatattcaagaagttcaacttaaatgtgcaggctgtcgatgttctcttggacaacatccggagcatagaaagagctgaggaatttgctttccgtgttgaagaagatgctgtttggagtcaggttgccaaagcccagttacgtgaaggtcttgtcagtgaagcaattgagtccttcattcgtgcagatgatgctgcacacttccttgatgtcatccgtgctgcggaggaagctaatgtgtacaatgatttagtgaagtaccttctgatggtaaggcaaaaggcacgggaacccaaagtcgatggagaactcatctttgcatatgctaagattgacaggctcagtgatattgaggaattcattcttatgccaaatgttgccaaccttcaaaatgttggcgaccgtctgtatgatgaagaactatatgaagctgcaaaaatcatctatgctttcatttcaaactgggctaagctggctgttaccctggttaagctgaagcagttccaaggtgctgtggatgctgctcgcaaggctaacagtgccaaaacatggaaggaggtctgctttgcttgtgttgacgccgaggagttccgtcttgcacaaatttgtggtctcaatattattattcaggttgatgacttggaagaagtcagtgagtactaccagaatagaggatgcttcagtgaacttattgctctcatggagagtggtcttggacttgaacgtgcacacatgggcatcttcacagaattgggagttctgtatgctagataccgctctgagaagcttatggagcacatcaaacttttctccacccgtctcaatattcctaagcttattcgagcctgtgatgaacagcagcactggaaagaacttacctacctgtacatacagtatgatgaatttgacaatgcagccaccactattatgaaccactctcctgatgcatgggatcatatgcagttcaaggatgtttgcgttaaagttgcaaacgttgagctatattacaaggcagttcacttctatttgcaagagcatcctgatctcatcaatgatatgctgaatgtgcttgcacttcgtttagatcataccagagttgtagacataatgcgcaaggctggtcaattgcatcttgtgaaaccatatatggttgcagttcagagtaataatgtctctgctgtgaatgaagccttgaatgagctttatgttgaagaggaagactatgagagactccgtgaatcagttgacatgcatgacaactttgaccaaataggtcttgcccagaagctggagaagcatgaattgcttgagatgaggaggattgctgcctacatttacaagaaggctggcaggtggaagcaatccattgctctatcaaagaaagataacatgtacaaggattgtatggagacatgctcacaatctggtgaccgtgaactgtcagaggacttgcttgtgtattttatcgagcagggtaagaaagaatgctttgcttcttgcctcttcatttgctacgacctgatccggccggatgtcgctcttgagcttgcgtggatgaacaacatgttggactttgccttcccatacctgttgcagttcatccgtgaatacactagcaaggtggatgatttagtgaaggacagaattgagtcacagaatgaagaaagagtcaaagagaaggaggagaaagatcttgtggctcagcagaacatgtatgcgcaattgcttcctcttgctttgcctgctccgccaatgcctggcatgggtggccctccacctccgatgggtgggatgggcatgcctccaatgggtggaatgggtatgccgccgatgggccctggtccgatgccagcattcgggatgccagcaatgggaagctactgagatgtttttgcagagagcttagacgatgatttgaatcgtccctgtgtaagcgaaggtggaaacttcattggagttgtagatggttacagtttggaattaatattctttatggtaccagaatttttttggcaagtgaaaccttagccagagtctgagaattgcaacctgttataccgtaggatcggataggatgggggtgattaggttggttgagcgagctgttgaaagctggtaccatttgtatagtgtgatgaaaactttgtagacattttgcttgtataatactcctacttgttggcacagtgaaggacaaacaaatgtatgctgacttgttatgtcctcctgattgcaatt

SEQ ID NO: 5119 - DNA, 5731 bp, Zea mays
tgtgtcccctccccccctcagatcagatctctccctctccttctcccggccccgagtggagctgtggaggcacctcgcatcaccgccttcgtctctccagactagccgagagagatctcgacaccgccgcccgttgccatggcggcggccaacgcccccatcgccatgcgcgaggcgctcacgctcaccagcctgggcatcgcgccgcagtttgtcacgtttacccatgtcaccatggagtcggagaagtacatctgcgtccgcgagacctcgccgcagaacagcgtcgtcatcatcgacatggccatgcctatgcagccgctccgccgccctatcaccgccgactccgccctcatgaaccccgacgccaggatcctcgcgctcaaagcccaaatacctggaacaacacaggatcaccttcaaatatttaacatcgaggctaagactaagatcaagtctcaccaaatgcccgaacaggttgtattttggaagtggatcactcccaaattgttgggtttagtgacacaaacatctgtttaccactggtcgattgaaggtgattctgagcccaccaagatgtttgataggacagctaacttggcaaacaatcaaatcatcaactatcgatgtgacccagcggagaagtggcttgtgcttattggaattgcaccgggagccccagagagaccacaactggtgaagggaaatatgcaacttttttctgtcgatcaacagcgtagccaggcgcttgaagcccatgcagcatcttttgcaacatttaaggttgttggtaatgagaacccatcaacccttatttgttttgcctcaaagacaactaatgctggacagatcacttcaaagttgcatgttattgaactgggtgcccagccagggaaacctggcttttctaagaaacaagcggaccttttcttcccaccagatttccaggatgattttcccgtagctatgcaggtttcacaaaagtatgggcttatctatgtaattacaaagcttggccttttgtttgtatatgacttggaaactgctgctgcagtttacagaaatagaatcagtccagaccctatattcttgacagcagaatcttcctctactggtggattttatgccatcaacagaagagggcaggttttacatgccacggttaatgatgcaactgttgtaccatttgttagcggccagctgaacaaccttgagcttgctgttaatcttgccaagagagcaaatcttcctggtgcagagaacttggttgtgcaaaggttccaggaactgtttgcgcaaacaaaatacaaggaagcagctgagctggctgcagagtctccgcagggcctcttgaggactcctgaaactgttgcgaaatttcagagtgttcctgtgcaagctgggcaaacacccccactcttgcagtactttggcacattgctaactcgagggaagctcaatgcctttgagtctcttgagctatctcgacttgttgtcaatcagaacaaaaagaaccttctggaaaactggttggctgaagacaaactggagtgcagtgaagaactaggagatcttgtcaagactgtggacaatgatcttgcactgaaaatatacatcaaggccagggcaacccctaaagttgttgctgcttttgctgaaaggagggagtttgacaaaatacttatatattcaaagcaggttggatacaccccagattatctcttcctcctgcaaaccattttgcggacagatccacagggagctgtcaactttgcattgatgatgtcacaaatggagggaggttgtccagtagactacaacactatcactgatctcttccttcagagaaatatgatacgggaggctacagcttttctgctggatgttctgaagccaaacttgccggatcatgcttttcttcaaaccaaggttttggagatcaacttagtgacttacccaaatgttgcagatgccattcttgcgaatggcatgttcagtcattatgaccgtcctcgtattgctcagctctgtgaaaaggctggattatacttgcgtgccctccagcattattcagagttgcctgatatcaagcgtgtcattgtaaatactcatgccattgagccccaggcacttgttgagttctttggcaccctttcaagggagtgggcactagagtgcatgaaggaccttctactggtaaatctgaggggaaatcttcagattgttgtgcaggctgcgaaagaatattctgaacaactaggagttgatgcttgcataaaattatttgaacaattcaaatcttatgagggcctctactttttcttgggatcctatttgagctccagtgaggatccagatatccatttcaaatacatagaagcagctgcaagaactggacagatcaaagaagttgagcgtgtaaccagagagtctaatttctatgatgcggagaagacaaagaactttttgatggaagcaaagctacctgatgcccgcccactgattaatgtttgtgaccgctttggatttgttccagatctgactcactatctatatacaaacaatatgcttcggtatattgagggctatgtacaaaaagtcaatcctggtaatgctcccttggtagttgggcaacttctggatgatgaatgcccggaagatttcatcaagggtttgattctctctgttcgttctctgcttcctgttgagccactagttgatgaatgcgagaagaggaaccgcctacggttgcttactcaattcttggagcatctagtgagtgaaggtagccaagatgtgcatgtccacaatgctcttgggaaaatcatcatcgacagcaacaataaccctgagcatttccttactaccaacccattttatgactctcgtgttgtgggcaaatactgtgaaaagcgagatcctacacttgctgttgttgcttatagacgtgggcaatgtgacgacgagcttattaatgtcactaacaaaaactcattgttcaagctacaagctagatatgtggttgagagaatggatggtgatctgtgggataaagttcttcagcctgagaatgaatatagaaggcaactcattgaccaagtggtttcgaccgcattgcctgaaagcaagagccccgagcaagtctctgctgctgttaaggcattcatgactgctgaccttcctcacgaattgattgagcttcttgaaaagattgttcttcagaattctgcattcagtggaaacttcaacctgcagaacctactcatcctgaccgccatcaaggcggatccatccagagtcatggactatgttaacagactagacaattttgatgggcctgctgttggtgaagttgctgtcgaggcacagctgtacgaggaggcttttgctatatttaagaagttcaacttaaatgtgcaggctgttgatgttctcttggataacatccgaagcatagacagggctgaggagtttgccttccgtgttgaagaagatgctgtttggagccaggttgctaaagcccagttacgtgaaggtctggtcagtgaagcaattgagtccttcattcgtgcagatgatgcagcacacttccttgatgtcatccgtgcggctgaggaagccaatgtgtacaatgatttagtgaagtaccttctgatggtaaggcaaaaggcacgggaacctaaagtcgacggagaactcatctttgcatacgctaagattgacagactcagtgacattgaagaattcatacttatgccaaatgttgccaaccttcaaaatgttggtgaccgtctatatgatgaagaactatatgaagctgcaaagatcatatatgctttcatctcaaactgggctaagctggctgttaccctggttaagctgaagcagtaccaaggtgctgtggatgctgctcgcaaggctaacagtgctaaaacatggaaggaggtctgctttgcttgtgttgacgcggaggagttccgtcttgcacaaatatgtggtctcaatattattgttcaggttgacgacctggaagaagtcagtgagtactaccagaacagaggatgcttcagtgaacttattgctctcatggagagtggtcttggacttgaacgtgcacacatgggcatcttcacagaattgggagttctatatgctagataccgctctgagaagcttatggagcacatcaaacttttctccacccggctcaacattcctaagcttattcgagcttgtgacgaacagcagcactggaaagaacttacctacctgtacatacagtatgatgaatttgacaatgctgccaccacaattatgaaccactctccagatgcatgggatcacatgcagttcaaggatgtctgcgttaaagttgcaattgtcgagctatattacaaggcagttcacttttatctgcaagagcatcctgatctcatcaatgatatgctaaacgtgcttgcacttcgtttagatcacaccatagttgtagacataatgcgcaaggctggtcagttgcatcttgtgaaaccatatatggttgcagttcagagtaacaatgtatctgccgtgaatgaagccttgaatgagctttatgtcgaagaggaggactacgagagactccgtgaatcagttgacatgcatgacaactttgaccagattggtcttgcccagaagcttgagaagcatgaattgctggagatgaggaggatcgccgcctacatttacaagaaggctggcaggtggaagcagtcgattgctctatcgaagaaagacaacatgtacaaggactgcatggagacatgctcacaatctggcgaccgtgaactgtcagaggacttgctcgtgtatttcattgagcagggtaagaaagaatgttttgcttcttgcctcttcatttgctacgacctgatccggccagatgtggctcttgagcttgcatggatgaacaacatggtggactttgccttcccgtacctgttgcagttcattcgtgaatacactagcaaggtggatgatttagtgaaggacaagatcgagtcgcagaaggaagaaagagccaaggagaaggaggagaaagaccttgtggctcagcagaacatgtatgcgcagctgcttcctctcgctttgccggcgccgccaatgcctggcatgggtggtcctccacctccgatgggtggaatgggcatgcctcccatgggcgggatgggtatgccgccgatgggccctggtccgatgccagcattcggaatgggaggctactgagtggtggttttgcagggagcttagatgatgatgtgaattgttccattgcaagcataagtggaacctcattggagctgtagatggttttacagtttgggaaatcaatattctttattgtaccaggaaacttttttttgggcgagtgagtgaaatcagcctgacccatagtttgagaagcgcaacctgtgatatgttttacgatgggatcggaaataggatgattaggttgtttcagcatgagctgttaaaagctggtaccatgtgtatgtatagtggtgtgataaaatcttttgcgtgtcggcagagtgaagatagacaaatgtatgtttccttgttacgacctgttaatctatatattagcccgacttgtagttcaaatgccctacattattttcttctagctcctccaacttgtagttcaatcggtaatactatatttattaataaattcaatggatatgttctctat

SEQ ID NO: 5120 - DNA, 5430 bp, Zea mays
accgcctccgctagcccttccgctccatactagccgaaagagatctcggcaccgccgcccgtcgccatggcggcggccaacgcccccatcgccatgcgcgaggcgctcacgctcaccagtctaggcatcgcgccgcagttcgtcaccttcacccatgtcaccatggagtcggagaagtacatctgcgtccgcgagacctccccgcagaacagcgtcgtcatcatcgacatggccatgcccatgcagccgctccgccgtcctatcaccgccgactccgcccttatgaaccccaacgccaggatcctcgcgctgaaagcccaaatacctggaacaacacaggatcaccttcaaatatttaacattgaggctaagactaagatcaagtctcaccaaatgcccgagcaggttgtattttggaaatggatcactcctaaattgttgggtttagtgacacaaacatctgtttaccactggtcaattgaaggtgattctgagccaaccaagatgtttgataggacagctaatttggcaaacaatcagatcatcaactatcgatgtgacccagcggagaagtggcttgtacttattggaattgcacctggagccccagagagaccacaactggtgaagggaaatatgcaacttttttctgttgatcaacaacgtagccaggcacttgaagcccatgcagcatcttttgcaacatttaaggttgttggtaatgagaatccatcaacccttatttgtttcgcctcaaagacaactaatgctgggcagatcacttcaaagttgcatgttattgaactgggtgcacagccagggaaacctggcttttctaagaaacaagctgacctcttcttcccaccagatttccaggatgattttcctgtagctatgcaggtttcacaaaagtatgggcttatctatgtaattacaaagcttggccttttgtttgtatatgacttggaaactgctgcggcagtttacagaaatagaattagtccagaccctatatttttgacagcagaatcttcctctactggtggattttatgccatcaacagaagagggcaggttttacatgccacagttaatgatgcaactgttgtaccttttgtcagtggccaattaaacaaccttgagcttgctgtgaatctggccaagagagctaaccttcctggtgctgagaacttggttgtgcaaagattccaggaactgtttgcacaaacaaaatacaaggaggcagctgagctggctgcagaatctccccagggtctcctgaggacgcctgagaccgtggctaaatttcagagcgttcctgtgcaagctgggcaaacgcccccactcttgcagtactttggcacattgctaactcgagggaagctcaatgcctttgagtcgcttgagctatctcgacttgttgtcaatcagaacaaaaaaaatcttctggaaaattggttggcagaagacaagctggagtgtagtgaagaactaggagatcttgtcaagactgtggacaatgatcttgcactgaaaatatacataaaggctagggcaacccctaaagttgttgctgcttttgctgaaaggagggagtttgacaagatactgatatactcaaagcaggttgggtacactccagattatctcttcctcctccagaccatattgcgtacagacccacagggagctgtaaactttgccctcatgatgtcacaaatggagggaggctgcccagtagattataatacaataactgatcttttccttcagagaaatatgatacgggaggcaacagcctttctgttggatgttctgaagccaaacttgccagagcatgcttttcttcaaaccaaggttttggagataaacttagtgacttacccaaatgttgctgatgccattcttgctaatggtatgttcagtcattacgaccgccctcgtattgctcagctatgtgaaaaggccggtttgtacttgcgagccctccagcattactcagagttgcctgatatcaagcgtgccattgtaaatactcatgccattgagccacaggcacttgttgagttctttggcaccttgtcaagagagtgggctttggagtgcatgaaagacctcctactggttaatctgaggggaaatcttcagattgtggtgcaggctgcaaaagaatactgtgagcagctaggggttgacgcgtgcatcaaattatttgagcaattcaaatcttatgagggtctttactttttcttgggatcctatctgagctccagcgaggacccagatatccatttcaagtacatagaagcagctgcgaggactggacagatcaaagaagttgaacgtgtaaccagagagtcaaacttctacgatgctgagaagacaaagaactttttgatggaagcaaaactacctgatgcccgtccactgattaatgtttgtgaccgctttggttttgtgccagacctcactcactacctgtacacaaacaacatgcttcgatatatcgaaggctatgttcaaaaggtgaatcctgggaatgctccattggtagtggggcaactacttgatgatgagtgtcctgaagattttatcaagggtttgattctctctgtccgttctctccttcctgttgagccactggttgatgaatgtgagaagaggaaccgcttacgtttgctcactcaattcttggagcacttagtgagtgaaggtagccaagacgtgcatgtccataatgctcttggaaaaatcatcatcgacagcaacaacaatcctgagcatttccttactaccaacccattttacgactctcgtgttgtgggtaaatattgtgaaaagcgggatcctacacttgctgttgttgcttacagacgtgggcagtgtgatgatgaacttattaatgtcactaacaaaaactcattattcaagctacaagctaggtatgtggttgagagaatggatggtgatctgtgggataaagttcttcagcctgagaatgaatatagaaggcaactcattgaccaagtggtttcgactgcgttgcctgagagcaagagccctgagcaagtgtctgctgctgttaaggctttcatgactgctgacctgcctcatgaactgattgagcttcttgaaaagattgttcttcagaattccgctttcagtggaaatttcaatctgcagaacctgctcatcttgactgctataaaggcagatccatccagagtcatggactatgtcaacagacttgataactttgatgggcctgctgttggagaagttgctgttgaagcacaactgtatgaggaggcttttgctatattcaagaaattcaacttaaatgtgcaggctgtcgatgttctcttggacaacatccggagcatagaaagagcagaggaatttgctttccgtgttgaagaagatgctgtttggagccaggttgccaaagcccagttacgtgaaggtctggtcagtgaagcaattgagtccttcattcgtgcagatgatgctgcacactttcttgatgtcatccgtgctgccgaggaagctaatgtgtacaatgatttagtgaagtaccttctgatggtaaggcaaaaggcacgggaacccaaagtcgatggagaactcatctttgcatatgcaaagattgacaggctcagtgacattgaggaattcattcttatgccgaatgttgccaaccttcaaaatgttggtgaccgtctttttgaggaagaactatatgaagctgcaaagatcatctatgctttcatctcaaactgggctaagctggctgttacccttgttaagctgaagcagttccaaggtgctgtggatgctgctcgcaaggctaacagtgctaaaacatggaaggaggtctgctttgcttgtgttgacgctgaggagttccgtcttgcacaaatatgtggtctcaatattattgttcaggttgatgacttggaagaagtcagtgagtactaccagaacagaggatgcttcagtgaacttattgctctcatggagagtggtcttggacttgaacgtgcacacatgggtatcttcacagaattgggagttctatatgctagataccgctctgagaagcttatggagcacatcaaacttttctccacccgtctgaatattcctaagcttattcgagcttgtgatgaacaacagcactggaaagaacttacctacctgtacatacagtatgatgaatttgacaatgctgccaccacaattatgaaccactctccagatgcatgggatcatatgcagttcaaggatgtctgcgttaaagttgcaaatgtcgagctatattataaggcagttcacttctatttgcaagagcatcctgatctcatcaatgatatgctaaatgtgcttgcacttcgtttagatcataccagagttgtagacataatgcgcaaggctggtcagttgcatcttgtgaaaccatatatggttgcagttcagagtaacaatgtctctgctgtgaatgaagccttgaatgagctttatgttgaagaggaggactatgagagactccgtgaatcagttgacatgcatgacaactttgaccagataggtcttgcccagaagcttgagaagcatgaattgctggagatgaggaggattgccgcctacatttacaagaaggctggcaggtggaagcaatcgatagctctatcgaagaaagacaacatgtacaaggattgcatggagacatgctcacaatctggtgaccgcgaattgtcagaggacttgcttgtctatttcattgagcagggtaagaaagaatgcttcgcttcttgcctcttcatttgctatgacctgatccgaccggatgtcgctcttgagcttgcatggatgaacaacatgatggactttgccttcccgtacctgttgcagttcattcgtgaatacactagcaaggtggatgatttagtgaaggacaagattgagtcgcagaaggaagaaagagccaaagagaaggaggagaaagaccttgtggctcagcagaacatgtatgcacagctgcttcctctcgctttgcccgccccgccaatgcctggcatgggtggccctccacctccgatgggcggaatgggcatgcctccgatgggtatgccgccgatgccagcatttgggatgccaccgatgggaagctactgatttggttttgcagcataagtggaacttcattggagttgtagatggttgacagtttggaatcaatattcttcattgtaccaggaaactttttggcgagtgagtgaaatcagtcttacccgtagtttgagaagtgcaacctgtgatatgtttacgatgggatcggaaataggatgattaggttgtttcagcatgagctgttgaaagctggtaccatatgtatagtgtgataaaatctttgtagacatttttcttgta

SEQ ID NO: 5121 - DNA, 5475 bp, Pennisetum glaucum
gcccccatcgccatgcgcgaggcgctcacgctcaccagcctgggcatcgccccgcagttcgtcaccttcacccacgtcaccatggagtcggagaagtacatctgcgtccgcgagacctccccgcagaacagcgtcgtcatcatcgacatggccatgcccatgcagccgctccggcgccccatcaccgccgactccgcgctcatgaaccccaacaccaggatcctcgcgctcaaagcacaaatacccggcactacacaggatcaccttcaaatatttaatattgaggctaagactaagattaagtctcatcagatgccagagcaggttgtgttttggaaatggatcgctcccaagctgttgggtttagtaacacaaacatcagtttatcactggtcaattgaaggtgattctgagcccaccaagatgtttgataggacagcaaatttagcaaacaatcagatcatcaactaccgatgtgacccagccgagaagtggcttgtgcttattggaattgctcctggtgccccagagagaccacaactggtgaaggggaacatgcagcttttttctgttgaccaacagcgtagccaggcacttgaagctcatgcagcatcgtttgcaacattcaaggttgttggtaatgagaacccatcaacccttatttgttttgcctcgaagacaactaatgctggacagattacttcaaagttacatgttattgaactgggtgcccagccagggaaacctggcttttctaagaaacaagccgacctcttcttcccacctgatttccaggatgatttccctgtagctatgcaggtttcacaaaaatatggacttatctatgtaattacaaagcttggccttttatttgtatatgacttggaaactgcctcagcagtttacagaaatagaattagtccggaccctatattcttgacagcagaatcttcttcaactggtgggttttatgccatcaacagaagggggcaggtgttacatgccacagttaacgatgcaactgttgtgccttttgtcagtggtcaattaaacaaccttgagctagctgtgaatcttgctaagagagccaatcttcctggtgcagagaacttggttgtacaaagatttcaggaactgtttgcacagacaaaatacaaggaagcagctgagctggccgcagagtctcctcaaggccttctgagaacacctgagacggttgcaaaatttcagagtgttcctgtgcaagctgggcaaacacccccactgttgcagtactttggtacattgctaactcgagggaagcttaatgccttcgagtctcttgagctatctcgacttgtcgtcaatcagaacaaaaagaaccttctggaaaattggttggcagaagacaaactagagtgcagtgaagaacttggagatcttgtcaagactgtggataatgacatggcactaaaaatatacataaaggctagggcaacccctaaagttgttgctgcttttgctgaaaggagggagtttgacaagatacttatatactcaaagcaggttgggtacactccagattatctgttcctcctccagaccattttacgtacagatccacagggagctgtgaactttgctctcatgatgtcacaaatggagggaggttgtccagtagattataatactataactgatcttttccttcagaggaatatgatacgggaggcaacagcttttttgttggatgttctcaaaccaaatttgccagagcacgcttttcttcaaacaaaggttttggagataaacttggtgacttatccgaatgttgctgatgccattcttgctaatggtatgttcagtcattacgaccgccctcgtattgctcagctgtgtgaaaaggctggcttgtacttgcgagctctccagcattactcagagttacctgatatcaagcgtgtcatcgtcaatacccatgccattgagccacaggcacttgttgagttctttggcaccttgtcaagagagtgggccttggagtgcatgaaggaccttctagtggtcaatctgaggggaaatcttcaaatcgttgtgcaggctgcaaaagaatactctgagcagttaggagttgacgcatgcataaaactgtttgagcaattcaaatcttatgagggcctttactttttcttgggatcctatctgagctccagtgaggacccagatatccatttcaaatacatagaagcagctgccaggactggacagatcaaagaagttgaacgtgtaactagagagtctaacttctatgatgcggagaagacaaagaactttttgatggaggcaaaactacctgatgcccgtccattgattaacgtttgtgaccgctttggttttgtgccagatctcactcactatctgtacacaaacaacatgcttcggtatatcgaaggctatgtgcagaaagtgaatcctgggaatgctcccttggtagtggggcaactacttgatgatgaatgtcctgaagattttattaagggtttgattctctctgtccgttccctccttcctgttgagccactggttgatgaatgcgagaagaggaaccgcctacgtttgctcactcagttcttggagcacttagtgagcgaaggtagccaagatgtacatgtccacaatgctcttgggaaaatcatcatcgacagcaacaataatcctgagcatttccttactactaatccattttatgactcacgtgttgtgggtaaatactgtgaaaagcgggaccctacgcttgctgttgttgcttacagacgtgggcaatgtgacgaggaacttattaatgtcactaacaaaaactcactgttcaagctgcaagctagatatgttgttgagaggatggatggtgatctgtgggataaagttcttcagcctgagaatgaatacagaaggcaactcattgaccaggtggtttcgaccgcattacctgagagcaagagccctgagcaagtatctgctgctgttaaggctttcatgactgctgacctccctcacgaattgatcgagcttcttgaaaagattgtccttcagaattctgcattcagtggaaacttcaatctgcagaacctgctcattttgactgccatcaaggcagacccatccagagtcatggactatgttaacagactagacaactttgatggccctgctgttggagaagttgctgttgaggcgcagctatatgaggaggcttttgctatcttcaagaagttcaacttgaatgtgcaggctgttgatgttctcttagataacatccggagcatagaaagggctgaagaatttgctttccgtgttgaagaagatgctgtttggagccaggttgccaaggcccagttacgtgagggtctagtcagcgaagcaatcgagtccttcattcgtgctgatgatgccacacatttccttgatgtcatccatgctgctgaggaagcgaatgtgtacaatgacttagtgaagtaccttctgatggtgaggcaaaaggcacgggagcccaaagttgatggagaactcatctttgcatatgctaagattgacagactcagtgacattgaagagttcattcttatgccaaatgttgccaaccttcaaaatgttggtgaccgtctgtacgatgaagaactatatgaagctgcaaagatcatctacgcgttcatctcaaactgggctaagctggctgttaccctagttaagctgaagcagttccaaggtgctgtggatgctgctcgcaaggctaacagtgctaagacatggaaggaagtctgctttgcttgtgttgatgctgaggagttccgtcttgcacagatatgcggtctcaacattattgtccaggttgatgacttggaagaagtgagtgaatactaccaaaatagaggatgcttcaatgaacttatagctctcatggagagtggtcttggacttgaacgtgcacacatgggcatcttcacagaacttggagttctgtacgctagataccgccatgagaagcttatggagcacatcaaacttttctccacccgtctcaacattcctaagcttatccgagcttgtgatgaacagcagcactggaaagaacttacatacctctacatacagtatgatgaatttgacaatgctgccaccactattatgaaccattctccagatgcatgggatcatatgcagttcaaggatgtttgtgttaaagttgcaaatgttgaactatattacaaggcagttcacttttatttgcaagagcaccctgatctcatcaatgatatgctaaatgtgcttgcgcttcgtttggatcataccagagttgttgacataatgcgcaaggctggtcagttgcatcttgtgaaaccttatatggttgcagttcagagtaacaatgtctctgctgtgaatgaagcattgaatgagctttatgttgaagaggaagactatgagagactccgtgaatcagttgacatgcatgataactttgaccagataggtcttgcccagaagcttgagaagcatgagttgcttgagatgaggaggattgctgcctacatttacaagaaggctggcagatggaagcagtccattgctctatcaaagaaagacaacatgtacaaggattgcatggagacatgctcgcagtctggtgaccgtgaactgtctgaggacttgcttgtctatttcattgagcaggggaagaaagaatgctttgcttcttgcctcttcatttgctatgacttgatacgaccggatgttgcccttgagcttgcatggatgaacaacatgatagactttgctttcccatacctgttgcagttcattcgcgaatacaccagcaaggttgatgatttagtcaaggacaaaattgagtcgcaaaatgaggaaagagcgaaagagaaagaggagaaagatcttgttgctcagcagaacatgtacgcccagctgcttcctctcgctttgcccgctccgccgatgccaggcatgggcggtcctccacctccgatgggtggaatgggcatgcctccgatgggtggaatgggaatgcctccgatgggccctggtccgatgccagcatttgggatgccaccaatgggaagctactaggttggttttgcagagcgcttagatgattcggattttttccagtgtaagcagaaagttgaactttggggttgtagatgatcacagtttggaattaatattctttatggtaccacggaattttgtctctagccagagtttgagaaatgctacctgttggtatgttataattggataggatgaggatgagtgtaggtcgattgagctggagctgtcgaaagctgctggtaccatttgtatagtgtgacaaaaatttgtagacattctgcttgtatacctggtggcctcagtggcagacgaacaatgtatgtttattacatttttttacgcccttgtgtttgtaataaatgttgtttattt

SEQ ID NO: 5122 - DNA, 5856 bp, Oryza sativa
aagcaatagagaagccaagcaggcagccactaaattgggttggggtgcctcctccttcctttctttctttcatctgcttcgtcctcagatccgatctctcttctcattctcttctcttggtttggggtgtcacgactcacgacctgccgccttcttcctccccgtcgctctagaggggatctcaccgccggccgtctctcgccatggcggcggccaacgcccccatcgccatgcgcgaggccctcacgctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaagctcaaatacctgggacaacacaggatcacctgcaaatcttcaacattgaggctaaaacaaaaattaagtcccaccagatgcctgagcaggttgtgttttggaaatggatcaccccaaagttgttgggtttggtaacacaaacatcagtttatcactggtcaattgagggagattctgaaccggccaagatgttcgataggacggctaatttggccaacaatcaaattatcaactatcgatgtgatccatctgagaagtggcttgtgcttattggaattgcacctggtgctccagagaggccacaactggtgaagggaaatatgcaacttttttctgtggatcagcaacgtagtcaggcacttgaagcccatgcagcatcctttgcatcatttaaggtcgtgggcaacgagaacccttcaactctcatctgctttgcctcaaagacaactaatgctgggcagatcacttctaagttgcatgttattgaattgggtgcccagccagggaaaccagggttttccaagaagcaagctgatcttttcttccccccagattttcaggatgattttcctgtggccatgcagatctctcagaagtatggccttatctatgtaattacgaagcttggccttttatttgtatatgacttggaaacagctgcagcggtctatagaaatagaattagtccagatcctatattcttgacagcagagtcttctgcaagtggtggtttttatgccatcaataggagaggacaggttttacatgccacagttaatgatgcaaccattgtgccttttgtcagcagtcaattaaataaccttgaactagctgtaaatcttgccaaaagagctaatcttcctggggcagagaacttagttgtgcaaaggtttcaagaattgtttgcacaaacaaaatacaaggaagcagctgagttggctgcagaatctcctcaaggtcttctccgaactcctgagactgttgcaaaatttcagagtgttcctgttcaagctgggcaaacgcctccactcttgcagtactttggcacattgctaactcgggggaagctcaatgcttacgagtctcttgagctatctcgacttgttgtcaatcagaacaaaaagaaccttttggaaaactggttggctgaagacaaattggagtgcagtgaagaacttggagatcttgtcaagactgtggacaatgatcttgctctgaaaatatacataaaggctagggcaacccctaaagttgttgccgcttttgctgaaagaagggaatttgacaagatccttatatattcaaagcaggttggatacacccctgactacctcttcctcctccagaccattttacgtacggatccacagggagctgtcaactttgcgctcatgatgtcacaaatggaggggggctgtccagttgattacaatactataactgatctcttccttcagagaaacatgatacgtgaggcaacagctttcctgctggatgttttaaagccaaacttgccggagcatgcttttcttcaaaccaaggttttggagatcaacttggtcacttacccaaatgttgctgatgccatccttgctaatggtatgttcagtcattatgatcgccctcgtgttgctcagctttgtgaaaaggctggcttgtacttgcgagctctccagcattacacagaattaccagatatcaagcgtgtcatggtgaatacccatgccattgagccacaggcacttgttgagttctttggcactctttcaagagagtgggctttggagtgcatgaaggaccttctgctggtcaatctaagagggaatcttcaaattgttgtacaggctgccaaagaatactctgagcagctaggggttgatgcttgcataaaactgtttgagcaattcaaatcttacgagggcctttactttttcttgggagcttatttgagttccagtgaggatccagatattcatttcaaatacatagaagcagctgctaggactggacagatcaaagaagttgaacgtgtaaccagggaatccaacttttatgatgcggagaagacaaagaactttttaatggaagcgaaactgcctgatgcccgtccgctgattaatgtctgcgaccgctttggatttgttccagatttgacccactatctgtatacaaataatatgcttcggtatattgaaggctatgtacagaaagtgaaccctggaaatgctccattagttgttggacagctacttgatgatgagtgccctgaagatttcattaagggtttgattctgtctgtccgttctctccttcctgttgagccactagttgatgaatgcgagaagaggaaccgcctacggctgctgacacaatttttggagcacttagtgagcgagggtagccaagatgtccatgtgcacaatgctcttggaaaaatcatcattgacagcaacaataatcctgagcacttccttaccaccaatccattttatgactctcgcgtggtcggtaaatactgtgaaaagcgggatcctacccttgctgttgttgcttacagacgtggacagtgtgatgatgaacttattaatgtcaccaataaaaactcactgttcaagctgcaagctaggtatgtggttgaaagaatggatggtgatctgtgggataaagttctacagcctgaaaatgaatatagaaggcaactcattgaccaagtggtttctacggctttgcctgaaagcaagagccccgagcaagtgtctgctgctgttaaggctttcatgacagctgatcttccccatgaactgattgaacttcttgaaaagatcgtccttcagaattctgctttcagtggaaacttcaatctgcagaaccttctcatcttgacagccatcaaggctgacccatccagggtcatggactatgtcaacaggctggacaactttgatgggcctgctgttggagaagtagcagttgaagcacagctgtttgaggaggctttcgctatcttcaagaagttcaacttaaatgtgcaggctgtcaatgttctattggacaacatccgaagcatagaaagagctgaagagtttgcattccgtgttgaagaagatgctgtttggagccaggttgccaaggcccagttgcgtgaaggtttggttagtgaagcaattgagtccttcattcgtgcagatgatgcaacacatttcctcgacgtcatccgtgctgctgaggaagctaatgtatacgatgatctagttaagtacttgcttatggtaaggcagaaggcaagggaacccaaagttgatggagaactcatctttgcgtatgctaagattgatagactcagtgatattgaagagttcattctcatgccaaatgttgccaatcttcaaaatgttggtgatcgtctgtatgatgaagaactttatgaagcagcaaagatcatctatgccttcatctcaaactgggctaagctggctgttacccttgttaagctgaagcagttccaaggtgctgtggatgctgctcgcaaggctaacagtgctaaaacatggaaggaagtctgctttgcttgtgttgatgccgaggagttccggctagcacaaatatgtggtctcaatattattgtccaggttgatgatttggaggaagtaagtgaatactaccagaacagaggatgtttcaatgaacttatttccctcatggaaagtggtctaggactggagcgtgctcacatgggcatcttcacagaattaggagtcctctatgctagatatcgccctgagaagctcatggaacacatcaaacttttctccacacgtctcaacattcctaagcttatccgtgcttgtgatgaacagcagcactggaaagagcttacttacctatacatccagtatgatgaatttgacaatgctgccaccactattatgaaccattctccggatgcatgggatcatatgcaatttaaggatgttgctgttaaagttgcaaatgttgagctatactacaaggcagtgcacttctatctgcaagagcatcctgatctcatcaatgaccttctcaatgtacttgcgcttcgtttggatcatacaagagtcgtggacataatgcgcaaggctggtcagttgcatcttgtgaaaccatacatggttgcagttcagagcaacaatgtctctgctgtgaatgaagctttgaatgagctttatgttgaagaggaggactatgagagactccgtgaatcggttgatatgcatgacaactttgatcagataggtcttgcccaaaagcttgagaagcatgaattgcttgagatgaggaggatcgctgcctacatttacaagaaggctggcagatggaagcaatctattgccctgtcgaagaaagacaacatgtacaaggattgcatggagacatgctcacagtctggtgaccgcgagctgtcagaagatttgcttgtctatttcattgaacagggaaagaaagaatgctttgcttcttgtctctttatttgttatgacttgatccgtgcggatgttgctcttgagcttgcatggatgaacaacatggtggactttgcattcccctatctgttacagttcattcgggagtacacaagcaaggttgatgagctagtgaaggacaggattgaatcacagaatgaagtaagggctaaagagaaggaagaaaaagatcttgttgctcagcagaacatgtatgcccaattgcttcctctcgccttgcctgctccacctggtatgggcggtcctccaccgccaatggggatgccgggcatgcctccgatgggcggaatggggatgcctccgatgggtcccggacctatgccagcatatgggatgcctccaatgggaagctactgagtatcatccacttgtgaagagttcatttagatgataagaatttcaatttacacagaagaggaggcatctttcaagttgtagatgtgctattattggttgtttaaactgattcttttggtaccaggacaattttggcgagtgaaatctctagccaggtcgagttaatgactagttgctatatattatattacgatgggataggacgagggatggttgttaggttgagcgggagctgcaaaggctggtaccattatttgtataggttgtgtgataaaaaagcttgtagacattttgcatgtacactttgccgtagtggttggcgttggcagccataaacaggaacaccattgtctgtatgttacttgtttacggtctcatgtccagctgtttgaattttgtacctgaaatatttttttctttggacaaaaagatggagtatttgaatatttcgctcttgccagtgacttgtgtattctatagtattatatgggtttttctttgagtaaataaatgcatttgccaaccc

SEQ ID NO: 5123 - DNA, 5962 bp, Oryza sativa
gagaagccaagcaggcagccactaaattgggttggggtgcctcctcctccctttctttctttcatctgcttcgtcctcagatccgatctctcttctcttgttctggggttggggtctcacgacccgccgccttcttcgtccccgtcgctctagaggggatctcaccgccagccgtctctcgccatggcggcggccaacgcccccatcgccatgcgcgaggcgctcacgctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaagctcaaatacctgggacaacacaggatcacctgcaaatcttcaacattgaggctaaaacaaaaattaagtcccaccagatgcctgagcaggttgtgttttggaaatggatcaccccaaagttgttgggtttggtaacacaaacatcagtttatcactggtcaattgagggagattctgaaccggccaagatgttcgataggacggctaatttggccaacaatcaaattatcaactatcgatgtgatccatctgagaagtggcttgtgcttattggaattgcacctggtgctccagagaggccacaactggtgaagggaaatatgcaacttttttctgtggatcagcaacgtagtcaggcacttgaagcccatgcagcatcctttgcatcatttaaggtcgtgggcaacgagaacccttcaactctcatctgctttgcctcaaagacaactaatgctgggcagatcacttctaagttgcatgttattgaattgggtgcccagccagggaaaccagggttttccaagaagcaagctgatctcttcttccccccagattttcaggatgattttcctgtggccatgcagatctctcagaagtatggccttatctatgtaattacgaagcttggccttttatttgtatatgacttggaaacagctgcagcggtctatagaaatagaattagtccagatcctatattcttgacagcagagtcttctgcaagtggtggtttttatgccatcaataggagaggacaggttttacatgccacagttaatgatgcaaccattgtgccttttgtcagcagtcaattaaataaccttgaactagctgtaaatcttgccaaaagagctaatcttcctggggcagagaacttggttgtgcaaaggtttcaagaattgtttgcacaaacaaaatacaaggaagcagctgagttggctgcagaatctcctcaaggtcttctccgaactcctgatactgttgcaaaatttcagagtgttcctgttcaagctgggcaaacgcctccactcttgcagtactttggcacattgctaactcgggggaagctcaatgcttacgagtctcttgagctatctcgacttgttgtcaatcagaacaaaaagaaccttttggaaaactggttggctgaagacaaattggagtgcagtgaagaacttggagatcttgtcaagactgtggacaatgatcttgctctgaaaatatacataaaggctagggcaacccctaaagttgttgccgcttttgctgaaagaagggaatttgacaagatccttatatattcaaagcaggttggatacacccctgactacctcttcctcctccagaccattttacgtacggatccacagggagctgtcaactttgcgctcatgatgtcacaaatggaggggggctgtccagttgattacaatactataactgatctcttccttcagagaaacatgatacgtgaggcaacagctttcctgctggatgttttaaagccaaacttgccggagcatgcttttcttcaaaccaaggttttggagatcaacttggtcacttacccaaatgttgctgatgccatccttgctaatggtatgttcagtcattatgatcgccctcgtgttgctcagctttgtgaaaaggctggcttgtacttgcgagctctccagcattacacagaattaccagatatcaagcgtgtcatggtgaatacccatgccattgagccacaggcacttgttgagttctttggcactctttcaagagagtgggctttggagtgcatgaaggaccttctgctggtcaatctaagagggaatcttcaaattgttgtacaggctgccaaagaatactctgagcagctaggggttgatgcttgcataaaactgtttgagcaattcaaatcttacgagggcctttactttttcttgggagcttatttgagttccagtgaggatccagatattcatttcaaatacatagaagcagctgctaggactggacagatcaaagaagttgaacgtgtaaccagggaatccaacttttatgatgcggagaagacaaagaactttttaatggaagcgaaactgcctgatgcccgtccgctgattaatgtctgcgaccgctttggatttgttccagatttgacccactatctgtatacaaataatatgcttcggtatattgaaggctatgtacagaaagtgaaccctggaaatgctccattagttgttggacagctacttgatgatgagtgccctgaagatttcattaagggtttgattctgtctgtccgttctctccttcctgttgagccactagttgatgaatgcgagaagaggaaccgcctacggctgctgacacaatttttggagcacttagtgagcgagggtagccaagatgtccatgtgcacaatgctcttggaaaaatcatcattgacagcaacaataatcctgagcacttccttaccaccaatccattttatgactctcgcgtggtcggtaaatactgtgaaaagcgggatcctacccttgctgttgttgcttacagacgtggacagtgtgatgatgaacttattaatgtcaccaataaaaactcactgttcaagctgcaagctaggtatgtggttgaaagaatggatggtgatctgtgggataaagttctacagcctgaaaatgaatatagaaggcaactcattgaccaagtggtttctacggctttgcctgaaagcaagagccccgagcaagtgtctgctgccgttaaggctttcatgacagctgatcttccccatgaactgattgaacttcttgaaaagatcgtccttcaaaattctgctttcagtggaaacttcaatctgcagaaccttctcatcttgacagccatcaaggctgacccatctagggtcatggactatgtcaacaggctggacaactttgatgggcctgctgttggagaagtagcagttgaagcacagctgtttgaggaggctttcgctatcttcaagaagttcaacttaaatgtgcaggctgtcaatgttctattggacaacatccgaagcatagaaagagctgaagagtttgcattccgtgttgaagaagatgctgtttggagccaggttgccaaggcccagttgcgtgaaggtttggttagtgaagcaattgagtccttcattcgtgcagatgatgcaacacatttcctcgacgtcatccgtgctgctgaggaagctaatgtatacgatgatctagttaagtacttgcttatggtaaggcagaaggcaagggaacccaaagttgatggagaactcatctttgcgtatgctaagattgatagactcagtgatattgaagagttcattctcatgccaaatgttgccaatcttcaaaatgttggtgatcgtctgtatgatgaagaactttatgaagcagcaaagatcatctatgccttcatctcaaactgggctaagctggctgttacccttgttaagctgaagcagttccaaggtgctgtggatgctgctcgcaaggctaacagtgctaaaacatggaaggaagtctgctttgcttgtgttgatgccgaggagttccggctagcacaaatatgtggtctcaatattattgtccaggttgatgatttggaggaagtaagtgaatactaccagaacagaggatgtttcaatgaacttatttccctcatggaaagtggtctaggactggagcgtgctcacatgggcatcttcacagaattaggagtcctctatgctagatatcgccctgagaagctcatggaacatatcaaacttttctccacacgtctcaacattcctaagcttatccgtgcttgtgatgaacagcagcactggaaagagcttacttacctatacatccagtatgatgaatttgacaatgctgccaccactattatgaaccattctccggatgcatgggatcatatgcaatttaaggatgttgctgttaaagttgcaaatgttgagctatactacaaggcagtgcacttctatctgcaagagcatcctgatctcatcaatgaccttctcaatgtactcgcgcttcgtttggatcatacaagagtcgtggacataatgcgcaaggctggtcagttgcatcttgtgaaaccatacatggttgcagttcagagcaacaatgtctctgctgtgaatgaatctttgaatgagctttatgttgaagaggaggattatgagagactccgtgaatcggttgatatgcatgacaactttgatcagataggtcttgcccagaagcttgagaagcatgaattgcttgagatgaggaggatcgctgcctacatttacaagaaggctggcagatggaagcaatctattgccctgtcgaagaaagacaacatgtacaaggattgcatggagacatgctcacagtctggtgaccgcgagctgtcagaagatttgcttgtctatttcattgaacagggaaagaaagaatgctttgcttcttgtctctttatttgttatgacttgatccgtgcggatgttgctcttgagcttgcatggatgaacaacatggtggactttgcattcccctatctgttacagttcattcgggagtacacaagcaaggttgatgagctagtgaaggacaggattgaatcacagaatgaagtaagggctaaagagaaggaagaaaaagatcttgttgctcagcagaacatgtatgcccaattgcttcctcttgccttgcctgctcctcctggtatgggcggtcctccaccgccaatggggatgccgggcatgcctccgatgggcggaatggggatgcctccgatgggtcctggacctatgccagcatatgggatgcctccaatgggaagctactgagttatcatccacttgtgaagagttcatttagataagaatttcaatttacacagaagaggaggcatctttcaagttgtagatgtgctattattggttgtttaaactgattcttttggtaccaggacaattttggcgagtgaaatctctagccaggtcgagttaattgctggttgctatatatattatgttacgatgggataggatgagggatggttgttaggttgagcgggagctgcaaaggctggtaccattatttgtataggttgtgtgataaaaaagcttgtagacattttgcatgtacactttgccgtagtggttggcgttggcagccataaacaggaacaccattgtctgtatgttacttgtttacggtctcatgtccagctgtttgaattttgtacctgaaatatttttttctttggacaaaaagatggagtatttgaatatttcgctcttgccagtgacttgtgtattctataatattatatgggtttttctttgagtaaataaatgcatttgccaaccctggttgctgtggtgtacaacaaaacaatgcaagtgttcctcgatcggttgccttgttgcagccttcacccctgcgctgcatgctgtgtgatttgctaattgggtttgttatgaagctggttatccg

SEQ ID NO: 5124 - DNA, 5883 bp, Brachypodium distachyon
cgggagggcttgtgagcaaaaagggatttccaacacgacagtacgacgcgcaccagagagaaaaagagagaaagacgagaagacccacttctaaaaattcgcttctcctcttcttcctcctccagatctcatttctgcctagcctctctcgctcccaccggccggagcgagaggccacccccgacccccgacctccaccgtcgccgtctgccgccatggcggcggccaacgcgcccatcgccatgcgcgaggccctcacgctgacgagcctggggatcgcgccgcagttcgtcacattcacgcacgtcaccatggagtcggaccgctacatctgcgtgcgggagacctcgccgcagaacagcgtcgtcatcgtcgacatggccatgcccagccagccgctccgcaggcccatcaccgccgactccgcgctcatgaacccaaacaccaggatcctcgccctcaaagctcaaatagctggaacgacacaggatcacctgcaaatctttaatattgaggcaaaaacgaaagttaagtcacaccagatgcctgaacaggttgtgttctggaaatggattacccctaagttgttgggtttggtaacacaaacatcagtttatcactggtcaattgaaggagattctgaacccactaagatgttcgataggacagctaatctggccaataatcagattatcaactatcgttgtgatccagcagagaagtggctcgtgcttattggaatcgcacctggtgctccagagaggccgcagctggtgaagggaaatatgcaacttttttctgtggatcagcagcgtagccaagcacttgaagctcatgcagcttcttttgcaacattcaaggttgctggcaatgagaacccatcaaccctcatctgttttgcttcaaagtcatcaaatgctggacagattacttctaagttacatattattgaactaggtgcccagccagggaagcctggcttttccaagaaacaagccgatctcttcttcccaccagatttccaggatgattttcctgtagccatgcagatctctcaaaagtatggtcttgtctatgtaattacgaaacttgggcttttgtttgtttacgacttagaaactgctgcagcagtttatagaaatagaatcagtcccgatcccatattcttgacggcagagtcttctacaactggtggattttatgccatcaacagacgtgggcaggttttgcacgcaacagttaatgatgcaaccgttgtgccttttgtcagtggtcagttaaacaacctggagttagctgtcaatcttgccaaaagagccaatcttcccggggcagagaatctggttgtgcaaagatttcaggagctgttcgcacaaacaaaatacaaggaagcagcggagctggctgcagaatctcctcagggtattctgagaactcctgagactgttgcaaaattccagagtgttcctgttcaagctgggcaaacacctccactcttgcagtactttggcacattacttacgaaagggaagctcaacgcgtacgaatcacttgagttatctcgactcgttgtcaatcagaacaagaagaaccttttggaaaattggttggcggaagacaagttggagtgcagtgaagagctaggagatcttgtcaagacggttgacaatgatcttgcactgaaaatatacataaaggctagggcaacccctaaagttgttgctgcttttgctgaaaggagggagttcgacaagatccttatatactcaaagcaggttggatacacgcctgattacctcttcctactccagaccatattgcgcacggatccacagggagctgtcaactttgctctcatgatgtcacaaatggaggggggttgtccactagactataataccataactgatctcttccttcagagaaatatgatacgggaggcaactgcttttctactggatgttctgaagccaaacttgccagagcatgcttttcttcagaccaaggttttggagatcaacttggtgacttacccaaatgttgctgatgccatccttgctaatggcatgttcagtcattatgatcgccctcgcattgctcaactgtgtgaaaaggctggcttgtacttgcgggcccttcagcactacgcagaattacctgatattaagcgtgtcatcgtgaatacccatgctattgagccacaggcacttgttgagttctttggaactctttctaaagaatgggcattagaatgcatgaaggacctcctactggtcaatctgagaggaaatcttcaaattgttgtgcaggctgccaaagaatactctgagcagcttggggttgacgcttgcataaaactatttgagcaatttaaatcatatgagggcctctacttcttcctaggatcctatttaagctccagtgaggatccagacatccatttcaaatacatagaatcagctgcaaggactggacaaattaaagaggttgagcgtgtcaccagagagtccaacttttacgatgctgagaagacaaagaactttttgatggaagcaaaactgcctgacgcccgtccactgattaatgtttgcgaccgctttggttttgttcctgatcttactcactatctgtacacaaataatatgctccggtatatcgaaggctatgtacagaaagtgaaccctggaaatgctccgttggttgtgggacagctacttgatgatgagtgcccggaagatttcattaagggtttgattttgtctgttcgctctctccttcctgtcgagccacttgttgatgaatgcgagaagaggaaccgcctacggttgctgacacaattcttggagcacttggtgagcgagggtagccaagatgtgcatgtccacaatgcacttgggaaaattattattgacagcaacaacaaccctgagcatttccttactaccaacccattctacgactctcgtgtggttggtaaatactgtgaaaagcgggatcctacacttgctgttgttgcttacagacgtggacagtgtgatgaagaactcatcaatgttaccaacaagaactccctgttcaagctgcaagctaggtatgtagttgaaagaatggatggcgatctttgggacaaagttctacagcctgaaaatgaatatagaaggcagttcattgaccaagtggtttctactgcattgcccgaaagcaagagtcctgagcaagtttctgctgccgttaaggctttcatgacagccgaccttcctcatgaactgatcgaacttcttgaaaagattgtccttcagaattctgcgttcagcggaaacttcaatcttcagaatctgctcatcttgacagccatcaaggcggactcgtccagggtcatggattatgttaacagattggacaactttgatggtcctgctgttggagaagtagctgtagaagcacaactctacgaggaggctttttccatattcaagaagttcaatttaaatgtgcaggctgtcaatgttctgttggataacatccaaagcattgaaagagcggaagagtttgcattccgtgttgaagaggatgctgtttggagccaggttgccaaggcccagttgcgtgaaggtctagtcagtgaagcgattgagtcctttattcgtgcagacgacgcggcacatttccttgatgtcatccgtgctgctgaggaagccaatgtatatgatgatttagtgaagtacttgctgatggtaaggcaaaagtcaagggagcccaaagttgatggtgaactcatctttgcatatgctaaaactgataggctcagtgacatcgaagagtttattcttatgccaaatgttgccaatctccaaaatgtcggtgatcgtctgtacgacgaagaactttatgaagctgcaaagattatctatgccttcatctcgaactgggctaagctggctgtcaccttggtaaagctgaagcaattccaaagtgctgtagatgctgctcgtaaggctaacagcgctaaaacatggaaggaggtctgctttgcttgtgttgatgctgaggagttccgtctagcgcaaatctgtggtctcaatattatagttcaggtcgatgacttggaagaagtgagtgaatactaccagaacagaggatgtttccatgaacttatttccctcatggagagtggtcttggacttgaacgagctcacatgggcatctttacagaattgggagttctgtatgctagatatcgccctgagaagctcatggaacacatcaaactcttctcaacacgtctcaacattcctaagcttatccgtgcttgtgatgaacaacagcactggaaagagctcacatacctatacatacaatatgacgagtttgacaatgctgccaccactatcatgaaccattctccagatgcatgggatcatatgcaattcaaggatgtttgtgtcaaggttgcaaatgtcgagatatattacaaggcagtgcacttctatttgcaagaacaccctgatctcatcaatgatcttctcaacgtgcttgcacttcgtttggatcatacaagagttgttgatataatgcgcaaggctggtcagttgcatcttgtgaaaccgtacatggttgcagttcagagcaacaatgtatctgctgtcaatgaagctttgaatgaactgtatgtcgaagaggaggactatgagaggctccgtgaatctgttgatatgcatgataactttgaccagataggtcttgcccagaagcttgagaagcatgaattgctcgagatgaggaggattgcttcctacatatacaagaaggcgggcagatggaagcaatctattgccctgtcaaagaaggataacatgtacaaggattgcatggagacatgctcacaatctggtgatcgtgagctctcagaggatttgcttgtctattttatcgagcagggaaagaaggaatgttttgcttcttgcctcttcatttgctacgacttgattcgtgcagatgttgctcttgagcttgcatggacgaataacatgctggactttgctttcccttatctgttacagttcatccgtgagtacactagcaaggtagatgatttagtgaaggacaggattgaatcgcagaaggaagaaaaagctaaagagcaagaagagaaggaagtagttgcacagcagaacatgtatgcccagttgctccctctcgccttgcccgctccacctggtatgggagggatgggcatgcctccgatgggtggaatgggcatgccgcctccaatgggcggaatgggcatgccaccgatgggtcctggtccgatgccagcatacgggatgcctccaatgggaagctactgagcatatcttcctgtcatcgcttttgaagagtatagatgatgtcaaatatttcagttcacccagaggatctagaggcatctttgaaagatgtagatccgcgtcattgtttgctccagttaatattcttttggtaccaggacaattttggcgagcgaaatctctatattataacggtcggataggatcggcagcatgactaatgatttagggcccagttgagttggggagctgcagggttggaagaagaagattagaccggtaccatttgtataggtgttgaaaatgtttgtagacattctgcattgtacacttcgtcagtcaagtcagcgttggtgttggcagccagccataaaacacaaacacaaaatactgcctctgtatgtttactaccatctcatcatgttcagtgctttgggtttcttgtatgtacctgcaaaacagcctattctgaatctgcccattgtttctatagtttctttcctgcatcctgatcctgtcatattttgataagaatttgctctgatgttcctgaccg

SEQ ID NO: 5125 - DNA, 5637 bp, Brachypodium distachyon
caccgtcgccgtctgccgccatggcggcggccaacgcgcccatcgccatgcgcgaggccctcacgctgacgagcctggggatcgcgccgcagttcgtcacattcacgcacgtcaccatggagtcggaccgctacatctgcgtgcgggagacctcgccgcagaacagcgtcgtcatcgtcgacatggccatgcccagccagccgctccgcaggcccatcaccgccgactccgcgctcatgaacccaaacaccaggatcctcgccctcaaagctcaaatagctggaacgacacaggatcacctgcaaatctttaatattgaggcaaaaacgaaagttaagtcacaccagatgcctgaacaggttgtgttctggaaatggattacccctaagttgttgggtttggtaacacaaacatcagtttatcactggtcaattgaaggagattctgaacccactaagatgttcgataggacagctaatctggccaataatcagattatcaactatcgttgtgatccagcagagaagtggctcgtgcttattggaatcgcacctggtgctccagagaggccgcagctggtgaagggaaatatgcaacttttttctgtggatcagcagcgtagccaagcacttgaagctcatgcagcttcttttgcaacattcaaggttgctggcaatgagaacccatcaaccctcatctgttttgcttcaaagtcatcaaatgctggacagattacttctaagttacatattattgaactaggtgcccagccagggaagcctggcttttccaagaaacaagccgatctcttcttcccaccagatttccaggatgattttcctgtagccatgcagatctctcaaaagtatggtcttgtctatgtaattacgaaacttgggcttttgtttgtttacgacttagaaactgctgcagcagtttatagaaatagaatcagtcccgatcccatattcttgacggcagagtcttctacaactggtggattttatgccatcaacagacgtgggcaggttttgcacgcaacagttaatgatgcaaccgttgtgccttttgtcagtggtcagttaaacaacctggagttagctgtcaatcttgccaaaagagccaatcttcccggggcagagaatctggttgtgcaaagatttcaggagctgttcgcacaaacaaaatacaaggaagcagcggagctggctgcagaatctcctcagggtattctgagaactcctgagactgttgcaaaattccagagtgttcctgttcaagctgggcaaacacctccactcttgcagtactttggcacattacttacgaaagggaagctcaacgcgtacgaatcacttgagttatctcgactcgttgtcaatcagaacaagaagaaccttttggaaaattggttggcggaagacaagttggagtgcagtgaagagctaggagatcttgtcaagacggttgacaatgatcttgcactgaaaatatacataaaggctagggcaacccctaaagttgttgctgcttttgctgaaaggagggagttcgacaagatccttatatactcaaagcaggttggatacacgcctgattacctcttcctactccagaccatattgcgcacggatccacagggagctgtcaactttgctctcatgatgtcacaaatggaggggggttgtccactagactataataccataactgatctcttccttcagagaaatatgatacgggaggcaactgcttttctactggatgttctgaagccaaacttgccagagcatgcttttcttcagaccaaggttttggagatcaacttggtgacttacccaaatgttgctgatgccatccttgctaatggcatgttcagtcattatgatcgccctcgcattgctcaactgtgtgaaaaggctggcttgtacttgcgggcccttcagcactacgcagaattacctgatattaagcgtgtcatcgtgaatacccatgctattgagccacaggcacttgttgagttctttggaactctttctaaagaatgggcattagaatgcatgaaggacctcctactggtcaatctgagaggaaatcttcaaattgttgtgcaggctgccaaagaatactctgagcagcttggggttgacgcttgcataaaactatttgagcaatttaaatcatatgagggcctctacttcttcctaggatcctatttaagctccagtgaggatccagacatccatttcaaatacatagaatcagctgcaaggactggacaaattaaagaggttgagcgtgtcaccagagagtccaacttttacgatgctgagaagacaaagaactttttgatggaagcaaaactgcctgacgcccgtccactgattaatgtttgcgaccgctttggttttgttcctgatcttactcactatctgtacacaaataatatgctccggtatatcgaaggctatgtacagaaagtgaaccctggaaatgctccgttggttgtgggacagctacttgatgatgagtgcccggaagatttcattaagggtttgattttgtctgttcgctctctccttcctgtcgagccacttgttgatgaatgcgagaagaggaaccgcctacggttgctgacacaattcttggagcacttggtgagcgagggtagccaagatgtgcatgtccacaatgcacttgggaaaattattattgacagcaacaacaaccctgagcatttccttactaccaacccattctacgactctcgtgtggttggtaaatactgtgaaaagcgggatcctacacttgctgttgttgcttacagacgtggacagtgtgatgaagaactcatcaatgttaccaacaagaactccctgttcaagctgcaagctaggtatgtagttgaaagaatggatggcgatctttgggacaaagttctacagcctgaaaatgaatatagaaggcagttcattgaccaagtggtttctactgcattgcccgaaagcaagagtcctgagcaagtttctgctgccgttaaggctttcatgacagccgaccttcctcatgaactgatcgaacttcttgaaaagattgtccttcagaattctgcgttcagcggaaacttcaatcttcagaatctgctcatcttgacagccatcaaggcggactcgtccagggtcatggattatgttaacagattggacaactttgatggtcctgctgttggagaagtagctgtagaagcacaactctacgaggaggctttttccatattcaagaagttcaatttaaatgtgcaggctgtcaatgttctgttggataacatccaaagcattgaaagagcggaagagtttgcattccgtgttgaagaggatgctgtttggagccaggttgccaaggcccagttgcgtgaaggtctagtcagtgaagcgattgagtcctttattcgtgcagacgacgcggcacatttccttgatgtcatccgtgctgctgaggaagccaatgtatatgatgatttagtgaagtacttgctgatggtaaggcaaaagtcaagggagcccaaagttgatggtgaactcatctttgcatatgctaaaactgataggctcagtgacatcgaagagtttattcttatgccaaatgttgccaatctccaaaatgtcggtgatcgtctgtacgacgaagaactttatgaagctgcaaagattatctatgccttcatctcgaactgggctaagctggctgtcaccttggtaaagctgaagcaattccaaagtgctgtagatgctgctcgtaaggctaacagcgctaaaacatggaaggaggtctgctttgcttgtgttgatgctgaggagttccgtctagcgcaaatctgtggtctcaatattatagttcaggtcgatgacttggaagaagtgagtgaatactaccagaacagaggatgtttccatgaacttatttccctcatggagagtggtcttggacttgaacgagctcacatgggcatctttacagaattgggagttctgtatgctagatatcgccctgagaagctcatggaacacatcaaactcttctcaacacgtctcaacattcctaagcttatccgtgcttgtgatgaacaacagcactggaaagagctcacatacctatacatacaatatgacgagtttgacaatgctgccaccactatcatgaaccattctccagatgcatgggatcatatgcaattcaaggatgtttgtgtcaaggttgcaaatgtcgagatatattacaaggcagtgcacttctatttgcaagaacaccctgatctcatcaatgatcttctcaacgtgcttgcacttcgtttggatcatacaagagttgttgatataatgcgcaaggctggtcagttgcatcttgtgaaaccgtacatggttgcagttcagagcaacaatgtatctgctgtcaatgaagctttgaatgaactgtatgtcgaagaggaggactatgagaggctccgtgaatctgttgatatgcatgataactttgaccagataggtcttgcccagaagcttgagaagcatgaattgctcgagatgaggaggattgcttcctacatatacaagaaggcgggcagatggaagcaatctattgccctgtcaaagaaggataacatgtacaaggattgcatggagacatgctcacaatctggtgatcgtgagctctcagaggatttgcttgtctattttatcgagcagggaaagaaggaatgttttgcttcttgcctcttcatttgctacgacttgattcgtgcagatgttgctcttgagcttgcatggacgaataacatgctggactttgctttcccttatctgttacagttcatccgtgagtacactagcaaggtagatgatttagtgaaggacaggattgaatcgcagaaggaagaaaaagctaaagagcaagaagagaaggaagtagttgcacagcagaacatgtatgcccagttgctccctctcgccttgcccgctccacctggtatgggagggatgggcatgcctccgatgggtggaatgggcatgccgcctccaatgggcggaatgggcatgccaccgatgggtcctggtccgatgccagcatacgggatgcctccaatgggaagctactgagcatatcttcctgtcatcgcttttgaagagtatagatgatgtcaaatatttcagttcacccagaggatctagaggcatctttgaaagatgtagatccgcgtcattgtttgctccagttaatattcttttggtaccaggacaattttggcgagcgaaatctctatattataacggtcggataggatcggcagcatgactaatgatttagggcccagttgagttggggagctgcagggttggaagaagaagattagaccggtaccatttgtataggtgttgaaaatgtttgtagacattctgcattgtacacttcgtcagtcaagtcagcgttggtgttggcagccagccataaaacacaaacacaaaatactgcctctgtatgtttactaccatctcatcatgttcagtgctttgggtttcttgtatgtacctgcaaaacagcctattctgaatctgcccattgtttctatagtttctttcctgc

SEQ ID NO: 5126 - DNA, 5643 bp, Secale cereale
acgcacgaccgacccccctcccctcacctccgactgtgtcctctcgccaccgccgtctgccgccatggcggcggccaacgcccccatcgccatgcgcgaggctctcacgctgacgagcctggggatcgcgccgcagttcatcaccttcacccacgtcaccatggagtcggacaggtacatctgcgtccgggagacctcgccgcagaacagcgtcgtcatcatcgacatggccatgcccagccagcccctccgcaggcccattaccgccgactccgcgctcatgaaccccaacaccaggatcctcgcgctcaaagctcaaatacctggaaccacgcaggatcacctgcaaatctttaatattgaagctaaaactaaaattaagtcacatcagatgcccgagcaggttgtattttggaaatggatcaccccaaagttgctgggtttggtaacacaggcatcggtgtatcactggtcaattgaaggagattctgagcccattaagatgtttgataggacagctaatttggctaataatcaaattatcaactatcggtgtgatccagcggagaagtggctcgtgcttattggaattgcacctggtgccccagagaggccacagctggtaaagggaaatatgcaacttttttctgtggatcagcagcgtagccaagcacttgaagcccatgctgcttcatttgcaacattgaaggttcctggcaacgagaacccatccaccctcatctgttttgcttctaaggcatctaatgctggaacagttacttctaagttgcatattattgaattgggtgcccagccagggaaacctggcttttccaagaaacaagccgatctcttcttcccaccagatttccaggatgactttcctgtagccatgcagatctctcaaaagtatggccttgtctatgtaattacgaagcttggtctgctgtttgtatatgacctggaaactgctgcggcagtttatcgaaatagaatcagtccagaccccatattcttgactgcagagtcttctacaaccggtggattttatgccattaatagaagagggcaggttttgcatgccacagttaacgatgcaactgttgtgccttttgtcagtggtcaattaaacaaccttgaacttgccgtgaatcttgccaaaagagccaatctccctggggcagagaacttggttgtgcaaagattccaggaactgtttgcacagacaaaatacaaggaagcagcagagttggctgcagaatcccctcagggtcttctacgaactccggagactgttgccaaattccagagtgttcctgttcaagctgggcaaacacctccactcttgcagtactttggcacattgcttactcgagggaagctcaatgcttacgaatccctcgagttatctcgacttgttgttaatcagaacaagaagaaccttttggaaaattggttggctgaagacaaattggagtgcagtgaagagcttggagatcttgtaaagacggtagacaatgatcttgcgctgaaaatatacataaaggctagggcaacccctaaagtcgtcgccgcttttgctgagaggagggagtttgacaagatccttatatactcaaagcaggttggatacactcctgactacctcttcctcctccagaccatcttacgtacagatccacagggagctgtcaactttgctctcatgatgtcacaaatggagggaggttgcccgctggattataataccataactgatctcttccttcagagaaatatgatacgagaagcaacagcttttctgttggatgttctgaaaccgaatttggaagaacatgcttttcttcaaaccaaggttttggagatcaacttggtaacttacccaaatgtcgctgatgccatccttgctaatggtatgttcagtcactatgatcgccctcgtattgctcagctgtgtgaaaaggctggcttgtacttgcgggctctccagcactatgcagagttacctgatatcaagcgtgttatcgtgaatacccatgctattgagccgcaggcactcgttgagttcttcggaactctttctaaagaatgggcattagaatgcatgaaggaccttcttctggtcaacctgagaggaaatcttcaaattgttgtgcaggctgccaaagaatactgcgagcagcttggagttgacgcttgtattaaattatttgaacaatttaaatcatacgaagggctctacttcttcttagggtcctatttgagctccagtgaggatccagatatccatttcaaatatatagaatcagctgcaaggactggacagattaaggaagttgagcgagtcacaagagagtctaatttttacgatgctgagaagacaaagaactttctgatggaagcaaaactacctgatgctcgtccactcataaatgtctgtgaccgctttggctttgttccagatcttactcactatctgtacacaaacaatatgctccggtacatcgaaggctatgtacagaaggtgaaccctggaaatgctccattggtagtggggcagttacttgatgatgagtgcccggaagatttcattaagggtttgattttgtctgttcgatctcttcttcctgttgagccactggttgatgaatgcgagaagaggaaccgtctacggttactgacacaattcttggagcacttagtgagcgagggtagtcaagatgtgcatgtccacaatgctcttgggaaaattatcattgacagcaacaacaatcctgagcacttccttactaccaacccgttctatgactcccgtgtggtgggtaaatactgtgaaaagagggatcctactcttgctgttgttgcttacagacgtggacagtgcgatgaagaacttatcaatgttaccaacaaaaactccctgttcaagctgcaagctaggtatgtggttgaaagaatggacggtgatctgtgggataaagttctacagcctgataatgaatatagaaggcagttcattgaccaagtggtttctactgcattgcccgaaagcaagagtcctgagcaagtttctgctgctgttaaggctttcatgacagctgacctccctcatgaactgattgaacttcttgagaagattgtccttcagaattctgcgttcagtggaaacttcaatcttcagaatctactcatcttgacagccatcaaggcagactcatctagggtcatggactatgttaacagactagacaactttgatggtcctgccgtcggagaagtagcagttgaagcacaactttatgaggaggcttttgccatattcaagaagttcaacttaaatgtgcaggctgtcgatgttctgttggataacatccgaagcatagaaagggcagaagagtttgcattccgtgttgaagaagatgctgtctggagccaggttgccaaggcccagttgcgtgaaggtctaatcagtgaagcaatcgagtccttcattcgtgcagatgatgtgacacatttccttgatgtcatccgtgctgctgaggaagccaatgtataccatgatttggtcaagtacttgctgatggtaaggcaaaaggcaagggaacccaaagtcgacagcgaactcatctttgcatatgctaagattgatagactcagtgacattgaagagtttattctgatgccgaatgttgccaatctccaaaatgttggcgaccgtctgtatgacgaagagctatatgaagctgcaaagatcatctatgccttcatctcaaactgggctaagctggctgtcaccttggtcaagctgaagcagttccagagtgctgtagatgctgcccgcaaggctaacagcgctaaaacatggaaggaggtctgctttgcttgtgttgacgctgaggagttccgtctagcacaaatctgtggtctcaacattatcgttcaggttgatgatttggaggaagtgagtgaatactaccagaacagaggttgtttcagtgaacttatttccctcatggagagtggtcttggacttgagcgggcacacatgggcatctttactgaattgggagttctctatgctagataccgccctgagaagctcatggaacacatcaaactcttctccacccgtctcaacattcctaagcttatccgtgcttgtgacgaacaacagcactggaaagagcttacatacctatacattcaatatgatgaatttgacaatgctgctaccactatcatgaaccattccccagatgcatgggatcacatgcaatttaaggatgtttgtgtcaaagttgcaaatgttgagatttattacaaggcagtgcatttctatttgcaagagcaccctgatctcatcaatgatcttctcaatgtgcttgcacttcgtttggatcataccagagttgtagatataatgcgcaaggctggtcagttgcatctggtgaaaccgtacatggttgcagttcagagcaacaatgtctctgctgtcaatgaagctttgaatgagctttatgtcgaagaagaggactacgagaggctccgtgaatctgttgacatgcatgataactttgatcagataggtcttgcccagaagcttgagaagcatgagttgcttgagatgagaaggattgctgcctacatttacaagaaggctggcagatggaagcaatctattgccctatcgaagaaagacaacatgtacaaggattgcatggagacatgctcacagtctggtgaccgcgagctctcagaggacttgcttgtctatttcatcgaacagggaaagaaagaatgttttgcttcttgcctcttcatttgctacgatttgattcgtgcggatgttgctcttgagcttgcatggacgaataacatgctggatttcgcgttcccctatcttttacagttcatccgcgagtacacaagcaaggtagatgatttggtgaaggacaggatagaatcgcagaaggaagagaaagctaaagagagcgaagagaaggaactagttgcgcagcagaacatgtacgctcaattgcttcctctggccttgcctgctccgcccggcatgatgggcggtccacctccgatgggtggaatgggcatgccgccgatgggcgggatgggtatgcccccgatgggtcctggtccaatgccagcatacgggatgccgccaatgggaagctactgagtcaaccagcctctgttgtatgaatttgaagagtacagatgatgtgaagtatttcagttgacgcagagggagggagagaatcatgaatgcccatccaagagaggtatcttccaaggtgtatatctgcgtcattggttgttccagtcaatattcttttggtaccaggacaattttggcaagcgaaatctctagccgagtaattacaggattgctatattatatatattatattacggtcggataggatgagcagcatgactggttaggcccctggtaccatttgtataggtgttatattgaaagtttgtagacattctgcatgtacactcgtcggtgttggtgttgctgccagccataaacacatcaaatactgtctgtatgttaattaccggtttcgatctcttgtccagtgtttggtttcttgtaactaaatgaacgcttttgttgaactt

SEQ ID NO: 5127 - DNA, 5718 bp, Brachypodium distachyon
atcttctcgcccccgtcgttggttccttcatcagatccgatctctctccgccgtcttcctcagccggagctctctctctctcgccaccgccgtctgccgccatggcggcggccgccaacgcccccatcgccatgcgcgaggcgctcacgctgacgagcctggggatcgcgccgcagttcgtcaccttcacgcacgtcaccatggagtcggaccgctacatctgcgtgcgcgagacctcgccgcagaacagcgtcgtcatcgtcgacatggccatgcccagccagccgctccgcaggcccatcaccgccgattccgccctcatgaaccccaacaccaggatcctcgccctcaaagcccaaatagctggaacgacgcaggatcacctacaaatcttcaatattgaagctaaaactaaagtaaagtcgcaccagatgcccgagcaggtcgtgttctggaaatggatcacccccaagttgttgggtttggtaacacaggcatccgtttatcactggtcaattgaaggggattctgaacccatcaagatgttcgataggacagctaatttggctaataatcagattatcaactaccgatgtgatccggcggagaagtggctggtgcttattggaattgcacctggtgctccagagaggccacagttggtgaaggggaatatgcaacttttttccgtagatcagcagcgaagccaggcacttgaagcccatgcagcatcttttgcaacatttaaggttcctggcaatgagaacccatcaaccctcatttgttttgcgtcgaagtcaactaatgctggacagattacttctaagttgcatgttatagaactgggtgcccagccagggaaacctggtttttccaagaagcaagcagatctcttcttccctccagatttccaggacgattttcctgtagccatgcagatctctcaaaagtatggccttatctatgtaattacgaagcttgggcttttgtttgtgtatgacttggaaactgctgcagcagtttatagaaacagaatcagcccagatcctatattcttgacagcagagtcttctacaactggtggattttatgccatcaacagaagagggcaggttttacatgccacagttaatgatgcaactgttgtgccatttgtcagtggccaattaaacaaccttgagctagctgtgaatcttgctaaaagagctaatcttcctggggcggagaacttggttgtgcaaagattccaggaactgttttcgcaaacaaaatacaaggaagcggcggagctggctgcagaatctcctcagggtcttctgcgaacccccgagactgttgcgaaatttcagagtgttcctgttcaagctgggcaaacacctccactcttgcagtactttggcacattactaactcgagggaagctcaatgcttacgagtctctggagttatctcgacttgttgtcaatcagaacaaaaagaatctattggaaaattggttggcagaagacaagttggagtgcagtgaagagcttggagatcttgttaagacggtagataatgaccttgcattgaaaatatacatcaaggctagggcaacccctaaagtcgttgccgcttttgctgaaaggagggagtttgacaagatccttatatactcgaagcaggttggatacactccggattacctcttcctcctccagactatcctacgtacagatccacagggagctgtcaactttgctctcatgatgtcacaaatggagggtggttgcccgttagattataatactataactgatctcttccttcagagaaatatgatacgagaggcaaccgcctttctgctggatgttctgaaaccaaacttggaagagcatggttttcttcaaaccaaggttttggagatcaacttggtgacttaccctaatgttgctgatgccatccttgctaacggtatgttcagtcattatgaccgtcctcgcattgctcagctgtgtgaaaaggctggcttgtacttgcgagctcttcagcactatgcagagttacctgatatcaaacgtgtcatcgtgaatacccacgccatcgagccacaggcactcgttgagttttttggcaccctttcaaaggaatgggcactagagtgcatgaaggaccttctactggtcaatcttagaggaaaccttcagatagttgtgcaggctgccaaagaatactccgagcagctaggagtcgatgcttgcattaaactatttgagcaatttaaatcttatgagggcctctacttcttcttgggatcctatttgagctccagtgaggacccagatatccacttcaagtacatagaatcagctgcaaggactgggcagatcaaagaagttgagcgtgtgaccagagagtctaatttctatgacgctgagaagacaaagaactttctgatggaagcaaaactacctgatgctcgtccactgattaatgtctgtgaccgctttggttttgttccagatctgactcactatctgtacacaaataacatgctccggtatattgaaggctatgtacagaaggtgaaccctggaaatgccccgttggttgtggggcagctgcttgatgacgagtgccctgaagatttcataaagggtctgatcctatctgttcgctctctccttcctgttgagccacttgtcgacgaatgcgagaagaggaaccgtcttcgtctgcttacacaatttttggagcacttggtgagcgagggtagccaagatgtgcatgtccataatgctcttgggaaaattatcatcgatagcaacaacaatccagagcatttccttactaccaacccattttatgactctcgtgtggtgggtaaatattgtgaaaagcgggatcccacgcttgctgttgttgcttacaggcgtggacagtgtgatgaggaacttattaatgttaccaacaaaaactcactgttcaagctgcaagctaggtacgtggttgaaagaatggatggtgatctgtgggataaagttctactgcctgaaaatgaatacagaaggcagttcattgaccaagtggtttctactgcgttgcctgaaagcaagagccctgagcaagtttctgctgctgtcaaggctttcatggaagctgacctcccgcatgaactgattgaacttcttgaaaagatcgttcttcagaattctgcattcagcggaaacttcaatcttcagaacctgcttatcttgacagccatcaaggcagacccatccagggtcatggactatgtcaacagactagacaactttgatggccctgccgttggagaagtagctgttgaggcacaactgtatgaggaggctttcgccatattcaagaagttcaacttaaatgtgcaggctgtcaatgttctgttagataacatccgaagcatagaaagagctgaagagtttgcattccgtgtggaggaagatgctgtttggagccaggttgctaaggcccagttgcgtgaaggtttagtcagcgaagcaattgagtccttcattcgtgcggatgatgcagcacatttccttgatgtcatccgtgctgctgaggaagctgatgtataccatgatttggtcaagtacttgcttatggtcaggcaaaaggcaagggagcccaaagttgatggagaactcatcttcgcatatgctaagattgacaggctcagtgacatcgaggagtttattcttatgccaaatgttgccaatctccaaaatgttggtgaccgtctgtatgatgaagaactttatgaagctgcaaagattatctatgccttcatttcgaactgggctaagctggctgtcacccttgtcaagctgaagcagttccaaggtgccgtagatgctgctcgcaaggctaacagcgctaaaacatggaaagaggtttgctttgcttgcgttgatgctcaggagttccgtctagcacaaatatgtggtctcaatattattgtccaggttgatgacttggaagaagtgagtgaatactatcagaacagaggatgtttcgatgaacttatatctctcatggagagtggtcttggactagagcgtgcacacatgggcatcttcacagaactgggagtcctttatgctagataccgcactgggaaactcatggaacacatcaaacttttctccacacgtctcaacattcctaagcttatccgtgcttgtgatgaacaacaacactggaaagagcttacttatctgtacatacaatatgatgaatttgacaatgccgccaccactattatgaaccattctccagatgcatgggatcatatgcaatttaaggatgttgctgtgaaagttgcaaatgttgagatatattacaaggccgtgcacttctatttgcaagagcaccctgatctcatcaatgatcttctcaacgtgcttgcacttcgcttggatcacacaagagttgtagacataatgcgcaaggcgggccagttgcatcttgtgaaaccatacatggttgctgttcagagcaacaatgtctctgctgtcaacgaggctttgaatgaactttatgttgaagaggaggactacgagagactccgtgaatcagttgacatgcatgataactttgatcagattggtcttgcccagaagcttgagaagcatgaattgcttgagatgaggaggattgctgcttatatttacaagaaagctggcagatggaagcaatctattgccctgtcgaagaaagacaacatgtacaaggattgcatggagacatgctcgcagtctggtgaccgtgagctgtctgaggatttgcttgtctatttcatcgagcagggaaagaaagaatgttttgcttcttgccttttcatttgttacgacttgattcgtgcggatgttgctcttgagcttgcgtggacgaacaacatgttggactttgctttcccctacctgctacagttcatccgtgagtacacaagcaaggtagatgacttggtgaaggacaggattgaatcacagaaagaagagaaagctaaagagcaagaagagaaggacgtcgtcgctcagcagaacatgtacgctcaattgcttcctctcgccttgcctgctccgcctggtatgggcggtccacctccaatggggatgcctccaatgggcgggatgggcatgccgccgatgggcgggatgggtatgcctccgatgccagcatacgggatgcctccgatgggaagctactgagctatcgtcactggcggcttttgaagaacatagatgatgccgattgttttagttatttacagtggtgaagaggatccctgatgagtcattcaaagttgtagattttgggctattggttgtttaaatttaacattcttttggtaccagagacaattttggcgagcaagatgtgtaaccgaacttggtggttgctaaatgtattacggccgggtaggatgaggatgattaggcagggagaggttggggagagtggtgccatatttgtataggctgtgtgattacaaagtttgtagacattttgcatgtacactcttgtctgtctgtcgtcagtgttggtgttgccagccatgaacataaacactgcatgtatgttattactatatatgtttacgttcccatgtatcttgtcttgaatgaagctgtgtattcttggcagtgtgagtaaaaaggtcacaatttctttgcgtggaatggacgggacaatgatata

SEQ ID NO: 5128 - DNA, 5587 bp, Brachypodium distachyon
ctctcgccaccgccgtctgccgccatggcggcggccgccaacgcccccatcgccatgcgcgaggcgctcacgctgacgagcctggggatcgcgccgcagttcgtcaccttcacgcacgtcaccatggagtcggaccgctacatctgcgtgcgcgagacctcgccgcagaacagcgtcgtcatcgtcgacatggccatgcccagccagccgctccgcaggcccatcaccgccgattccgccctcatgaaccccaacaccaggatcctcgccctcaaagcccaaatagctggaacgacgcaggatcacctacaaatcttcaatattgaagctaaaactaaagtaaagtcgcaccagatgcccgagcaggtcgtgttctggaaatggatcacccccaagttgttgggtttggtaacacaggcatccgtttatcactggtcaattgaaggggattctgaacccatcaagatgttcgataggacagctaatttggctaataatcagattatcaactaccgatgtgatccggcggagaagtggctggtgcttattggaattgcacctggtgctccagagaggccacagttggtgaaggggaatatgcaacttttttccgtagatcagcagcgaagccaggcacttgaagcccatgcagcatcttttgcaacatttaaggttcctggcaatgagaacccatcaaccctcatttgttttgcgtcgaagtcaactaatgctggacagattacttctaagttgcatgttatagaactgggtgcccagccagggaaacctggtttttccaagaagcaagcagatctcttcttccctccagatttccaggacgattttcctgtagccatgcagatctctcaaaagtatggccttatctatgtaattacgaagcttgggcttttgtttgtgtatgacttggaaactgctgcagcagtttatagaaacagaatcagcccagatcctatattcttgacagcagagtcttctacaactggtggattttatgccatcaacagaagagggcaggttttacatgccacagttaatgatgcaactgttgtgccatttgtcagtggccaattaaacaaccttgagctagctgtgaatcttgctaaaagagctaatcttcctggggcggagaacttggttgtgcaaagattccaggaactgttttcgcaaacaaaatacaaggaagcggcggagctggctgcagaatctcctcagggtcttctgcgaacccccgagactgttgcgaaatttcagagtgttcctgttcaagctgggcaaacacctccactcttgcagtactttggcacattactaactcgagggaagctcaatgcttacgagtctctggagttatctcgacttgttgtcaatcagaacaaaaagaatctattggaaaattggttggcagaagacaagttggagtgcagtgaagagcttggagatcttgttaagacggtagataatgaccttgcattgaaaatatacatcaaggctagggcaacccctaaagtcgttgccgcttttgctgaaaggagggagtttgacaagatccttatatactcgaagcaggttggatacactccggattacctcttcctcctccagactatcctacgtacagatccacagggagctgtcaactttgctctcatgatgtcacaaatggagggtggttgcccgttagattataatactataactgatctcttccttcagagaaatatgatacgagaggcaaccgcctttctgctggatgttctgaaaccaaacttggaagagcatggttttcttcaaaccaaggttttggagatcaacttggtgacttaccctaatgttgctgatgccatccttgctaacggtatgttcagtcattatgaccgtcctcgcattgctcagctgtgtgaaaaggctggcttgtacttgcgagctcttcagcactatgcagagttacctgatatcaaacgtgtcatcgtgaatacccacgccatcgagccacaggcactcgttgagttttttggcaccctttcaaaggaatgggcactagagtgcatgaaggaccttctactggtcaatcttagaggaaaccttcagatagttgtgcaggctgccaaagaatactccgagcagctaggagtcgatgcttgcattaaactatttgagcaatttaaatcttatgagggcctctacttcttcttgggatcctatttgagctccagtgaggacccagatatccacttcaagtacatagaatcagctgcaaggactgggcagatcaaagaagttgagcgtgtgaccagagagtctaatttctatgacgctgagaagacaaagaactttctgatggaagcaaaactacctgatgctcgtccactgattaatgtctgtgaccgctttggttttgttccagatctgactcactatctgtacacaaataacatgctccggtatattgaaggctatgtacagaaggtgaaccctggaaatgccccgttggttgtggggcagctgcttgatgacgagtgccctgaagatttcataaagggtctgatcctatctgttcgctctctccttcctgttgagccacttgtcgacgaatgcgagaagaggaaccgtcttcgtctgcttacacaatttttggagcacttggtgagcgagggtagccaagatgtgcatgtccataatgctcttgggaaaattatcatcgatagcaacaacaatccagagcatttccttactaccaacccattttatgactctcgtgtggtgggtaaatattgtgaaaagcgggatcccacgcttgctgttgttgcttacaggcgtggacagtgtgatgaggaacttattaatgttaccaacaaaaactcactgttcaagctgcaagctaggtacgtggttgaaagaatggatggtgatctgtgggataaagttctactgcctgaaaatgaatacagaaggcagttcattgaccaagtggtttctactgcgttgcctgaaagcaagagccctgagcaagtttctgctgctgtcaaggctttcatggaagctgacctcccgcatgaactgattgaacttcttgaaaagatcgttcttcagaattctgcattcagcggaaacttcaatcttcagaacctgcttatcttgacagccatcaaggcagacccatccagggtcatggactatgtcaacagactagacaactttgatggccctgccgttggagaagtagctgttgaggcacaactgtatgaggaggctttcgccatattcaagaagttcaacttaaatgtgcaggctgtcaatgttctgttagataacatccgaagcatagaaagagctgaagagtttgcattccgtgtggaggaagatgctgtttggagccaggttgctaaggcccagttgcgtgaaggtttagtcagcgaagcaattgagtccttcattcgtgcggatgatgcagcacatttccttgatgtcatccgtgctgctgaggaagctgatgtataccatgatttggtcaagtacttgcttatggtcaggcaaaaggcaagggagcccaaagttgatggagaactcatcttcgcatatgctaagattgacaggctcagtgacatcgaggagtttattcttatgccaaatgttgccaatctccaaaatgttggtgaccgtctgtatgatgaagaactttatgaagctgcaaagattatctatgccttcatttcgaactgggctaagctggctgtcacccttgtcaagctgaagcagttccaaggtgccgtagatgctgctcgcaaggctaacagcgctaaaacatggaaagaggtttgctttgcttgcgttgatgctcaggagttccgtctagcacaaatatgtggtctcaatattattgtccaggttgatgacttggaagaagtgagtgaatactatcagaacagaggatgtttcgatgaacttatatctctcatggagagtggtcttggactagagcgtgcacacatgggcatcttcacagaactgggagtcctttatgctagataccgcactgggaaactcatggaacacatcaaacttttctccacacgtctcaacattcctaagcttatccgtgcttgtgatgaacaacaacactggaaagagcttacttatctgtacatacaatatgatgaatttgacaatgccgccaccactattatgaaccattctccagatgcatgggatcatatgcaatttaaggatgttgctgtgaaagttgcaaatgttgagatatattacaaggccgtgcacttctatttgcaagagcaccctgatctcatcaatgatcttctcaacgtgcttgcacttcgcttggatcacacaagagttgtagacataatgcgcaaggcgggccagttgcatcttgtgaaaccatacatggttgctgttcagagcaacaatgtctctgctgtcaacgaggctttgaatgaactttatgttgaagaggaggactacgagagactccgtgaatcagttgacatgcatgataactttgatcagattggtcttgcccagaagcttgagaagcatgaattgcttgagatgaggaggattgctgcttatatttacaagaaagctggcagatggaagcaatctattgccctgtcgaagaaagacaacatgtacaaggattgcatggagacatgctcgcagtctggtgaccgtgagctgtctgaggatttgcttgtctatttcatcgagcagggaaagaaagaatgttttgcttcttgccttttcatttgttacgacttgattcgtgcggatgttgctcttgagcttgcgtggacgaacaacatgttggactttgctttcccctacctgctacagttcatccgtgagtacacaagcaaggtagatgacttggtgaaggacaggattgaatcacagaaagaagagaaagctaaagagcaagaagagaaggacgtcgtcgctcagcagaacatgtacgctcaattgcttcctctcgccttgcctgctccgcctggtatgggcggtccacctccaatggggatgcctccaatgggcgggatgggcatgccgccgatgggcgggatgggtatgcctccgatgccagcatacgggatgcctccgatgggaagctactgagctatcgtcactggcggcttttgaagaacatagatgatgccgattgttttagttatttacagtggtgaagaggatccctgatgagtcattcaaagttgtagattttgggctattggttgtttaaatttaacattcttttggtaccagagacaattttggcgagcaagatgtgtaaccgaacttggtggttgctaaatgtattacggccgggtaggatgaggatgattaggcagggagaggttggggagagtggtgccatatttgtataggctgtgtgattacaaagtttgtagacattttgcatgtacactcttgtctgtctgtcgtcagtgttggtgttgccagccatgaacataaacactgcatgtatgttattactatatatgtttacgttcccatgtatcttgtcttgaatgaagctgtgtattcttggcag

SEQ ID NO: 5129 - DNA, 5595 bp, Hordeum vulgare
cggccaacgcccccatcgccatgcgcgaggccctcacgctcacgagcctggggatcgcgccgcagttcatcaccttcacccatgtcaccatggagtcggacaggtacatctgcgtgcgggagacctcgccgcagaatagcgtcgtcatcatcgacatggccatgcctagccagcccctccgcaggcccattaccgccgactccgcgctcatgaaccccaacaccaggatcctcgcgctcaaagctcaaatacctggaaccacgcaggatcacctgcaaatctttaatattgaagctaaaactaaaattaagtcacaccagatgcctgagcaggttgtgttttggaaatggatcaccccaaagttgctggggttggtaacacaggcatcagtgtatcactggtcaattgaaggagattctgagcccactaagatgtttgataggacagctaatctggctaataatcagattatcaactatcgttgtgatccagcggagaagtggctcgtgcttattggaattgcacctggtgccccagagaggccacagctggtaaagggaaatatgcaacttttttctgtggatcagcagcgtagccaagctcttgaagcccatgctgcttcatttgcaacattcaaggttcctggcaacgagaacccatccaccctcatctgttttgcttctaaggcatctaatgctggaacacttacttctaagttgcatattattgaattgggcgcccagccagggaaacctggcttttccaagaaacaagccgatctcttcttcccaccagatttccaggatgactttcctgtagccatgcagatctctcaaaagtatggccttgtctacgtaatcacgaagcttggtctgctgtttgtatatgacctggaaactgctgcggcagtttatagaaatagaatcagtccagaccccatattcttgactgcagagtcttctacaactggtggattttatgccattaatagaagagggcaggttttgcatgccacagttaacgatgcaactgttgtgccttttgtcagtggtcaattaaacaatcttgaacttgccgtgaatcttgccaaaagagccaatcttcctggtgcagagaacttggttgtgcaaagattccaggaactgtttgcacagacaaaatacaaggaagcagcagagttggctgcagaatcccctcagggtcttctacgaactccagagactgttgccaaattccagagtgttcctgttcaagctgggcaaacacctccactcttgcagtactttggcacattgcttactcgaggcaagctcaatgcttacgaatccctcgaattatctcgacttgttgtcaatcagaacaagaagaaccttttggaaaattggttggcagaagacaagttggagtgcagtgaagagcttggagatcttgtaaagacggtggacaatgatcttgcgctgaaaatatacataaaggctagggcaacccctaaagttgtcgctgcttttgctgagaggagggagtttgacaagatccttatatactcaaagcaggttggatacactcctgactacctcttcctcctccagaccatcttacgtacggatccacagggagctgtcaactttgctctcatgatgtcacaaatggaggggggttgcccactggattataataccataactgatctcttccttcagagaaatatgatacgagaagcaacagcttttctgttggatgttctgaaaccaaatttggaagaacatgcttttcttcagaccaaggtcttggagatcaacttggtaacttacccaaatgttgctgatgccatccttgctaatggtatgttcagtcactacgaccgccctcgtattgctcagctgtgtgaaaaggctggcttgtacttgcgggctctccaacactatgcagagttacctgatattaagcgtgttatcgtgaatacccatgctattgagccgcaggcacttgttgagttcttcggaactctttctaaagaatgggcattagaatgcatgaaggaccttctactggtcaacctgagagggaatcttcaaattgttgtgcaggctgccaaagaatactgcgagcagcttggagttgacgcttgtattaaactatttgaacaatttaaatcatacgaagggctctacttcttcttagggtcctatttgagctccagtgaggatccagatatccatttcaaatatatagaatcagctgcaaggactggacagattaaagaagttgagcgagtcacaagagagtctaatttttacgatgctgagaagacaaagaactttctgatggaagcaaaactacctgatgcccgtccactcataaatgtctgcgaccgctttggctttgttccagatcttactcactatctgtacacaaacaatatgctccgatacatcgaaggctatgtacagaaggtgaaccctggaaatgctccgttggtagtggggcagttacttgatgacgagtgcccggaagatttcattaagggtttgattttgtctgttcgatctcttcttcctgtcgagccactggttgatgaatgcgagaagaggaaccgtctacgtttgctgacacaattcttggagcacttagtgagcgagggtacccaagatgtgcatgtccacaatgctcttgggaaaattatcattgacagcaacaacaatcctgagcatttccttactaccaacccattctatgactcccgtgtggtgggtaaatactgtgaaaagagggatcctactcttgctgttgttgcttacagacgtggacagtgcgatgaagaacttatcaatgttaccaacaaaaactcgctgttcaagctgcaagctaggtatgtggttgaaagaatggacggtgatctgtgggataaagttctacagcctgataacgaatatagaaggcaattcattgaccaagtggtttctactgcattgcccgaaagcaagagtcctgagcaagtttcagctgctgttaaggctttcatgacagctgacctccctcatgaactgattgaacttcttgagaagattgtccttcagaattccgcgttcagtggaaacttcaatcttcagaatctgctcatcttgacagccatcaaggcggactcatctagggtcatggactatgttaacagactagacaactttgatggtcctgccgtcggagaagttgcagttgaagcacaactttatgaggaggcttttgccatattcaagaagttcaacttaaatgtgcaggctgtcgatgttctgttggataacatccgaagcatagaaagggcggaagagtttgcattccgtgttgaagaagatgctgtctggagccaggttgccaaggcccagttgcgtgaaggtttagtcagcgaagcaatcgagtccttcattcgtgccgatgatgtgacacatttccttgatgtcatccgtgctgctgaggaagccaatgtataccatgatttggtcaagtacttgctgatggttaggcaaaaggcaagggagcccaaagttgacagcgaactcatctttgcatatgctaagattgatagactcaatgacattgaagagtttattctgatgccgaatgttgccaatctccaaaatgttggtgaccgtctgtatgacgaagaactctatgaagctgcaaagatcatctatgccttcatttcaaactgggctaagctggctgtcaccttggtcaagctgaagcagttccaaggtgctgtagatgctgctcgcaaggctaacagcgctaaaacatggaaggaggtctgctttgcttgtgttgatgctgaggagttccgtctggcacaaatctgtggtctcaacattatcgttcaggttgatgacttggaggaagtgagtgaatactaccagaacagaggatgtttcagtgaacttatttccctcatggagagtgggcttggacttgagcgggcacacatgggcatctttactgaattgggagttctctatgctagataccgccctgagaagctcatggaacacatcaaactcttctccacccgtctcaacattcctaagctcatccgtgcttgtgatgaacaactgcactggaaagagcttacatacctatacattcagtatgatgaatttgacaatgctgctaccactatcatgaaccattctccagatgcatgggatcacatgcaatttaaggatgtttgtgttaaagttgcaaatgttgagatttattacaaggctgtgcatttctatttgcaagagcaccctgatctcatcaatgatcttctcaatgtgcttgcacttcgtttggatcataccagagttgtagatataatgcgcaaggctggtcagttgcatcttgtgaaaccatacatggttgcagttcagagcaacaatgtctctgccgtcaatgaagctttgaatgagctttatgtcgaagaggaagactacgagaggctccgtgaatctgttgacatgcatgataactttgatcagataggtcttgctcagaagcttgagaagcatgagttgcttgagatgagaaggattgctgcctacatttacaagaaggctggcagatggaagcaatctattgccctctcgaagaaagacaacatgtacaaggattgcatggagacatgctcacagtctggtgaccgtgagctctcagaggacttgcttgtctatttcatcgaacagggaaagaaagaatgttttgcttcttgcctcttcatttgctacgacttgattcgtgcggatgttgctcttgagcttgcatggacgaataacatgctggatttcgcgttcccctatctattacagttcatccgtgagtacacaagcaaggtagatgatttggtgaaggacaggatagaatcgcagaaggaagagaaagctaaagataacgaagagaaggaactagttgcgcagcagaacatgtacgctcaattgcttcctctggccttgcctgctccgcctggtatgatgggcggtccgccacctccgatgggcggaatgggcatgccgccaatgggcgggatgggtatgcctccgatgggtcccggtccaatgccagcatacgggatgcctccaatgggaagctactgagtcaaccaacctctgttgtatgaatttgtagagtacagatgatgtgaaatatctcagctgacgcggagggaggaaatcatgagaatgtatcccagagaggtatcttccaaggtgtatatctgcgtcattggttgtgttccagttaatattcttttggtaccaggacaattttggcaagcgaaatctctagccgagtttgagttaattacaggatgctatattatatatattacggtcggataggatgagcagcagcatgactggttaggcccctggtaccatttgtataggtgttctattgaaagtttgtagacattctgcatgtacacttgtcggtgttggtgttgccgccagccataaacacaaatactgtctgtatgttaattaccggtttcgatctcttttgtccagtgcttagatttttgtagctgaatgaacgctttctttgaacaacagtatattctttagttgc

SEQ ID NO: 5130 - DNA, 5384 bp, Secale cereale
agaacagcgtcgtcatcatcgacatggccatgcccagccagcccctccgcaggcccattaccgccgactccgcgctcatgaaccccaacaccaggatcctcgcgctcaaagctcaaatacctggaaccacgcaggatcacctgcaaatctttaatattgaagctaaaattaaaattaagtcacatcagatgcccgagcaggttgtattttggaaatggatcaccccaaagttgctgggtttggtaacacaggcatcggtgtatcactggtcaattgaaggagattctgagcccattaagatgtttgataggacagctaatttggctaataatcaaattatcaactatcggtgtgatccagcggagaagtggctcgtgcttattggaattgcacctggtgccccagagaggccacagctggtaaagggaaatatgcaacttttttctgtggatcagcagcgtagccaagcacttgaagcccatgctgcttcatttgcaacattgaaggttcctggcaacgagaacccatccaccctcatctgttttgcttctaaggcatctaatgctggaacagttacttctaagttgcatattattgaattgggtgcccagccagggaaacctggcttttccaagaaacaagccgatctcttcttcccaccagatttccaggatgactttcctgtagccatgcagatctctcaaaagtatggccttgtctatgtaattacgaagcttggtctgctgtttgtatatgacctggaaactgctgcggcagtttatcgaaatagaatcagtccagaccccatattcttgactgcagagtcttctacaaccggtggattttatgccattaatagaagagggcaggttttgcatgccacagttaacgatgcaactgttgtgccttttgtcagtggtcaattaaacaaccttgaacttgccgtgaatcttgccaaaagagccaatctccctggggcagagaacttggttgtgcaaagattccaggaactgtttgcacagacaaaatacaaggaagcagcagagttggctgcagaatcccctcagggtcttctacgaactccggagactgttgccaaattccagagtgttcctgttcaagctgggcaaacacctccactcttgcagtactttggcacattgcttactcgagggaagctcaatgcttacgaatccctcgagttatctcgacttgttgttaatcagaacaagaagaaccttttggaaaattggttggctgaagacaaattggagtgcagtgaagagcttggagatcttgtaaagacggtagacaatgatcttgcgctgaaaatatacataaaggctagggcaacccctaaagtcgtcgccgcttttgctgagaggagggagtttgacaagatccttatatactcaaagcaggttggatacactcctgactacctcttcctcctccagaccatcttacgtacagatccacagggagctgtcaactttgctctcatgatgtcacaaatggagggaggttgcccgctggattataataccataactgatctcttccttcagagaaatatgatacgagaagcaacagcttttctgttggatgttctgaaaccgaatttggaagaacatgcttttcttcaaaccaaggttttggagatcaacttggtaacttacccaaatgtcgctgatgccatccttgctaatggtatgttcagtcactatgatcgccctcgtattgctcagctgtgtgaaaaggctggcttgtacttgcgggctctccagcactatgcagagttacctgatatcaagcgtgttatcgtgaatacccatgctattgagccgcaggcactcgttgagttcttcggaactctttctaaagaatgggcattagaatgcatgaaggaccttcttctggtcaacctgagaggaaatcttcaaattgttgtgcaggctgccaaagaatactgcgagcagcttggagttgacgcttgtattaaattatttgaacaatttaaatcatacgaagggctctacttcttcttagggtcctatttgagctccagtgaggatccagatatccatttcaaatatatagaatcagctgcaaggactggacagattaaggaagttgagcgagtcacaagagagtctaatttttacgatgctgagaagacaaagaactttctgatggaagcaaaactacctgatgctcgtccactcataaatgtctgtgaccgctttggctttgttccagatcttactcactatctgtacacaaacaatatgctccggtacatcgaaggctatgtacagaaggtgaaccctggaaatgctccattggtagtggggcagttacttgatgatgagtgcccggaagatttcattaagggtttgattttgtctgttcgatctcttcttcctgttgagccactggttgatgaatgcgagaagaggaaccgtctacggttactgacacaattcttggagcacttagtgagcgagggtagtcaagatgtgcatgtccacaatgctcttgggaaaattatcattgacagcaacaacaatcctgagcacttccttactaccaacccgttctatgactcccgtgtggtgggtaaatactgtgaaaagagggatcctactcttgctgttgttgcttacagacgtggacagtgcgatgaagaacttatcaatgttaccaacaaaaactccctgttcaagctgcaagctaggtatgtggttgaaagaatggacggtgatctgtgggataaagttctacagcctgataatgaatatagaaggcagttcattgaccaagtggtttctactgcattgcccgaaagcaagagtcctgagcaagtttctgctgctgttaaggctttcatgacagctgacctccctcatgaactgattgaacttcttgagaagattgtccttcagaattctgcgttcagtggaaacttcaatcttcagaatctactcatcttgacagccatcaaggcagactcatctagggtcatggactatgttaacagactagacaactttgatggtcctgccgtcggagaagtagcagttgaagcacaactttatgaggaggcttttgccatattcaagaagttcaacttaaatgtgcaggctgtcgatgttctgttggataacatccgaagcatagaaagggcagaagagtttgcattccgtgttgaagaagatgctgtctggagccaggttgccaaggcccagttgcgtgaaggtctaatcagtgaagcaatcgagtccttcattcgtgcagatgatgtgacacatttccttgatgtcatccgtgctgctgaggaagccaatgtataccatgatttggtcaagtacttgctgatggtaaggcaaaaggcaagggaacccaaagtcgacagcgaactcatctttgcatatgctaagattgatagactcagtgacattgaagagtttattctgatgccgaatgttgccaatctccaaaatgttggcgaccgtctgtatgacgaagagctctatgaagctgcaaagatcatctatgccttcatctcaaactgggctaagctggctgtcaccttggtcaagctgaagcagttccagagtgctgtagatgctgcccgcaaggctaacagcgctaaaacatggaaggaggtctgctttgcttgtgttgacgctgaggagttccgtctagcacaaatctgtggtctcaacattatcgttcaggttgatgatttggaggaagtgagtgaatactaccagaacagaggttgtttcagtgaacttatttccctcatggagagtggtcttggacttgagcgggcacacatgggcatctttactgaattgggagttctctatgctagataccgccctgagaagctcatggaacacatcaaactcttctccacccgtctcaacattcctaagcttatccgtgcttgtgatgaacaacagcactggaaagagcttacatacctatacattcaatatgatgaatttgacaatgctgctaccactatcatgaaccattccccagatgcatgggatcacatgcaatttaaggacgtttgtgtcaaagttgcaaatgttgagatttattacaaggcagtgcatttctatttgcaagagcaccctgatctcatcaatgatcttctcaatgtgcttgcacttcgtttggatcataccagagttgtagatataatgcgcaaggctggtcagttgcatctggtgaaaccgtacatggttgcagttcagagcaacaatgtctctgctgtcaatgaagctttgaatgagctttatgtcgaagaggaggactacgagaggctccgtgaatctgttgacatgcatgataactttgatcagataggtcttgcccagaagcttgagaagcatgagttgcttgagatgagaaggattgctgcctacatttacaagaaggctggcagatggaagcaatctattgccctatcgaagaaagacaacatgtacaaggattgcatggagacatgctcacagtctggtgaccgtgagctctcagaggacttgcttgtctatttcatcgaacagggaaagaaagaatgttttgcttcttgcctcttcatttgctacgatttgattcgtgcggatgttgctcttgagcttgcatggacgaataacatgctggatttcgcgttcccctatctattacagttcatccgcgagtacacaagcaaggtagatgagttggtgaaggacaggatagaatcgcagaaggaagagaaagctaaagagagcgaagagaaggaactagttgcgcagcagaacatgtacgctcaattgcttcctctggccttgcctgctccgcccggcatgatgggcggtccacctccaatgggtggaatgggcatgccgccgatgggcgggatgggtatgcccccgatgggtcctggtccaatgccagcatacgggatgcctccaatgggaagctactgagtcaaccagcctctgttgtatgaatttgaagagtacagatgatgtgaagtatttcagttgacgcagagggagggagagaatcatgaatgcccatcccagagaggtatcttccaaggtgtatatctgcgtcattggttgttccagtcaatattcttttggtaccaggacaattttggcaagcgaaatctctagccgagttggagttaattacaggattgctatattatatatattatattacggtcggataggatgagcagcatgactggttaggcccctggtaccatttgtataggtgttatattaaaagtttgtagacattctgcatgtacactcgtcggttttggtgttgctgccagccataaacacatcaaatactgtctgtatgttaattac

SEQ ID NO: 5131 - DNA, 5672 bp, Elaeis guineensis
ctcttccacccacctcctctcctccctctcggaacgggtttcgccgcctcagatccaaggtagtctccgtagatctccttcggctcctctcacgctgccggattcctaggcaagaaccccgagggaggccccgatccagtcaccatggccgcggccaacgctcccatcagcatgcgggaggccttgacgcttccgactattggaattaatccgcaattcatcacatttacgcacgtaacgatggaatcagagaagtatatatgtgtcagggagacgtctccacagaacagcgtggttatcatcgacatgaacatgccgatgcagccgttgaggagacctattactgcagactcggctttgatgaatcctaacagcaggattcttgctcttaaagctcaaataccaggaactactcaggatcaccttcaagtattcaatattgagatgaagactaaaatgaaatcacaccagatgcctgagcaggttgtcttttggaagtggatcaccccaaagatgctggggctggttactcaaacctcagtttaccattggtcaatagaaggtgattcggagcctgttaagatgtttgacaggacagctaatttgacaaacaatcagatcattaattaccgttgtgaccccatggagaagtggctagttctgattggaattgcacctggtgcccctgagagaccacaactagtcaaaggaagtatgcagcttttttctgtggatcagcaacgcagtcaggcccttgaagcacatgctgcatcctttgcatcatttaaggttgctggcaatgaaaacccctccattcttatttgttttgctacaaagacttctaatgctggacagattacttcaaagctgcatgttattgaacttggtgcccagccagggaagcctgggttttcaaagaaacaagcagatctgtttttcccacctgattttgctgatgacttccccgtggcaatgcagatctcacagaagtacagtttgatatatgtgatcacaaagcttggtctgctatttgtgtatgatttggagacagcaacagcagtctatagaaatcgaattagcccggatcctatatttctgacagcagaggcttcatctattggtggtttttatgctgttaataggcgggggcaggttctgcttgctactgttaatgaggcaactattgtgcccttcgtcagtggtcaattgaacaatctggagctagctgttaatctcgccaaacgaggaaatcttccaggggcagagaatctggttgtgcagaggttccaggaactattctctcagacaaaatacaaggaagctgctgaacttgctgcagaatctccacaaggcattctgagaactcctgagactgtcgcaaaatttcagagcgttcctgtacaatctgggcaaacaccaccgctattgcagtattttggaacattgctaactagaggaaaactcaatgcctttgagtctttggagttgtctcgcctagttgtgaatcagaacaaaaaaatctattagaaaattggttggctgaggacaagcttgagtgcagtgaagaacttggggatcttgtgaagactgtggacaatgatcttgcactgaaaatatatataaaagcaagggctactccaaaagttgttgctgcttttgcagaacgaagggagtttgacaagattctcatatactccaagcaggttggatacacaccagattatcttttccttctgcagacaattctacggtcagatcctcagggagctgtcaattttgctcttatgatgtcacaaatggagggtggctgtccagtggattataatacgatcacagatctattccttcagaggaacatgatccgagaggcaacagcttttctgttagatgttttaaagccaaatctacctgagcatgctttccttcaaaccaaggtcttggagatcaatctggtgacatatcctaatgtggcagatgctatattagctaatggaatgttcagtcattacgatcgcccccggatagctcaactatgtgagaaagctgggttgtatatgagagcccttcagcactatacagaattacctgatatcaaacgtgttattgtgaacactcatgccattgagccacaggcgctagtggaattcttcggtacactttctaaagagtgggcattagagtgcatgaaagatcttttgatggtcaacctgagaggaaatcttcagataatcgttcaggttgctaaggaatattccgagcagttaggtttggaagcatgcataaaactatttgagcaatttaagtcctacgaaggtctttacttctttttgggttcatatctgagttccagtgaagatccagatatacactttaaatatattgaggcagcagccagaactggccaaattaaggaagttgaacgtgtaacaagagaatctaacttctatgaccctgagaaaacaaagaatttcctaatggatgctaaacttccagatgcgcggcccctgataaatgtttgtgaccgttttgggtttgtccctgatttgactcactacttgtatacgaacaacatgcttcgatatatcgaaggctatgttcagaaagtgaacccaggcaatgctcctttggtggttggacaacttctagatgatgagtgccctgaagatttcattaaaggtctcattctttctgttcgttccctccttccggttgagccacttgtcgatgaatgtgagaagaggaatcgtttgcggttgctcacacaatttttggaacatcttgtgagcgagggaagccaagatgtgcatgttcacaatgctctgggaaagatcatcatagacagcaataataatcccgagcattttctcactactaatccatattatgattcacgtgttgtgggtaaatattgtgaaaaacgggatcccactcttgctgttgttgcatatagacgaggacaatgtgatgatgagcttataaatgttacaaataaaaactctcttttcaaattgcaggccagatatgtcgtggaaaggatggatgctgatctatgggagaaagttcttcaacctgagaatgaatatagaagacaacttattgatcaagttgtttctacggcattgcctgaaagcaagagtccagagcaagtttctgcagctgttaaagctttcatgactgctgatcttccacatgaactgattgaactgcttgaaaagattgtgcttcagaattctgcatttagtggaaacttcaatttacaaaacctgcttatcttaacagccattaaagcggatgcatccagggttatggattacattaataggttggacaactttgatggacctgcggttggagaagtagcagttgaagcacaactgtatgaggaagcctttgcgatctttaagaagttcaacttaaatgtacaagcagtcaatgttctcttggataacatccaaagcatagagcgggctgtagaatttgcataccgtgttgaggaagatgctgtttggagccaggttgctaaggctcagttaagggaagggttagtaagtgatgctattgaatcattcatccgtgcagatgatgcaacccaattcctagatgttattagtgctgctgaacaggctaatgtgtatcatgacttggtgaagtacttactgatggtgaggcaaaaggccaaagagccaaaggtggatggtgaacttatttatgcatacgcaaagatagataggctaggtgaaatagaagaattcattcttatgccaaatgttgctaatctccaaaatgttggtgaccgtttgtttgatgatgccctttatgaggctgctaagataatatttgccttcatttctaactgggctaagctggctagtacactagtcaagctgaagcagttccaaggtgcggttgatgctgctcgcaaggcaaacagctcaaagacatggaaggaggtttgttttgcctgtgtggatgctgaggagttccgcctggctcaaatttgtggtctgaatatcatcatacaggtggatgatttggaagaagtcagtgaatattaccaaaacagaggatgcttcaatgagcttatttcccttatggagagtggccttggattggaacgcgcacatatgggtatttttacggagttgggagtgctgtatgcaagatatcggccagaaaagcttatggagcacattaaacttttctctacccgtctcaacattcctaagcttatccgtgtatgtgatgagcaacagcactggaaggagctcacctatctgtatatacagtatgatgaatttgacaatgctgcgaccactataatgaaccattctccagatgcttgggatcacatgcagttcaaggatgttgcagtcaaagtggcaaatgttgagctttattacaaggcagtgcatttctacctgcaggaacatcctgacctcattaacgatctcctcaatgtacttgcccttcgtgtggatcacacacgtgtagtggacataatgcgaaaggctgggcatttgcatcttgtgaagccatacatggttgcagtacaaagtaacaatgtagctgctgttaatgaagcattaaatgaaatttatattgaagaggaagattacgacagattacgggaatcagttgatatgcatgacaactttgatcagattggccttgcgcagaagattgagaagcatgagcttttggagatgagacgggttgctgcatacatctataagaaagcagggaggtggaagcagtcgattgctctgtccaagaaggacaacctgtacaaagatgccatggagacatgctcgcaatccggtgaccgtgagcttgcagaggagttgcttgtttatttcattgagcagggaaagaaggaatgctttgcttcatgtctcttcatatgttatgatttgattcggcctgacattgcccttgagcttgcctggatgaacaacatgatcgactttgctttcccatacctcttgcagtttattcgtgagtacactggcaaagtagatgaactcataaaagataaaattgaagcacagaatgaagtcaaagccaaggagaaggaagaaaaggatatggttgcccaacagaatatgtatgcacagttgctgcctcttgctttgccagctccaccgatgccaggcatggggggaggacctggcgtgggcggacctttttcagccccaccaccaccaatgggtgggatggctatgcctccaatgccgccatttggcatgccccctatgggaagctactgatagtcaggttgatgccagtattggaggtctcagatattttttctgtactcgttttgcagtgggttgaagcagcagtagccacttgttatcattaatgtagctgagaccagttgtgcgcttgttattctttggtagcaggccggtttttttgctgttgttgaggctaagctgaggattctgtatggtgaattttacatgattagaaaatggtgtcgttaggtttggtatgaacagtggctgcgtgccatgtgtataggttcgcttggtatattcaatagaccattagttttaccttcctttcttcccgtcggaggcaccgtcagttgtatccttttgcagtattgctgcttttcatttcccagtgtgtattgggtagattgattttgtatcctattttacaaatta

SEQ ID NO: 5132 - DNA, 5167 bp, Musa acuminata
tgccatggccgcggccaacgctccgatagtgatgcgggaggctttgacgcttccgagcattgggatcaatcctcagttcatcacgttcactcatgttactatggaatcggacaagtacatatgcgtcagggagacctccccgcagaatagtgttgttatcgttgacatgaacatgccgatgcagccactgaggaggccgatcaccgcagactctgctctgatgaatcccaacagcagaattcttgctcttaaagctcaaatacctggaaccactcaggatcatttgcagattttcaatattgaggcaaagactaaaattaaatctcaccagatgcctgagcaggttgtcttttggaagtggatcaccccaaaaatgttgggtctagttacacaaacttctgtctatcattggtcaatcgaaggtgaaaccgagcctattaaaatgtttgatagggcagctaatttgacaaacaatcagatcatcaactacaagtgtgatcccacagagaaatggcttgtccttattggaattgcacctggtgctccggagagaccacaactggtgaaaggaaatatgcagctgttttctctggatcagcagcgtagtcaggcacttgaagcacatgctgcatcttttgcatcgttcaaggtggttgggaatgagaaaccctcccttcttatttgtttttcctcaaagacacttaatgctggacaaattacctcaaagttgcatgtcattgaacttggagcccaaccagggaagccaggtttcacaaagaagcaagcagatttattcttcccaccagatttcgcagatgatttccctgtggcaatgcagatctcccaaaaatacagtttggtatatgtcatcacaaagcttggtttgttgtttgtgtatgatcttgaaactgcaacagcagtttacagaaatcgaatcagtgcagatcctatatttctcacaactgaggcttcaaatgttggtggtttttatgcgatcaataggaagggccaggttctgctggccactgttaatgaagcggcaattgtgccattcgtcagtgggcaattgaacaacctggagcttgccattaaccttgcaaaacgaggaaaccttccaggagctgaaaatttggttgtgcagaggttccaagaactattttcccagaccaaatacaaggaggctgctgaactggctgcagaatctccacaaggcattcttcgaactccggagactgttgcaaagtttcagagtgttccagtccaagctgggcagacaccaccactgttgcagtactttggaacattattaacaagaggaaagcttaatggttttgaatctttagagttatctcgtcttgttgtgaaccagaacaaaaagaatctacttgagaattggttggctgaagacaagctagagtgcagtgaagaacttggggatcttgtcaagactgtggacaatgatcttgcactgaaaatatatataaaagcaagggctacgccaaaagttgttgctgctttcgctgaacggagggagtttgacaagattcttatttactcaaagcaggttggctacacaccagattatcttttccttctgcagactattctgaggtcggatcctcagggagcagtcaattttgctcttatgatgtcacaaatggagggaggctgtccagtggattacaatacaatcactgatctttttcttcagagaaatatgattcgtgaagcaacggctttcttgttagatgtcttgaagccaaatctacctgaacatgcttttcttcagaccaaggttttagagattaatttggtgacatatccaaatgtcgcagatgccatactggccaatggaatgttcagtcactatgatcgtcctcgaattgctcagctttgtgaaaaagctggtttatatgtgcgagcccttcagcattatacagagttgcctgatattaaacgtgtcattgtgaatactcatgccattgagccacaggcacttgtcgagttctttgggacgctttccagggagtgggcactagagtgcatgaaggaccttttactggtcaacttgagagggaaccttcagataattgtgcagactgccaaagaatactctgaccaattaggtgtggatgcttgcataaaactatttgagcaatttaagtcctatgaaggtctttacttcttcttgggatcttatttgagctccagtgaagacccggatatacacttcaagtatattgaggcagcagcaaaaactggacagttaaaagaagttgaacgtgtaacaagagaatctaacttctatgaccctgagaaaacaaagaattttcttatggaagccaaactaccagatgcaaggcccctgatcaatgtttgtgatcgttttggttttgttccagatttgactcactatttatatacaaacaacatgctccggtacattgaaggatatgttcagaaagtaaacccagggaatgctcctttggttgttgggcagttgctagatgatgaatgccctgaagattttattaaaggtctgattctctctgtccgttctctcctgccagttgagcctcttgtggctgagtgtgagaagaggaaccggttacgcttgctcacacaatttttggaacatcttgttagcgagggtagccaagatgtgcatgtccataatgctctggggaagattatcatagacagcaataacaatccagagcattttctaactactaacccatactatgattcgcgtgttgttggtaaatattgtgaaaaacgggatcctactcttgcagttgttgcatacagaagaggtcaatgcgatgatgaacttataaatgttactaacaaaaattcattgttcaaactgcaagccagatatgttgttgaaaggatggatgctgatctgtgggagaaagttcttcaacctgaaaatgaatacagaagacaacttattgatcaagttgtttctactgcattgcctgagagcaagagcccagagcaagtctctgcagctgtcaaagctttcatgactgctgatcttccacatgaacttattgaactacttgagaagatcgtcctacaaaattctgcctttagtgggaacttcaatctgcaaaacctgctgattttgacggctattaaagctgatccaccaagggtcatggattacattaatagattagataattttgatggtccagcagttggtgaggtggcagttgaagcacaactttatgaagaagcctttgccatcttcaagaaatttaacttaaatgtccaggcagtcaatgtcctcctagacaacatccaaagcatagagcgggctgtagagtttgccttccgtgttgaagaagatgctgtatggagccaggttgcaaaagctcaattaagggcaggtttagtaagtgatgcaattgagtcattcattcgtgctgatgatgaaacccaatttcttgatgttattcgggctgctgaagatgctaatgtttaccatgacctggtgaagtacttgttgatggtgaggcagaagactaaagagccgaaagtggatggtgaactgatatttgcatatgctaagattgatagactaggtgaaattgaggagttcattcttatgccaaatgttgctaatcttcaaaatgtcggggatcgtttgtttgatgatgctctttacgaagctgctaaaatcatatttgctttcatttccaactgggcaaaattggcttgcacactcgttaagctgaagcagttccaaggtgctgttgatgcagctcgcaaggcaaatagcacaaagacatggaaggaagtttgttttgcttgtgtcgatgccgaggagttccgcttggcacaaatatgtggtctgaatatcattattcaggtggatgacctggaagaggtcagtgagtattatcagaacaggggttgctttaatgagttgatttccctcatggagagtggccttggcttggaacgtgcacacatgggcatctttacagagttgggagttctgtatgccagatatagaccagaaacactaatggagcacattaaacttttctcaacccgtttgaacattcccaagcttatacgtgtttgtgatgaacaacagcactggaaagagctaacctatttgtacatacagtatgatgaatttgacaatgctgccacaactatcatgaaccattctccagatgcatgggatcacatgcaattcaaagatgttgttgtcaaagttgcaaatgttgagctctactacaaggctgtgcatttctacttgcaagaacatcctgacctcattaacgatgttctacatgtgcttgcacttcgtgtggaccacacacgtgttgtagatatcatgcgaaaggctggtcacttgcatcttgtaaagccatatatggttgcagttcaaagtaacaatgtagctgctgttaatgaagcactaaatgaaatctatgttgaggaggaagactatgatagattacgggaatcagttgacttgcatgataactttgatcagataggccttgcacagaggattgaaaaacatgagcttcttgagatgcggaggattgctgcatatatctataagaaagctgggagatggaagcagtctattgcattatccaagaaggacaatctttacaaagatgcaatggagacatgttcacagtctggtgatcgtgaactttcagaagagttgctggtttattttatcgaacaggggaagaaggaatgctttgcttcatgtctcttcatttgttatgacttgatccgtccagatgttgcccttgaacttgcctggatgaacaatatgattgactttgctttcccatatctcttgcagtttattcgggaatatgctagtaaagttgatgaacttgtaaaggataaaattgaagcacaaaatgaagtgaaatccaaggaaaaggtagaaaaggatttggttgcacagcagaatatgtatgcacagttgctgcctcttgctttaccagcaccacctatgcctagtatgggaggatcaaacatgggcgggccttatggtgcgccaccaccaatgcctggtatgggaatgccaccaccaatgcctggtatgggaatgcctggtatgggaatgccgccaatgccaccatttgggatgcctccaatggaaaattactgagaa

SEQ ID NO: 5133 - DNA, 6326 bp, Theobroma cacao
tgtttagttttaccatattcagccgttattccctttttcttgtagcatctttaaattcaaaataaaataaaatttacggtcgggtaattacccgaatctggcggctatataaaaactaagagccagcaaatgcgcatagcactctaaggcacacattttgcacgtcctttcctctttcttctttatttttctggagtgccttagattggatctctctctctctctctctctctctctctgcttctctgttcttcaattcttcaccaaattcgatcttcccttttttcttttctccgtggatttttcgtactgttttaaatccctgcttcagatctcgtggcagagtgtttgctttttcgtctcttttctcagtgtttcgttttgactccgcaattgaaagattgaatctcagcagtagatctgctcctgattcgtgaatcgtcaaccgttgatctgagccaccatggcggccgcgaacgctcccatcgccatgaaggaggttttaactttgccgagcattggcattaatcctcaatttatcactttcacgaacgtaactatggaatctgataaatatatttgtgtgagggaaacggcgccacaaaatagtgttgtgatcatagacatgaacatgccgatgcagccgttgagacggcctattacagcggactccgctcttatgaatccgaattctagaatccttgctttgaaagctcaactacctggaacaactcaagatcacttgcaaatatttaacatagagatgaaagcaaaaatgaaatcacatcagatgcctgaacaggttgtattttggaaatggattagcccaaaaatgcttggcctggtcactcagactactgtgtatcattggtcaattgaaggtgattccgaaccaactaagatgtttgagagaacagctaatttagtgaacaatcagataataaactataaatgtgacccttcggagaagtggttggttttgattggaattgcccctggtgcacctgagaggccacaattggttaaggggaacatgcaacttttttctgttgatcagcagcgtagtcaagctcttgaagcacatgctgcttcatttgctcaatttaaggttccaggaaatgagaatccttctactcttatttcctttgccaccaagacttttaatgctggccagattacatcaaagctgcatgtaattgagcttggtgctcagccaggtaagccatcgttttcaaagaaacaggcagatctattctttccaccagattttcaagatgattttccagtcgcaatgcagatatcccacaaatacagtttaatctatgtaatcaccaagcttgggctgctttttgtgtacgatctagagacagcaactgctgtatacagaaatagaatcagtccagacccaatatttttaacctctgaagcttcatcagttggagggttttattccatcaacaggcgaggtcaggtgttactggctactgtaaatgacgcaacaatagtgccatttgttagcggtcaattgaacaatttggagcttgctgtcaatcttgccaaaagagggaaccttcctggtgcggagaacctggttgtccaacgttttcaagaattgtttgctcagacaaagtacaaagaagctgctgagcttgctgcagagtctccacaagggatccttcgcacacccgatacagttgccaagtttcagagtgttcctgtgcaagctgggcagactccaccgctgttgcagtactttggtacacttttaacaagagggaagctcaatgcattcgagtctttggaattgtctcgacttgttgtaaaccaaaacaagaagaatcttttggaaaattggttggctgaagataaattggagtgtagtgaggaacttggagatcttgtgaagactgtggataatgatcttgcattgaaaatatatattaaagctagggcaactccaaaagttgttgcagcttttgcagaaaggagggagtttgacaaaatcttgatttactcgaagcaggttgggtacacacctgactacttgttccttctgcaaacaattcttcgtacagatccacagggagctgttaattttgcattgatgatgtctcaaatggagggaggttctccagttgattacaataccattactgatctttttcttcagaggaacttgatccgggaggccactgcatttctattagatgttttgaagccaaatctgccagagcatgcctttctacaaacaaaggtcctggaaatcaatctagtaacatttccaaatgttgctgatgccattttagcaaatggaatgttcagtcactatgatcgtccacgaattgcacaactttgtgagaaagctggtctctatgtgcgagctctgcagcattacacggagttgccagatgttaaacgtgtcattgtgaatacacatgctattgagccacaggcgcttgttgagttttttggtactctttcacgagaatgggctttggagtgcatgaaggaccttttgctggttaatctaagagccaaccttcaaataattgttcaggttgccaaggagtattgtgagcagttgggtgttgatgcttgcataaaactttttgagcaatttaagtcatatgaagggttgtactttttcctgggttcttatttgagctcaagtgaggaccctgatatacacttcaagtacatcgaggcagctgctaaaactggacagataaaggaggttgagcgtgtgaccagggaatcgaatttttatgatgctgaaaagacaaagaacttcctgatggaggccaagcttcctgatgctaggcccctgattaatgtttgtgatcgatttgggttcgttcctgatctcactcactacctttacacaaacaacatgctccggtacattgaaggttatgttcagaaggtgaaccctgggaatgctcctttggtagtgggccagttgctagatgatgaatgcccagaagattttattaagggtctcattctctcagtccgttctttgcttccagttgagccccttgtggaggaatgtgagaagagaaatcgacttcgtttacttacacagttcttggagcatcttgtaagtgaaggaagccaagatgtgcatgtccacaatgctctgggtaaaatcatcattgatagcaataacaatccagagcacttcctcacaactaacccttactatgattcccgggttgtgggtaagtactgtgagaagcgtgatcccaccctggcagttgtggcttaccgaagaggacaatgtgacgatgaacttatcaatgtcacaaataaaaactcattgttcaaattgcaggccaggtatgttgttgagaggatggatgctgatctttgggagaaggtcctaaatcctgaaaatgaatatagaagacagctaattgatcaggttgtgtcgactgctttgccagaaagcaagagtccagaacaagtttctgcagctgttaaagctttcatgactgctgacctgccccatgaactgattgagcttcttgagaagattgtgctccaaaactctgcattcagtgggaacttcaatctgcaaaatctacttattttgacagctattaaggcagatccatctagagttatggattatatcaataggctagataattttgatggacctgctgttggagaagtggctgtggaagcacaactatacgaagaagcttttgcaattttcaaaaaattcaacttaaatgttcaggctgtcaatgttttattggataacattagaagcattgatcgggctgtggaatttgcattccgagttgaagaagatgctgtttggagtcaggtggccaaggcacaactgagggaggggctggtgagcgatgcaattgaatcgtttattcgtgcagatgacgctactcaattccttgacgttatccaagctgctgaggatggtgatgtctaccctgatctggtgaggtaccttctgatggttaggcagaaggtcaaggagcccaaggtggacagtgagcttatttatgcctatgcaaagattgatagattgggtgaaattgaagaattcattctcatgccaaatgtggctaatcttcaaaatgttggtgatcgcttgtttgacgaagacctatatgaagctgcaaaaataatatttgcatttatatctaactgggccaagttggctgttacactggtgaggcttaaacaattccagggtgctgttgatgcagcacgaaaggcaaacagtgccaagacatggaaggaggtttgctttgcttgtgttgatgcagaggaattccgattggcacagatctgtggtcttaacattattgtacaagtggatgacttggaagaagtcagtgaatactatcagaatagaggatgcttcaatgagttgatctctctcatggagagtggtttaggattggaacgtgcacacatggggatctttactgaattgggagtgctgtatgccagatatcgtccagagaagcttatggagcacattaaattattctctactcgtctcaatattcccaagctaataagagcttgtgatgagcagcagcactggaaggaacttacctatttgtatatccaatatgatgagtttgataatgctgctactactgtgatgaaccactctcctgaagcatgggaccatatgcagttcaaagatattgcagtcaaagttgcgaatgttgagctatattacaaggctgtccatttctacttgcaagaacatcctgatctaatcaatgacatgctgaacgtgcttgcacttcgtgtggaccacacacgtgttgttgacattatgagaaaggctggtcatctgcgtcttgtgaagccatacatggttgctgttcagagcaacaatgtctcagcagtaaatgaggcattgaatgagatttatgtggaggaagaagattatgatagattgagagaatcaattgactttcacgataattttgatcagattggccttgcacaaaagattgagaaacatgagctgcttgagatgaggcgtgttgccgcatacatttacaaaaaggcaggcagatggaagcagtccattgcattgtcgaagaaagacaacctttacaaagatgcaatggaaacagcttcacagtctggtgaccgcgaacttgccgaggagttgcttgtatacttcattgaacagggcaagaaggaatgttttgcatcatgcctctttgtttgttatgacttaatccgaccagatgttacccttgagctagcgtggatgaacaatatgattgactttgcattcccatatctgttacagtttatccgtgaatatactggcaaagttgacgaacttatcaagtacaagattgaggctcaaattgaagaaaaggctaaagagcaggaagagaaggaggtgatcgcacaacagaacatgtacgctcagttactacctcttgccttgcctgcaccaccaatgccaggtatgggaggatcgacaatgggaggagtggggatgccaccaccacccatgggaggaatggggatgcctccaatgccacctttcggcatgccaccaatgggcagctattaagtctttaacagctttgtttgattgaagaagttacttagctgtggatccatgttgttgctcaagagagaaaaatgacgacagcgtagtttcgattagtggcatttcagcagggctccgatgccttccatatattttttttcactttctttgcgttccttcatctgatgggggtgaagatgaagatcaagttggaataatgccatttttgtgctttaggtgtgtgagatattgtctttgtaatattcttttttgtagaagaggcattttttttggggctgctggcacagagggcaagcacaggatttcatgcatttgtattttgtagtattattatttccttctcggtcttcggaatcgaccgaaagtatatacaaaatcacttcacactgaatcataactccggaatttgatattttcctttaaactttatttccctcattgtttgtttatttgccttttcattcaagtggaaacaaaatttcctttctgatttatatttcattttacagaaattttagacttctaaatgtttattttaaaattccgtttgatcaggcagttcgatcatttcgtgcagaatggggaaagaacgggatagaaaggcaattaacatagttttatcatatatatatatatatatatatttatgaagtgtgaaattctataatttgggaagtaaaactaaataatatgttattaatatgtttaaagtaattacaggaaaaaataaattaatatttaatgt

SEQ ID NO: 5134 - DNA, 5122 bp, Musa acuminata
tgccatggcggctgccagcgcccccatcgtgatgcgggaggccctgacccttccgagcatcgggatcaatcctcagttcattacgtttacgcatgtcacgatggaatcggacaagtacgtatgcgttcgggagacctctccccagaatagcgtggttatcgttgatatgaacatgccgatgcagcctttgaggaggccgatcacagcagactctgctttgatgaatcccaacagcaggattcttgcacttaaagctcaaatacctggaactactcaggatcacttgcaggtgttcaatattgaggcaaagaccaaaattaaatctcatcagatgcctgagcaggttgttttttggaagtggatcactccaaagatgttgggtctggctacacaaacttcagtctatcattggtcaatagaaggtgaagcagaacctcttaagatgtttgatagggctgctaatttgacaaacaatcaaataattaattacaggtgtgatcccactgagaaatggctagttcttatcggaattgcacctggtgctccagagaggccacaactggtaaaaggaaatatgcagctcttttctgtggatcagcagcgtagtcaagcacttgaagcacatgcctcatccttcgcgtcatttaaggtggctgggaatgagaacccctctgttcttatttgttttgcctcaaagacaatgaacgctggtcaaacgacctcaaagttgcatgtcattgaactaggagcccaaccaggaaagccgggttttaccaagaaacaagcagatttattcttcccaccagattttgcagatgacttccctgtgtccatgcagatctcccaaaagtacagtttgatatatgttatcacaaagcttggtctattatttgtgtatgatctggaaacagcaacagcagtttacagaaacagaatcagtccagatcccatatttctcacaacagaggctccaaatgttggtggcttttatgcaataaatagaaagggccaagttctgctggctactgtcaatgaggcaactcttgtgcctttcgttagtggccaattaaacaatctggagcttgctgttaaccttgcaaaacgagggaaccttccaggagctgagaatttggttgtgcagaggttccaagaactattttcccagacaaaatacaaggaggctgcagaacttgctgcagaatcaccacaaggtattcttcgaactccagagaccgttgcaaagtttcagagtgttccagtccaagctgggcaaacacctccactgttgcagtactttggaacattgttaacaaaaggcaagcttaatgcttttgagtctttagaattatctcgccttgttgtgaaccagaacaagaagaatctactggaaaattggttggctgaagacaagcttgagtgcagtgaagagcttggggatcttgtcaagactgtggacaatgatcttgcacttaagatctatataaaagcaagggctactccgaaagttgttgctgcttttgcagaacgaagggagtttgacaagattcttatatactcaaagcaggttggctacacaccggattatcttttccttctgcagaccattttgaggtcagatcctcagggagcagttaattttgctcttatgatgtcacaaatggatggaggctgtccagtagattacaatacaatcactgatctttttcttcagagaaatatgattcgggaagcaacagcattcctgttagatgtcttgaagccaaatctaccagagcatgcttttcttcaaactaaggttttagagattaatttggtgacgtatccaaatgttgcagatgctattttggctaatggaatgttcagtcattatgatcgacctcggattgctcaactatgtgaaaaggctggcctatatgtccgagcccttcagcattacagtgagttacctgatattaaacgtgttattgtgaacactcatgccattgagccacaggcacttgtcgagttctttgggaccctttccagggaatgggcattggagtgcatgaaagaccttttactggtcaatttgagagggaaccttcagataattgtgcagactgctaaagaatattctgagcagttaggtgtagatgcatgcataaaactgtttgagcaatttaagtcctatgaaggtctttacttcttcttgggattttatttaagttccagtgaggatcctgatatacacttcaagtacattgaggctgcagcaaaaactggacagttaaaggaagttgaacgtgtaacacgggaatctaacttctatgatcctgaaaaaacaaagaatttcctgatggaagccaaacttccagatgcaaggcccttgatcaatgtttgtgaccgttttggttttgttccagatttgacccactatttatatacaaacaacatgcttcgatatattgaaggctatgttcaaaaagtaaatccaggaaatgcccctttggttgttgggcagctgctagatgatgaatgtcctgaagatttcattaaaggtctgattctttctgtccgttctctcctgccagttgagcctcttgtggctgaatgtgagaagaggaatcgcctacgactgctcacacaatttttggaacatcttgtcagtgaggggagccaagatgtgcatgttcataatgctctgggaatgataatcatagacagcaataacaatccagagcattttctaactactaacccatactatgattcacgtgttgttggtaaatattgtgaaaagcgggaccctactcttgcagttgttgcatacagacgaggccagtgtgatgatgaacttataaatgtcactaacaaaaactcactgttcaaactgcaagcaagatatgtcgttgagaggatggatgctgatctgtgggagaaagttcttcaccccgaaaatgaatacagaagacaacttattgatcaagttgtttctactgcgttgcctgagagcaagagcccagagcaagtctctgctgctgttaaagccttcatgacagctgatcttccacatgaacttattgaactactagagaagattgtgctacaaaattctgcctttagtgggaatttcaatctgcaaaacctactgattttgacagctattaaagctgatccgccgagagtaatggattacattaatagattagacaattttgatggcccagcagttggggaggttgcagttgaagcacagctgtatgaggaagcattcgccattttcaagaaattcaacttaaatgtgcaggctgtcaatgttctcctggacaacatccaaagcgtagagcgggctgtagaatttgccttccgtgttgaggaagatgctgtgtggagccaggttgcaaaagctcagttgcggcaagggttagtgagtgatgcaatcgagtccttcattcgtgcagatgatgaaacccagttcctcgatgttattcgagctgccgaagatgctaatgtttaccatgacttggtgaaatacttgttgatggtgaggcaaaaggttaaagagccaaaagtggacggtgaactgatctttgcatatgctaagattgataggctcggtgaaattgaggagttcattcttatgccaaatgttgctaatcttcaaaacgtcggcgaccgtttatttgatgatgccctttatgaagctgctaagatcatatttgctttcatttcaaactgggcaaaattggctattacacttgttaagctgaagcaattccagggtgctgttgatgcagctcgcaaggcaaatagctcaaagacatggaaggaagtctgttttgcttgtgtagatgctgaggagttccgtttggcacaaatatgtggtctgaatgtaattattcaggtggatgacttggaagaggtcagtgactattatcagaacaaaggttgctttaacgagttaatttctctcatggaaagtggccttggtttagaacgtgcacacatgggcatctttacagagttgggggtcttatatgctagatataggccggagaaacttatggagcacattaaacttttctcgactcgtttgaacattcccaagcttatccgtgtttgtgatgagcaacaacactggaaagaactaacctatttgtatatacaatatgatgaatttgacaatgctgcaacaactatcatgaaccattctccagatgcatgggatcatatgcagtttaaagatgttattgtcaaagttgcaaatgttgagctctattacaaggctgtgcatttctacctgcaagaacatcctgatctcattaatgatgttctacatgtacttgcccttcgtgtggaccacactcgtgttgtagatatcatgcggaaggctggtcacttgcatcttgtgaagccatatatggttgcagttcaaagtaacaatgtagctgctgttaatgaagcactaaatgaaatttatgttgaggaggaagactatgatagattacgtgaatcagttgacttgcatgataactttgatcagataggccttgcacagaggattgaaaagcatgagcttcttgagatgaggaggattgcagcatatatatataagaaagctggaagatggaagcagtccattgcgctgtccaagaaggacaacctgtacaaagatgcaatggagacgtgttcacagtctggtgaccgtgaactttcagaagaactgctcgttttttttatcgaacagggaaagaaggaatgctttgcttcatgtcttttcatttgttatgaattgatccgtcctgatgttgcccttgagctggcttggatgaacaatatgattgactttgctttcccatatctcttgcagtttattcgagagtacactagtaaagttgacgaacttgtaaaatataagattgaggcacaaaatgaagtgaaatctaaagaaaaggaagagaaggatttggttgcacagcagaatatgtatgcacagttgctgcctcttgctttaccagctccatcaatgcctggtatgggaggaccgaacgcaggtggaccttacacggctccagctccaatggctggcatgggaatgcctccaatgccaccatttggcatgcctccgatgggaagctactga

SEQ ID NO: 5135 - DNA, 6007 bp, Ricinus communis
ttttaacacgtctatcttcttcataagattttctttttccatttatatttatagatttttagaattttttaataatagtaaataaaaaaaaataaaaaaaaataatcaaattaatataatctcctcaattcacaataagattagatctctcaacattctctcattcacttctgctgcttcttctcttcttcttcttcttctttttctcttttcttagatccttttggatttctagggtttcatcgctgctctagatctcacaataataataacaaacatcagcgacttgaatctccattagtttgactttcctttttcaaatcgacggttcaattccaatcacagatctgtttccttcattttgagccgtcgatctctcaccatggcggccgctaacgccccgatcaccatgaaagaagttttaactttaccaaccattgggatcagtccacagtttataacgtttacgaatgtgacaatggagtctgataagtatatatgtgtaagagaaacggcgccgcagaatagtgttgttattattgatatgaatatgccaatgcagcctttaagacgtcctattactgctgattccgctcttatgaatcctaattctagaattctcgctttgaaagctcaactcccaggaactactcaggatcacctacagatatttaacattgaaatgaaagcgaaaatgaaatcacaccagatgcctgagcaggttgtcttttggaagtggataagcccaaagatgttgggcctggtcacccagacatcagtttatcattggtcaattgaaggtgattctgaacctgtcaagatgtttgagagaacagctaatttggtgaacaatcagataatcaactacagatgtgacccttctgagaagtggttagttttgattggaatagctcctggttcacctgagaggcaacaattggttaaagggaatatgcaacttttctctgtggatcagcagcgtagtcaagcccttgaagcacatgctgcagcctttgcccagtttaaggttccaggaaatgagaatccttcaactcttatttcatttgccacaaaaacttttaatgctggtcagattacatcgaagttgcatgtcattgagctcggtgctcagccagggaagccatcattcacgaagaaacaggccgatcttttcttccctccagactttgctgatgattttcctgttgcgatgcagatatcccacaaatacagtttgatatatgtgatcaccaaacttggattgctatttgtctatgatttggagacagctagcgctgtttacagaaatagaatcagtccagatcctatatttttgacagctgaagcttcatcagctggaggcttttattccattaataggcgtggccaggtgttactggctactgtcaacgaggcgacaattgttccatttgttagtggtcaattgaataatttggaacttgctgtcaatcttgctaaaagaggaaaccttcctggtgcagagaatctggttgtccagcgttttcaagagctatttgctcaaacaaagtataaagaggctgctgagcttgctgcagagtctccacaaggaattcttcgaacacctgatacagttgcaaagtttcagagtgttcctgtgcaaactgggcaaacaccccctctgctgcagtactttggaacacttctaacaagaggaaagctaaatgcatttgagtcgttggaactgtcacgtcttgttgtcaatcaaaacaaaaagaatctcttggagaactggttggcggaggacaagttagagtgcagtgaggaacttggagatcttgtgaagaccgtggataatgaccttgcactgaagatatttattaaagctagagctacaccaaaggttgttgctgcttttgctgagagaagggagtttgacaagattttgatttactcaaagcaggttgggtatactcctgactatttgttccttctgcaaacaattctgcgttcagatcctcagggagcagtgaattttgctttgatgatgtcccaaatggagggaggctgtcctgtggattacaatactatcactgatctctttcttcagaggaacctgatccgtgaggcaacagcttttctgttggatgtgttgaagccaaatctaccagaacacagttttctgcaaacaaaggttcttgaaatcaatttggtaacatttcctaatgtagctgatgctattctagccaatggaatgttcagccactatgatcgtcctcgtattgctcaactctgtgaaaaagctggtctatatatcagagccctgcaacattattcagagttgccagatattaaacgtgtgattgtcaatacacatgcaatagagccacaggcacttgtagagttttttggtactctttcacgagaatgggctttggagtgcatgaaggatcttttactggtcaatcttagagggaaccttcagataattgtgcaggctgccaaggaatattgtgagcagttgggcgttgatgcctgcataaaactatttgagcaattcaagtcttatgaggggctgtactttttcctggggtcatatttgagttccagtgaggatcctgatatacacttcaagtacatcgaggcagctgctaaaactggacaaataaaggaggttgaacgtgttactagagaatcaaatttttatgatgcagaaaagacgaagaactttctgatggaggccaaacttccagatgcaaggcctctgattaatgtttgtgatcgttttggttttgtggctgaccttacacactacctctactcaaacaacatgcttcgctatattgaaggttatgttcaaaaggtaaaccctggtaatgcaccgttagttgtgggccaactgcttgatgatgagtgccctgaggacttcatcaagggcttgattctttctgttcgttcattacttcctgtggagccccttgttgaagaatgcgagaagagaaatcggcttcgattgctcactcagttcttggagcatcttgtgagcgagggaagccaagatgtccatgtgcacaatgctctgggtaaaattattattgacagcaataacaatccagagcacttcctgacaactaacccttactatgattctcgggttgtgggtaaatattgtgagaaacgcgatcccaccctggctgttgtggcttaccggagagggcaatgtgatgatgaacttatcaatgtgacaaataagaactctttgttcaaattacaagccagatatgtggttgaaaggatggatgctgatctgtgggagaaggttcttaatccggagaatgaatatagaagacagctcattgatcaagttgtatctactgctttgcctgaaagcaagagcccagaacaagtttctgcagcagttaaggctttcatgactgctgatctccctcatgaattgattgagcttcttgagaagattgtgcttcaaaactctgcgtttagtggaaatttcaatctgcagaatcttcttattttgactgccattaaagcggatccatctagagttatggattacatcaacagattggataattttgatggacctgctgttggggaagtggctgtagaggcccaactttacgaggaagcatttgcaattttcaagaagttcaacttgaatgttcaggccgtaaatgtcttgttggataatattcggagcattgaccgtgcggtggaatttgcattccgtgttgaagaagatgcagtttggagccaagtggcaaaggctcaacttagggaaggactggtgagcgatgcaattgaatcatttattcgtgctgatgacgctactcagttcttggaggtaattcgagctgctgaggatgcaaatgtctatcatgacttggtgaggtacctcctgatggttaggcagaaggcaaaagaacccaaggtggacagtgagcttatttttgcatatgcaaagattgatcggctgagtgacattgaggaatttattctcatgccaaatgtagcaaatctccaaaatgttggtgatcgtttatttgatgaagctctatatgaggctgcaaaaataatatttgcattcatatcaaactgggccaagttggctgtcacgcttgtgaggctgaaacaattccaaggtgctgttgatgcggcacggaaagccaacagtgcaaaaacatggaaggaagtttgctttgcttgtgttgatgctgaggagttccgtctggctcagatatgtggtctcaacatcattattcaggtggatgacttggaagaggtcagtgaatactaccagaacagaggatacttcaatgagctgatctcgctcatggagagtggcttagggttggaacgtgcacatatgggtatattcacagagttgggagttttgtatgctagatatcgtcctgacaaacttatggagcacattaaattgttctctacccgtctgaatattccaaagcttatacgtgcttgtgatgaacaacaacattggaaggagcttacctatttgtatatccagtacgatgaatttgataatgcggcaaccaccataatgaaccattctcctgaggcatgggatcacatgcaattcaaagacgtggcagtaaaggttgctaatgtggagctatattataaggctgtgcatttctacttgcaagagcacccagatcttatcaatgatcttctcaatgtgctggctctccgtgtggaccatactcgtgttgtagacatcatgcgcaaggctggtcaccttcttttggtgaagccatatatgattgctgttcagagcaataatgtgtctgctgtgaacgaggccttgaatcagatttatgtggaggaggaagattatgaaagattgcgtgagtcaattgatttgcatgacaactttgatcagattggcctagcacagaagattgagaaacatgagcttcttgaaatgagacgtgttgccgcatacatttacaagaaggcaggaagatggaagcagtccattgcattgtcaaagaaagacaacctttacaaagatgcaatggagacagcatcgcaatctggtgatcgtgaactagcagaggagttgcttgtttatttcattgatcagggcaagaaagaatgctttgcatcatgcctctttgtgtgttatgatttgattcgggtagatgttgctctggaacttgcctggatgaataatatggttgactttgccttcccatatctgctgcagttcatccgcgaatacaccggcaaagttgatgagcttgtgaaagacaaaattgaggctcaaaaggaggtaaaggctaaagagcaggaagagaaggatgtgattgctcagcagaacatgtacgctcagttgcttcctcttgctttgcctgcaccaccaatgccaggtatgggcggaccaacaatgggtggaggttttgtgccacccccgcctatggggggaatgggaatgcctccaatgccaccttttggcatgccgccaatgggcagttattgagatgcaggtgatcctttttgtagaatttagctgtgaatccaggatgcttataaaggaaatgcaagctagcagttggggctttccatttggtggtgtttactgggctgtggcacctttattccttttttgtgcttgttttggtggaatgaaggtgtggttggaataatgccttatttactttttttttttcttttaattttaaatctttaggtgtgtggataagtgttgtaatattcttttgatagttgaggcattttttggctgcttttagagggcaagccgaggatttcctgtatttgtatttttttcttccgcccttttcagtctaggaacttgccaagtatagtacgaaatgtttccatacccatcgcaatgcaccaactagacctattatgcttctttactttaattggcatcattctctcttttacatatgtgattttgccatttaattttgtgctgtattttaactttgaaatgctagtcctgggaaacaatttatttcca

SEQ ID NO: 5136 - DNA, 5783 bp, Citrus clementina
attttaacacgtcccctcctctcctctctccctcggcccgatttttttcttttttaaaaattcatttcactttcttttcctcttcgcttcttcttcttcttcgtgctgcgaagtgccttaagataagatctcattctattttatctctctagatctctcgtctaggttttaattgctgccgtagatctcgcagcgatttgaatctctcttgtaataggattgaattgaattgaatctccaccgtagatctctcccgatctgatcccaaatcatggctgctgccaacgcgccgatctccatgaaggaggtcttaaccttgccaagtgtcgggattaatccgcaatttattactttcacgaatgttacgatggaatctgataagtacatatgtgttcgagaaactgctccacagaatagtgttgtgattattgatatgaatcagccgatgcagccgttgaggcggcctatcacggctgactcagcacttatgaatcccaattcaagaattcttgctttgaaagcacaactccctggaaccactcaggatcacttgcaaatatttaacattgagctgaaagcaaaaatcaaatcgcatcagatgtctgagcaggtggtcttttggaagtggattagcccaaagatgttgggagttgtcactcaaacttcagtgtatcattggtcaattgaaggtgattctgaaccagtcaagatgtttgatagaactgctaatttgacaaataatcagataattaactacaaatgtgaccctactgaaaaatggttggttttgattggaattgctcctggttcagctgagaggccacaattggttaaagggaacatgcaacttttttcagtggatcaacagcgtagtcaagctcttgaagcccatgctgcatcatttgcccaattcaaggttcctgggaatgagaatccttctgttcttatttcctttgcgacaaagtctttcaatgctgggcaggttacatcaaagctgcatgttatcgagcttggtgcgcagccaggaaagccatcttttacaaagaagcaagcagatcttttctttcctcctgattttgctgatgattttccagtggcaatgcagatatcgcacaaatatggtttgatttatgttatcaccaagcttggattgctatttgtttacgatttggagacggctgcggcagtgtaccgaaacagaattagtccagatccaatatttttgacatctgaagcttcttcgctgggaggtttttatgccatcaacaggcgaggccaggtgttactggcaacagttaatgaagcaacaatagtgccttttgttagtggccaattgaacaatcttgaactagcagtcaatctggccaaaagaggaaaccttcctggtgcagagaatctggttgtccagcggttccaagaactgtttgctcagacaaagtataaagaggcagctgagcttgctgcagaatctccacaaggactcctccgcacaccagatacagttgccaaatttcagagtgttcctgtgcaagctgggcagactccacctttgttgcagtactttgggacacttttgacaaggggaaagctcaatgcttttgagtcattggaattatctcgcctagttgtgaaccagaacaaaaagaatcttttggaaaactggctagcagaggacaagttggaatgtagtgaggaacttggagaccttgtgaagactgtggataatgatcttgcactgaaaatatatattaaagctagggcaaccccaaaagttgttgcagcttttgcagagaggagggagtttgacaaaattttgatttactcaaagcaggttgggtatacacctgattatttattccttctgcaaacaattctccgaacagatcctcagggagctgttaactttgcattaatgatgtcccaaatggagggaggttgtccggttgattacaatacgattactgatctgtttcttcagaggaacttgatccgcgaagcaacagcctttctgttggatgttttaaagccaaatctaccagaacatggttttcttcagacaaaggtgctggagatcaatctcgtaacttttccaaatgtagctgatgctattttggccaatggaatgttcagccactatgatcgtcctcgaattgcccaactttgtgaaaaagctggtctttatatgagagctctgcaacattacacagaattaccagatattaagcgtgtcattgtaaatacacatgcaattgagccacagtcgctggttgagttttttggtactctttcaagagaatgggctttggagtgcatgaaggaccttttactcgttaacctaaggggcaaccttcagataattgtgcagactgccaaggaatactgcgagcagttgggcgttgaggcttgcattaaactttttgagcaattcaagtcatatgaagggctgtactttttcctgggttcatacttgagttccagtgaggatcctgacatacacttcaaatacatagaggcagctgctaaaaccggacaaataaaagaggtggaacgagtgacaagagaatcaaatttttacgaccctgaaaagaccaagaactttttgatggaagccaagcttcctgatgccaggcctctgattaatgtctgtgaccgatttggttttgttccagatctcacacattacctctacacgaacaacatgcttcgctacattgaaggttatgttcagaaggtgaacccagggaatgctcccttagttgtaggacagctgttagatgatgaatgccctgaagattttattaagggcctcattctttctgtccgttctttgcttccggttgagcccctggttgaagaatgtgagaagaggaatcggcttcgtttgctcactcagttcttggagcatcttgttagtgaaggaagccaagatgttcatgtccacaatgctctgggtaaaattattattgacagcaataacaatccagagcacttccttaccactaatccttactatgattcccgagtggtgggtaaatattgtgagaaacgtgatccaaccctggctgttgtggcttaccgtaggggacaatgtgatgatgaactcatcaatgtcaccaataagaactcactgttcaaactacaagccagatatgtggttgagagaatggatgcggatctatgggagaaggttcttacccctgaaaatgagtatagaagacagctcattgatcaagttgtatctactgctttgccagaaagcaagagtccagaacaagtttctgcagctgttaaagctttcatgactgctgatctgccccatgaactaattgaacttcttgaaaaaattgtgctgcaaaactctgccttcagtgggaacttcaacttgcaaaacctgcttatcttgacagctattaaggctgatccatctagagtcatggattatgttaatagactagataactttgatggacctgctgttggggaagtggctgttgaagctcaactatatgaggaagcatttgctattttcaagaagttcaacttgaatgttcaggctgtcaatgtcttgttggataacatccgaagtattgaacgggctgtggagtttgcattccgtgttgaagaagatgcagtttggagccaggtagcaaaggctcaactgagggaggggctggtgagcgatgcaattgagtcatttatccgtgctgatgatgctactcaattcctggatgttattcgtgctgccgaggatgcagatgtctaccatgacttagtgagataccttcttatggtcaggcaaaaggtaaaagagccgaaggtggatagtgagctcatttatgcatatgcaaagattgataggctgggtgatattgaggaatttattctcatgccgaatgttgctaatctccaaaatgttggtgatcgcttgtatgatgacaccctctacgaggctgcaaaaataatatacgcatttatatctaactgggcaaagttggccgtcacacttgtgaagctgaaacagtttcaaggtgctgtcgatgcggcacggaaagccaacagtgcaaagacatggaaagaagtttgctttgcatgtgttgatgctgaggagttccgtttggctcagatatgtggtctcaacattattgtacaggtggatgacctggaagaagtcagtgaatattaccagaacagaggatacttcaatgaattaatctctctcatggagagtggtttgggattagaacgtgcacatatgggtattttcaccgagttgggagttctttatgccagatatcgttatgagaagcttatggagcacatcaaattgttttccacccgccttaatatccccaagcttattcgtgcttgtgatgagcagcagcactggaaggaactcacctatttgtatatccagtatgatgagtttgataatgcagcaactaccattatgaaccattctcccgaagcatgggatcacatgcagttcaaagacgttgctgtcaaagttgctaatgttgagctatattataaggccgttcacttctacttgcaagaacatcctgacctcatcaacgatctacttaatgtgcttgcacttcgtgtggaccatacacgtgttgttgacattatgcgaaaggctggtcaccttctccttgtgaagccctacatggttgcagttcagagcaacaatgtttctgctgtgaacgaggctttgaatgagatttacgttgaggaggaggactacgagagattgcgtgaatctattgatatgcatgataactttgatcagattggccttgcacagaagattgagaaacatgagcttttggaaatgagacgagtcgctgcatatatttacaaaaaggctggcagatggaagcaatctattgcactgtcaaagaaagacaaggtttacaaagatgcgatggagactgcctcacaatctggtgatcgtgaacttgcagaggagttgctggtttatttcatagaacaggggaagaaggaatgctttgcgtcatgcctgttcgtttgttatgatttgatcagacctgatgttgctcttgaactttcttggatgaacaacatgatcgactttgccttcccatatctcttgcagtttatccgtgaatacacaggcaaagttgatgaacttgtgaaggacaaaattgaggctcaaattgaagtcaagtctaaagagaaagaagaaaaggatgtaattgcacaacagaatatgtatgctcaattgctgcctcttgctttgcctgcgccacctatgcctggtatgggaggtggttttgcttcaacagcaccacctatgggtggaatgggaatgcctccgatgcctcctttcggcatgcctccaatgggtagctactgattttgttgatcagatcgggaaataggtgtagttgcttgttggttggagcacaagaacttagcagttgtttcaggcttgcttttgcgtggtgttcctcaggattcgtcgcctcccattgtttttttggtgttccttttgtctcatggtgaaagtctaatcagaaataacatggcatttttttgtactagttgtgtggatatgtgttgtagtattttttttttcccgggtagcagaggcattttttggctgctggtacagagcacgccgagagtttcctgctttgtactatttttcttgtggtccaaaattgaccaggattatcattaccaaacacttctacagatttaagttccaattacaatatgttctgtattttcattttcattcttaatttcctttattttca

SEQ ID NO: 5137 - DNA, 5551 bp, Phalaenopsis aphrodite
cgtacgacgacgtacacgacgaggtacgtacgtcgttctctctctctctctctctctctctctctctctctctctctctctctcttatatatactcctgtgcccttgagatccagcttttccatcttcccctcccctcttcctctcggaagatccgaaaggcttaatccactccagatcctcaagcttagccgcctgccgatcccatcgccatggctgcggccaacgccccgatttccatgcgggaggtcctaacgcttcccagcgctggcatcaatcctcaattcattacgtttacacatgtgacgatggaatcggataagtatatatgcgtgcgggagacctctccgcagaatagtgtggtgattattgatatgagcatgcctatgcagcctttgaggaggccgattactgcagactcggctctaatgaatcctaatagcaggattctcgcccttaaagctcaattacctggaactactcaagaccacctgcaaatatttaatattgagatgaaggccaaaataaaatcacatcaaatgcctgagcaggttgtcttttggaagtggataactcctaaaatgttgggtttggttacacaaacatctgtatatcattggtcaatagaaggagaatccgagccagtaaaaatgtttgaccggacagctaatttgactaacaatcaaatcataaactacagatgtgacccatcagaaaagtggctcgttcttattggcattgctcctggttctccagagaggccacaactagtgaaaggaaatatgcagctgttttctgttgatcaacaacgaagtcaagcgctcgaagcacatgctgcatcttttgcttcattcaaagttgttggaaatgagaattcatcaatccttatatgttttgcctcaaagacccacaatgccggtcaaataacttcgaaattgcatgtgattgagcttggggcccagccaggcaagccaggcttttccaagaaacaagctgatctattctttccgccagattttggtgatgactttcctgtggccatgcaggtttcatcgaagtatagtttgatatatgtgatcacaaagctcggccttctctttgtatatgacttggagacagctgcagcagtttatcgaaaccgaataagcccagaccctatatttctgacttcagaagcttcatctgttggtggattttatgccattaatagaagaggtcaggttctgcttgcaactgtgaacgaggcaaccatagtgccttttgtcagtggtcagttaaacaatcttgaacttgctgtaaatcttgcgaaacgaggaaatcttcctggtgcagaaaacttggttgtgcaaaggtttcaggaattgttctctcagacgaagtataaggaagctgctgaacttgctgctgaatctccccaaggactccttagaactccagagactgtagcaaagtttcagagtgtgcctgttcaagctgggcaaacaccgccattgttgcagtattttgggacattgttaacaagggggaaactcaacgcttttgagtctttggagttgtccaggcttgttgtgaaccagaataaaaagaatctcttagagaattggttggccgaggataaactggagtgcagtgaagaacttggggatcttgtgaagacggtagacaatgatctggcactcaaaatttacataaaagcaagggctactccaaaggttgttgctgctttcgctgaaagacgggaatttgataaaattcttatttattctaagcaggttggctacacaccagactaccttttccttttgcaaacaattttacggtcagatccacagggagcagtaaattttgctctgatgatgtctcaaatggagggtggcagcccagttgattataatacgattacagatctattccttcagagaaacctcatcagggaggcaacagcatttttgttggatgtattaaagccaaatcaacctgaacatgcttttcttcaaactaaggtcttggagattaatttggtaacatacccaaatgttgcagatgccatattagctaatggcatgtttagtcactatgatcgcccccgcatcgctcagttatgtgaaaaggctgggttatatgtgcgagctctccagcactattctgagttgccagatatcaagcgtgtaattgtgaatacacatgcaattgagccacaggcccttgtggagttttttggaacactttctaaagagtgggcattggaatgcatgaaggaccttttattagttaatttaagaggcaaccttcagataatagtgcaggtggcaaaagaatactgtgaacaattaggttttgatgcgtgtataaagctttttgagcagtttaggtcctacgaaggcctttacttctttttggggtcttatttgagttctagtgaggatccggagatacacttcaagtatattgaggcagcagcaaaaactggacagataaaagaagtggagcgtgttacaagagaatctaacttctatgaccctgaaaaaacaaagaacttccttatggaggccaagctaccagatgcaaggcccttgataaatgtatgtgatcgtcatggatttgttccagatttgactcactacctctacaccaacaatatgctgcggtacattgaaggatacgttcagaaggtgaacccaggaaatgccccaatggttgttgggcaacttcttgatgatgaatgtccggaagattttatcaaaggccttattctttcagtgcggtccctccttccagttgagcctcttgtggagcaatgtgagaaaagaaatcgtcttcggttacttacacagttcctagaacatcttgtgagcgagggaagtcaagatgtgcacgttcacaacgctctaggaaaaattatcatcgacagcaacaataatccagagcatttcttgactaccaatccattttatgattcccgtgttgttggtaaatattgtgagaagcgggatcctactttagcagttgttgcatacaggcgagggcaatgtgatgatgaacttattaatgttacaaacaagaattccctgttcaaattacaagctaggtatgttgtagaaagaatggatgctgatctctgggccaaggttcttgaacctgagaatgaatatagaaggcagcttatcgatcaggttgtttctacagcattgcctgaaagtaaaagtccggagcaagtatctgctgctgttaaagcatttatgactgctgatcttccacatgaacttattgaactccttgaaaagattgtactccagaattctgcctttagtggaaacttcaatttgcagaatctgctgattttgacagcaattaaagctgatccgtcaagggtcatggattacgttaatcggttggacaactttgatgggcctgcagttggggaggttgctgttgaagggcaattatatgaggaagcctttgctatctttaagaagttcaacttgaatgtgcaagcggtgaatgtcttgttggacaatatccgaagcatagagagagctgtagagtttgctttccgggtagaagaagattctgtttggagtcaggttgctaaggctcagttaagggaaggactagtgagtgatgcaatcgaatcatttattcgtgcggatgatgcaacacaatttttggatgttattcgtgctgcggaagatgccaatgtgtatcatgacttggtgagttacctattgatggtgaggcaaaaggtgaaggagcctaaggtggacagtgaattaatatatgcatatgctaagattgatcgtcttggtgatattgaagaattcattcttatgccaaatgttgcaaatcttcaaaatgttggcgaccgattatacgatgcagaattatatgaagctgctaaaattatatttgccttcatttcaaactgggccaaactggctagtacacttgttaagctgaaacaattccaaggtgcagttgatgctgctcgtaaagcgaacagctcgaagacatggaaggaggtttgctttgcttgcgttgatgccgaggagtttcgattggcacaaatatgcgggcttaacatcattgtccaggttgatgacttggaagaagtcagtgattattaccagaacaggggatgcttcaatgaacttatctctcttatggagagtggacttggtttagaacgtgctcacatgggcatttttacggagttgggagtgctatatgctaggtatcgagaggagaaacttatggagcacattaaacttttctctacacgtctcaacattccaaaacttattcgtgtttgtgatgagcaacaacactggaaggagcttacttatctgtacattcagtatgatgaatttgacaatgctgccaccacaattatgaaccattcgccagatgcatgggatcacatgcagttcaaagatgtttcagttaaagttgctaatgttgagctttattacaaggccgtgcatttctacttggaagaacatccagacctcatcaatgatcttcttaacgtgctagccctacgtgttgatcacacacgtgtggttgatattttgcgaaaggctggccatttgcatcttattaagccatatatggttgcggtgcaaagtaataatgtagctgcagtgaatgaagcattaaatgagatatatgtagaggaagaggactatgaacgacttcgggaatcagtcgatatgcatgataactttgatcaaattggacttgcacaaaagcttgagaagcatgagcttcttgaaatgaggcggattgctgcttacatttacaagaaagctggaagatggaagcaatccattgcactgtctaagaaggacaaactttacaaggatgccatggaaactgcctctcagtctggggaccgtgagcttgctgaggagctgcttgtttactttattgagcagggtaagaaggaatgttttgcttcatgcctctttgtctgttatgagctaatcaggctggatgtcgtccttgagcttgcctggatgaataacatgatcgactttgccttcccatatctccttcaagttatccgcgagtactcgggcaaggtggatgaactgataaaggataaaattgaaacacaaaacgaagtgaaagccaaagagaaggaagaaaaagatatggtagctcaacagaatatgtacgcccagcttcttccccttgccttgcctgctcccccgattcctggcatggggggagttggcggaggcttcgtacccccgccaccgcccgtcgcaatgggtgggatgggtatgcccccgatgccaccattcggcatgcctccgatgggaagctactgataaaatttttgttttaaacattttgtacttctcgtgtttcatcaacaatgcggaaatttttcaaagttgtgatagccattgcttattattcacatttaggtaatgcttaattttctattaatgctcttattggatgtcaggtgcagttttgccgtttattgggggctcgtttgtattttccgtgttatcttttggtgagggttattctgctgtagtgtg

SEQ ID NO: 5138 - DNA, 5854 bp, Gossypium raimondii
agaactaatggaatttactcattgttccttcttcgcttttgtgtcatcatcagtggcttagattggatcggtctctgcttcttttcctttttcagttcttccgcaagattccatcttcatttcatttatcctctcaatagattttcaattgtttttttttaatccctgcttcagatctcttggcagagtttttccattttttttcgcgtctcgttctcggtgtttcctttgactcgcaaattgaaagatttgatctcgggcgtagatctgctcctgattcgtcaatcctcgtccgttgatctgagccaccatggcggctgcgaacgctcctattgccatgaaggaggtcttaactttgccaagcattggcattaatccgcagttcattacattcacgaacgtaactatggaatctgataagtatatttgcgtgagagaaactgcaccgcaaaatagtgttgtgatcatcgacatgagcatgccgatgcagccgttgagacggcctattacagcggactctgctcttatgaatccaaattctagaatcctggctctgaaagctcaactgccgggaacaactcaagatcatttgcaaatatttaacatagagatgaaagcaaaaatgaagtcacatcagatgcctgaacaggttgtattttggaaatggatttccccaaaaatgcttggcctagtcacacaaacttctgtgtatcattggtcaattgaaggcgactccgtaccagttaaaatgtttgagagaacagcaaatttagtgaacaatcagataataaactataaatgtgatccttctgagaagtggttggttttgattggaattgcccctggtgcacctgagaggccgcaattggttaaggggaacatgcaacttttctccgttgatcagcaacgtagtcaagctcttgaagcacatgctgcttcatttgcacaatttaaggttccaggaaatgagaatccttctattctaatttcctttgccacgaagacttttaatgctggtcagattacatcaaaattgcatgtaattgagcttggtgcgcagccaggtaagccatcgttttcaaagaaacaggcagatctattctttccaccagattttcaagatgattttccagttgcaatgcagatatcccacaaatatagtttgatctatgttatcaccaagctaggactgcttttcgtttatgatctagagactgcaagtgctgtatacagaaatagaatcagtccagatccaatatttttaacctctgaagctacatcagcgggagggttttatgccatcaacaggcgagggcaggtgttgctggctactgtaaatgaagcaacaatagtgccatttgttagcggtcaattgaacaatttggagcttgctgtcaatctagctaaaagaggaaaccttcctggtgcagagaacctggttgttcaacgttttcaagaattgtttgctcaaacgaagtataaagaagctgctgagcttgctgcagagtctccacaagggatccttcgtacacctgatacagttgccaagtttcagagtgttcctgtgcaagctgggcagactccaccgctgttgcagtactttggtacgcttttaactagagggaagctcaatgcattcgagtcattggaattatctcggcttgtggtaaaccaaaacaagaaaaatcttctggaaaattggttggctgaagataagttggaatgtagtgaggaacttggagaccttgtgaagactgtggataatgatcttgctctaaaaatatatattaaagctagggcaactccaaaagttgttgcagcttttgcagaacggagggagtttgataaaatcttgatttactcgaagcaggttgggtacgctcctgattacttattccttctgcaaacaattcttcgtacagatccacagggagctgtaaattttgcattgatgatgtctcaaatggagggaggttgcccagttgattacaacaccattactgatctttttcttcagaggaacttgatacgggaggctacagcatttctattggacgttttgaagcctaatctgcctgagcatgcttttctacaaactaaggtcttggaaatcaatctagttacttttccaaatgttgctgatgccattttagcaaatggcatgttcagtcactatgaccgtcctcgcattgcacaactctgtgagaaagctggtctctatgtccgagctctgcagcattacactgagttaccagatattaaacgtgtcattgtgaatacacatgctattgagccacagtcacttgttgagttttttggtactctttcacgagaatgggctttggagtgcatgaaggatcttttgctggttaatctaaggggcaacctccaaataattgttcaggttgccaaggagtattgtgagcagctgggtgttgatgcttgcataaagctttttgagcagtttaagtcttatgaaggattgtacttctttctgggctcttatttgagctcaagtgaggaccctgatatacactttaagtacatcgaggcagctgctaaaactggacaaataaaggaggttgagcgtgtgaccagggaatccaacttttacgatgctgagaagacaaagaacttcctgatggaggccaagcttcctgatgctaggccgttgattaatgtttgtgatcggtttgggtttgttcctgatctcactcactatctctacacaaataacatgttacgttacattgaaggttatgttcagaaggtgaacccagggaatgctcctttagtggtggggcagttgctagatgatgaatgccctgaagattttatcaagggcctcattctctcagtccgttctttgcttccagtcgagccccttgtggaggaatgtgagaagagaaatcgtcttcgtttacttacacagttcttggagcatcttgtaagtgagggaagccaagatacacatgtccacaatgctttgggtaaaatcatcattgacagcaataacaatccagagcatttcctcacaaccaacccttactatgactcccgggttgttggcaagtactgtgagaagcgtgatcccaccctagcagttgtggcttaccgaagaggacaatgtgatgatgaacttatcaatgtcacaaataaaaactcattgttcaaattgcaagccaggtatgttgttgagaggatggatggcgatctttgggagaaggtgctaaatcctgaaaatgaatacagaagacagctaattgatcaggttgtgtcgacagctttgccagaaagcaagagtccagaacaagtctctgccgctgttaaagctttcatgactgctgacctgccccatgaactgattgaacttcttgagaagattgttctccaaaactctgcattcagtgggaacttcaatctgcaaaatcttcttattctgacagctattaaggcagatccatctagagttatggattatatcaataggctagataattttgatggacctgcagttggagaagtggccgtcgaagctcaactgtatgaagaagcatttgcaattttcaaaaagttcaaccttaatgttcaggctgtcaatgttttattggataacataagaagcatcgatcgggctgtggaatttgcattccgagttgaagaagatgctgtttggagtcaggtggcaaaggcacaactgagggaggggctagtaagcgatgcaattgaatcgtttattcgtgcagatgatgctactcagttccttgatgtaatccgagcatctgagggtgctgatgtgtaccctgatttggtgaggtaccttctgatggttagacagaaggtcaaggagcccaaggtggatggtgaactcatttatgcatatgcaaagattgatagactgggtgaaattgaagaattcattctcatgccaaatgttgctaatcttcaaaatgttggtgatcgtttgtttgatgaagccttgtatgaagctgctaaaataatatttgcatttatatcaaactgggccaagttggctgttacactggtgaggcttaaacaattccagggtgctgttgatgcagcccgaaaagcaaatagtgccaagacatggaaggaggtttgctttgcttgtgttgatgcagaggaattccgattggcacagatatgtggtcttaacattattatacaggtggatgacttggaagaagttagtgaatactatcaaaataggggatgtttcaatgagttgatctctctcatggagagtggtttaggattggaacgtgcacacatggggatctttactgagttgggagttctttatgccagatatcgttatgagaagcttatggagcacattaaattgttctctactcgtctcaatatccccaagctgataagagcctgtgatgagcagcagcattggaaggaacttacgtacttgtatatccagtacgatgagtttgataatgctgctactactgtgatgaaccactctcctgaagcatgggatcacatgcaatttaaagatattatagtcaaagttgcaagtgttgagctttattacaaggctgtccacttctacttgcaagaacatcctgatctcatcaatgatatgcttaacgtgcttgcactacgagtggatcacacccgtgtcgttgacattatgagaaaggctggtcatctgcgtcttgtgaagccatacatggttgctgttcagagcaacaacgtgtcagcagtaaatgaggcattgaatgagatttatgtggaggaagaagattatgatagattgagagaatctattgacttgcacgataactttgatcagattggccttgcacaaaagattgagaaacatgagctgcttgaaatgaggcgtgttgctgcatacatttacaaaaaggcaggtagatggaagcagtcaattgccttgtcaaagaaggacaaccattacagagatgcaatggaaacagcttcacagtctggtgaacgtgaacttgccgaggagttgcttgtttacttcattgagcagggcaagaaagaatgctttgcatcgtgcctctttgtctgttatgacttagttcgaccagatgttgcccttgagctagcctggataaacaatatgattgactttgcattcccgtatctattacagtttatccgtgaatacactggcaaagttgatgaacttatcaaggacaagattgaggctcaaaaggaagtaaaggctaaagagcaggaagagaaggatgtgatcgcacaacagaacatgtatgcacagttgctacctcttgccttgcccgcaccgccagtgccaggcatgggaggttttgctccaccacccatgggaggaatgggaatgcctccaatgccagctttcggcatgccaccaatgggcagctattaagtcgtaacaggtctgttcaattgaaacattttatgttacctagtggatcaatggggctccatatagctgcaatttcgaggctttcattctttttcccctctttcgttttcatttgtctgatgagtgaagatcaaaatttggaataatgccatttttgtgtttcaagtgtgtgatatatggccttgtaatattcttttatttagaagaggtattttttggggtggtgatagagagcaaaccgaggatttcatgaatttgtaatttgtagtattatttcctgtcggtcattggaatcgaccgagcatgtaccaaaaaaacttacacaccaatcatatttttggattttaatgttcttatttaaacgttgtttccccttaaattcactgctaaaccatcttagaattaggatttatgtatagttaaataaaatttgacatggatttttat

SEQ ID NO: 5139 - DNA, 5424 bp, Musa acuminata
cccgaatcggctgccatggccgcggccaacgcccccatcgtgatgcgggaagccttgacgcttccgagcatcgggatcaatcctcagttcatcacgttcacgcatgtcacgatggaatcggacaaatatatatgcgtcagggagacctctccagaaaatagcgtcgttatcgttgatatgaacatgccgatgcagccgttgaggaggccgatcactgcggattctgctctgatgaaccctaacagcaggattcttgctcttaaagctaaaatacctggaaccactcaggatcacttgcaggtattcaatattgaggcgaagtctaaaattaaatctcatcagatgcctgagcaggttgtcttttggaagtggataaccccaaagatgttgggtctcgtcacacaaacttctgtctatcattggtcaatcgaaggtgaagccgagcctttgaagatgtttgatagggctgctaacttgacaaacaatcagatcattaactataagtgtgaccccacagagaaatggctagttcttattggaattgcacctggtgcttcagagagaccacaactggtgaaaggaaacatgcagctcttttccgtggatcagcagcgaagtcaggcacttgaagcacatgctgcatcctttgcatcattcaaggtggttgggaatgagaattcctccactctcatttgttttgcctcaaagtcaagtaatgctggacaaattacctcaaagttgcatgtcattgaacttggagcccaaccagtgaaacctttaccagggaagccaggtttcacaaagaaacaagcagatctattctttccaccagattttgcagatgacttccctgtggcaatgcagatctcccaaaagtacagtttggtatatgtcatcacaaaacttggtttgcttttcgtgtatgatcttgaaacaacagcagcagtttacagaaatcgaatcagtccggatcctatatttctcacaaccgaggcttcaaatattggtggattttatgcgatcaacaggaggggccaggttctgctggctactgttaatgaagcaacaattgtgccattcatcagtgggcaattgaacaatctggagcttgctgttagcattgcaaaacgaggcaaccttccaggagcagagaatttggttgtgcagaggttccaagaactattttcccagacgaaatataaggaggccgctgaacttgctgcggaatctccacaaggcattcttcgaactccagagactgttgcaaagtttcagagtgttccggtacaagctgggcagacaccaccactgttgcagtattttggaacattgttaacaagaggaaaacttaatgcttttgaatctttagagttatctcgtcttgttgtcaaccagaacaaaaagaacctactagagaactggttagctgaagacaaactcgagtgcagtgaagaacttggggatcttgtcaagactgtagacaatgatcttgcactgaaaatctatataaaagcaagggctacaccaaaagttgttgctgcttttgctgaacgaagggaatttgacaagattcttatttactcaaagcaggttggctacacaccagattatcttttccttctgcagacaattctgaggtcagatcctcagggagcagttaattttgctcttatgatgtcacaaatggagggaggttgtccagtggattacaatacaatcactgatctctttcttcagagaaatctgattcgagaggcaacagctttcttgttagatgtcttgaagccaaatctgcctgagcatgcttttcttcaaaccaaggttttagagataaatttggtgacatatccaaatgttgcagatgctatattggctaatggaatgttcagtcactatgatcgtcctcggattgctcagctttgtgaaaaagctggcttgtatgtgcgagcccttcagcattattcggagttgcctgatataaaacgtgtcattgtgaatactcatgccattgaaccacaggcgcttgttgagttctttgggacactttccacagagtgggcactagagtgcatgaaggaccttttaatggtcaatttgagagggaaccttcagataattgtgcagactgcgaaagaatattctgagcagttaggtgtggatgcctgcataaaattatttgagcaatttaagtcctatgaaggtctttacttcttcttgggttcttatttaagctccagtgaagatccagacatacacttcaagtatatcgaggcagcagcaaaaactggacagttaaaagaagttgagcgtgtaacaagagaatctaacttctatgaccctgagaaaacaaagaattttctgatggaagccaaacttccagatgcaaggcccttgatcaatgtttgtgaccggtttggttttgttccagatttgactcactatttatatacgaacaacatgctccgttacattgaaggctacgttcagaaagtaaacccgggaaacgctcctttggtagttgggcagctgctggatgatgaatgtcctgaagattttattaagggtctgattctttctgtccgttctctcctgcctgtcgagcctcttgtggatgaatgtgagaagaggaatcggctacgactgctcacacaatttttggaacatcttgttagtgagggtagtcaagatgttcatgtccataatgctcttggaaaaattatcatagacagcaacaacaatccagagcattttctaactactaacccatattatgattcacgtgttgttggtaaatattgtgaaaaacgggaccctactcttgcagttgttgcatatagacgaggtcaatgtgatgatgaacttatcaacgttaccaacaaaaattccttgttcaagctgcaagccagatatgtcgttgaaaggatggatgctgatctatgggagacagttcttcaacctgaaaatgaatacagaaggcaacttattgatcaagttgtttctaccgcattgcctgagagcaagagcccagagcaagtctctgcagctgttaaagctttcatgagtgctgatcttccacatgaacttattgaattacttgagaagattgtgctacagaactctgccttcagtgggaacttcaatctgcaaaacctactgattttaaccgctattaaagcagatccaccaagggtcatggattacattaatagattagacaattttgatggtccagcagttggtgaggtggcagttgaagcacaactttacgaggaagcctttgccatattcaagaaatttaacttaaacgttcaggcagtaaatgtcctcctggataatatccaaagcatagagcgagctgtagagtttgctttccgtgttgaggaagatgctgtgtggagccaggttgcaaaagctcaattgcgggaagggttagtaagtgatgcaattgaatcattcattcgtgctgatgatgaaacccagttcctcaatgttattcgggctgctgaagatgctaatgtatatcatgacctggtgaagtacttgttgatggtgaggcagaaagttaaagagccgaaagtggatggtgaactgatatttgcatatgctaagattgataggctaggtgaaattgaggagttcattctcatgccaaatgttgctaatcttcaaaatgttggcgaccgtttatttgatgatgctctttacgaagctgctaagattatatttgcttttatttcaaactgggcaaaactggcttgtacactcgttaagctgaagcagttccagggtgctgttgatgcagctcgcaaagcaaatagctcaaagacatggaaggaagtttgttttgcttgtgttgatgctgaggagttccgcttggcacaaatatgtggtctgaatattattatccaggtggatgacctggaagaggttagtgattactatcagaacagaggttgcttcaatgagttaatctctctcatggagagtggccttggcttggaacgtgcacacatgggcatctttacagagttgggggtcctatatgctagatacagatcagagaaacttatggagcacattaaacttttctcaacccgcttgaacattcccaagcttattcgtgtttgtgatgagcaacaacattggaaagaactaacctacttatatatacagtatgatgaatttgacaatgctgccacaactatcatgaaccattctccagatgcatgggatcatatgcagttcaaagatgttgtagtcaaagttgcaaatgtggagctctattacaaggctgttcatttctacttacaagaacatcctgacctcatcaatgatgttttacatgtgcttgcacttcgtgtggaccacacacgtgtagtagatatcatgagaaaggctggttacttgcatctagtgaagccatatatggttgcagttcaaagtaacaacgtagctgctgttaatgaagcactaaatgaaatttatgttgaggaggaagactatgatagattgcgtgaatcagttgatttgcacgataactttgatcagataggccttgcacagaggattgaaaaacacgagcttcttgagatgcggaggattgctgcatatatctataagaaagctgggagatggaagcagtccattgcactatccaagaaggacaacctttacaaagatgcaatggagacgtgttcgcagtctggtgaccgtgaactttcagaagaattgcttgtttattttatcgaacagggaaagaaggaatgctttgcatcgtgtctcttcatttgttatgacttgatccgtcctgatgttgcccttgaacttgcctggatgaacaatataattgactttgcattcccatacctcttgcagtttattcgtgagtacactagcaaagttgatgagcttgtaaaagatagaattgaagcacagaatgaagtgaaaaccaaagaaaaggaagaaaaggatttggtttcacagcagaatatgtatgcacagttgctgcctcttgctttaccagctccgcctggtatgggagcgccaaacatgggtggaccttatgcagttcctccaccaatgcctggcatgggaatgcctccgatggcaccatttggaatgcctccaatgggaagttactgagaaattttgttattgggacaacatgcaatgcttgttcttaatgtgcaacggttcaaatcgattggagactccagtcttgttgatgctgatatgttatacatttcatattcttttgctagcagtgattgattgccactgaggccagagcctagggcttttgtatggtctccgtactgtgtgagagtggtgcttatgatgtatagggtcatttagtgttgagcaaaacaactactgttgttcttttaaaaaaaaaatagttaaaatgacctgattagatattgt

SEQ ID NO: 5140 - DNA, 5470 bp, Papaver somniferum
atcctccatttgaaaccaatctagtagttgtctctagtgtcgatctagacaccatggctgctgctaatgctcctatcaccatgaaggaggccttgactttaccgtcgattggcattactccacaattcattacgtttactcatgttactatggaatcggataagtacatatgtgtaagggagacatcaccacagaatagtgttgttattattgatatgagcatgcctaatcaaccactaagaaggcctatcaccgcggactcggctttgatgaatcctaattccagaattcttgctttgaaagctcaacttccgggaaccactcaggatcatctacaaatattcaacattgaaatgaaagcgaaaatgaagtcccatcaaatgcctgaacaggttgtcttttggaagtggatttccccaaaaatattaggcctggtcactcaaacctcggtatatcattggacaattgaaggtgaatcagatcctgtaaagatgtttgatagaacagccaatttagcaagtaatcaaataatcaactacagatgtgatccttctgagaaatggttggttttgattggaattgcacccggttcacctgagaggccgcaacttgtcaaaggaaacatgcagcttttctctgtggaacagcaacgaagtcagtcgcttgaagcgcatgctgcatcttttgcttcacataagattccagggaatgaaaacccatctactctcatttgttttgccacgaagaccaccaatgctgggcaaattacgtcaaaattgcatgtgattgagcttggtgcccagccaggcaaaccagctttttcaaagaaacaagcagatcttttctttcctccagatttcgctgatgactttccggtgtcaatgcagatatcacacaagtacagcttgatctatgtgattacaaagcttgggcttttatttgtgtatgatctcgagacagctacagcagtttacagaaaccgaattagtccggatcctatatttttgacggcggaagcttcatctgtaggaggcttttatgctgtgaatcggcgtggacaagttctgcttgctactgttaatgaggcaactattgtgccttttgtcagcggccagttaaacaatcttgaacttgctgtaaatcttgccaaaaggggaaaccttcctggggcagaaaacttggttgtccagcgcttccaagaattgttctctcagacaaaatacaaggaggctgcagagcttgctgcagaatccccacagggtatcctgcgtactccagacactgttgccaaatttcagagtgttcctgttcaagctgggcaaactcccccacttctgcagtactttgggacattgttaaccagaggaaagctcaatgcatttgaatcactggagttatcacgacttgttgtgaatcagaacaaaaagaatcttttggagaattggttggctgaggataaacttgaatgcagtgaggaacttggagaccttgtgaagactgtggataatgaccttgcactgaaaatatacatcaaggctagagctactcctaaagttgttgcggcctttgctgaacgaagggaatttgataaaattctcatctactcgaagcaggttggatacacacctgattatctattcctcctgcaaacaattctgcgatcagacccccagggagctgtcaattttgctctgatgatgtcacaaatggaaggtggatgtccagttgattataacacaatcaccgatcttttcctacagcggaacttgattcgtgaggcaacggcttttctattggatgttctgaagccgaatttgccagagcatggttttctacaaacaaaggtcctggagatcaatctagttacttttccaaatgtagcagatgcgatcttggccaatggcatgttcagtcactacgaccgtcctcgcgttgctcagctttgtgaaaaagctggactgtatgtccgtgctctccagcattatgccgagttgcctgacatcaaacgagttattgtgaatacacatgcgattgagccacagtcacttgtagagttctttgggactctttctaaggagtgggctctggagtgcatgaaggaccttttacttgttaacctgagaggaaatcttcagataattgttcagactgccaaggaatattcagagcagttgggtgttgaggcgtgcattaagctctttgagcaatttaagtcttacgaaggtttatacttcttcttggggtcgtacttgagttccagcgaggatcccgaaattcactttaagtacattgaagctgctgctaagactggacaaattaaggaggttgaacgtgtgacacgagaatcaaacttctatgatgctgagaagaccaaaaatttccttatggaggccaaacttccagatgcgcgtccattaattaatgtctgtgatcgttttggtttcgttcctgacctcacccactacctctacactaacaacatgctgcgatacatcgagggttatgtacaaaaggtcaatccagggaatgctcctctagttgtagggcagcttttggatgatgaatgcccagaagatttcatcaaaggacttattctttctgttcgttcacttctcccagtggagccccttgtagatgaatgtgagaagaggaatcgtcttcgtttactgacccaattcctggagcatcttgtaagtgaagggagtcaagatgtgcatgttcataatgccctgggtaaaattatcattgatagcaacaacaatcctgaacatttcctcaccaccaatccatactatgattcacgcgtagttggtaaatattgtgaaaaaagggacccgaccttggcagttgttgcttaccgtagaggacagtgtgacagtgaacttattaatgtcacaaacaagaattccttgttcaaattgcaagccaggtatgtggtggagaggatggattcggacctctgggatttggttcttaaccctgaaaatgagtatagaagacagctaattgatcaagtagtttctactgcgttgcctgaaagcaagagcccagagcaagtttctgcggcagtcaaagctttcatgacagctgatcttccacacgagctaattgagctgcttgaaaagatcgtacttcaaaactctgctttcagtggaaactttaatctgcaaaatcttttgattctgacagccattaaagcagatgcgtctagagttatggattacatcaataggctggacaatttcgatggacctgctgttggggaggtagctgtggaagctcaactgtttgaagaagcatttgccattttcaagaagttcaatttgaatgtccaggccgtgaacgtccttttggataatattcaaagcattgaacgagctgaggagttcgcattccgtgttgaagaagatgctgtttggagtcaggtggccaaggcccagctcagggagggtttagtgagtgaggctattgagtcgttcatccgtgctgatgatgccactcatttcttagatgttatcaaggcttccgaggatgcaaatgtatatcatgatctagtgaagtacctcttgatggttagacaaaagtctaaggagcccaaggtggacagcgagcttatttatgcatatgctaagattgataggttgggtgatattgaagagtttattctaatgccgaatgttgctaatctccaaagtgttggtgatcggttatacgatgaagaactctatgaggctgccaagatcatatttgctttcatttccaactgggccaagctggcagtttgtcttgttaagcttagacagttccaaggtgctgttgatgcagctcgtaaggccaacagtgcaaagacatggaaggaaatttgctttgcctgtgttgatgccgaggaattccgtttggctcagatatgtgggctcaacatcatcatacaggtggatgacttggaggaggtcagtcaattctatcagaacaggggctgcttcaacgaattaatttctctaatggagagcggtctaggattggagcgtgcacatatgggtatctttaccgagttaggagtcctatatgccagatatcgtccagagaagctcatggaacatatcaagctgttctcaacccgtctcaatattcctaagcttattagagcatgcgatgagcaacaacactggaaggaattagtatatctatacatacagtatgatgaattcgacaatgctgcaaccaccatcatgaatcattccccagaagcatgggatcacatgcaattcaaagatgtggcagttaaagttgcaaatgtggaactatactacaaggcggtccacttttacttgcaagagcaccctgatcttattaatgatatgctcaatgtgctcgctcttcgtgtggaccatactcgtgttgtagacataatgcgcaaggctggtcacctgctccttgtgaaaccatacatggttgccgttcagagcaacaatgtctctgctgtgaatgaggcattgaaccaaatctacgtcgaggaggaagactatgataggctgcgcgaatcgattgacatgcatgacaattttgatcagataggccttgcacagaaggttgagaaacacgagcttcttgaaatgagaagaatagctgcttatatttacaagaaagcaggtaggtggaggcagtccattgcattgtcgaagaaggacaacctttacaaagatgccatggagacatgttctcaatctggtgatcgtgagctttcagaggagttgctcgtgtatttcattgagcagggtaagaaggagtgctttgcatcatgcctctttgtttgttatgatttaatccggcctgatgttgcgcttgagcttgcctggatgaacaacatgatcgattttgccttcccgtacctattgcaatttatccgtgagtacactggtaaagttgatgagctggttaaggatagaattgcggcccaaagtgaagttaaggtcaaagagcaggaggagaaagatatggtagcacaacagaacatgtatgctcaattgctaccacttgcattgcctgcaccaccaatgcccggtatgggaggtggcgggggaatgggaggttatggtcctccaccccccatgggaggtatgggaatgcctccaatgccagcatacggaatgcccccgatgggttaccaatgatccaggttaaagcaagattattgtatcgaacagtggtcatttgtaagcaccagcatatagaacatccgagaagtttgtgctgtcaggttgatgggatgaatgatgtttaattctaattttggggatgtgaagggagtctgagaaataagatataatgatccatattctttggtttttcctatctggcatatagatgttattagtctgtaaaagatattctttgggtagcataaaaaggggcatgtgtattttcttttcttaccactattggaaggctgagctgaccgtcttatcatctc

SEQ ID NO: 5141 - DNA, 5677 bp, Aquilegia formosa
ccatggcggctgcaaatgctcctatcactatgaaggaggcattaacgttgcctagtattggaattaatccacaattcatcacgttcacacatgtaacgatggaatcagataaatacatttgtgttcgagagacatcaccacagaatagtgttgttataattgatatgaacatgccaaatcagccattgagaaggcctattactgctgattctgcgttgatgaatcctaatagtagaattcttgctctgaaagctcaacttcctggaactactcaagatcatttgcaaatattcaacatcgaaatgaaagcgaagatgaagtcacatcagatgcctgaacagattgtattttggaagtggattactccaaaaatgttgggcctggtcacacaaacctcagtgtatcattggtcaattgaaggtgattcagagcctgtaaaaatgtttgatagaacggctaatttggcaagtaatcaaataattaactatcgctgcgaccctgctgagaagtggctggtcttgatcggaattgctccaggttcagctgagaggccacaactggtgaagggaaatatgcagcttttttctgtagatcaacaacgcagccaagctctggaagcccatgctgcagcatatgcctcacataaggttcctggaaacgagaatccttctactcttatttgctttgcttcaaagactacaaatgctggtcaaatcacatcgaaattgcacgtaattgaacttggtgctcagccaggaaaaccggcttttacaaagaaacaagcagatcttttcttcccaccagattttgctgatgactttccagtagcaatgcagatatcacacaaatatggtttgatatatgtgatcacaaaacttggacttctgtttgtatatgacctggagacggcaactgcagtttaccggaatcgaatcagtcctgaccctatatttttgacttctgaggcctcatccgtaggaggcttttatgctgtcaatcgacgagggcaggtgctacttgccactgtcaatgaagcaacaattgtgccttttgtcagtggtcaattgaacaatctagagcttgctgttaatcttgctaaaagaggaaaccttcctggggctgaaaacttggttgttcaacggttccaagaactgttttctcagacaaaatacaaggaagctgctgagcttgctgcagaatctccacagggaattcttcggactcctgatactgttgcaaagtttcagagtgtacctgttcaatctggacaaactccaccattgttgcagtactttggtacactgttaactagaggaaagctcaatgcatttgaatcgttggaactttcacgacttgttgtgaatcagaataaaaagaatctcttggagaattggttggctgaggacaagcttgaatgtagcgaggaacttggtgaccttgttaagactgtggataatgaccttgctcttaaaatatacatcaaggctagggccaccccgaaggttgttgctgcttttgctgaacgccgggaatttgacaaaattctcatttattcaaagcaggttggatacacgccagattatctgtttcttctgcaaacaattttacgggcagatccccagggagcagttaattttgctttaatgatgtctcaaatggagggaggttgcccagttgattacaacacaattactgatctctttcttcagcgaaacttgattcgtgaggcaacagcctttttgttggatgttcttaaaccaaatttaccggagcatgcattcctccaaaccaaggtcttggaaatcaatctagttacatttccaaatgtagcagatgctattctggcaaatggcatgttctcgcactatgatcgtcctcgaattgcacaactttgtgaaaaggctggtctgtatgtgcgtgctcttcagcactatgctgaactaccagatataaaacgtgtcattgtgaatacacatgccattgagccacagtcactggtcgagttctttggaaccctttcaagagaatgggcactggaatgtatgaaggaccttttacttgttaatctgagggggaatcttcagataattgtgcagactgccaaagaatattctgagcagttgggtgttgattcttgcataaagctctttgaacaatttaagtcttatgaagggttatatttctttctgggatcgtacttgagttccagcgaggatcctgacattcacttcaagtatatcgaggcagctgcaaaaactggtcaaatcaaggaagttgaacgtgtaacaagagagtcaaatttctacgatgccgagaaaacgaagaacttcttgatggaagccaaattaccagatgcacgtcctttgattaatgtctgtgatcgatttggttttgttccggatttgacacattacctctacacaaacaacatgcttcgatatattgaaggctatgttcaaaaggtcaacccaggaaatgctcctctagtcgtggggcagttgctagatgatgaatgccctgaagatttcattaaggggctcattttgtcagttcgttctctccttcctgtggagcctcttgtggaggaatgcgagaagaggaatcgccttcgtttgctgactcaatttttggagcatcttgtgagtgagggaagccaagatgtgcatgttcacaatgctttgggtaaaatcatcatagacagcaacaataatcctgaacactttctcaccaccaacccatactatgattcacgcgttgttggtaaatattgtgagaaacgagacccaacattggcagttgttgcttatcgaagagggcaatgtgatgacgagctaattaatgtcacaaacaagaactcactgttcaaactgcaggccagatatgtggtggaaaggatggattctgatctgtgggagaaagttcttaacccagaaaatgagtacagaagacagctcattgatcaagttgtatccactgcattgcctgagagcaagagccctgagcaagtttctgcggctgtcaaggcgttcatgactgctgatcttccacatgaactaatagagcttcttgagaaaattgttcttcaaaactctgctttcagtggtaacttcaatttgcagaatctcctgattttgactgctatcaaggcagatgcatctagagttatggactacatcaatagattggacaactttgatggacctgctgttggggaggtcgctgtggaagcacaactgtatgaagaggcatttgctatcttcaagaagttcaacttgaatgttcaggctgttaatgttctcttggataacattcaaagcattgagcgagctgtggagtttgcctttcgtgttgaagaagatgctgtttggagtcaggttgccaaggcccaactcagagagggattggtcagtgatgcaattgagtcatttattcgtgcagatgatgccactcagtttttagatgtaattcgtgctgctgaggataccaactgttaccatgacctggtgagatatctattgatggttaggcagaagtccaaggaacccaaggtggacagtgagctcatatatgcatatgccaagattgataggctaagtgacattgaagaatttattttgatgccaaatgttgccaatctccaaaatgttggtgatcgactatatgatgagtccctctacgaggctgcaaagatcatatatgcctttatctctaactgggccaaactagctgtcacacttgtgaagttgaaacaattccaaggtgcagttgatgcagctcgaaaggccaacagtgcaaagacatggaaggaagtttgttttgcatgtgttgatgccgaggagttccgcttggcacaaatatgtggtctcaatatcattgtacaggtcgatgacttggaggaagttagtgattattatcagaacagaggttgcttcaatgagttaatatctctcatggagagtggtctaggattggaacgagctcatatgggcatatttactgagctaggggtcctatatgctagataccgtcctgagaagcttatggaacacatcaagcttttctcaactcgtctcaacattcccaagcttattagagcctgtgacgaacagcaacattggaaagaactcacctatctgtacatccaatatgatgagtttgacaatgccgcaacgaccattatgaaccattctccagaagcttgggatcatatgcagttcaaagatgttgcggttaaagttgcaaatgtggaactgtattacaaggcagtacacttctacttgcaggaacatcctgatcttattaatgatttcctcaatgtacttgcccttcggcttgatcacacacgtgttgtcgacataatgcggaaggcgggctttctacatcttatcaagccatacatggttgcagttcaaagcaccaacactcctgccgtaaatgaggctttgaatgggatctatgttgaggaagaggattatgagaggctacgtgaatccattgacatgcatgatagctttgatcagataggtcttgcacaaaaggttgagaaacatgaacttctggagatgagacgtatagctgcgtatatatataagaaagctggtagatggaagcagtctattgccttgtcaaagaaagatagcctttacaaagatgccatggagacgtgctcacagtcaggtgatcgtgagttatcagaagagctccttgtatatttcattgagcagggaaagaaagagtgttttgcttcgtgcctctttgtgtgttatgatttaatacggccggatgttgcacttgaacttgcctggatacacaatatgatcgactttgcgtttccgtatctattacagttcattcgtgagtatacaagcaaagttgacgatcttgtgaaggacaaaattgaggctcttagtgaggtgaaggccaaagagaaggaggaaaaagatatggttgcacagcagaatatgtatgcccaattgctgccacttgctttgcctgccccgccagggatgggaggagctggattaggtggaggatatggccccccacctggcatgccacaaccatttggcatgcctggcatgcctccaatgcaacaacctggcatgcctccaatgccacaaccatacggcatgccgcaatactgagcttaaggtgtacgcatgaatcataaagaatcgcggtagtaccataagtgaaaggaaggcatgctgataggtggaagctcctgtttgtgtacacaaattgtgagatatctacttggggaatgtgaagcttcaaggttccgaataagatcaacattcattttcagttaaggttggttgtactttttagtattcttttggtagcagaggcattttttgctgccgttgaggctgagctgagcattttgtcagtattagactgagtttttgtgtgggtcaccatctacaagaagaattaaagtttatatggtgcagttcagtattacacttttatttacgtatgctcacgtctgtagttgttgggtgctggatgcagcgtgtataatctcccttcactctctttacggttctttcccttgtgtcttaaacataggtgtattatcttgcttttcttggtattgaggttcgcttgcttgtgcttgtactttttgtagtcctaatctatgatctgaacagaggatccatggttccacatt

SEQ ID NO: 5142 - DNA, 5801 bp, Gossypium raimondii
ggatccagcatctacattaaatccaagagcaagctaatgcgcacaccagtgtttcaaggcacattttttacacgtccgttccactttctccggtgccttggattggatctctcccatctgcttcactttctctcttttcaaatgctttaattctctgcctcagatctcttcgcaaagtactttttttatagtttcgctcgtctctttctcagtgttcagttttgactcgcgattgaaagattcaatctcaaccgttagatccgctcctgattcgtggatcttcatccttcgatctgagccaccatggcggccgcgaacgctcccatcgccatgaaggaggttttaactttgccgagcgttggtattaatccgcaatttatcacattcacgaatgtaactatggaatctgataagtatatttgtgtgagggaaaccgcgccacaaaatagtgttgtgatcatcgacatgagcatgccgatgcagccgttgagacggcctattacagctgactctgctctcatgaatccaaattccagaatcctcgctttgaaagctcaactaccgggaacaactcaagatcacttgcaaatatttaacatagagatgaaagcgaaaattaaatcgcatcagatgcctgaaccggttgtattctggaaatggattaccccaaaaacgcttggtctggtcacacaaacctccgtgtatcattggtcaattgaaggtgattctgagccagttaagatgtttgaaagaacagcaaacttggtgaacaatcagataataaactataaatgtgatccttcagagaagtggttggttttgattggaattgcccctggtgcacctgagaggccacaattggtgaaggggaacatgcaacttttctctgttgatcagcagcgtagtcaagctcttgaatctcatgctgcttcatttgcacaatttaaggttccaggaaatgagaatccttctattcttatttcttttgctaccaagagttttaatgctggccaaattgtatcaaagttgcatgtaattgaacttggtgcccagccaggtaagccatcattttcaaagaaacaggcagatctattctttccaccagattttcaagatgattttccagttgcaatgcagatatcacacaaatatagtttgatctacgttattacaaagcttgggctgctatttgtttatgatctagagactgcaactgctgtatacagaaatagaataagtccagacccaatatttttaacatctgaagcttcgtcggcaggagggttttatgccatcaacaggcgaggtcaggtgttgttggctactgtaaatgaagcaacaatagtgccatttgttagcagtcaattgaacaatttggagcttgctgtcaatctggctaaaagaggaaaccttccaggtgcagagaacctggttgtccaacgttttcaagaattgtttgctcagacaaagtataaagaagctgctgagcttgcagcagagtctccacaggggatccttcgcacgcctgatacagttgccaagtttcagagtgtacctgtgcaagctgggcagactccaccactgttgcagtattttggtacacttttaacaaagggaaagctcaatgcctttgagtcattggaattatctcgacttgtggtaaatcaaaacaagaagaatcttctagagaattggttggctgaagataaattggaatgtagtgaggaacttggagaccttgtgaagactgtggataatgatcttgcactgaaaatatacattaaagctagagcaactcctaaagttgttgcagcttttgcagaacgtagggagttcgacaaaatcttaatatactcaaagcaggttgggtactctcctgactatctgttccttctgcaaacaattcttcgtacagatccacagggagctgttaattttgcattgatgatgtctcaaatggagggaggttgtccggttgattacaacactattactgacctctttcttcagaggaatttgatacgggaggctaccgcatttcttttagatgttttgaagccaaatctgccagagcatgcttttctacagacgaaggttttggaaatcaatctagtaacttttcctaatgttgctgatgccatcttagcaaatggaatgttcagtcactatgatcgccctcgaattgcacaactttgtgagaaagctggtctctatgtgcgagctctgcagcattacagtgagttgcctgacattaaacgtgtcatcgtgaacacacatgctattgagcctcagtcgcttgttgagttttttggcactctttcacgagaatgggccttggagtgcatgaaggaccttcttctggttaatctaagaggcaaccttcaaataattgttcaggttgccaaggagtactgtgagcagttgggtgttgaggcttgcataaaactttttgagcagtttaagtcatatgaaggattgtactttttcctgggatcttatttgagttcaagtgaggaccccgatatacactttaagtacattgaggcagctgctaaaactggacaaataaaggaggttgagcgtgtgaccagagaatcaaacttctatgatgctgaaaagacaaagaacttcctgatggaggccaagcttcctgatgctaggcccctgattaatgtttgtgatcgatttgggtttgttcctgatctgacccactacctctacacaaacaacatgctccgttacattgaaggttatgttcagaaggtgaacccgggcaatgctcctttggtagtggggcagttgcttgatgatgaatgccctgaagattttattaaaggtctcattctctcagtccgttccttgcttccagttgagccacttgtggatgaatgtgagaagagaaatcgacttcgtttgcttacgcagttcttggagcatcttgtgagtgagggaagccaagatgtgcatgtccacaatgctcttggtaaaatcatcattgaaagcaacaacaatccagagcacttcctcacaaccaatccttactatgattcccgggttgttggtaagtattgtgagaaacgtgatcccaccttggcagttgtggcttaccgaagaggacaatgtgatgatgaacttatcaatgtcacaaataagaactcgttgttcaaattgcaggccaggtatgttgttgagaggatggatggcgatctttgggagaaggttctaaatcctgaaaatgaatatagaagacatctaattgatcaggttgtgtcaactgctttgccagaaagcaaaagtccagaacaagtctctgctgctgttaaagctttcatgactgctgacctgccccatgaactaattgagcttcttgagaagattgtgctccaaaactctgcattcagtgggaactttaatctgcaaaatctacttattttgacagctatcaaggcagatccctctcgagttatggattatattaataggctagataactttgatggaccagcagttggagaagtggccgtggaagctcaactatatgaagaagctttttcaattttcaagaagtttaacttaaatgttcaggctgtcaatgttttactggataacattagaagcattgatcgagccgtggaatttgccttccgagttgaagaagatgctgtttggagtcaggtggcaaaggcacaactgagggaagggctggtgagcgatgcaattgaatcatttatccgtgcagatgatgctactcacttccttgatgtcatccgagcttctgaggatgctaatgtctaccctgatctcgtaaggtaccttctgatggtcaggcagaaagtcaaggagcccaaggttgacagtgaactcatttatgcatatgcaaagattgatagactgggtgaaattgaagaattcattctcatgccaaatgtggctaatcttcaaaatgtcggtgatcggttgttcgatgaagagctatatgaagctgcaaaaataatatttgcatttatatctaactgggctaagttggctgttacacttgtgagacttaaacaattccagggtgctgttgatgcagcacggaaagcaaacagtgccaagacatggaaggaagtttgctttgcttgtgttgatgcagaggaattcagattggcacaaatatgtggtcttaatgttattgtgcaggtggatgacttggaagaagtcagtgaatactatcagaatagaggatgcttcaatgagttaatctctcttatggagagtggtttaggattggagcgtgcacacatgggtatctttactgagttgggagtcctgtatgccagatatcgtccagagaaacttatggagcacattaaattgttctctacgcgtctcaacattcccaaactgataagagcttgtgatgagcagcagcattggaaggaacttacctatttgtatatccaatatgacgagtttgataatgctgcaactactgtcatgaaccactctcctgaagcatgggatcatatgcagttcaaagatattattgtcaaagttgctagtgttgagctctattacaaggctgtccacttctacttgcaagaacatccagatctcatcaatgatatgctgaacgtgcttgcacttcgtgtggatcacactcgtgttgttgacattatgagaaaggctggtcatctacgtcttgtgaagccatacatggttgctgttcagagcaacaatgtatcggcagtaaacgaggcattgaatgagatttatgtggaggaagaagattatgatagattaagagaatctattgatttgcatgataactttgatcagattggacttgcacaaaagattgagaaacatgagctgcttgaaatgaggcgtgttgctgcatacatctacaaaaaggcaggcagatggaagcagtccattgccttgtcaaagaaggacaaccattacagagatgcaatggaaacagcttcacagtctggtgaacgtgaacttgccgaggagttgcttgtttacttcattgaacagggcaagaaggaatgctttgcatcgtgcctctttgtctgttatgacttaattcgagcggatgttgctcttgaactggcctggatcaacaatatgattgatttcgcattcccatatctgctgcagtttatccgtgaatatactggcaaagttgacgaacttatcaaggacaagatagaagctcaaaaagaagtaaaggctaaagagcaagaagagaaagaagtcattgcacaacagaacatgtatgctcagttactacctcttgccttgcctgcaccgccaatgccaggaatgggaggaccaacaatgggtggtggatttgcgcctccaccaccacccatgggaggaatgggaatgcctccgatgccaccttacggcatgccaccaatgggcagcagttattaactcatgacagaaagaggcatttttttggatgctggtaagaaggtaagccgaggatttttatcacacatgcatatttgtattttgtagttttattttcctttaatgtccttggaattgacccagcagtatatacgagaacacttcccacttcattgtttcttctttttgcttcattcttttcctaaatcgaaacagaaaatttgtttatgatccatatacatgtttttttgggctactctttattggtagaatatgtttgcagtatatacatgtacatcttttctatataaaataaatattattgctggtctttagttagatttgattattttgatcggaatggtgattatgtgatgcgaatacgtgtccaaaag

SEQ ID NO: 5143 - DNA, 5926 bp, Gossypium hirsutum
gtgtttcaaggctacattttttactacgtccgttccactttctccggtgccttggattggatctctcccatctgcttcactttctctcttttcaaatgctttaattctctgcctcagatctcttcgctaaagtacttttttttatagtttcgctcgtctctttctcagtgttcagttttgactcgcgattgaaagattcaatctcaaccgttagatccgctcctgattcgtggatcttcatccttcgatctgagccaccatggcggccgcgaacgctcccatcgccatgaaggaggttttaactttgccgagcgttggtattaatccgcaatttatcacattcacgaatgtaactatggaatctgataagtatatttgtgtgagggaaaccgcgccacaaaatagtgttgtgatcatcgacatgagcatgccgatgcagccgttgagacggcctattacagctgactctgctctcatgaatccaaattctagaatcctcgctttgaaagctcaactaccgggaacaactcaagatcacttgcaaatatttaacatagagatgaaagcgaaaattaaatcgcatcagatgcctgaaccggttgtattctggaaatggattaccccaaaaacgcttggtctggtcacacaaacctccgtgtatcattggtcaattgaaggtgattctgagccagttaagatgtttgagagaacagcaaacttggtgaacaatcagataataaactacaaatgtgatccttcagagaagtggttggttttgattggaattgcccctggtgcacctgagaggccacaattggtgaaggggaacatgcaacttttctccgttgatcagcagcgtagtcaagctcttgaatctcatgctgcttcatttgcacaatttaaggttccaggaaatgagaatccttctattcttatttcttttgctaccaagagttttaatgctggccaaattgtatcaaagttgcatgtaattgaacttggtgcccagccaggtaagccatcattttcaaagaaacaggcagatctattctttccaccagattttcaagatgattttccagttgcaatgcagatatcacacaaatatagtttgatctacgttattacaaagcttgggctgctatttgtttatgatctagagactgcaactgctgtatacagaaatagaataagtccagacccaatatttttaacatctgaagcttcgtcggcaggagggttttatgccatcaacaggcgaggtcaggtgttgttggctactgtaaatgaagcaacaatagtgccatttgttagcagtcaattgaacaatttggagcttgctgtcaatctggctaaaagaggaaaccttccaggtgcagagaacctggttgtccaacgttttcaagaattgtttgctcagacaaagtataaagaagctgctgagcttgcagcagagtctccacaggggatccttcgcacgcctgatacagttgccaagtttcagagtgtacctgtgcaagctgggcagactccaccactgttgcagtattttggtacacttttaacaaagggaaagctcaatgcctttgagtcattggaattatctcgacttgtggtaaatcaaaacaagaagaatcttctagagaattggttggctgaagataaattggaatgtagtgaggaacttggagaccttgtgaagactgtggataatgatcttgcactgaaaatatacattaaagctagagcaactcctaaagttgttgcagcttttgcagaacgtagggagttcgacaaaatcttaatatactcaaagcaggttgggtactctcctgactatctgttccttctgcaaacaattcttcgtacagatccacagggagctgttaattttgcattgatgatgtctcaaatggagggaggttgtccggttgattacaacactattactgacctctttcttcagaggaatttgatacgggaggctaccgcatttcttttagatgttttgaagccaaatctgccagagcatgcttttctacagacgaaggttttggaaatcaatctagtaacttttcctaatgttgctgatgccatcttagcaaatggaatgttcagtcactatgatcgccctcgaattgcacaactttgtgagaaagctggtctctatgtgcgagctctgcagcattacagtgagttgcctgacattaaacgtgtcatcgtgaacacacatgctattgagcctcagtcgcttgttgagttttttggcactctttcacgagaatgggccttggagtgcatgaaggaccttcttctggttaatctaagaggcaaccttcaaataattgttcaggttgccaaggagtactgtgagcagttgggtgttgaggcttgcataaaactttttgagcagtttaagtcatatgaaggattgtactttttcctgggatcttatttgagttcaagtgaggaccccgatatacactttaagtacattgaggcggctgctaaaactggacaaataaaggaggttgagcgtgtgaccagagaatcaaacttctatgatgctgaaaagacaaagaacttcctgatggaggccaagcttcctgatgctaggcccctgattaatgtttgtgatcgatttgggtttgttcctgatctgacccactacctctacacaaataacatgctccgttacattgaaggttatgttcagaaggtgaacccgggcaatgctcctttggtagtggggcagttgcttgatgatgaatgccctgaagattttattaaaggtctcattctctcagtccgttccttgcttccagttgagccacttgtggatgaatgtgagaagagaaatcgacttcgtttgcttacgcagttcttggagcatcttgtgagtgagggaagccaagatgtgcatgtccacaatgctcttggtaaaatcatcattgaaagcaacaacaatccagagcacttcctcacaaccaatccttactatgattcccgggttgttggtaagtattgtgagaaacgtgatcccaccttggcagttgtggcttaccgaagaggacaatgtgatgatgaacttatcaatgtcacaaataagaactcgttgttcaaattgcaggccaggtatgttgttgagaggatggatggcgatctttgggagaaggttctaaatcctgaaaatgaatatagaagacatctaattgatcaggttgtgtcaactgctttgccagaaagcaaaagtccagaacaagtctctgctgctgttaaagctttcatgactgctgacctgccccatgaactaattgagcttcttgagaagattgtgctccaaaactctgcattcagtgggaactttaatctgcaaaatctacttattttgacagctatcaaggcagatccctctcgagttatggattatattaataggctagataactttgatggaccagcagttggagaagtggccgtggaagctcaactatatgaagaagctttttcaattttcaagaagtttaacttaaatgttcaggctgtcaatgttttactggataacattagaagcattgatcgagccgtggaatttgccttccgagttgaagaagatgctgtttggagtcaggtggcaaaggcacaactgagggaagggctggtgagcgatgcaattgaatcatttatccgtgcagatgatgctactcacttccttgatgtcatccgagcttctgaggatgctaatgtctaccctgatctcgtaaggtaccttctgatggtcaggcagaaagtcaaggagcccaaggttgacagtgaactcatttatgcatatgcaaagattgatagactgggtgaaattgaagaattcattctcatgccaaatgtggctaatcttcaaaatgtcggtgatcggttgttcgatgaagagctatatgaagctgcaaaaataatatttgcatttatatctaactgggctaagttggctgttacacttgtgagacttaaacaattccagggtgctgttgatgcagcacggaaagcaaacagtgccaagacatggaaggaagtttgctttgcttgtgttgatgcagaggaattcagattggcacaaatatgtggtcttaatgttattgtgcaggtggatgacttggaagaagtcagtgaatactatcagaatagaggatgcttcaatgagttaatctctcttatggagagtggtttaggattggagcgtgcacacatgggtatctttactgagttgggagtcctgtatgccagatatcgtccagagaaacttatggagcacattaaattgttctctacgcgtctcaacattcccaaactgataagagcttgtgatgagcagcagcattggaaggaacttacctatttgtatatccaatatgacgagtttgataatgctgcaactactgtcatgaaccactctcctgaagcatgggatcatatgcagttcaaagatattattgtcaaagttgctagtgttgagctctattacaaggctgtccacttctacttgcaagaacatccagatctcatcaatgatctgctgaacgtgcttgcacttcgtgtggatcacactcgagttgttgacattatgagaaaggctggccatctacgtcttgtgaagccatacatggttgctgttcagagcaacaatgtatcggcagtaaacgaggcattgaatgagatttatgtggaggaagaagattatgatagattaagagaatctattgatttgcatgataactttgatcagattggacttgcacaaaagattgagaaacatgagctgcttgaaatgaggcgtgttgctgcatacatctacaaaaaggcaggcagatggaagcagtccattgccttgtcaaagaaggacaaccattacagagatgcaatggaaacagcttcacagtctggtgaacgtgaacttgccgaggagttgcttgtttacttcattgaacagggcaagaaggaatgctttgcatcgtgcctctttgtctgttatgacttaattcgagcggatgttgctcttgaactggcctggatcaacaatatgattgatttcgcattcccatatctgctgcagtttatccgtgaatatactggcaaagttgacgaacttatcaaggacaagatagaagctcaaaaagaagtaaaggctaaagagcaagaagagaaagaagtcattgcacaacagaacatgtatgctcagttactgcctcttgccttgcctgcaccgccaatgccaggaatgggaggaccaacaatgggtggtggatttgcgcctccaccaccacccatgggaggaatgggaatgcctccgatgccaccttacggcatgccaccaatgggcagcagttattaactcatgacagaaagaggcattttttggatgctggtaagaaggtaagccgaggatttttatcacacatgcatatttgtattttgtagttttattttcctttaatgtccttggaattgacccagcagtatatacgagaacacttcccacttaattgtttcttctttttgcttcattcttttcctaaatcggaacagaaaatttgtttatgattcatatacatgtttttctgggctactctttattggtagaatttgttggcagtatatacatgtatatcttttctatataaaataaatattattgctggtctttagttagatttgattattttgatcggaatgatgattatgtgatgcgaatacgggtccaataggtttggaatccaaaaaattaaaatgacatgccacgaaagagtaatgcacgtatgatgtaattatggaaaaaaatcaagaacggactgagaggatcgacaaagtttatgtagattttgatcttccggacacgtaattgacctcgaaatcaagaacaggatcttgatcagag

SEQ ID NO: 5144 - DNA, 6044 bp, Gossypium raimondii
cgatttttatcagtttcgagtaattttcaactcaatcggtttaactccgtttgtttgggtcaacataacaatcggttctcaatccaattagtcagggcgaccaatctagtcatgttaaaaaaacacatcacatcatcgaatctttggtgggatccaatttcatatattaaaattgatttagttgtcaaattcaagcaccaaaataaacaaaaaaaaaagtgcatgtaacaaaatagatctaattaccaaatttaagataaaaaatatattatccctaaatattgggtgtaatataattttattaataatttttattttaactaagaaaataagattagtatataatatagttttatcgagtcccttatatttgatctctcttcttttcctcgtttcttcaacaaaattcaatctccaagatttttcaactgttctattttgaaatctctggttcagatctcttagtatagtttctttatatttttttcctctttttctttctcagtggcaagctttcaaaaatattcaatctcagccgtaagatctgctcttgatttgtcgatccgagccaccatggcggccgctaacgctccaatcgccatgaaagaggtcttaactttgccaagcattggcattagtcctcaattcatcacgttcacgaatgtaactatggaatctgagaagtatatttgtgtgagggaaacggcaccacaaaacagtgttgttatcatagacatgaacatgccgatgcagccgctgagacggcctattacggcggactctgctcttatgaatccaaattctagaatcctcgccttgaaagctcaactaccaggaacgactcaagatcacttgcaaatatttaacatagagctgaaagcaaaaatcaaatcacatcagatgcctgaacaggttgtattttggaaatggattagcccaaaactgcttggcttggtcacacagacctctgtgtatcattggtcgattgaaggtgaatctgagccggttaagatgtttgagagaacagctaatttagcaaacaatcagataataaactataaatgtgacccttcagagaagtggttggttttgattggaattgcccctggtgcacctgagaggccacaattggtcaaggggaacatgcaacttttctctgtggatcagcagcgtagccaagctcttgaagcacatgctgcttcatttgcacaatttaaggtcccaggaaatgagaatccatctattcttatttcgtttgccaccaagagttttaatgctggccagattacatcaaagttgcatgtaattgagctgggtgcccagccaggtaagtcatcgttttctaagaaacaggcagatctattcttcccgccagattttcaagatgattttcctgtcgccatgcagatatcccacaaatatgctttgatttatgttatcaccaaacttgggctgctgttcgtttatgatctggagacagcgactgctgtttacagaaatagaatcagtccagatccaatatttttaacctctgaagcttcagcagttggagggttttatgccatcaacaggcgaggtcaggtgttgctggctactgtaaatgaagcaacattagtgccatttgttagcggtcaattgaacaacttggagcttgctgtcagtcttgctaaaagaggaaacctccctggtgcagagaacttggttgtccaacgttttcaagagttgtttgctcaaactaagtataaagaagctgctgagcttgctgcagagtctccacaagggatccttcgcactcctgatacggttgccaagtttcagagtgttcccgtgcaagctgggcagactgcaccactgttgcagtactttagtatccttctaacaagggggaagctcaatgcatttgagtcattggaactatctcggcttgtggtaaaccaaaacaagaagaaccttctggagaattggttggctgaagataaattggaatgcagtgaagaattgggtgaccttgtgaagactgtggataatgatcttgcactgaaaatatatattaaagcaagggcaactccaaaagttgttgctgcttttgctgaacgtagggagtttgacaagatcttgatttactcaaagcaggttgggtacactcctgactacttgttccttttgcaaacaattctccgtacagatccacagggagctgttaattttgcattgatgatgtctcaaatggagggaggctgtccggttgattacaacaccattactgatcttttccttcagaggaacttgataagggaagctactgcatttctattggatgttttgaaaccaaatctaccagagcatgcttttctccaaacaaaggtcttggaaatcaatctagtaacttttccaaatgttgctgatgccattttagcaaatggaatgttcagtcactatgatcgtccccgaattgctcagctttgtgagaaagctggtctgtatatccgagctctgcagcattactctgagttgccagatattaaacgtgtcattgtgaatacacatgctattgagccacagtcacttgttgagttttttggtactctttcacgtgaatgggctttggagtgcatgaaggacctcctactggttaatcttagaggcaaccttcaaataattgtgcaggttgcgaaagagtattgtgaacagttgggtgttgattcttgcataaaaatttttgagcagtttaagtcgtatgaaggattgtactttttcctgggctcatatttgagctcaagtgaggaccctgatatacactttaagtacattgaggcagctgctaaaactggacaaataaaggaggttgagcgcgtgaccagggaatcaaacttttatgatgccgaaaagacaaagaacttcttgatggaggccaaacttccggatgctaggccattgattaatgtttgtgatcgatttgggtttgttccggatctcactcactacctctacacaaataatatgctccgttacattgaaggttatgttcagaaggtgaacccagggaatgctcctttggtagtgggccagttgctagatgatgaatgtcctgaagactttataaagggtctcattctgtctgtccgttctttgcttcctgttgagcctcttgtggaggaatgtgagaagagaaatcgacttcgtttactaacacagttcttggagcatcttgtgagtgagggaagccaagatgtgcatgtccacaatgctctgggtaaaataatcattgacagcaataacaatccagagcacttcctcactaccaacccttactatgattctcgggttgttggtaagtactgtgagaagcgtgatcccaccctggctgttgtagcataccgaagaggacaatgtgacgatgaacttataaacgtcacaaataagaactccttgtttaaattgcaggctaggtatgttgttgaaaggatggatggtgatctttgggagaaggttctaaatcccgaaaatgaatatagaagacagctgatagatcaggttgtatcgactgctcttccagagagcaagagtcccgaacaagtctctgcagctgttaaagcttttatgacagctgacctgccccatgaacttattgagcttcttgagaagattgtactccaaaactctgcattcagtgggaacttcaatctacagaatcttcttattttgacggctattaaggcagatccatctagggttatggattatatcaataggttggataattttgacggacctgctgttggagaagtggccgttgaagcccaactgtatgaagaagcttttgcgatcttcaaaaagttcaacttaaacgtgcaggccgtcaatgttttattggacaatatcagaagcattgatcgggctgtggaattcgcattccgagttgaagaagatgctgtttggagtcaggttgcaaaggcacaactgagggaggggctggtgagcgatgccattgaatcttttattcgcgcggatgatgctacccagttccttgatgttatccgagcttccgaggatgctgatgtctaccctgatttggtgaggtatcttctgatggttaggcagaaggtcaaggagcccaaggtggatggtgaacttatttatgcctatgcaaagattgatagacttggcgaaattgaagaattcattctcatgccaaatgttgctaatcttcaaaatgttggtgaccgcttgttcgatgaagccctatacgaagctgcaaaaataatatttgcgtttatatctaactgggccaaattggctgttacactggtgagacttaaacaattccaaggtgctgttgatgcagcacgaaaagcaaacagtgcaaagacatggaaggaggtttgctttgcttgtgttgatgcagaagaattccgattggcacagatatgtggtcttaacatcatcatacaggtggacgacttggaagaagttagcgaatactatcagaacagaggatgcttcaatgagttgatctctcttatggagagtggtttaggactggaacgtgcacatatggggatctttactgaactgggagttttgtatgccagataccgtcccgagaagcttatggagcacattaaattgttctctactcgtctcaacattcccaagctgataagagcttgtgatgaacagcagcactggacggaacttacctatttatacattcaatacgacgagtttgacaatgctgcaactaccgtgatgaaccactctcccgaagcatgggatcatatgcagttcaaagacattatagtcaaagttgctagtgttgagctatattacaaggctgtccacttctacttgcaagaacaccctgatctcataaatgatatgttgaacgtgctcgcacttcgtgtggaccacactcgtgttgttgatatcatgagaaaggcaggtcatctgcgacttgtgaagccttacatggttgctgttcagagcaacaacgtgtcagcagtaaatgaggcgttgaatgagatttatgtagaggaagaagattacgatagattgagagaatctatcgacttgcatgataactttgatcagattggtcttgcacaaaagatcgagaaacatgagctgctggagatgaggcgagttgctgcatacatttacaagaaggctggcagatggaagcagtccattgcattgtcaaagaaagacaaccattacaaagatgcaatggaaacagcttcacagtctggtgaacgtgaacttgccgaggagttacttgtttactttattgaacagggtaagaaggaatgctttgcatcatgcctctttgtttgttatgacttacttcgagcagatgtcgttctcgagctagcctggattcacaatatgatcgactttgcattcccgtatctgttgcagtttatccgcgaatataccggcaaagtcgatgaacttatcaaggataaaatcgaggctcaaaaggaagtaaaagccaaagagcaagaagagaaggaagtgattgcacaacagaacatgtatgctcagttgctacctctagccttacctgcaccaccaatgcctggaatgggaggaggttttgctccaccaccaccacccatgggaggaatgggaatgccgccttttggtatgccaccaatgggcagctattaagccttaagaacatggtttgttttttattgaagattctatttttaggagaaaaaaccgtagttcttatcaatttggaataatgtgctattttagtgttttttttttggagggatgtgataatgattttgtagtttgccctcattatttttctcctttttggtggtagcaaaagaggcattttttggctgctaatatactagagactagagaaagggtagtctaagggtttcatgaatatttgtatttttattatttcctttccatttccgaattgatctgagtatatatatgaaatgatacacttccatgtcatttttttcccttgcaaattgctttgatattagtaaaagtactatttctattctaaaaaaaaa

SEQ ID NO: 5145 - DNA, 5743 bp, Eucalyptus grandis
ctggcggagcttcactgccgcgagatctcgcagcgatccatttcccggccgcggggatccgatccatccgccccggcccgacccgaaccgaaccggccgcccgccgatccgaccgaccatggcggccgccaacgctccgatcaccatgaaggaggccttgacgcttccgagcctgggcatcagtccacagttcatcacctttacgcatgtcacgatggaatccgagaagtacatctgcgtgcgcgaaacggcacctcagaatagcgtggtcatcatcgacatgagcatgcctatgcaacctttgaggaggcctattactgcggactcagcactgatgaacccaaattctagaattctcgctttgaaagcccaactttccggaaccactcaagatcacttgcaaatattcaacattgagatgaaagcaaaaatgaagtcttatcagatgccagagcaggttgtcttttggaagtggattactcccaaattgttgggtcttgtcacccaaacctcggtatatcattggacaattgaaggtgatgctgagcctgtaaagatgtttgacagaacagctaatcttgtcaacaaccagataataaattatcgatgtgacccttccgaaaaatggttggttttgattggaattgctcctggttcgcctgagcggccacaactggtgaaggggaatatgcaacttttctctgtggagcagcagcgtagtcaagcccttgaagcacatgctgcatcatttgcaacttataaagttcctgggaatgagaatccttcaactctcatctcctttgcaacgaagactgttaatgctggtcaaattgcatcaaagttacatgttatcgagctgggtgcccaaccagggaagctgtcttttacgaagaaacaagcggatcttttttttcctcctgattttggtgatgattttccagtggcaatgcagatatcccacaaatacagtttgatatatgtgatcaccaaacttgggctgctatttgtctatgatttggagacagctactgctgtatacagaaacagaattagtccagatccagtatttctaactgcagaagcttcatcagttggcggtttttatgccgtaaacaggcgtggccaggtcttattggctactgtaaatgaggcaacgattgtgccttttgttagtggccaactgaacaacttggagcttgctgtgaatcttgcaaagagaggaaatcttcctggtgcagagcagctggttgtgcaacgtttccaagaactctttgctcaaactaaatacaaagaagctgctgagcttgctgctgagtctccgcaaggaatacttcgcaccccggacacagttgctaaatttcagagtgtcccagtgcaatctgggcaaacaccacctctattgcaatactttgggacccttttaaccaggggaaagcttaatgcatttgagtcattggagctatcacgcctggtcgtgaatcaaaacaagaaaaaccttcttgagaactggttggctgaggataagctggaatgcagtgaggaacttggggatcttgtgaagaccgttgataatgacctcgcattgaaaatttatatcaaagccagagcaactccaaaggtagttgcagcttttgctgagcggcgagagtttgacaaaattctgatatactcaaagcaggttgggtacacgccagactatctcttccttttgcagacaattctgcgaacagatcctcagggagctgtcaactttgcattaatgatgtcccaaatggagggaggctgtccagtggattacaacactataacagatctctttcttcagaggaatttgatccgagaagcgactgcattcttgttagatgtactaaaaccaaatttgccagaacatgcttttcttcagacaaaggttcttgaaatcaatctggtcacttttccaaatgtagctgatgccatcttggctaatggcatgttcagtcactatgatcgtcctcgaattgcccaactttgtgaaaaagcaggtctctttgttagggcccttcagcactatactgagctgccagatatcaaacgtgtcattgtgaacacacatgctattgagccacagtcacttgttgagttttttggtacactatcgcgagagtgggctttggagtgcatgaaggaccttttgttggtcaatctgaggggcaatcttcagattatcgtacaggttgccaaggaatattgtgagcagttgggtgttgatgcatgcataaagatttttgaacaattcaagtcgtatgaggggttgtattttttcctaggctcgtacttgagctccagtgaggatcctgacattcacttcaagtacattgaggctgctgctaaaactggacaaattaaagaggtggaacgtgtgactagagagtcaaatttctatgaccctgagaagactaaaaatttcctgatggaggccaagcttcctgatgcacggccactaattaatgtttgtgatcgttttggctttgtgcctgatctcacacattatctttacacaaataacatgcttcgatatatcgagggctatgtccagaaggtcaaccctggaaatgctcctttggtagtggggcagctgatagatgatgaatgcccagaagatttcataaaaggcttaattctttctgttcgatctttgctaccagtggagcctcttgttgatgagtgtgaaaagaggaatcgactccgtttgctcactcagtttttggaacatctcgtgagtgagggaagccaagatgtacatgtccacaatgctttgggtaaaatcatcatcgaaagtaacaacaatccggagcattttctcacaaccaacccatactatgattcacgtgttgtgggtaaatattgtgagaaacgcgatcctactcttgcggttgtggcttacaggaggggccaatgtgatgaagaacttatcaatgtgaccaataaaaattccctgttcaaattacaagccaggtatgtagttgaaaggatggatggtgatctatgggagaaagttctggaccctgagaactcttataggagacagctaattgatcaggttgtctctacggctttgcctgagagcaagagcccagaacaagtttctgcagccgttaaagctttcatgacagctgatcttcctcatgaactgattgagcttcttgagaagattgtgcttcagaattctgcttttagtgggaacttcaacttgcagaacttgcttatcttgacggccatcaaggcagatccatctcgagttatggattatgtaaatagactggataactttgatggaccagcggttggggaagtagctgtggaagcccaactttatgaggaagcttttgcaattttcaagaagttcaatttgaatgtccaggctgtaaatgtcttactggataatattcaaagcattgagcgagcggttgagtttgcatttagggttgaggaagaggctgtttggagtcaggtagccaaggcccaactaagggagggtcttgtcagtgatgctatcgagtcatttatccgtgcagatgatgccactcagtttttggatgttattcgtgctgctgagaatgctaatgtctatcatgacttagtgaagtaccttctgatggtgaggcaaaagacgaaagaacccaaggtggatggtgagctcatatttgcatatgccaagattgatagattgggtgagattgaggaattcatcctgatgccaaatgtcgccaatcttcaaaatgttggtgatcgcttgtatgatgaaggcttatacgaagctgccaaaatcatttttgcctttatttctaactgggccaagttggccagcacacttgtgaagctgggacaattccagggagctgttgatgcagctcgaaaggccaatagcgcaaagacatggaaggaagtttgcttcgcctgtgttgatgccgaggagttccgcttggcacaaatgtgtggtctcaacatcatcatacaggtggatgatttggaagaagtcagtgaatattaccagaacagaggatactttaatgagcttatctctctcatggagagtggtctgggtttggaacgtgcacatatgggtatttttaccgagttaggtgtcctttatgcaagataccgtccggagaagctcatggagcacattaagctgttcgcaactcggcttaatattcccaagcttatacgagcttgtgatgagcagcagcattggaaagagctcacttacttatacatccaatacgacgagttcgacaatgcagcaacgaccataatgaaccattctcctgaagcatgggatcacatgcagtttaaagatgtggtcgtcaaagttgccaatgttgaactctactacaaggctgtgcacttctatttgcaagaacatcctgatttaatcaacgatgttctcaatgtgcttgcacttcgtgtggagcatacacgtgttgttgacattatgcgaaaggctggtcatctgcggcttgtcaagccttacatggttgcagtacagagcaacaatgtttctgctgttaatgaagctttgaatgagatctatgtagaagaggaagattatgacagattgcgtgaatctattgatttgcatgataactttgatcagataggccttgcacagaagattgagaaacatgagcttcttgagatgagacgtgttgctgcttatatctacaagaaggctggtagatggaagcaatcaatcgcattgtccaaaaaagataacctttacaaagatgccatcgaaacagcatctcagtctggtgaccgtgaactagcagaagagttgcttgtttatttcattgaaaagggaaagaaggaatgctttgcttcgtgcctctttgtctgttacgatttaatcagggcagacattgtgcttgaactcgcttggatgaacaatatgattgattttgctttcccatatctgcttcagttcatccgtgagtacactagcaaagttgatgagcttgtgaaggacaagattgaaactcaaaatgaagtaaagacaaaagagaaggaagagaaggatgtcattgcacagcagaacatgtatgctcagttgctgcctttagctttgcctgcacccccaatgcctggtatgggaggaccggggatgggggggatgggagcaggttttgctcccccaccaatgggtgggatggggatgcctcctatgccaccgtttggcatgccgcctatgggaagctactaaattcagggaagatggaccttgctattcgtttctttgatagcagtagcgtcacaagactttgtggactcgaagttttcgttattgctttgggtggacgtagctggggtgctgcgcaataactgtctcgagtttttgtatctttcataggcctgttgggtaattgttgtaacactcaattgtttttggataggaagcggcattcttttgctgttgtagagtgtcaggggaagaggatttgcttgtattctagtgatcttatcggtgtctattgaggaaacaatagtaaaatacatgaagatatatagactgaatcccagtgcgggaagatatatgttagcatgcttgtttcttactttgtcggttctgcttttattggaattctagtgcttcttcactcgaggtggtgtcagttatttggaccgtaaaaggagctttcttttggtgtatttatatgggacttctgttctgatgatcgtttgaggactgaaagcggttcatgcc

SEQ ID NO: 5146 - DNA, 5643 bp, Vinca minor
tcttcctagatctctttcgttctctgtttctgactattctgctggttactttgaggagctcagatctcacaccggcggattcgcttgatttaccgccgttttaccgattcattcacctgttttcagatctagatttttgttctcggagctccgatctcgccgccatggcggccgctaacgctccgatcaccatgaaagaggctctcacgctgacgagcatagggatcaatccgtcatttatcacatttacaaatgtgaccatggaatctgataagtatatatgtgtacgtgagacgtcgccacaaaatagcgttgtaattattgatatgagtatgccaaatcaacctttgaggaggccgatcactgcagactcagctcttatgaaccccaataccagaatcttagccttgaaagcccaactccctggcacaacacaagatcatttacaaatatttaacatcgaggctaaggctaaaatgaagtcatatcaaatgcctgagcaggttgtcttttggaagtggattaccccaaaaatgttgggtttagtcacacagacctccgtgtatcattggtctattgaaggtgaatctgaacctttaaaaatgtttgatagaacggcgaatttggcaaacaaccaaataatcaattataggtgcgatccatctgaaaaatggttggttttggttggaattgcacctggttctcccgagagacctcaactggttaaaggaaatatgcaactgtattctgtggaacagcagcgtagtcaagcacttgaagctcatgctgcatcatttgcttccttcagagtaccaggaaatgataaggattctattcttatatcatttgcaacaaaatccacaaatgctggacaggttgtctcaaaattgcatgttattgagcttggagcccagccaggaaagccatcttttacaaagaagcaagccgatcttttcttccctcccgattttgctgatgactttcctgtagcaatgcagatttctcacaagtatagtttgatatatgtgatcacaaagcttgggcttctcttcgtatatgacctggatacagccactgcggtttatagaaatagaatcagtccagatcctatatttttgacatcagaggcttcatctgtggggggcttctatgcaatcaaccggcgaggtcaggtattgcttgcaacagtgaatgaagcgacaattgtgccatttgtcaatggccagttgaacaatctggagcttgcagtaaatctcgctaaaagaggaaaccttcctggtgcagagaatttggttgtgcaccgcttccaggagttgtttgctcaaacaaaatataaggaagctgcggagcttgcagctgaatctccacaaggcattctacgaacgcctgacactgttgccaaatttcagagtgtacctgtccaagctggacaaacacctcctctcttgcagtactttggaacacttttaacccgaggaaagcttaatgcatttgagtcattggagttatcccgccttgtggtgaatcagaataagaaaaatcttttggagaactggttggctgaggataaactggaatgtagtgaggaacttggtgaccttgtgaagactgtggacaatgatcttgcactgaaaatatatataaaagcgagggcaactcctaaggttgttgcggcctttgctgagcggagggaatttgacaaaattctgatttactccaagcaggttggctatacaccagattatttgttccttctgcaaacaattctgcgttccgaccctcagggagctgttaattttgcccttatgatgtctcaaatggagggaggctgccccgttgattacaacactataactgatctctttcttcagaggaacatgatacgtgaggccacagcatttttgttggatgttctgaagcctaatttaccagaacatgcgttccttcaaaccaaggtccttgaaatcaatcttgtgacattccctaatgtggctgatgctattttagcaaatggaatgtttagccactatgaccgcccacgtattgctcaactttgtgagaaagccggtttatatatgcgagctcttcagcactactctgaactgccagatatcaagcgtgttattgtgaacactcatgcaattgagccacagtctcttgtagaatttttcggtactctttcacgagaatgggcattggaatgcatgaaggatttgctactcgtcaacctaaggggcaaccttcagatcattgttcaagttgctaaagagtactgtgaacagatgggtgttgatgcttgtatcaagatttttgagcagttcaagtcctatgaaggattatacttcttcttgggctcgtatctgagctcaagtgaggaccctgatatacatttcaagtacattgaagctgccgcaaagactggacaaattaaggaggttgagcgtgtgacaagggagtctaatttttatgatgccgaaaagacaaagaacttcttgatggaagccaagcttccagatgctaggccactgatcaatgtatgtgatcggtttggttttgttccggatttgactcactacttatacacgaacaacatgctccggtatattgaaggatatgtacagaaggtcaatccaggaaatgctcctttagtggttgggcagctgctggatgatgagtgccctgaagattttatcaaaggactcattctttctgtgcggtccctgcttccagttgaaccccttgtggacgagtgtgagaaaaggaatcgactccggttgctgactcaatttttggagcatctcgtgagtgaaggaagtcaagatgtacatgttcacaatgctttggggaagatcattatagacagtaataacaaccctgagcacttcctcactactaacccatattacgactcgcgtgttgttggaaaatattgtgagaaacgtgatcccacccttgctgttgtggcctaccggagagggcagtgtgatgatgagctcatcaatgtaacaaacaagaattctctatttaaactgcaggccaggtatgtagttgaaagaatggacggtgatctctgggacatggtcctgaaccctgagaatgagttcaggagacagcttatagatcaagttgtatctactgctcttcctgagagcaagagccctgaacaagtttctgcagctgtcaaggcctttatgaccgctgatcttcctcatgaacttattgagcttcttgagaagattgtgcttcaaaactctgcattcagtggaaacttcaatttgcagaacttactgatactgactgctattaaagcagatccctctagggttatggactatgttaatagactggataactttgatggacctgcagttggtgaagtggctgtggaagcccaattatatgaagaagcttttgcaattttcaagaagttcaatttgaatgtccaagctgtcaatgtcttattggataatattcgtgacatcaaccgtgcagtggagtttgcgttccgtgttgaagaagatgctgtctggagtcaggttgctaaagctcaattgagggagggattggttagtgaagcaatcgagtcctttatccgtgcagatgatgtcactcaattcttagaggtcataaaagctgctgaggatgctgacgtgtaccatgacctggtgaagtaccttctaatggttaggcagaaaaccaaggaacccaaggttgatagtgagattatctatgcctatgctaaaattgataggctgagtgacattgaagaatttattctcatgccaaatgttgctaatcttcctaatgtgggtgaccgcttgtacgatgaggctttatatgaggctgcaaaaatcatttatgctttcatttctaactgggccaagttggctgtcactttagtcaaattgaagcaatttcaaggtgctgttgatgctgcaaggaaggcaaacagctcaaaaacatggaaagaagtatgctttgcttgtgtcgatgctgaggagttccgtttggctcagatttgtgggcttaacattattgtacaggtggatgacttggaagaagtcagtgaatactatcaaaataggggatgcttcaatgaacttatttctctcatggaaagcggattaggattggagcgtgcacatatgggcatatttacagaattgggtgtgctttatgcaagataccgatatgagaagctcatggagcatatcaagttattttctacccgacttaacattcccaagctaatccgagcttgtgatgagcagcagcactggaaagaacttacatatctgtatattcaatatgatgaatttgacaatgctgccaccaccgtcatgaatcattcaccagatgcttgggatcacatgcagttcaaggatattattgtgaaagttgctaatgttgagctttattataaggctgtacatttctatttgcaagagcatcctgatctcattaatgatgttctcaatgtccttgcacttcgagttgaccatactcgtgtcgtggacataatgaggaaggctggccatctacgtcttgtgaaaccgtacatggttgcagttcagagcaacaacgtttctgctgtgaatgaggctctgaatgagatctatgttgaggaggaagactacgacagattacgagaatcaattgatttgcatgatagctttgatcaaattggccttgcacaaaagattgagaagcatgagctgcttgagatgaggcgtgtagctgcttatatttacaagaaggcaggtaggtggaagcaatctattgctttgtcaaagaaagacaatctttacaaagatgcaatggagacagcttcacagtccggggatcgtgaacttgctgaggagctgcttgtttatttcatcgaacaaggaaagaaggaatgctttgcgtcatgcctatttgtttgttatgatttaattcgtgcggatgttgctcttgagctcgcttggatgaacaatatgatcgactttgcattcccttatctgttgcagttcatccgtgaatacactggcaaagttgatgatttaataaaggacaaaattgaatctttgaaagaagtgaaggcgaaggagaatgaagagaaggacgtcattatgcagcagaatatgtatgctcaattgctacctcttgctctgcctgcaccaccgggtatgggaggaggttttgctcaacctccacctccacacatgggcggaatgggaatgccaccaccaggaatgggaatgccaccaatgccgcaatttggcatgccaccgatggggtattgatcttggcatatatatacatacaaaagtggatagtgcacgtggttgccccaggtgggaagatgagagcgcggccagtttgggctctttcatagttgatgtttcttggttcacctcaaatctttttatcatttcgtttaggttgttgatgggtgtcagtgcaggttttaagagtaaaaaagaattatgttcaagtgttgtttgtcataggtgtggatatttttctatgtaatattctttggtagcgaggcaattttttgcagctggtaggcggcaagctgaggatattttgtattttattatgatgacacagtggtcaacttaaatatttgtcattttttaaactgatttttctgtttat

SEQ ID NO: 5147 - DNA, 5390 bp, Malus domestica
ccatggcggccgcgaacgctccgatcaccatgaaggaggccctaacgcttccgagcgttgggattaatccacagttcataacgtttacacatgttactatggaatccgataagtacatatgcgttcgggagacttcgcctcagaatagtattgtcattatcgatatgagtatgccgatgcaacctctgaggaggcctatcactgcagactctgcgcttatgaatccgaattccaaaatccttgccttgaaagctggagttcaaggtactactcaggatcaccttcaaatatttaacattgagatgaaagcaaaactgaaatctcatcttatgcctgagcagattgttttctggaagtggataaccccaaagatgttgggtttagtcactcagactacggtatatcactggtcaattgaaggtgaatctgaacctgtaaaggtgtttgagcgaacagctaatctggctaacaatcagattataaattaccgctgcgatccttctgagaagtggttggttttgattggaattgctcctggtgcaccagagaggccacaattggtgaaaggaaatttgcaactgttctctgtggatcagcagcgcagtcaagctcttgaagcacatgctgcatcatttgcccaatacaaggttccagggaatgagaatccttcaactcttatttcttttgccaccaagaccctcaatgctggacagattacatcaaagttacatgttattgagcttggtgcccagccagggaaaccatcttttacgaagaaacaagcagatctcttctttcctccagattttgctgatgatttcccagtcgccatgcagatgtctcacaagtacagcttgatttacgtaattacaaagcttgggctactatttgtgtatgatttagagacagctagtgcagtttacagaaatagaattagtccggatccaattttcttgacaacagaggcttcatcagttggagggttttatgcagttaataggcggggccaggtgttgttggctacaattaatgaacaaacaattgtgccttttgtcagcggtcagctaaacaatttggagcttgctgtgaatctggctaaaagaggaaatcttccaggtgccgagaatctggttgtccagcgtttccaagaactgtttgcccaaacaaagtacaaagaagctgctgagcttgcagcggagtccccacaaggaattctccgcacacctgatactgttgctaaattccagagtgttcctgtccaagctgggcaaacaccgcctttgttgcagtactttgggacactcttgacaagagggaagctcaatgcatttgagtcattggaattgtcacgtcttgtagtaaaccagaacaagaagaaccttttagagaactggttagcagaggacaaactcgaatgtagtgaggaattgggagatcttgtgaagactgtggataatgatctggctttgaaaatatatattaaagccagggcaactcccaaagttgttgcagcttttgctgaacgaagggaatttgacaaaattctgatctactcaaagcaggttggctacacacctgactatctgttccttttgcaaacaattcttcgagcagatcctcagggtgctgttaattttgcattaatgatgtctcaaatggaaggtggttgtccagttgattacaacaccataacggatctcttccttcagaggaaccttattcgcgaggcaaccgcctttttattggatgttttgaagccaaatcttccagagcatgcgttcctgcaaacaaaggtccttgagatcaatttagtgactttcccaaatgtggctgatgctattttagccaatggaatgttcagtcattatgaccgtcctcgtattgcccagctatgcgaaaaggctggtctttatgtgcgagctttgcaacattactcagagttgcctgatattaaacgtgtcatagtgaacacacatgcaatagagccacagtcacttgtagagttttttggcactctatcaaaagaatgggcattggagtgcatgaaagatcttttattggtcaacttaagaggaaaccttcagataatagtgcaggttgctaaggaatactctgagcagttgggagttgatcagtgcatgaagctctttgaacagttcaagtcatatgaagggttgtatttcttcctcggttcgtttttgagctcaagtgaggatcctgatatccacttcaagtacattgaggcagctgctaaaactggacaaatcaaagaggtggagcgagttactagagaatcaaacttctatgacgctgagaagacgaagaatttcttaatggaagcgaagctccccgatgcacgtccattgattaatgtttgtgatcgttttggatttgttccagatctcacccactacttgtacacgaacaatatgcttcgttacattgaaggttacgttcagaaggtgaatcctgggaatgctccattagttgtgggacagttgctggatgatgagtgccctgaagattttatcaaaggcttaattctttctgtccgttcattgcttccagtggagccccttgtggacgaatgtgagaagaggaatcgccttcgtttactcacacagttcttggagcatcttgtgagtgagggaagccaagatgtacatgttcacaatgctttgggtaaaatcatcattgatagcggcaataatccagaacacttccttaccacaaacccatattatgattcgcgtgttgttggtaaatattgtgagaaacgtgatcctaccctggctgttgttgcttaccgccgtggacaatgtgacgatgaactcattaatgtcacaaataagaactctttgttcaaattgcaagcaaggtatgtggttgagaggatggatgaagatctttggggaaaagttcttgaccctgagaatgagtacagaagacagcttattgatcaagttgtttctactgccttgcccgaaagcaagagcccggaacaagtttctgcggctgttaaggctttcatgactgctgatttgccccatgagttaattgagcttcttgaaaagattgtgcttcaaaactctgccttcagtgggaactttaatctgcaaaacctgctaatcttgaccgccatcaaggcagatccgtcgagagtcatggattacattaataggcttgataattttgatggacccgcagttggggaagtagctgtggaagcccaactgtatgaggaagcgtatgcaatcttcaagaagtttaacttgaatgtccaagcggttaatgtcttgctggataacatccgaagcattgatagggctgttgagtttgcgttccgtgtggaagaagatgctgtttggagccaggttgcaaaggctcagctccgggagggtctggtgagcgatgctattgagtcatttatccgtgcagatgatgccactcaattcttggatgttattcgcgcttctgaggatgcagatgtgtaccatgacttggtgaggtatcttctgatggttaggcaaaaggtgagagagcccaaggtggacagtgagctcatttatgcatatgcaaagattgataggcttgctgacattgaagaatttattcttatgcccaatgtcgctaatctccaaaatgttggtgatcgcctatatgacgaggctctctatgaggctgcaaagataatatatgccttcatatctaactgggcaaagttggctgtcacacttgtgaagctcaaacaatttcaaggtgctgttgatgcagcacgaaaagccaacagttcaaagacatggaaggaggtttgctttgcttgtgttgatgctgaggagttccgcttagctcagatttgtggtctcaacattattatacaggtggatgatctggaagaggtcagtgaatactaccagaatagaggatgcttcaacgagctaatatctctaatggagagtggtctggggttggaacgtgctcacatgggaatctttaccgagttgggggttctatatgctagatatcgcccagagaaacttatggagcacatcaaattgttcgcaaataggctaaatattcccaagcttattagagcatgtgatgagcagcaacattggaaggagctgacctatctgtatattcaatatgatgagtttgataatgctgcaaccaccatcatgaatcattcccctgaagcctgggatcacatgcagttcaaagacgtggcagttaaagttgctaacgtggagctatattataaggctgtgcacttctacttgcaagagcatccggacctcattaatgatattctaaatgtgcttgcacttcgtgtagatcatacacgtgtggttgacatcatgcgaaaggctggtcacttgcttcttgtgaagccatacatggttgcagttcagagcaacaatgtctctgctgtgaatgaggctttgaacgagatatatgttgaggaggaagactatgaaagattgcgtgaatccattgatttgcacgatagctttgaccaaataggcctcgctcaaaagattgagaaacacgaacttctggaaatgagacgtgttgctgcatatatctacaagaaagctggaaggtggaagcagtccattgcattgtcaaagaaagataaactttacaaagatgccatggagacagcctcacaatctggtgaccgtgaactggcagaggagttgcttgtttacttcattgaacagggaaagaaagaatgctttgcatcgtgcctctttgtctgttacgatttgataaggccggacattgcccttgaacttgcatggatgaacaacatgatcgactttgctttcccatatctgttacagtttatccgggaatacactggcaaagttgatgaactggttaaggacaagattgaagctcaaaaggaggtcaaggctaaagaacaggaagataaagaagttattgcgcagcagaacatgtatgctcagttgctgcctcttgctttgcctgcgccaccaatgcctggcatgggaggcggaatgggaggagggtatgctccaccgccacctatgggaggaatgccaccgatgggcatgccgccctttggcatgccaccaatgggcagtagctactgaggcgtgttgaactattcttgcggagttcgacatttgaatttggtgttttagtgagtagggaaacctatttgatagaacctaccatttagtgtaattttgtgtggatatgttgtgttgtaatattcttttgtagcagagccaatttttgtttggctggtggttgagggcaagcttagaattctctgtatttttttgttctcgttttttcgaacctacccgagtccgagtataatacaaaacactacactgatcattttgattatgttccaa

SEQ ID NO: 5148 - DNA, 5861 bp, Chelidonium majus
aactcaagagggttaaaagttttctgcgctgcttcagatctcgtagcgatcgaaatctcaagcgggtttgttatctcttcgtgcagaaatcctggttctgaaccctcggtagggggttttgatcctccatccaaattcgttttccagtttgaagcgccgatctaggcgccatggctgccgcaaatgctccaatcaccatgaaggaggccttgacgttgccttcaattggtatcactcagcaattcatcacctttacacatgttacgatggaatcggataagtatatatgtgttcgggagacatcaccgcagaatagtgttgtgatcattgatatgagcatgcctaatcagccattgagaaggcctatcactgctgactcggctttgatgaacccaaattccagaattctcgctttgaaagctcaacttccgggaactactcaggatcacttacaaatattcaacattgaaatgaaggcgaagatgaagtcgcatcagatgcctgaacaagttgtcttttggaagtggatcacccccaaaatgctaggtctggtaacacaaacctcggtgtatcattggtcaattgaaggtgattcggagcctgtaaagatgtttgacaggacagctaatctagcgaacaatcaaataatcaactacagatgtgacccttctgagaaatggcttgttttgattggaattgctccaggttcacctgagaggccgcaactggtcaaagggaatatgcagcttttctctgtagaccagcaacgtagtcaagcccttgaagctcatgcagcatcttttgcatcatataaagttcctgggaacgaaaatccatctattctcatcagttttgcctcaaagactaccaatgctggacaaattacatcaaagttgcatgtgattgaacttggtgcccagccaggcaaaccagcttttacaaagaaacaagcagatcttttcttccctcctgatttcgctgacgacttccctgtggcgatgcagatatcacacaagtacagtttgatctatgtgattacaaagcttggacttctgttcgtgtatgatctcgaaacagctacagcggtttacaggaaccgaatcagtccggatcccatatttttgacggcagaagcttcatccgtaggaggcttctatgctgtcaatcgacgaggacaagttttgcttgccactgttaacgaggcgacaattataccttttgtcagcggccaattaaacaatctggagcttgcggttaatcttgccaaaagaggaaatcttcctggggcagaaaacttggttgttcagcgtttccaagaattattctctcagacgaaatataaggaggctgcggagcttgctgcagaatcccctcagggaatcctacgtactccagacactgttgcgaaatttcagagtgttcctgttcaagctgggcaaactccaccactgttgcagtactttgggacactgttaactagaggcaagctcaatgcatttgaatcattggaattgtcaagacttgttgtgaatcagaacaaaaagaatcttctggagaattggttggctgaggataaactcgagtgtagtgaggagcttggagaccttgtgaagactgtggataatgacctcgcgttgaaaatatatatcaaggctagagctactcccaaagttgttgcagcttttgcagagcgaagggaatttgacaaaattcttatctactcgaagcaggttggatacacgcctgattatcttttccttctgcaaacaattctgcgatcagatccccagggagccgtcaatttcgctttgatgatgtcacaaatggagggaggatgtccagttgattataacacaatcacagatctcttccttcagaggaacatgatccgtgaggcaactgcctttttgttggatgttcttaagccaaatttgccagaacatgctttcctgcaaacaaaggtcttggagatcaatctagtgacttttccgaacgtagcagatgcaatcttggctaatggaatgttcagtcattatgaccgtcctcgcgttgcgcagctttgtgagaaagctggactttatgtgcgcgctctccagcattacgcagagttgccggacattaaacgtgttattgtgaatacacatgctattgagccacagtcacttgtggagttctttggaaccctttcgaaggagtgggctctggagtgcatgaaggatcttttacttgttaatctgaggggaaatcttcagataattgtgcagactgccaaagaatattcagagcagttgggtgttgaggcatgcataaagctctttgaacaatttaagtcctatgaaggtttatacttcttcttgggctcgtatttgagttccagtgaggaccccgacattcactttaagtacattgaagcagctgctaaaactgggcaaatcaaggaggttgaacgtgtgacaagagaatcaaacttctacgatgctgagaagacaaagaacttcctgatggaagctaaacttccagatgcccgtcccctgattaatgtttgtgatcgttttggatttgttcctgacctcacccactacctctacacgaacaacatgcttcgatatattgagggttatgttcaaaaggtcaatccagggaatgctcctctcgttgtagggcagctgctggatgatgaatgcccagaagatttcattaaagggcttattctttccgttcgttctctcctcccagtggagcctcttgtggaggaatgcgagaagaggaatcgtctacgtttactgacacagttcttggagcatcttgtgagtgaggggagccaagacgtacatgttcataatgctttgggtaaaatcatcatagatagcaacaacaacccggagcattttctcaccaccaatccttactatgattcacgcgtcgttggtaaatattgtgaaaagagggaccctacccttgcagtcgttgcttaccgaagaggacaatgtgatgaggaacttgtcaatgtcacaaataagaactccttgttcaaactgcaggccagatacgtggtggaaaggatggattcagacctctgggagaaagttcttgaccctgataatgagtacagaagacaacttattgatcaagtcgtgtctactgctttgcctgaaagcaagagccccgagcaagtttctgcggcagtcaaagctttcatgactgctgatcttccacacgaactaattgagctacttgagaagattgtgcttcaaaactctgccttcagtggaaacttcaatctgcaaaatcttttgatcctaacagccatcaaagcagatgcttctagagttatggactacatcaatagattggacaatttcgatggacctgctgtcggggaggtggctgtggaagcacaactttttgaagaagcatttgcaatcttcaagaagttcaacctgaatgtccaggctgtaaatgtccttttggataatattcaaagcattgaacgagctgtggagtttgcattccgcgttgaagaagatgctgtttggagtcaggtagccaaggctcaactcagggagggattagtgagcgatgcaattgagtcattcatccgtgcagatgattccactgaatttttagctgttattaaggcagcggaggatgcaaatgtatatcatgatctagtgaggtacctcttaatggttaggcaaaagtccaaggagcccaaggtggacagcgagcttatttatgcatatgccaagattgataggttgggtgatattgaagaattcattctaatgccaaatgttgctaatctccaaaatgttggtgatcgcttgtttgatgaaaccctatatgaggctgcaaagatcatatttgcttttatttctaactgggccaagctggctagcacacttgtgaggctcagacagttccaaggtgcagttgatgcagctcgaaaagccaatagttcaaagacatggaaggatgtttgctttgcctgtgttgatgccgaggaattccggttggcacagatatgtggactcaacatcattatacaggtggacgacttggaggaggtcagtcagtactatcagaacaggggttgcttcaacgagttaatatctctcatggagagtggactagggttggagcgtgcacatatgggaatctttaccgagttaggagtcctatatgctagatatcgtcctgagaagcttatggaacatatcaaactgttctcaacccgtctcaacattcccaagcttataagagcttgtgatgaacagcagcactggaaggaactcacctatctgtatatccagtatgatgagtttgacaatgcggcaaccaccatcatgaaccattctccggaagcatgggaccacatgcagtttaaggatgttgcagttaaagttgcaaatgtggaactatactacaaggctgtgcacttctacttgcaggaacaccctgatcttattaacgatatgctcaatgtgcttgcccttcgtgtagaccacacacgtgttgtggacataatgcgcaaggcgggtcacttgcgtcttgtgaagccatacatggttgcagttcagagtaataatgtctctgctgtgaatgaggctttgaatgagatctacgttgaggaggaggactatgataggttgcgtgaatcaattgacatgcatgataactttgatcagataggcctcgctcagaaggttgaaaaacacgagcttcttgaaatgaggagaatagctgcttatatttacaagaaagcaggtaggtggaagcagtccatcgctttgtctaagaaggacaatctttacaaagatgctatggagacgtgctctcaatctggtgatcgtgaactttcagaggagttgcttgtgtatttcattgaacagggtaaaaaggagtgttttgctgcgtgcctctttgtttgttatgatgtgatccgaccagatgttgcgcttgagcttgcctggatgaacaatatgatcgactttgtgttcccatacctattgcagtttatccgcgagtacactggcaaagttgatgagcttgtaaaggacaggatcgcagctcaaagtgaagttaaagccaaagagaaggaggagaaagacatggttgcacagcagaatatgtatgcccagttactaccacttgcactgccagcaccaccaatgccagggatgggtggaggttacggtcctccaccaccaatgggaggaatgggtatgcccccaatgccgccatatggcatgcctccaatgggttattagattccaggtaaaaagaatatgtattgaacagtcagtagtagcaccaacagaaaggggagaattttgttgctgccaggtggttatggatgttttattcgaattttggggatgtgaagagtctctcaggttccaaaataagaactaaattctttttgtatttcttcgtcagtagtagagaaatgttatatttcttgatattcttttggtagcagaggcatttttgtgctaccgtcgaaggctgagctaacttgtattctatatctctgtttgctgggatcatgtggtatacgatctttacctgacattggcagttgcacttcatgtgtggtggtggttgtggctgaagctgtcacttgtataggttgtcggtccctgtagtcttgtttagtaaactctctttttctttatttcttagatctgtatttgattgtgttcttttgccttttttgtttgtttgttcattctcttgttatatactgcaaaatcctagattacaattcagtgttattgatgtatcttgttttaatggagaaacctagtcgctttagacccacgtcgaccactacatcggctccattttcaagtttccag

SEQ ID NO: 5149 - DNA, 5692 bp, Castanea mollissima
aacaaataaacacctcctctctctctctctcttgctgtagatctctctctctctctctgtgagtctgtggatttggtcgctgcttccagatcttgcagcgattcgaatcctgtgcgagctttccatctccgactctcaattggtgattcaatcgcagccacagatctgcggagcctccatcgatctcagccaccatggcggccgccaacgctccgatcaccatgaaagaggccctaactttaccgagtattgggatcaatccacaattcatcacgttcactcatgttactatggaatccgataagtatatatgtgttcgggaaacatcgccgcagaatagcgttgttattattgatatgagtatgccaatgcagcctttgaggaggcctattactgcagactctgcgctcatgaatccaaattccagaatccttgctttgaaagcccaaatccaaggaactaatcaggatcacttgcaaatttttaacattgagatgaaagcaaaaatgaaatcttatcagatgcctgagcagattgtcttttggaagtggattacgccaaagatgctgggcctggtgacacagacctcagtatatcattggtcaattgaaggtgattctgaacctgtaaagatgtttgatagaacagctaatttggcaaacaatcagattataaactatcgatgtgacccttctgaaaagtggttggttttgattggaattgctcctggtgcacctgagaggccgcaattggttaaagggaatatgcaacttttctccattgatcagcagcgcagtcaagcgcttgaagcacatgctgcatcatttgcccaatttaaggttccaggaaatgattatccttctgttcttatttcctttgcaacaaagaccctcaatgctggacagattacatcaaagttacatattattgagcttggtgcccagccagggaagccgtcttttacaaagaaacaagcagatcttttcttcccacctgattttgccgatgactttccagttgcaatgcagatatcccagaaatacaatttgatctatgtgatcaccaagcttggactattatttgtttatgacatggagaccgctactgcggtatatagaaatagaattagtccagatccaatatttttgacagcggaagcttcatcgttgggaggtttttatgctgtcaataggcgtggacaggtgctactggctactgtcaacgaacaaacgattgtgccatttgtcagcggccagttgaacaatttggagctagctgtcaatcttgccaaaagagggaatcttcctggtgctgagcagctggttgtccaacgtttccaagaactgtttgcccaaacaaaatacaaagaagctgcggagcttgctgctgagtctccacaaggaatcctccgtacacctgacacagttgcaaaatttcagagtgttcctgttcaagctgggcaaacgccaccgctgttgcaatattttgggacactattgacgagaggaaagcttaatgcatttgagtcattggaattatcacgcctagttgtgaaccaaaacaaaaagaatcttttggaaaattggttggcggaggataagctggaatgcagcgaggaactaggtgatcttgtgaagactgtggataatgatctagcattgaaaatatatattaaagccagagcaactccgaaagtcgttgctgcttttgctgagcggagggagtttgacaaaattctgatctattcaaaacaggttgggtacactccagactatctatttcttctgcaaaccattcttcgttcagatcctcagggagctgtcaattttgcattaatgatgtctcaaatggagggaggttgtccagttgattacaataccataacagatctctttcttcagaggaacttgattcgtgaggcgacggccttcctattagatgttttgaagccaaatcttcctgaacatggtttccttcaaacaaaggtcctggaaatcaatctggtaacttttccaaatgtagctgatgctatattagccaatggaatgttcagccactatgaccgtcctcgaattggccaactttgtgaaaaagctggtctttatattcgtgctctgcaacattacacagagttgcccgatattaaacgtgtcattgtgaatacacatgcaattgagccacagtcacttgtagagtttttcggcactctgtcacgagaatgggctttggagtgtatgaaggaccttttattggtcaacctaagaggcaatcttcagataattgtgcaggctgccaaggaatattgtgaacagttgggtattgattcatgcataaagctttttgagcaatttaagtcatatgaaggactgtactttttccttgggtcatttttgagctccagtgaggaccctgacattcactttaagtacattgaggcagctgctaaaactggacaaatcaaagaggttgagcgtgtgaccagagagtcaaatttctatgacccggagaaaacaaagaactttttaatggaagctaagcttccagatgcacgcccactaattaatgtttgtgaccgttttgggtttgttcccgatctcacacactatctgtactcaaataacatgcttcgttacattgaaggttatgttcaaaaggtgaacccagggaatgctcctttagttgtggggcagctgctagatgatgagtgtcctgaagattttatcaaaggcttgattctttctgtccgttctttgcttccagtggagccccttgtggaggaatgtgagaagaggaaccgacttcgtttactcactcagttcttggagcatcttgtgagtgagggaagccaagatgtacatgttcataatgctttgggtaaaatcatcattgatagcaacaacaatccagagcacttcctcaccacgaacccctattatgattcccgtgttgtgggtaaatattgcgagaaacgagatcctaccctggcagttgtggcttaccggcgaggacaatgtgatgatgagctcatcaatgtcacaaataaaaattctttgttcaaactgcaagcaagatatgtggtagaaaggatggatggtgatctttgggagaaagttcttaaccctgaaaatgtctatagaagacagctcattgatcaagttgtgtctactgctttgcctgaaagcaagagcccagaacaagtttctgctgctgttaaggctttcatgactgctgatctacctcacgaattaattgagctccttgaaaagattgtgctgcagaactctgcattcagtgggaactttaatctgcagaacctgcttattctgacagccattaaagcagatccatctagagttatggattacattaatagactagacaactttgatggacctgcagttggggaagtggccgtggaagcccaactttatgaggaagcatttgcaattttcaagaagtttaacttgaatgttcaggctgtcaatgtcttattggataatatccgaagcattgaacgggctgtggagtttgcattccgtgttgaagaagatgcagtttggagccaagtgggcaaggctcaactcagggagggcctggtgagcgatgccattgagtcatttattcgtgcagatgacgcaactcaatttttggatgttattcgtgcttctgaggatgctgatgtttaccatgacttggtgaggtaccttctgatggttaggcagaaggtgaaagagcccaaggttgacagtgagctcatctatgcatatgcaaaaatagataggctgagtgacattgaagagtttattctcatgccaaatgtggctaatctccaaaatgttggtgatcgcttatatgatgaagccttatatgaggctgcaaagataatatttgcctttatatctaattgggccaagttggctatcacacttgtgaaactaagacagttccaaggtgctgtggatgcagcaaggaaagctaacagttcaaaaacatggaaggaagtctgctttgcttgtgtcgatgcggaggagttccgcttagctcagatatgtgggctcaacattattatacaggtggatgacttggaagaggtcagtgaatattaccagaatagaggatgcttcaatgagctaatctctcttatggagagcggtttaggtctggaacgtgcacatatgggcatctttactgagttgggagttctgtatgctagataccgtcctgagaagcttatggagcacatcaagctgttctcaacccgtctcaatattccaaagcttatacgagcttgtgatgaacaacagcattggaaggaactcacctatctgtatatccaatatgatgaatttgacaatgctgcaactactataatgaaccattcccctgaggcatgggatcacatgcagtttaaagatgtagcagttaaagttgctaatgtggagctgtattacaaggctgtgcacttctatttgcaagaacatccagatcttattaatgaccttctcaatgtgcttgcacttcgtgtggaccatacacgtgttgttgacattatgcggaaggctggtcacctgcatcttgtgaagccatatatggttgcagttcagagtaacaatgtggctgctgtgaatgaggcgttgaatggaatatatgttgaggaggaagactatgatagattgcgtgaatcaattgatctgcatgataacttcgatcaaattggtcttgcacagaagattgagaaacatgagcttcttgaaatgagacgtgttgctgcttatatctacaagaaagctggaaggtggaagcagtccattgcattgtcaaagaaagacaacctttacaaagatgccatggagacagcctcacaatctggtgaccgtgaacttgcagaggaattgctagtttacttcattgaaaagggaaagaaggaatgcttcgcatcatgcctctttgtttgttatgatttgattcgggcagacattgctcttgaacttgcctggatgaacaatatgatcgactttgctttaccgtatctgttgcagttcatccgtgaatacacaggcaaagttgatgaacttgtgaaggacaaaattgaggctctgaatgaggttaagattaaagagaaggaagagaaggatgtgattcaacaacagaacatgtatgcacagttgctgcctcttgctttgcctgcacctccaatgcccggtatgggaggtgcaccaggaatgggagggtttgttccaccgcctatgggtggaatggggatgcctcctatgccaccttttggtatgcctccaatggggagcagctactgatatgggggcaggcaaattgtcatgcaagttgagtgtaggggcaaggacgacctagcggttatggcatttttgtcttcttgtgttattgagtggggttttggtgcctcattttttcccgttgttctgatgggggtgaaggtgtagttgaaataatgtcaattattttgtgtcataagggtgtggatatatgtattgtaatattcttttggtagcgaggcatttttttggctgcctgtggagggcaagctgtggattttctgtattttacttattgtggtctaggaattgacccattatagtacagaacacttgatactgatcatcatctaccagtttgatatgttatggccgtgctttgattgattcttttttctgtggta

SEQ ID NO: 5150 - DNA, 5417 bp, Gossypium hirsutum
tcgatccgagccaccatggcggccgctaacgctccaatcgccatgaaagaggtcttaaatttgccaagcattggcattagtcctcaattcatcacgttcacgaatgtaactatggaatctgagaagtatatttgtgtgagggaaacggcaccacaaaacagtgttgttatcatagacatgaacatgccgatgcagccgctgagacggcctattacggcggactctgctcttatgaatccaaattctagaatcctcgccttgaaagctcaactaccaggaacgactcaagatcacttgcaaatatttaacatagagctgaaagcaaaaatcaaatcacatcagatgcctgaacaggttgtattttggaaatggattagcccaaaactgcttggcttggtcacacagacctctgtgtatcattggtcgattgaaggtgaatctgagccagttaagatgtttgagagaacagctaatttagcaaacaatcagataataaactataaatgggacccttcagagaagtggttggttttgattggaattgcccctggtgcacctgagaggccacaattggtcaaggggaacatgcaacttttctctgtggatcagcagcgtagccaagctcttgaagcacatgctgcttcatttgcacaatttaaggtcccaggaaatgagaatccatctattcttatttcgtttgccaccaagagttttaatgctggccagattacatcaaagttgcatgtaattgagctgggtgcccagccaggtaagtcatcgttttctaagaaacaggcagatctattcttcccgccagattttcaagatgattttcctgtcgccatgcagatatcccacaaatatgctttgatttatgttatcaccaaacttgggctgctgttcgtttatgatctggagacagcgactgctgtttacagaaatagaatcagtccagatccaatatttttaacctctgaagcttcagcagttggagggttttatgccatcaacaggcgaggtcaggtgttgctggctactgtaaatgaagcaacattagtgccatttgttagcggtcaattgaacaacttggagcttgctgtcagtcttgctaaaagaggaaacctccctggtgcagagaacttggttgtccaacgttttcaagagttgtttgctcaaactaagtataaagaagctgctgagcttgctgcagagtctccacaagggatccttcgcactcctgatacggttgccaagtttcagagtgttcccgtgcaagctgggcagactgcaccactgttgcagtactttagtatccttctaacaagggggaagctcaatgcatttgagtcattggaactatctcggcttgtggtaaaccaaaacaagaagaaccttctggagaattggttggctgaagataaattggaatgcagtgaagaattgggtgaccttgtgaagactgtggataatgatcttgcactgaaaatatatattaaagcaagggcaactccaaaagttgttgctgcttttgctgaacgtagggagtttgacaagatcttgatttactcaaagcaggttgggtacactcctgactacttgttccttttgcaaacaattctccgtacagatccacagggagctgttaattttgcattgatgatgtctcaaatggagggaggctgtccggttgattacaacaccattactgatcttttccttcagaggaacttgataagggaagctactgcatttctattggatgttttgaaaccaaatctaccagagcatgcttttctccaaacaaaggtcttggaaatcaatctagtaacttttccaaatgttgctgatgccattttagcaaatggaatgttcagtcactatgatcgtccccgaattgctcagctttgtgagaaagctggtctgtatgttcgagctctgcagcattactctgagttgccagatattaaacgtgtcattgtgaatacacatgctattgagccacagtcacttgttgagttttttggtactctttcacgtgaatgggctttggagtgcatgaaggacctcctactggttaatcttagaggcaaccttcaaataattgtgcaggttgcgaaagagtattgtgaacagttgggtgttgattcttgcataaaaatttttgagcagtttaagtcgtatgaaggattgtactttttcctgggctcatgtttgagctcaagtgaggaccctgatatacactttaagtacattgaggcagctgctaaaactggacaaataaaggaggttgagcgcgtgaccagggaatcgaacttttatgatgccgaaaagacaaagaacttcttgatggaggccaaacttccggatgctaggccattgattaatgtttgtgatcgatttgggtttgttccggatctcactcactacctctacacaaataatatgctccgttacattgaaggttatgttcagaaggtgaacccagggaatgctcctttggtagtgggccagttgctagatgatgaatgtcctgaagactttataaagggtctcattctctctgtccgttctttgcttcctgttgagcctcttgtggaggaatgtgagaagagaaatcgacttcgtttactaacacagttcttggagcatcttgtgagtgagggaagccaagatgtgcatgtccacaatgctctgggtaaaataatcattgacagcaataacaatccagagcacttcctcactaccaacccttactatgattctcgggttgttggtaagtactgtgagaagcgtgatcccaccctggctgttgtagcataccgaagaggacaatgtgacgatgaacttataaacgtcacaaataagaactccttgtttaaattgcaggctaggtatgttgttgaaaggatggatggtgatctttgggagaaggttctaaatcccgaaaatgaatatagaaggcagctgatagatcaggttgtatcgactgctttgccagagagcaagagtcccgaacaagtctctgcagctgttaaagcttttatgacagctgacctgccccatgaacttattgagcttcttgagaagattgtactccaaaactctgcattcagtgggaacttcaatctacagaatcttcttattttgacggctattaaggcagatccatctagggttatggattatatcactaggttggataattttgacggacctgctgttggagaagtggccgttgaagcccaactgtatgaagaagcttttgcgatcttcaaaaagttcaacttaaacgtgcaggccgtcaatgttttattggacaatattagaagcattgatcgggctgtggaattcgcattccgagttgaagaagatgctgtttggagtcaggttgcaaaggcacaactgagggaggggctggtgagcgatgccattgaatcttttattcgcgccgatgatgctacccagttccttgatgttatccgagcttccgaggatgctgatgtctaccctgatttggtgaggtatcttctgatggttaggcagaaggtcaaagagcccaaggtggatggtgaacttatttatgcctatgcaaagattgatagactcggcgaaattgaagaattcattctcataccaaatgttgctaatcttcaaaatgttggtgaccgcttgttcgatgaagccctatacgaagctgcaaaaataatatttgcgtttatatctaactgggccaaattggctgttacactggtaagacttaaacaattccaaggtgctgttgatgcagcacgaaaagcaaacagtgcaaagacatggaaggaggtttgctttgcttgtgttgatgcagaagaattccgattggcacagatatgtggtcttaacatcatcatacaggtggacgacttggaagaagttagcgaatactatcagaacagaggatgcttcaatgagttgatctctcttatggagagtggtttaggactggaacgtgcacatatggggatctttactgaactgggagttttgtatgccagataccgacccgagaagcttatggagcacattaaattgttctctactcgtctcaacattcccaagctgataagagcttgtgatgaacagcagcactggaaggaacttacctatttatacattcaatacgacgagtttgacaatgctgcaactaccgtgatgaaccactctcccgaatcatgggatcatatgcagttcaaagacattatagtcaaagttgctagtgttgagctatattacaaggctgtccacttctacttgcaagagcaccctgatctcataaatgatatgttgaacgtgcttgcacttcgtgtggaccacactcgtgttgttgatatcatgagaaaggcaggtcatctgcgacttgtgaagccttacatggttgctgttcagagcaacaacgtgtcagcagtaaatgaggcgttgaatgagatttatgtagaggaagaagattacgatagattgagagaatctatcgacttgcatgataactttgatcagattggtcttgcacaaaagatcgagaaacatgagctgctggagatgaggcgagttgctgcatacatttacaagaaggctggcagatggaagcagtccattgcattgtcaaagaaagacaaccattacaaagatgcaatggaaacagcgtcacagtctggtgaacgtgaacttgccgaggagttacttgtttactttattgaacagggcaagaaggaatgctttgcatcatgcctctttgtttgttatgacttacttcgagcagatgttgttctcgagctagcctggattcacaatatgatcgacttcgcattcccgtatctgttgcagtttatccgcgaatataccggcaaagtcgatgaacttatcaaggataaaatcgaggctcaaaaggaagtaaaagccaaagagcaagaagagaaggaagtgattgcacaacagaacatgtatgctcagttgctacctctagccttacctgcaccaccaatgcctggaatgggaggaggttttgctccaccaccaccacccatgggaggaatgggaatgccgccttcgatgccaccttttggtatgccaccaatgggcagctattaagccttaagagcatggtttgttttttattgaaggttctatttttaggagaaaaaaccgtagttcttatcaatttggaataatgtgctattttagtgtttttttttggagggatgtgataatgattttgtagtttgccctcattatttttctcctttttggtggtagcaaaagaggcattttttggctgctaatatactagagactagagaaagggtagtctaagggtttcatgaatatttgtatttttattatttcctttccatttccgaattgatctgagtatatatatgaaa

SEQ ID NO: 5151 - DNA, 5528 bp, Cucumis sativus
gtttttattatccacccatcatggcggccgccagcgctccgatcaccatgaaggaagccataacgcttccgagcattggaattaatccgcaattcattacgtttacgcacgtgactatggaatcagataaatttatctgcgttcgagaaacggcaccgcagaatagtgttgtgattattgacatgaacatgccaatgcagccattgaggaggcctataactgcggactcagcacttatgaatcctaattctagaatattggccttgaaagctcaagtccaggggtcaactcaagaccacctacaaatattcaacattgaacagaagtcaaaaatgaaatcacatttgatgcccgaacaggttgtcttttggaagtggataacccctaagacattgggcttggtcactcaaacttcagtgtaccattggtctactgatggtgagtctgaacctgtgaaagtgtttgagagaacagccaatctggctaacaatcagattataaactataggtgtgatccttctgaaaagtggttggttttgattggtattgcacctggttcacctgagaggccacaacttgtgaagggcaatatgcaactcttctctgtggatcagcagagaagtcaagctcttgaagcacatgctgcagcatttgctcaatttaaacttcctggaaatgagaacccttcaactcttatatcctttgccacaaaaacacttaacgctggacaaatcacgtccaagttacatgtcattgaacttggtgcccagccagggaaacaatcatttacaaagaagcaagcagatctcttttttccacctgattttgctgatgactttcctgtggcaatgcagatatcgcacaaatatagtttgatctatgtgatcaccaagctggggctgttatttgtatatgacttagagacagctgctgctgtatataggaataggatcagcccagatcctatatttttgactgcagaggcttcttcggtgggaggattttatgctataaacaggaggggtcaagtgttactggctaccgtcaatgaacaaacaattatctccttcgtcagtggccagttgaacaatttagagcttgctgtcaatcttgctaaaagaggaaatcttcctggtgctgagaatctggttgtccagcgtttccaagaactttttgctcaaacaaagtacaaagaagctgctgaattggctgctgagtctcctcaagggatcctccgcacaccagatactgttgcaaaatttcagagtgtaccggtgcaaactggtcaaacaccccctctactgcagtattttggaactctattaacgagaggaaagctgaacgcattcgagtcattggagctgtctcgtttagttgttaaccagaataagaagaacctcttggagaactggttgggtgatgacaagttggaatgcagcgaggaactaggggatcttgtgaagactgtggacaatgacctggcgttgaaaatctatataaaagccagagcaacaccgaaggtagttgctgcctttgctgagcggagggaatttgacaagattcttatatattcaaagcaggttggatacacaccggactacttattccttttgcaaacaattctccgaactgacccccagggagcggttaactttgcattgatgatgtcacaaatggaaggaggttgccctgttgactacaacacgataactgatctttttcttcagaggaatttgattcgtgaggctactgctttcctgttagacgttttgaagccaaatctacctgagcatgctttcctccagacaaaggtcctagaaatcaatctggtaacttttccaaatgtagctgatgccatattggctaatggaatgtttagtcattatgatagacctcgaattgcacaactttgtgagaaggctgggctttacgtgcgagctttgcagcattatacggaactaccagatattaaacgagtcatcgtgaacacacatgctatcgaaccacagtcacttgtagagttttttggtaccttgtctcgtgagtgggctttggagtgtatgaaggaccttttgcttgtgaatctcagaggcaaccttcagataatagtgcaggttgcaaaggaatattgtgaacagttgggggttgatgcgtgcattaaactttttgaacaatttaagtcctatgagggcttgtacttcttcttggggtcatatttgagttcgagtgaggatcctgacattcacttcaagtacattgagtctgctgctaaaacaggacagattaaggaggttgaacgtgtaacaagagaatccaacttctatgatgccgagaaaaccaagaactttttaatggaagctaagcttccagatgctcgtcctttgattaatgtgtgtgaccggtttggatttgttccagatctcacacattacctttacacaaataacatgctccgctacattgaaggctatgttcaaaaggtgaaccctgggaatgctcctttagttgtgggtcagctgctggatgatgagtgtcctgaagatttcattaagggtttgattctctctgtccgatctttgcttcctgtggagcccctagtggatgaatgtgaaaagagaaatcgattgcggttgcttactcaatttttggagcatctggtgagtgagggaagtcaagatgtacatgtacataatgctctgggtaaaattattattgatagcaataataatccagaacacttcctcaccaccaatccgtactacgattcacgtgttgtggggaaatattgtgaaaaacgtgatcccactttagctgttgtggcctatcgacgtggacagtgtgatgatgagcttattaatgttacaaacaaaaactctttgttcaaactgcaagcaagatatgtggttgagaggatggatggtgatctttgggagaaggttcttaaccctgaaaatgaatatagaaggcagctcatcgaccaagttgtgtcaacagccttgccagaaagcaagagtccagagcaagtttcagctgctgttaaggcttttatgacagcagatctgccacatgagttgattgaacttcttgaaaagattgtcctgcagaactctgcctttagtggaaactttaatctgcagaatcttcttatattgacagccatcaaggctgatccatccagagttatggactacattaacaggctagataattttgatggacctgcagtcggggaagtggctgtggaggcacagctgtatgaagaggcatttgcaattttcaagaagttcaacttgaatgttcaggctgtcaatgtcctgttggataacattcaaagtattgaaagagctgtagagtttgcattccgggttgaagaagatgcagtttggagccaggtggcaaaggctcaactgagggaaggattggtgagcgatgctattgagtcctttattcgtgcagatgatgccactcaatttctggaagtcattcgtgctgctgaggatgcaaatgtgtatcatgatttagttaggtaccttttgatggttagggagaaggccaaagagcccaaggtggacagcgagctgatttatgcctatgctaaaattgatcggttggctgagattgaagaatttattctcatgccaaatgtggctaatcttcaaaatgttggcgaccgcctctatgatgaagctttatacgaggctgctaaaattatatttgccttcatatctaactgggccaagctggctgtcactcttgtaaaactgaagcagttccaaggtgctgttgatgcagcaagaaaagcaaacagtgcaaagacatggaaggaagtgtgctttgcttgtgttgatgctgaagagttccgcctggcacaaatctgtggtcttaacattattatccaggtggatgatctggaggaggtcagtgaatattatcagaatagaggatgcttcaatgaattaatttctctcatggagagtggactgggacttgaacgtgctcatatgggtatcttcactgagttgggagtgttgtatgctagataccgccatgagaagcttatggagcatatcaaactgttctcgacccggcttaatattcccaagcttatacgagcttgtgatgagcagcaacattggaaggaactcacctatttgtatatccagtacgatgaatttgataatgctgcaaccaccatcatgaatcattctcctgaagcttgggatcacatgcaatttaaagatgttgcagtcaaagttgcaaacgtggaattatattataaggctgtacatttttacttgcaagagcatcctgatctgattaacgatcttctcaatgtgcttgcacttcgtgtagaccacacaagagttgttgatattatgaggaaggctggtcacttgctgcttgtgaagccatacatgattgcagttcagagcaacaacgtgtctgctgtgaatgaggccttgaatggaatctatgttgaagaggaagactatgatagattgcgtgaatcgattgatttgcacgacaactttgatcaaataggccttgcacagaagattgagaagcatgagctacttgaaatgagacgggttgcagcttacatttacaagaaagccggaagatggaagcaatccattgccttgtcaaagaaagacaatctgtacaaggatgcaatggagacagcatcacaatctggtgaccgtgaacttgccgaggagttgcttgtttacttcattgaacagggaaagaaggaatgctttgcttcatgcctctttgtttgttatgacttaatccgggctgacgttgctcttgaacttgcctggatcaacaacatggtcgactttgctttcccatacctgttgcagtttatccgagaatataccggaaaggttgatgaacttgtgaaggacaagattgaagctgccaaagaagtcaaggctaaagagcaggaagagaaggacgttattgctcagcagaacatgtatgctcagttgctgcctcttgctttgcctgcaccacctatgccgggtatgggaggaggaccaggaatgccagggtttgtgcctggaccaccacaaatgggtggattggggatgcctccaatgccacctttcggcatgccacctatgggtagcagctattgacacatagaaaaacctagaaaaaaaagcgggattgatttatagattctaggggagagttgaaagaaagataccttgaaaatgggggagggggacttttcttaccttaattctacgctttcttccccagttgttcctcgatgggtgagccattctgttttcatgtgttatagtgtttgtggagtttttacttttaatttgtctttgtaatattcttttggtagcgcaggcattttttccggatgctctggtgcagcaacctgagggttctgtattttaagattttttctcctccactttattatatagcctggcctttcattaggaaatgctactttaaacgatgataaaacccagattcatagatttattgtcctttttttcttc

SEQ ID NO: 5152 - DNA, 5643 bp, Eucalyptus grandis
ccatggccgcggccaacgccccgatcgccatgaaggaggctctcacgcttcccagcgttggcatcaatccgcagttcatcacgttcacccacgtcaccatggagtcggacaagtacatttgcgttcgggagacgtcgccccagaacagcgtggtcattatcgacatgagcatgcccaaccagcctctcaggaggcccatcactgcggactccgctctcatgaaccctaattctagaatcctcgctcttaaagctcaacttccgggaaccacacaagatcacttgcaaatatttaacattgagatgaaagcgaaaatgaagtcccatcaaatgccggagcaggttgtcttttggaaatggattactcctaaaatgttgggtttagttacacaaacctcagtttatcactggtcaatcgaaggtgattctgagcctgtgaaaatgtttgagagaacagctaatctggtgaacaatcagattattaactaccgatgtgatccttctgagaagtggctggttttggtcggcattgctccaggctccccggagaggccacaattggtcaaggggaacatgcaacttttctccgtggatcagcagcgtagtcaagcccttgaagcgcatgctgcagcattcgcctcattcaaagtcccgggaaatgagaatccttctacactcataagctttgcgacgaaagccattaatgctggacaggttacatcgaagttacatgtcattgaactgggtgcccaaccaggaaaggcatccttcacaaagaagcaagcagatcttttctttcctccagattttgccgatgactttcctgttgcaatgcagatatctcaccaatatggtttgatatatgcgattaccaagcttgggctgttgtttgtgtatgacttggagactgcaactgcagtatacagaaacagaattagtccagatccgatatttttgacagctgaagcttcgtctattggaggattttatgccatcaatagacgaggacaggttctacttgctactgtaaatgaggctacgatcgtaccctttgtcagtggccagttaaacaacttggagcttgctgtcaatcttgccaaaagaggaaatcttcctggtgcagagcagctggttgtccaaaggttccaagaactgtttgcccagacaaagtacaaagaagctgctgagcttgctgctgagtctccacaaggaattttacgcacccctgatacggtcgcgaagtttcagagcgtccctgtgcaatctgggcagacaccacctctgttgcagtactttggcacccttcttactagaggaaagcttaatgcatttgaatcattggaactatcgcggcttgttgtgaaccaaaacaagaagaacctattggagaattggcttgcagaggacaagctagaatgcagcgaggaacttggagaccttgtgaagactgtggataatgatcttgcgttgaaaatatacatcaaagccagagcaactccaaaagttgttgcagcttttgctgaacggagagagtttgacaaaattctgatatactcaaagcaggtggggtataaccctgattatttgtttctcttgcaaacaatcctccgaacagatgcacagggcgccttgaattttgctttgatgatgtctcaaatggagggaggatgtccagttgactacaatacaattacagatctctttcttcagagaaatttgatccgtgaagcaacagcctttctgttagatgttttgaagccaaatcttccagagcatggttttcttcaatcaaaggtccttgaaatcaatctggtcactttccctaatgttgctgatgcaatcttggccaacggaatgtttagccactatgatcgtcctcgaattgcccagctttgtgaaaaagctggtctttatgttcgagcattgcaacactattcagaactcccagatatcaaacgtgtaattgtgaatacccatgctattgagccacagtcactggtagagttttttggcaccctttcacgggaatgggctttagagtgcatgaaggaccttttactggttaatctccgaggaaaccttcagataatagtacaggttgccaaagaatactgtgagcagctgggcgttgagccctgcataaagatttttgagcaattcaagtcttatgaaggactgtactttttcctgggttcatacttgagctccagtgaggaccctgacattcatttcaagtatattgaggccgccgctaaaaccggtcaaattaaagaggttgaacgagtgactagagaatcaaacttctatgacccagaaaagacaaaaaacttcttaatggaggccaagcttccggatgcacgtccccttatcaatgtctgtgatcgatttgggtttgtgcctgatctcactcactacctttataccaacaacatgctccgttatattgaaggttatgtccagaaggtgaaccctgggaacactcccttagtagtgggacagttgcttgatgacgagtgcccagaagactttatcaaaggcttaattctgtctgttcgttctctgcttccggtggagcccctggtggatgaatgtgaaaaaaggaatcgtctgcggttacttactcaattcctggagcatcttgtgagtgagggaagccaagatgtacatgttcataatgccctgggtaaaataattatagacagcaacaacaatccggaacacttcctcaccaccaacccatactacgattcccgtgtagtgggtaaatactgtgaaaaacgcgatcccactctagcagttgtagcttaccggagaggccaatgtgatgaggagcttatcaatgtaactaacaagaactctttgttcaagttacaagccaggtatgtggttgagagaatggatggtgatctgtgggagaaggttctaaaccctgagaatgaatataggagacagctgattgatcaggttgtatctacagcattgcctgaaagcaaaagtccagagcaagtgtctgcagctgttaaagccttcatgacagctgatctcccacatgaactgattgagctcttggagaaaattgttctgcagaactctgcattcagtgggaactttaacctacagaacctgcttatccttactgctattaaggcagacccatcaagagtaatggattatgtcaatagacttgataactttgatgggcctgctgttggagaagtcgctgtggaagcccaactctatgaggaagcctttgcaattttcaaaaagttcaacatgaatgttcaggctgttaatgtcttgttggacaatattagaagcattgagcgagctgtggagtttgcattcagggtcgaagaagaggctgtttggagccaggtggctaaagctcagttgagggagggtctggtgagtgatgcaattgagtcgtttattcgggcagatgatgcgactcaatttttggatgttattcaagctgctgagaatgcaaatgtctaccatgacttggtgaagtaccttctaatggttaggcagaaggcaaaagagccaaaagtggacagtgaacttatttatgcatatgcaaagattgatagattgggtgaaattgaagaatttattctcatgcctaatgtggccaatctacaaaatgttggtgatcgactgtttgatgaagctttatatgaggctgctaagatcatatttgcctttatctcgaactgggccaagttggcatgcacactggtgaaactgagacaattccaaggtgctgttgatgcagcacgaaaagccaacagtgcaaagacgtggaaggaagtctgttttgcttgtgttgatgctgaggagttccgcttagctcaaatatgtggtctgaacatcattgtccaggtggatgacctcgaagaagtcagcgaatactatcagaacagaggatgctttaatgagcttatctcacttatggagagtggcttggggctagagcgtgcacatatgggcattttcactgaattgggagttctttatgctagataccgtcatgagaagcttatggagcacatcaagctcttttctacacgtctcaacattccaaaacttatcagagcttgtgatgagcaacaacattggaaggagcttacctatttgtacattctatatgatgagtttgataatgctgcaactaccataatgaaccactctccagaagcatgggatcacatgcaatttaaagatgttattgtcaaagttgctagtgttgaactctactataaggctgtgcacttctacttgcaagaacatccagatcagataaatgatgttctaaatgtgcttgcactgcgagtggaccatacacgtgttgttgacatcatgcgaaaggctggtcacctgcgtcttgtgaagccgtacatggttgcagttcaaagcaataatgtgtctgctgtgaatgaggctttgaatgagatttatgtggaagaggaagactatgatcgactacgtgaatctattgatttgcatgataactttgatatgataggcttggctcagaagatcgagaagcacgaacttcttgaaatgagaagagttgctgcttatatttacaagaaggctggccgatggaagctgtcaattgcactgtccaagaaagacaatctttacaaagatgcaatggagacagcttctcagtctggtgaacgtgaacttgctgaagagttgcttgtttatttcattgagaaggggaagaaagaatgctttgcttcttgcctatttgtgtgctatgatttgattcgagcagatgttgctcttgagctagcttggatgaacaatatggttgactttgccttcccatatctcctccagtttatccgtgaatacacaggcaaagttgatgagctaataaaagacaagattgaatctcaaaatgaggttaaggcaaaagagaaggaagagaaggacgtgatcgcacagcagaatatgtatgctcaattgctgcctcttgctctgcctgcacctccgatgcccggtatgggaggaccaggaatggggggaggctttggtccacctcctcccatgggtggaatgggaatgcctccaatgccaccttttggaatgccacccatgggcagttattgagtttttgagaaacattgaagattttccaggaattaagagcaggatagcagtttgagttcttcactgaagtgtgtggctgagggtaaatttcatttttcatttttgcagaaagggtctcgaggtttctttgaaataattgcttttgctttcaaaaggtgtgtctattattagctgttgataatttttttttttggggggatagaactagaagacagcattcttttgggctattgtagacgcccagccaagggatttcttgtattataaaactaatttcgtttcatttgtgtatccacgaccaagagaatcacatgatttctatgttctggggtggacttttggatgaaattctttgatcggttcacttggaaaatgtcatgacggcgtccattctggtgctgttcaatcaaagtgatccataatttgtcttttggctttgtggaagggagtgattgcatacgcatctgtgagtttctttttcccctttgagtatgaatctggtatgagttgcatttcaccaaaa

SEQ ID NO: 5153 - DNA, 5776 bp, Amsonia hubrichtii
ataaatttcaagagaaaaagaaaaattccatttctcatttttatagagtacgacatagcctagaaatataaagcagtctgcattcactctctctctttagattagaaccctctcttcccctccatactctctcttcttagatctcttcgttctcttccctcactaccgttttctgtttctgaatactttgctggttctgcgagggttcgagggtttcttcgctgtctcagatctcaaagcgtctgagtcgcttgattattgtcgtttcttggactctcgaggtcgcgatttattcacttgttttccagatccggatatttgatctcggagctttgatctcgccaccatggcggctgctaacgctccgatcaccatgaaagaggctctcacgttgacgagcataggaatcaatccgcagttcatcacctttacaaatgtgaccatggaatccgataagtatatatgtgtacgtgagacagcaccacagaatagcgttgtaattattgatatgagtatgccaatgcaaccattgaggaggccgatcactgcagactcagctcttatgaaccccaataccagaatcttagctttgaaagcccaacttcctggaaccactcaagatcacttacaaatatttaacattgaggcaaaggccaaaatgaagtcgcatcaaatgcctgagcaggttgttttttggaagtggattaccccaaaaatgttgggtttggtcacacagacatctgtgtatcattggtctattgaaggtgaatctgaacctgtaaaaatgtttgatagaacagctaatttatcgaacaaccaaataatcaattataggtgtgatccatctgaaaaatggttggttctcattggaattgcacctggttctcctgagagacctcaactggttaaaggaaatatgcaactattttctgtggatcagcagcgtagccaagcccttgaagctcatgctgcatcatttgcctccttcagagtgccaggaaatgataaggattctattcttatatcatttgcaacaaaatcctcaaatgctgggcaggtcacctcaaaattgcatgttatcgagcttggagcccagccaggaaagccatctttctcgaagaagcaagcagatcttttcttccctccagattttgcagacgactttcctgtagcaatgcagatttctcagaagtatagcttgatttttgtgatcacaaagcttggacttctctttgtatatgacctggagacagctactgcagtgtatagaaataggatcagtccagatcctatctttttgacatccgaggctgcatcggtggggggattctattcaattaataggcgaggacaggttttgcttgcaacagtgaatgaagcaacaattgtgccatttgtcagtggccagttaaacaatctggagcttgctgtaaatcttgccaaaagaggaaaccttcctggtgcagagaatttggttgtccagcgattccaggagttgtttgctcagacaaagtataaggaagctgccgagcttgcagcagaatctccgcaaggcattctacgaacacctgacactgttgccaaatttcagagtgttcctgtccaagctggacaaacaccacctctgttgcagtactttgggacacttttaacacgaggaaagctcaatgcctttgagtcattggaattatcccgccttgttgtgaatcagaataagaaaaatcttttggagaactggttggctgaggataaactggaatgtagtgaggaacttggcgaccttgtaaagactgtggacaatgatctggcactgaaaatatatataaaagcgagggcaactcctaaggttgttgcagcttttgctgagcggagggaatttgacaaaatactgatatactccaagcaggttggctacacgccagattatttgttccttctgcagacaattctgcgttcagatcctcagggggctgttaattttgcccttatgatgtcccaaatggagggaggctgtcctcttgattacaacactataactgatctctttcttcagaggaacctgatccgtgaggctactgcatttttgttggatgttctaaagcccaatttaccagaacatgcataccttcaaacaaaggttcttgaaattaatcttgtcacattccctaatgtggctgatgctattttagcaaatggaatgtttagccactatgaccggccacgtattgctcagctttgtgaaaaagctggtctgtatatgcgagctcttcagcactacgctgagctgccagatatcaagcgagttattgtgaacactcatgcaattgagccccagagtcttgtagaattttttggtactctttcacgagaatgggcattggaatgcatgaaggatcttctactcgtcaacctaaggggcaaccttcagattattgttcaagttgctaaagaatactgtgagcagttgggggttgatgcatgtatcaagctttttgaacagttcaagtcctatgaaggattatacttcttcctgggttcttatctgagctcaagtgaggaccctgatatacatttcaagtacattgaagctgccgcaaagactggacaaattaaggaggttgagcgtgtgacaagggaatcaaatttttatgacgctgaaaagacaaagaacttcttgatggaagccaagctccccgatgctaggccactgatcaacgtgtgtgatcggtttggctttgttccagatttgactcactacttgtacacaaacaacatgctccggtatattgaaggatatgtccagaaggtcaatccaggaaatgctcctttagttgtcgggcagctactagatgatgaatgtcctgaagattttatcaaaggactgattctttcggtgcggtctctgcttccagttgagccccttgtggaggagtgtgagaaaaggaatcgacttcgcttgctaactcaatttttggagcatcttgtgagtgaaggaagccaagatgtacatgttcacaatgccttggggaaaatcataatagatagtaataacaaccctgagcacttcctcactaccaacccatattatgattcgcgtgttgttggcaaatattgtgagaagcgtgatccaacccttgctgttgtggcctaccggagagggcaatgtgatgatgaacttatcaatgtaacaaacaagaattctttatttaagctgcaggccaggtatgtggttgaaagaatggatggtgatctttgggagaaggtactgaaccctgaaaatgagttcaggcggcagcttatcgatcaagttgtatctactgctcttcctgaaagcaagagccctgagcaagtttctgcatctgttaaagcgtttatgactgctgatcttccacatgaacttattgagcttctggaaaagattgtacttcaaaactctgcattcagtggaaacttcaatttgcagaacttactgatcttgactgccataaaggcagacccttctagagttatggactacattaataggctggataactttgatggacctgcagtgggtgaagtggctgtggaagctcaattatatgaagaagcttttgcaattttcaagaagtttaatttgaatgtccaagctgttaatgtcttactggataatattcgtgacatcaaccgtgcagtggagttcgcgttccgtgttgaagaagaggctgtttggagtcaggttgctaaagctcaattaagagagggattagtaagtgatgcaattgagtcctttatccgtgcagatgatgccactcaattcttggaggtcatacgagctgctgaggatgctgatgtataccatgacctggtgaagtaccttctgatggttaggcagaagacaaaggaacctaaggttgacagtgagattatttatgcatatgctaagattgatagactgggtgacattgaggaatttattctcatgccaaatgttgctaatcttcctaatgtgggtgaccgcttgtatgatgaggctctgtatgaggctgcaaaaattatttttgcttttatttctaactgggccaagctggctatcacattagtcaagttgaagcaatttcaaggtgctgttgatgctgcaaggaaggcaaacagctcaaagacatggaaagaagtatgctttgcttgtgttgatgccgaggagttccgattggctcaaatttgtgggcttaacattattgtacaggtggatgacttggaagaagtcagtgaatattatcagaataggggatgcttcaatgaactaatttctctcatggaaagcggtctcggattggagcgtgcacatatgggcatatttacagaactgggtgtgctttatgcaagataccgccatgagaaactcatggagcatatcaagttattttctactcgactcaacattcccaagctaatcagagcttgtgatgagcagcagcactggaaggagctaacatatctatatattcaatatgatgaatttgataatgctggcactactgtcatgaatcattctccggatgcttgggatcatatgcagttcaaggatattattgtcaaagttgctaatgttgagctttactacaaggcagtacatttctatttgcaagagcaccctgatctcattaatgatcttctcaatgttcttgcacttcgtgttgaccattcccgtgttgtggacataatgaggaaggctggccatcttcgtcttgtgaaaccatacatggttgcagtccagagcaacaatgtttctgccgtgaatgaggctctgaatgagatctatgttgaggaggaagactatgacagattacgagaatcaattgatttgcatgataactttgatcagattggccttgcacagaagattgagaaacacgagctacttgagatgaggcgtgttgctgcttatatttacaagaaggcaggtaggtggaagcaatctattgcgctgtctaagaaagacaatctttacaaagatgcaatggagacagcttcacagtctggggatcgtgaacttgctgaggagctgcttgtttatttcattgaacaaggaaagaaggaatgctttgcatcatgcctctttgtttgttacgatttgattcgtgccgatgttgctctcgagcttgcttggatgaataacatgattgactttgccttcccgtatctgttgcagtttattcgtgaatacactggcaaagttgatgatttgatcaaggacaaaattgaagctatgaatgaagtgaaggccaaggagaatgaagagaaggacgtcattaagcagcagaatatgtatgctcaattgctgcctcttgcgctgcctgcaccaccaatgcctggtatgggaggaggatttgctccacctccacctccacccatgggtggaatgggaatgccaccaatgccgccatttggcatgccaccaatgggctcttattgatccgggcgagtataactgtagaaatctgtagtgcgcatggttgcttcaggtggaaatggaaccggaccagtttggctctccacagttgatgtttattggttcaacctattttcatttttatatcattttctgtaagttgttgacggatctcagtgcaggtttagagtaagcaataatgtttgcagtgttgtttgtcatagggtgtggatatgtttcttttgtaatattctttggtagcgaggcaattttttgcagctggggtaggcggcaagctgaggatattttgtattttattatgaaaatgaactagccgattatgaa

SEQ ID NO: 5154 - DNA, 5930 bp, Quercus alba
gcacaggcacagcgcatctcaacacacgtcttattccaaatcgacgagattttttctatatagtgtgttccctttcactttccccttaggccctgttcgatttctgcttctcgttattccgttgcaaaatcacatttctttctttccctttctcttcatttcttaattcccaaatcacagctcaaaacgcatcacaccctctctctctctcgctgtagatcgatctctctctgagtctctgaatttggtcgctgcttccagatcttgcggcgattcgaatcctccgtgagctttgcatctccgactctcaattggtgattcaatcgcagccacagatctgcggagcctccgtcgatctcagccaccatggcggccgccaacgctccgatcaccatgaaagaggccctaactttaccgagcattgggatcaatccacaattcatcacgttcactcatgttactatggaatccgataagtatatatgtgttcgggaaacagcgccgcagaatagcgttgttattattgatatgagtatgccaatgcagcctttgaggcggcctattaccgcagactctgcgctcatgaatccaaattccagaatccttgctttgaaagcccaaatacaaggaactaatcaagatcacttgcaaatatttaacattgagatgaaagcaaaaatgaaatctcatcagatgcctgagcagattgtcttttggaagtggattacgccaaagatgctgggcctggtgacacagacctcagtatatcactggtcaattgaaggtgattctgaacctgtaaagatgtttgatagaacagctaatttggcaaacaatcagattataaactatcgatgtgacccttctgaaaagtggttggttttgattggaattgctcctggtgcacctgagaggccacaattggttaaagggaatatgcaacttttctccattgatcagcagcgcagtcaagctcttgaagcacatgctgcatcatttgcccaatttaaggtaccaggaaatgattatccttctgttcttatttcctttgcgacaaagaccctcaatgctggacagattacatcaaagttacatattattgagcttggtgcccagccagggaagccgtcttttacaaagaaacaagcagatcttttcttcccaccagattttgccgatgactttccagttgcaatgcagatatcccagaaatacaatttgatctatgtgatcaccaagcttggactattatttgtttatgacatggagaccgctactgcagtatatagaaatagaattagtccagatccaatatttttgacagcggaagcttcatcattgggaggtttttatgctgtcaataggcgtggacaggtgctactggctactgtcaacgaacaaacgattgtgccatttgtcagtggccagttgaacaatttggagctagctgtcaatcttgccaaaagagggaatcttcctggtgctgagcagctggttgtccaacgtttccaagaattgtttgcccaaacaaaatacaaagaagctgcggagcttgctgctgagtctccacaaggaatcctccgtacacctgacacagttgcaaaatttcagagtgttcctgttcaagctgggcaaacgccaccgctgttgcaatattttgggacactattgacgagaggaaagcttaatgcatttgagtcattggaattatcacgcctagttgtgaaccaaaacaaaaagaatcttttggaaaattggttggcagaggataagctggaatgcagtgaggaactaggggatcttgtgaagaccgtggataatgatctagcattgaaaatatatattaaagccagagcaactccgaaagtcgttgctgcttttgctgagcggagggagtttgacaaaattctgatctattcaaagcaggttgggtacactccagactatctgtttcttctgcaaaccattcttcgttcagatcctcagggagctgtcaattttgcattaatgatgtctcaaatggagggaggttgtccagttgattacaataccataacagatctctttcttcagaggaacttgattcgtgaggcgacggccttcctattagatgttttgaagccaaatcttcctgaacatggtttccttcaaacaaaggtcctggaaatcaatctggtaacttttccaaatgtggctgatgctatattagccaatggaatgttcagccactatgaccgtcctcgaattggccaactttgtgaaaaagctggtctttatattcgtgctctgcaacattacacagagttgccagatattaaacgtgtcattgtgaatacacatgcaattgagccacagtcacttgtagagttttttggcactctgtcacgagaatgggctttggagtgtatgaaggaccttttattggtcaacctaagaggcaatcttcagataattgtgcaggctgccaaggaatattgtgaacagttgggtattgattcatgcataaagctttttgagcaatttaagtcatatgaaggactgtactttttccttgggtcatttttgagctccagtgaggaccctgacattcactttaagtacattgaggcagctgctaaaactggacaaatcaaagaggttgagcgtgtgaccagagagtcaaatttctatgacccggagaaaacgaagaactttttaatggaagctaagcttccagatgcacgcccactaattaatgtttgtgatcgttttgggtttgttccagatctcacacactatctgtactcaaataacatgcttcgttacattgaaggttatgttcaaaaggtgaacccagggaatgctcctttagttgttgggcagctgctagatgatgagtgtcctgaagattttatcaaaggcttgattctttctgtccgttctttgcttccagtggagccccttgtggaggaatgtgagaagaggaatcgacttcgtttactcactcagttcttggagcatctcgtgagtgagggaagccaagatgtacatgttcataatgctttgggtaaaatcatcattgatagcaacaacaatccagagcacttcctcaccacgaacccctattatgattcccgtgttgtgggtaaatattgcgagaaacgcgatcctaccctggcagttgtggcttaccggcgaggacaatgtgatgatgagctcatcaatgtcacaaataaaaattctttgttcaaactgcaagcaagatatgtggtagaaaggatggatggcgatctttgggagaaagttcttaaccctgaaaatgtctttagaagacagctcattgatcaagttgtgtctactgctttgcctgaaagcaagagcccagaacaagtttctgctgctgttaaggctttcatgactgctgatctacctcacgaattaattgagctccttgaaaagattgtgctgcagaactccgcattcagtgggaactttaatctgcagaacctgctcattctgacagccattaaagcagatccatctagagttatggattacattaatagactagacaactttgatggacctgcagttggggaagtggccgtggaagcccaactttatgaggaagcatttgcaattttcaagaagtttaacttgaatgttcaggctgtcaatgtcttattggataatatccgaagcattgaacgggctgtggagtttgcattccgtgttgaagaagatgcagtttggagccaagtgggcaaggctcaactcagggagggcctggtgagtgatgccattgagtcatttattcgtgcagatgatgcaactcaatttttggatgttattcgtgcttctgaggatgctgatgtttaccatgacttggtgaggtaccttctgatggttaggcagaaggtgaaagagcccaaggttgacagtgagctcatctatgcatatgccaaaatagataggctgagtgacattgaagagtttattctcatgccaaatgtggctaatctccaaaatgttggtgatcgcttatatgatgaagccttatatgaggctgcaaagataatatttgcctttatatctaattgggccaagttggctatcacacttgtgaaactaagacagttccaaggtgctgtggatgcagcaaggaaagctaacagttcaaaaacatggaaggaagtctgctttgcttgtgttgatgcggaggagttccgcttagctcagatatgtgggctcaacattattatacaggtggatgacttggaagaggtcagtgaatattaccagaatagaggatgcttcaatgagctaatctctcttatggagagcggtttaggtttggaacgtgcacatatgggcatctttactgagttgggagttctgtatgctagataccgtcctgagaagcttatggagcacatcaagctgttctcaacccgtctcaatattccaaagcttatacgagcttgtgatgaacaacagcattggaaggaactcacctatctgtatatccaatatgatgaatttgacaatgctgcaactactataatgaaccattcccctgaggcatgggatcacatgcagtttaaagacgttgcagttaaagttgctaatgtggagctgtattacaaggctgtgcacttctatttgcaagaacatccagatcttattaatgaccttctcaatgtgcttgcacttcgtgtggaccatacacgtgttgttgacattatgcggaaggctggtcacctgcatcttgtgaagccatatatggttgcagttcagagtaacaatgtggctgctgtgaatgaggcgttgaatggaatatatgttgaggaggaagactatgatagattgcgtgaatcaattgatctgcatgataactttgatcaaattggtcttgcacagaagattgagaaacacgagcttcttgaaatgagacgtgttgctgcttatatttacaagaaagctggaaggtggaagcagtccattgcattgtcaaagaaagacaacctttacaaagatgccatggagacagcctcacaatctggtgaccgtgaacttgcagaggaattgctagtttacttcattgaaaagggaaagaaggaatgcttcgcatcatgcctctttgtttgttatgatttgattcgggcagatattgctcttgaacttgcctggatgaacaatatgatcgactttgctttcccatatctgttacagttcgtccgtgaatacacaggcaaagttgatgaacttgtgaaggacaaaattgaggctctgaatgaggttaagattaaagagaaggaagagaaggatgtgattcaacaacagaacatgtatgcgcagttgctgcctcttgctttgcctgcacctccaatgcccggtatgggaggtgcaccaggaatgggagggtttgttccaccgcctatgggtggaatggggatgcctcctatgccaccttttggtatgcctccaatggggagcagctactgatatgcaggcaggcaaattgttcaagctgaagttaaggatgcaagttgagtgtaggggcaaggacgacctagcggttatggcatttttgtcttgtgttattgagtggggttttggtgcctcattttttccccttgttctgatgggggtgaaggtgtagttgaaataatgtcaaattattttgtgtcataagggtgtggatatatgtattgtaatattcttttggtagcgaggcatttttttggctgccagtagagggcaagctgtggattttctgtattttacttattgtggtctaggaattgaccccttatagtacagtacagaacacttgatactgatcatcatctaccagtttgatatgttatggccgtgctttgattgattctgtttttctgtcgtagtggtgataccttattcatttggattttgtatttagttgcaatcaa

SEQ ID NO: 5155 - DNA, 5527 bp, Tabernaemontana elegans
tcatgctttgtctccctagatctctttctttctcttccttcgcacccatcttctggttctgaatagtttgctggttctctgaggtttcgagggtttcttcgctgtcgcagatctcacagcgtgagtcgcttgattactgtggtttttttggactcttgaggtcgcgatttaatcaccattttccagatccggatttttgatctcggagcttgatctcgccaccatggcggctgctaacgctccgatcaccatgaaagagtcgctcacgttgacgagcataggaatcaatccgcagtttatcacctttacaaatgtgaccatggaatccgataagtatatatgtgtacgtgagacagcaccacagaatagcgttgtaattattgatatgagcatgccaatgcaacctttgaggaggccaatcactgcagactcagctcttatgaaccctaataccagaatcttagctttgaaagcccaacttcccggtacgactcaagatcacttgcaaatatttaacattgaggcaaaggctaaaatgaagtcacatcaaatgcctgagcaggttgttttttggaagtggattaccccaaagatgttgggtttggtcacccagacctctgtgtatcattggtccattgaaggcgaatctgaacctgtaaaaatgtttgatagaacagctaatttagcaaacaaccaaataatcaattataggtgtgatccatctgagaaatggttggttttgattggaattgcacctggtactcctgagagaccccaactggttaaaggaaatatgcaactcttttctgtggatcagcagcgtagccaagcccttgaagcgcatgctgcatcatttgcctcgtttagagtaaccggaaatgataaagattctattcttatatcatttgcaacaaaatcctcaaatgctggacaggtcacctcaaaattgcatgttattgagcttggagcccagtcaggaaagccatcttttacaaaaaagcaagcagatcttttcttccctccggattttgctgatgactttcctgtagcaatgcagatttctcagaagtatagcttgatttatgtgatcacaaagcttggacttctctttgtatatgatctggaaacagcgactgcagtttatagaaataggatcagtccagatcctatctttttgacctcagaggcttcgtcggttgggggtttctatgcaattaataggcgaggacaggttttgctcgcgacagtgaatgaagcaacaattgtaccgtttgtcagcggccagttaaacaatttggagcttgcagtaaatctcgccaaacgaggaaaccttcctggtgcagagaatttggttgtgcagcgtttccaggagttgtttgctcaaacaaagtataaggaagctgcagagcttgcagctgaatctccgcaaggcattctacgaacacctgacactgttgccaaatttcagagtgttcctgtccaagctgggcaaacaccacctctgttgcagtactttggaacactcttaacccgaggaaagctcaatgcctttgagtcattggaattatcccgccttgttgtgaatcagaataagaaaaatcttttggagaactggttggccgaggataaactggaatgcagtgaggaacttggtgaccttgtgaagactgtggacaatgatcttgcactgaaaatatatataaaagcaagggcaactcctaaggttgttgcagcttttgctgagcgaagggaatttgacaaaatactgatttactcgaagcaggttggctatacacctgattatttgttccttctacaaacaattctgcgttcagatcctcagggagctgttaattttgcccttatgatgtcccaaatggagggaggctgccctcttgactacaacactataactgatctctttcttcagaggaacatgattcgtgaggcaacagcatttttgttggatgttctgaagcccaatttgccagaacatgcataccttcaaactaaggtgcttgagatcaatcttgtcacatttcctaatgtggctgatgctattttagcaaatggaatgtttagccactatgaccgtccacgtattgctcagctttgtgagaaagctggtctctatatgcgagctcttcagcattactctgaactgcccgatattaagcgcgtcattgtgaacactcatgcaattgagccacagagtcttgtagaattttttggtactctttcacgagaatgggcattggaatgcatgaaggatcttctactcgtcaacctgaggggcaaccttcagatcattgttcaagttgctaaagaatattgtgagcagttgggggttgatgcttgtatcaagctttttgaacagttcaaatcctatgaaggattgtacttctttttgggctcgtatctgagctcaagcgaggaccccgatatacatttcaagtacattgaagctgctgcgaagactggacaaattaaggaggttgagcgtgtgacaagggagtcaaatttctatgacgctgaaaagacgaagaacttcttgatggaagccaagcttccagatgctagaccattgatcaacgtgtgcgatcggtttggctttgtcccagatttgactcactacttgtacacaaacaacatgctccgttatattgaaggatatgtccagaaggtgaatcctggaaatgctcctttagttgtgggtcagctactagatgatgaatgccctgaagattttatcaaaggactgatactttctgtgcgatctctgcttccagtcgagccccttgtggaagagtgtgagaaaaggaaccgacttcgcttgttaactcaatttttggagcatcttgtgagtgaaggaagccaagatgtacatgttcacaatgctttggggaaaatcataatagacagtaataacaaccctgagcacttcctcactaccaacccgtattatgattcacgtgttgttggtaaatattgtgagaagcgcgatcctacacttgctgttgtggcctaccgcagaggtcaatgtgatgatgaacttatcaatgttacaaataagaattctttatttaagctgcaggccaggtatgtagttgagagaatggatgctgatctttgggagaaggttctgaaccctgaaaatgagttcagacgtcagcttattgatcaagttgtatctactgctcttccagaaagcaagagtcctgaacaagtttctgcagctgttaaagcctttatgactgctgatcttcctcatgaacttattgaacttcttgaaaaaattgtgcttcaaaactctgcattcagtgggaacttcaatttgcagaacttactgatcttgactgctattaaagcagacccttctagagttatggactacataaataggttggataactttgatggacctgcagttggtgaagtagctgtggaagctcaattatatgaagaagcttttgcaattttcaagaagtttaatttgaatgtccaagctgtcaatgtattattggataatattcgtgacatcaaccgtgcagtggagtttgcattccgtgttgaagaagaggccgtgtggagtcaggttgctaaagctcaattgagggagggattagtgagtgatgcaattgagtcctttatccgtgcagatgacgccactcaattcttggaggtcatacgagctgctgaggatgctgaggtgtaccatgacctggtgaagtaccttctgatggttaggcagaaggcaaaggagcccaaggttgacagtgagattatttatgcatatgctaaaattgacagactgggtgacattgaggaatttattctcatgccaaatgttgctaatcttcctaatgtgggtgaccgcttgtatgatgaggctttgtatgaggctgcaaaaattatttttgcttttatttctaactgggccaagctggctagcacattagtcaagttgaagcaatttcaaggtgctgttgatgctgcaaggaaggcaaacagttcaaagacatggaaagaagtatgctttgcctgtgttgatgctgaggagttccgcttggctcaaatttgtgggcttaacattattgtacaggtggatgacttggaggaagtcagtgaatattatcagaacaggggatgcttcaatgaactaatttctctcatggaaagcggtttagggttggaacgtgcacatatgggcatatttacagaactgggtgtgctttatgcaagataccgccatgagaagctcatggagcatatcaagttattttctacccggcttaacattcccaagctcatccgagcttgtgatgagcagcagcactggcaagagctcacatatctgtatattcaatacgatgaattcgacaatgctgccactacagtcatgaatcattccccagatgcttgggatcatatgcagttcaaagatattattgtcaaagttgctaatgttgagctttactacaaggctgtacacttctatttgcaagagcaccctgatctcattaatgatcttctcaatgtccttgcacttcgtgttgaccatagccgtgttgtggacataatgaggaaggctggccatcttcgtctcgtgaaaccatacatggtcgcagttcagagcaacaatgtttctgctgtgaacgaggctctgaatgagatctatgtggaggaagaagactatgacaggttacgggaatcaattgatttgcatgataacttcgatcagattggccttgcacagaagattgagaaacatgagcttctcgagatgaggcgtgttgctgcatatatttacaagaaggcaggtaggtggaagcaatccattgcgctgtcgaagaaagacaatctttacaaagatgcaatggagacagcctcacagtctggggatcgtgaacttgctgaggaattgcttgtctattttatcgaacaaggaaagaaggaatgttttgcgtcatgcctctttgtttgttacgatttgattcgtgctgatgttgctcttgagcttgcttggatgaacaacatgatcgattttgccttcccatatctgttgcagttcatccgtgaatacactggcaaagttgatgaattaatcaaggacaaaattgaggctgtgaatgaagtgaaggccaaggagaatgaagagaaggacattattaagcagcagaatatgtatgctcaattgctgcctcttgctctgcctgcaccaccaatgccaggtatgggaggcggttttgctccacctcaacctacacccatgagtggaatgggaatgccaccaatgccaccatttggcatgccacctatgggctcttattgatgatctgggcaagtatatctgtagaaatccggagtgcacacggttgcttggggtggaaatggaaaccggagcattattggctctccaaagttaatgttccttggttcaaactgatttttatatgattttgtgtaagctgtcgaggggtctctcaatgcaggtttagagtaaagaataatatttgcagtgttgttt

SEQ ID NO: 5156 - DNA, 5819 bp, Gossypium raimondii
ggccagtatcaacgcaacgagtaaggcacattttttacacgttctgcttctcaagtgccttagattggatcgctcttcttcttcttcttcgtctttcgcttccctctttgcaactgttttaattatctgcttcagatctcttagcaaatattcaatctcagccatagatctgcccctgatttttgaatcttcatccgtcgatctgaatcaccatggcggccgcaaacgctcccatcgccatgaaggaggtcttaactttgccaagcattggcattagtcctcaatttatcacattcacgaacgtaactatggaatctgataagtatatttgtgtgagagaaaccgcgccgcaaaacagtgttgtgattatcgatatgaacatgccgatgcagccgttgagacggcctattactgcggactccgctcttgtgaatccgaattctagaatccttgctttgaaagctcaactaccgggaacaactcaagatcatttgcaaatatttaacatagagatgaaagcaaaaatgaaatcccatcagatgcctgaacaggttgtattttggaaatggattagcccaaaattgcttggcctggtaacactgacctctgtgtatcattggtcaattgaaggtgattctgaaccagttaagatgtttgagagaacagctaatttagtgaacaatcagatcataaactataagtgtgatccttcggagaagtggttggttttgatcggaattgcccccggtgcacctgagaagccacaattggttaaggggaacatgcaacttttctctgttgatcagcagcgtagtcaagctcttgaagcacatgctgcttcattcgctcagtttaaggttccaggaaatgagaatccttctattcttatttcatttgccactaagagttttaatgccggtcagattacatcaaagttgcatgtaattgagcttggtgcccagccaggtaagccgtcgttttcaaagaaacaagcagatctattcttcccgccagattttcaagatgattttccagttgcaatgcagatatcccacaaatatggtttgatctttgttattaccaagcttgggctgctgtttgtttatgatttagagacagcatctgctgtatacagaaacaggatcagtccagatccaatatttttaacatctgaagcttcagctgctggagggttttatgccataaataggcgaggtcaggtgttgttggcaactgtaaatgaagcaacaatagtgccatttgttagcggtcaattgaacaatttggagcttgccgtcaatctggctaaaagaggaaaccttccgggtgcagagaacttggttgtccaacgttttcaagaattgtttgctcagacaaagtataaagaagctgctgagcttgctgcagagtctccacaagggatacttcgcacacctgatacagttgccaagtttcagagtgtccctgtgcaagctgggcagactccgccgctgttgcagtactttggtacccttttaacaagaggaaaactcaatgcatttgagtcattggaattatctcggcttgtggttaaccaaaacaagaagaaccttctggagaattggttggctgaagataaattggaatgtagtgaggaacttggagaccttgtgaagactgtggataatgatcttgcgctgaaaatatatattaaagctagggcaactccgaaagttgttgcagcttttgctgaacgtagggagtttgacaagatcttgatttactcaaagcaggttgggtacactcctgactatttgttccttctgcaaacaattctccgtacagatccacagggagctgtcaactttgcattgatgatgtctcaaatggagggaggttgtccagttgattacaacaccatcactgatctttttcttcagaggaatttgatacgggaggctactgcatttctattagatgttttgaagccaaatctgccagagcatgcttttctacaaactaaggtcttggaaatcaatctagtaacttttccaaatgtagctgatgccatcttagcaaatggaatgttcactcactacgatcgtccccgaattgcacaactatgtgaaaaagctggtctctttgtgcgagctcttcagcattacactgagttgcccgatattaaacgtgtcatcgtgaatacacatgctatagagccacagtcacttgttgaattttttggaacactttcacgagaatgggctttggagtgcatgaaggaccttttgttggttaatctaagaggcaatcttcaaataatcgttcaggttgccaaagagtactgtgagcagttgggtgttgatgcttgcataaaactttttgagcaatttaagtcatatgaaggattgtactttttcctgggctcctatttgagctcaagtgaggatcctgatatacacttcaagtacattgaggcagctgctaaaactggtcaaatcaaggaggttgagcgtgtaaccagggaatcaaatttttatgatgctgagaagacaaagaacttcctaatggaggccaagcttcctgatgcaaggcccctaattaatgtttgtgatcgatttgggtttgttcctgatctcactcactacctctacacaaataacatgctccggtacattgaagggtatgttcagaaggtgaacccagggaatgctcctttggtagtggggcaattgctagatgatgaatgcgctgaagattttataaagggtctcattctctcagtccgttctctgcttccagttgagccccttgtggaggaatgtgagaaaagaaatcgccttcgtttgcttacacagtttttggagcatcttgtgagtgagggaagccaagatgtgcatgttcacaatgctctgggaaaaatcatcattgacagcaataacaatccagagcacttcctcacaaccaatccttactatgattctagggtggttggtaagtactgtgagaagcgtgatcccactctggcagttgtggcttacagaagaggacaatgtgatgatgaacttatcaatgtcactaataagaactcattattcaaattgcaggctaggtatgttgttgagagaatggatggtgatctttgggagaaggttctaaatcctgaaaatgaatatagaagacagctaattgatcaggttgtgtcaactgctttgccagaaagcaagagtccagaacaagtttctgcaactgttaaagctttcatgacagctgacctgccccatgaactgattgagcttcttgagaagattgtgctccaaaactctgcattcagtgggaacttcaatctgcaaaatctacttattttgacagctattaaggcagatccatctagagtcatggattatatcaataggctagataattttgatggacctgcagttggagaagtggctgtggaagcccaactatatgaagaagcttttgcgattttcaaaaagttcaacttaaatgttcaggctgtcaatgttttattggataacattagaagcattgatcgggcagtggaatttgcatttagagtcgaagaagatgctgtttggagtcaggtggcaaaggcacaactgagggaggggctggttagtgatgcaattgaatcgtttattcgtgctgatgatgctactcagttccttgatgttatcagagcttctgaggatgcagatgtctactctgatctggtgaggtatcttctgatggttaggcagaaggtcaaggagcccaaggtggacagtgaactcatttacgcctatgctaagactgatagactgggagaaattgaagaattcattctcatgccaaacgttgctaatcttcaaaatgttggtgatcgcttgtttgatgaagccctatatgaggccgcaaaaataatatttgcttttatatcgaactgggccaagttggctgttacactggtgaggcttaaacaattccagggtgctgttgatgcagcacgaaaagcaaacagtgccaagacatggaaagaggtttgctttgcttgtgttgatgcagaggaattccgattggcacagatatgtggtctgaacgttattatacaggtggatgacttggaagaagtcagtgaatactatcagaatagaggatgcttcaatgagttaatctctctcatggagagtggtttaggattggaacgtgcacacatggggatctttactgagttgggagttctgtatgccagatatcgtgcagagaagcttatggagcacattaagttgttctctactcgtctcaatattcccaagctgataagagcatgtgatgagcagcagcactggaaggaacttacctacttatatatccaatatgatgagtttgataatgctgcaactactgtgatgaaccactctcctgaggcatgggatcatatgcagttcaaagatatcatagtcaaagttgctagtgttgagctatattacaaggctgtccacttttacttgcaagagcatcctgatctcatcaatgatatgctgaatgtgcttgcgcttcgtgtggatcatactcgtgttgttgacattatgagaaaggccggtcatctgcgtctggtgaagccatatatggttgctgttcagagcaacaatgtatcagcagtaaatgaagcgttgaatgagatttatgtagaggaagaagattatgatagattgagagaatctattgacttgcatgataactttgatcagattggccttgctcaaaagattgagaaacatgagctgcttgagatgagacgtgttgctgcatacatatacaaaaaggcgggcagatggaagcagtccattgccttgtcaaagaaagacaacctttacaaagatgctatggaaactgcttcacagtctggtgatcgtgaacttgctgaggagttgcttgtttacttcattgagcagggcaagaaggaatgttttgcggcatgcctctttgtctgttatgacttaattcgaccagatgttgctcttgaaatggcctgggttaacaatatgatagacttcacattcccgttcctgttgcagtttatccgtgaatataccggcaaagttgatgaacttatcaaggataagatcgaggctcaaaaggacgtaaaggctaaagagcaagaagagaaggaggtcattgcacaacagaacatgtatgcgcagttgctacctcttgccttgccagcacctccgatgccaggaatgggaggaggttttgctcctccaccacctatggggggaggaatgggaatgcctccgatgccaccatacggtatgccacaaatgggcagctattaagtcctaaccaagtctgttttgtcaaaaaggttttattagcagcagggaatcccatggtgcattgaggttaaaaggctgacgtagttctattagtggcaaattttcacgcttcgacgctttcattttatttttcttgtccgtctctggtagggtgtgtgatatgtcttgtaatattcattttttttttatgtagcaagaggcatttttttggctgctgatagggggcaagccgaggatttaatgcatatttgtaattttccttcttgtagtattattttcttccggtctttggaagcgacttacgagtatatacgagcacacttgcacattacgcctgtcattatttcgaaatttgatatttttcggtaactcagtttacccccttacacctaaaatattcggtccctttttctttttaaattttttctatgtacttctttttacaacagtatatatattaacaaagtttatgttttgagttaatcaaatattaattcagta

SEQ ID NO: 5157 - DNA, 5762 bp, Papaver somniferum
tgctcctatcaccatgaaggaggccttgactttaccgtcaattggcattactccacaattcattacgtttactcatgtcactatggaatcggataagtacatatgtgtaagggagacatcaccgcagaatagtgttgttattattgatatgagcatgcctaatcaaccattaagaaggcctatcaccgcggactcggctttgatgaatcctaattccagaattcttgctttgaaagctcaacttccgggaaccactcaggatcatctacaaatattcaacattgaaatgaaagcgaaaatgaagtcccatcaaatgcctgaacaggttgtcttttggaagtggatttccccaaaaatgttaggcctggtcactcaaacctcggtatatcattggtcaattgaaggtgaatcagatcctgtaaagatgtttgatagaacagccaatttagcaagtaatcaaataatcaactacagatgtgatccttctgagaaatggttggttttgattggaattgcacccggttcacctgagaggccgcaacttgtcaaaggaaacatgcagcttttctctgtggaacagcaacgaagtcagtcgcttgaagctcatgctgcatcttttgcttcacataagattccagggaatgaaaacccttctactctcatctgttttgccacgaagaccaccaatgctgggcaaattacgtcaaaattgcatgtgattgagcttggtgcccagccaggcaaaccagctttttcaaagaaacaagcagatcttttctttcctccagatttcgctgatgactttccggtgtcaatgcagatatcacataagtacagcttgatctatgtgattacaaagcttgggcttttatttgtgtatgatctcgagacagctacagcagtttacaggaaccgaattagtccagatcctatatttttgacggcggaagcttcatctgtaggaggcttttatgctgtgaatcggcgtggacaagttctgcttgctactgttaatgaggcaactattgtgccttttgtcagcggccagttaaacaatcttgaacttgctgtaaatcttgccaaaaggggaaaccttcctggggcagaaaacttggttgtccagcgcttccaagaattgttctctcagacaaaatacaaggaggctgcagagcttgctgcagaatccccacagggtatcctgcgtactccagacactgttgccaaatttcagagcgttcctgttcaagctgggcaaactcccccacttctgcagtacttcgggacattgttaaccagaggaaagctcaatgcatttgaatcactggagttatcacgacttgttgtgaatcagaacaaaaagaatcttttggagaattggttggctgaggataaacttgaatgcagtgaggaacttggagaccttgtgaagactgtggataatgaccttgcactgaagatatacatcaaggctagagctactcctaaagttgttgcggcctttgctgaacgaagggaatttgataaaattctcatctactcgaagcaggttggatacacacctgattatctattcctcctgcaaacaattctgcgatcagatccccagggagctgtcaattttgctttgatgatgtctcaaatggaaggtggatgtccagttgattataacacaatcaccgatcttttcctacagcggaacctgattcgtgaggcaacagcctttctattggatgttctgaagccgaatttgccagagcatggttttctgcagacaaaggtcctggagatcaatctagttacttttccaaatgtagcggatgcgatcttggccaatggcatgttcagtcactacgaccgtcctcgcgttgctcagctttgtgaaaaagctggactgtatgtccgtgctctccagcattatgcagagttgcctgacatcaaacgagttattgtgaatacacatgcgattgagccacagtcacttgtagagttctttgggactctttccaaggaatgggctctggagtgcatgaaggaccttttacttgttaatctgagaggaaatcttcagataattgtgcagactgccaaggaatattcagagcagttgggtgttgaggcgtgcataaaactctttgagcaattcaagtcttatgaaggtttatacttcttcttgggatcgtacttgagttccagtgaggatcctgaaattcacttcaagtacattgaagctgctgctaagactggacaaattaaggaggttgaacgtgtgacaagagaatcaaacttctatgatgctgagaagaccaaaaatttccttatggaggccaaacttccagatgcacgtccattaattaatgtctgtgatcgttttggttacgttcctgacctcacccactacctctacactaacaacatgctgcggtacatcgagggttatgtacaaaaggtcaatccagggaatgctcctctagttgtagggcagcttttggatgatgaatgccctgaagatttcatcaaaggacttattctttctgttcgttcacttctcccagtggagccccttgtggatgaatgtgagaagaggaatcgtcttcgcttactgacccagttcctggagcatcttgtaagtgaagggagtcaagatgtgcatgttcataatgccctgggtaaaattatcattgatagcaacaacaatcctgagcatttcctcaccaccaatccatactatgattcacgcgtagttggtaaatattgtgaaaaaagggacccaaccttggcagttgttgcttaccgtagaggacagtgtgacagtgaacttatcaatgtcacaaacaagaattccttgttcaaattgcaagccaggtatgtggtggagaggatggattcagacctctgggatttggttcttaaccctgaaaatgagtatagaagacagctaattgatcaagtagtttccactgccttgcctgaaagcaagagcccagagcaagtttctgcagcagtcaaagctttcatgacagctgatcttccgcacgagctaattgagctgcttgaaaagatcgtacttcaaaactctgctttcagtggaaactttaatctgcaaaatcttttgattctgacagccattaaagcagatgcgtctagagttatggattacatcaataggctggacaatttcgatggacctgctgttggggaggtggctgtggaagctcaactgtttgaagaagcatttgccattttcaagaagttcaacttgaatgtccaggctgtgaacgttcttttggataatattcaaagcattgaacgagcggaggagtttgcattccgtgttgaagaagatgctgtttggagtcaggtggccaaggcgcagctcagggagggtttagtgagcgaggctattgagtcattcatccgtgctgatgatgccactcatttcttagatgttattaaggcttccgaggatgcaaatgtgtatcatgatctagtgaagtacctcttgatggttagacaaaagtccaaggagcctaaggtggacagtgagcttatttatgcatatgctaagattgataggttgggtgatattgaagagtttattctaatgccgaatgttgctaatctccaaagtgttggtgatcggttatacgatgaagaactctatgaggctgccaagatcatatttgctttcatttccaactgggccaagctggcagtttgtcttgttaagcttagacagttccaaggtgctgttgatgcagctcgtaaggccaacagtgcaaagacatggaaggaaatttgctttgcctgtgttgatgccgaggaattccgtttggctcagatatgtgggctcaacatcatcatacaggtggatgacttggaggaggtcagtcaattctatcagaacagaggctgtttcaacgaattaatttctctaatggagagcggtctgggtttggagcgtgcacatatgggtatctttaccgagttaggagtcctatatgccaggtatcgtccagagaagctcatggaacatatcaagctgttctcaacccgtctcaatattcccaagcttattagagcatgcgatgagcaacaacactggaaggaattagtatatttatacatacagtatgatgaattcgacaatgctgcaaccaccatcatgaatcattctccagaagcatgggatcacatgcaatttaaagatgtggcagttaaagttgcaaatgtggaactatactacaaggcggtccacttttacttgcaagaacaccctgatcttattaatgatatgctcaatgtgctcgctcttcgtgtggaccatactcgtgttgtagacataatgcgcaaggctggtcacctgctccttgtgaaaccatacatggttgccgttcagagcaacaatgtctctgctgtgaatgaggcgttgaatcaaatctacgtcgaggaggaagactatgataggctgcgcgaatcaattgacatgcatgataattttgatcagataggccttgcacaaaaggttgagaaacacgagcttcttgaaatgagaagaatagctgcctatatttacaagaaagcaggtaggtggaggcagtccattgcattgtcaaagaaggacaacctttacaaagatgccatggagacatgttctcaatctggttatcgtgagctttcagaggagttgctcgtgtatttcattgaacagggtaaaaaggagtgctttgcatcatgcctctttgtttgttatgatttaatccggcctgatgttgcccttgagcttgcctggatgaacaatatgatcgattttgccttcccgtacctattgcaatttatccgtgagtacactggtaaagttgatgagctggttaaggatagaattgcggcccaaagtgaagttaaggtcaaagagcaggaggagaaagatatggtagcacaacagaacatgtatgctcaattgctaccacttgcattgcctgcaccaccaatgcccggtatgggaggtggcggggggatgggaggaggttatggtcctccaccccccatgggaggtatgggaatgcctccgatgccagcatatggaatgcccccgatgggttaccaatgatccaagttaaagcaagaaaattatattgaacggtggtcatttgtaaacaccagcagacagagcatcggagaagtctgtggcatcaggttgatgggatgaaggatgtgtaattctaatttaggggatgtgaagggagtcagagaaataagatataatgatccatattctttgttttttctatccggcatatagatgttattagtttgcaaaagatattcttttggtagcagagaaagggggcatatgtattttcttttcttacctctattggaaggctgagctgactgtcctgtcttatcatctcttagtttattgtattccgagaatcatcgggagttctgatgctagcaaaagaaggaaggaaaagatcgtggagtggtggcgtacttgtgttgtatcatctcttaacttcacagatgattgcagtttgtggtttatcggctgaagctgcttcatgtataggtggtttaatccttcttgttgagcagcaggatttggcactccagtattttgtactttttagatgtgtatgtgattgtttttattctgttggctgtgtttttttcgtgttcattctcacatgtcataaaaacttagattactcttcggaatattattaatgatgaatccagtctgcggatggaaccatgagtca

SEQ ID NO: 5158 - DNA, 5486 bp, Prunus persica
ccgtcgatctgcgcaaccatggcggccgcgaacgctccgatcaccatgaaggaagccctaacgcttccgagcgttgggattaatccacaattcataacattcacacatgttactatggaatccgataagtacatatgtgttcgggagacttcgccgcagaatagtattgttattattgatatgagtatgccgatgcaacctttgaggaggccaatcactgcggactctgcacttatgaatccaaattccaaaatccttgcattgaaagcccaagtccaaggtactactcaggatcaccttcaaatatttaacattgagatgaaagcaaaattgaaatcacatcttatgcctgaacagattgttttttggaagtggataaccccaaagatgttgggtttagtcactcagactacagtgtatcactggtcaattgaaggggagtcggaacctgttaaggtgtttgagcgaacagctaatctggcaaacaatcagataataaattaccgttgtgatccttctgagaagtggttggttttggttggaattgctcctggtgctccggagaggccacaattggttaaaggaaatttgcaactcttctctgtggatcagcagcgcagtcaagctcttgaagcacatgctgcatcatttgctcaatacaaggttccagggaatgagaatccctcgactcttatttcttttgccactaagaccctgaatgctggacagattacatcaaagttacatgttattgagctcggtgcccagccagggaagccatcttttacgaagaaacaagcagatctgttctttcctccagattttgctgatgatttcccagttgccatgcagatgtctcacaagtacagcttgatttatgtaattacaaagcttgggctactgtttgtgtatgatttagagacagctagtgcagtttacagaaatagaattagtccggatccaatcttcttgacaacagaggcttcatcagttggagggttttacgcggttaataggcggggccaggtgttgttggctacaattaatgaacaaactattgtgccttttgtcagtggtcagttaaacaatttggagcttgctgtcaatctggccaaaagaggaaatcttcctggtgccgaaaatcttgttgtccagcgtttccaagaactgtttgcccaaactaagtacaaagaagctgctgaacttgctgctgagtccccacaaggaattctccgtacgcctgatacagttgctaaatttcagagtgttcctgtccaaactgggcaaaccccacctctgttgcagtactttgggaccctcttgacacgagggaagctcaatgcgttcgagtcattggaattatcacgtcttgtagtgaaccagaacaaaaagaatcttttggagaactggctggcagaggacaaactcgaatgcagtgaggaactgggagatcttgtgaagactgtggataatgatcttgctttgaaaatatatattaaagccagagcaactccaaaagttgttgcagcttttgccgagcgaagggaatttgacaagatactgatctactcaaagcaggttggctacacgcctgactatctgttccttttgcaaacaattcttcgagcagatccgcagggtgctgttaattttgcattgatgatgtctcaaatggaaggtggttgtccagttgattacaacaccataactgatctcttccttcagaggaacctgattcgtgaggcgactgcctttttattggatgttctgaagccaaatcttccagaacatgctttcctgcaaaccaaggtccttgagatcaatttagtgacttttccaaatgtggctgatgctattttagccaatggaatgttcagtcattatgatcgccctcgaattgcccagctatgtgaaaaagctggtctttatgtgcgagctctgcaacattactcagagttgcctgatattaaacgtgttatagtgaatacacatgcaatagagccacagtcacttgtagagtttttcggcactctttcacgagaatgggcattggagtgtatgaaagatcttttgttggtcaatttaagaggcaaccttcagataattgtacaggtcgctaaggaatactctgagcagttgggtgttgatcaatgcatgaagctttttgaacagttcaagtcatatgaagggttgtacttcttccttgggtcgtttctgagctcaagtgaggatcctgatatccacttcaagtacattgaggcagctgctaaaaccggacaaatcaaagaggtggagcgagttactagagaatcaaacttctatgacgccgagaaaacaaagaacttcttaatggaagctaagctcccagatgcacgaccgctcattaatgtttgtgatcgttttggatttgttccagatctgacccactacttgtacacgaacaacatgcttcgttacattgaaggttatgttcaaaaggtgaatcctgggaatgctcctttagttgtgggacagttgcttgatgatgagtgtcctgaagattttatcaaaggcttgattctttctgtccgttcattgcttcctgtggagccccttgtggaggaatgcgagaagaggaatcgacttcgtttgctcactcagttcttggagcatcttgtgagtgagggaagccaagatgtacatgttcacaatgctttgggtaaaatcatcattgatagcggcaataatccagagcacttccttaccacaaacccatattatgattcacgtgttgttggtaaatattgtgagaaacgtgaccctacccttgctgttgttgcttaccgccgtggacaatgtgatgatgaacttattaatgtcacaaataaaaactctttgttcaaattgcaagcaagatatgtggttgagagaatggatgaagatctttggggaaaagttcttgaccctgagaatgagtacagaagacaacttattgatcaagttgtttctactgccttgcctgagagcaagagcccagaacaagtttctgcggctgttaaggctttcatgactgctgatttgccccacgaattaattgaacttcttgaaaagattgtgcttcaaaactctgccttcagtggcaacttcaatctgcaaaacttgctaattttgacagccatcaaggcagatccgtctagagttatggattatattaataggctagataattttgatggacctgcagttggggaagtagctgtggaagcccagctgtatgaggaagcatttgcaattttcaagaagtttaacttgaatgttcaagctgttaacgtcttgctggataacatcagaagcattgatagggctgtggagtttgcattccgtgttgaagaagatgccgtttggagccaggttgcaaaggctcaactccgggaggggctggtcagcgatgcgattgagtcattcattcgtgcggatgatgccacccaattcttggatgttattcgtgcttctgaggatgcagatgtctaccatgacttggtgaggtaccttctgatggttaggcagaaggcgagagagcccaaggtggacagcgagctcatttatgcatacgcaaagattgataggcttgctgacattgaagagtttattcttatgcctaatgttgctaatctccaaaatgttggtgatcgcctatatgacgaggccctctacgaggctgcaaaaataatatttgcttttatatctaactgggccaagttggcaataacactagtgaagctcaaacaattccaaggtgctgttgatgcagcacgaaaagccaacagtgcaaagacatggaaggaggtttgctttgcttgtgttgatgctgaggagttccgcttagctcagatttgtggcctcaacattattattcaggtggatgatttggaagaggtcagtgaatactatcagaatagaggatgcttcaacgagctaatatctctaatggagagtggtctagggttagaacgtgctcacatgggaatttttaccgagttgggggttctatatgctagatatcgtccggagaaacttatggagcacatcaaattgtttgcaaatcgtctaaatattcccaagcttatacgagcttgtgatgagcagcaacattggaaggagcttacctatctctatattcaatatgatgagtttgataatgctgcaactaccatcatgaatcattcccctgaagcctgggatcacatgcagttcaaagatgtggcagttaaagttgctaatgtggagctatattataaggctgtgcacttctacttgcaagagcatccagatctcattaacgatcttctaaatgtgctcgcacttcgtgtagatcatacacgtgtggttgacattatgcggaaggctggtcacctgcttcttgtgaagccatacatggttgcagttcagagcaacaatgtctctgctgttaatgaggctttgaatgcgatatatgttgaggaggaagattatgaaagattgcgtgaatcaattgatttgcatgatagctttgaccaaataggccttgctcaaaagattgagaaacacgagcttctggaaatgagacgtgttgctgcttacatttacaagaaagcaggaaggtggaagcagtccattggattgtcaaagaaagacaaactttacaaagatgccatggagacagcctcacagtctggtgaccgtgaacttgcagaggagttgcttgtttatttcattgaacagggaaagaaagaatgctttgcatcatgcctgtttgtctgttacgatttgataagggcagatgttgtccttgaacttgcttggatgaacaacatgattgactttgctttcccatatctgctacagtttatccgtgaatacactggcaaagttgatgaactagtgaaggacaaacttgaagctcagaaagaggtgaaggctaaagagcaggaagagaaagaagttattgcacagcagaacatgtacgctcagttgctgcctcttgctttgcctgcaccaccaatgcctggtatgggaggggggtttgctcctccgccacctatgggaggaatgccaccaatgggcatgccaccttttggcatgccaccaatgggcagtagctattgagatgaactattcttgtggaactggatcttgaatttggtgttttagtcagtagggcaacctattcgatagaacgttccaattagtgtaattttatgaaggcttacatgccgtcatttcctttttattttacttttctaatttgtttttgatgggttgaaagggtgcagcttaaataattgtgtcataggttgtgtggatatgtcgtcttgtaatattcttttgtagcagaggcattttttctttttggctgttggttgagggcgagcttagaattttctcctctgtattattgttctcgtttttcaaacttgcctgagtataatacaaaacagtacattgataattttgaagtgctttattta

SEQ ID NO: 5159 - DNA, 5691 bp, Glycine max
tctctctcgcttttctctttagagggtccaacttgcttccagatctcgcaccgatttggatcactcttttgactcttcttcttccaattcattcgccgccgcagatctcactctccgatccaagccgtcatggcggctgccaacgctccgatcgccatgagagaagctctcaccttgccaagcattggcataaatccgcagttcatcactttcacgcatgtgacgatggagtccgataagtatatatgcgttcgagaaacggctccgcagaatagtgtggttatcattgatatgaacatgccgaatcagcctttgaggaggcctattacggcagattccgctcttatgaatccaaattccagaatccttgctttgaaagctcaactccaaggaacaactcaagatcacctacaaatttttaacattgaaatgaaagcaaagatgaaatcttatcagatgcccgagcaggtggtcttttggaagtggattacccccaagttgttgggtcttgtaacacagacctctgtataccattggtcaattgaaggtgactctgaacctgtaaagatgtttgagagaacagcaaatttggcaaacaatcaaataattaattatagatgtgatccttctgagaaatggttggtcttgattggtattgctccaggttcccctgagaggccacaattggttaaaggaaacatgcaactcttctctgtggatcaacagcggagccaggctcttgaagcacatgcggcatcatttgctcaattcaaagttcctgggaatgaaaatccttctactttgatttcttttgccactaaaacacttaatgctggccaaattatatccaagttgcatgttattgagctgggtgcacaaccagggaagccatcatttacaaagaaacaagcagatcttttctttcccccagattttgctgatgattttccagttgccatgcagatatcccacaaatacagtttgatttatgtgataacgaaacttggtctcctatttgtctacgatttggagacagctacagctgtatataggaacagaattagtccagatcctatatttttgacatcagaagctacatctgttggaggcttttatgccattaataggagaggccaggtgttgttggctactgttaatgagcaaacgatcgtgaattttgtcagtggtcagttaaacaatttggagctagcagttaatcttgccaagcgaggaaatcttcctggtgctgagaaactggtggtagaacgtttccatgaactgtttgcccaaacaaagtataaagaagcagctgaacttgctgctgagtctccgcaaggaatccttcgcacacctgatacagttgccaaatttcagagtgttcctgtgcaagctgggcaaactcctccactattgcagtattttggaacacttctaacaagaggaaagctgaatgcctttgagtcattggaattgtcaaggctggttgtgaaccagaacaagaaaaatcttttggagaattggttggcggaggataagcttgaatgcagtgaggagctaggagatcttgtaaagactgtggacaatgatcttgctttaaaaatatacatcaaagccagagctactccaaaagttgttgctgcttttgctgagagaagggagtttgacaagattctaatatactctaagcaggttgggtacacacctgactatctcttccttttgcaaacaattctccggacagatcctcagggtgctgttaattttgcattaatgatgtcgcaaatggagggaggttgcccagttgattacaacaccataactgatctgtttcttcagagaaatctgatccgtgaggcaacagcctttctgctagatgttctgaaaccaaatctaccagaacatgggtaccttcaaacaaaggtgttggagataaatctggttactttcccaaatgttgctgatgcaattttggctaatggaatgttcagccattatgaccgtcctcgtattgctcaactttgtgaaaaagctggtctttatgtgcgagctttgcaacattacacagagttgccagatataaaacgtgtgattgtaaatacacatgcaattgagccacagtcactcgttgaattttttggtactctgtcaagagaatgggcattagagtgtatgaaagacctattgctggtcaatcttagaggcaacctacagattattgtgcaggttgctaaagaatattgtgaacaattgggcgttgatgcttgcataaagctttttgagcagttcaggtcatatgaagggctgtattttttcctgggatcatatttgagctccagtgaggatcctgacattcacttcaagtacattgaggcagcagcaaagactggacaaatcaaagaggttgagcgtgtgactagagaatcaagtttttatgatcctgagaaaacaaagaactttctaatggaagctaagcttccagatgcacgacctctgattaatgtttgtgaccgatttggatttgttccggatctaacacactatctatacacaaacaacatgcttcgttacattgaaggttatgttcagaaggtgaacccagggaatgctcctttagtcgttgggcagcttttagatgatgaatgtccagaagattttatcaaaggcttgattctctctgttcgttccttactgccagtggagccccttgtggaggagtgtgagaagaggaatcggcttcgtttgcttacacagtttttggaacatcttgtaagtgagggaagccaggatgtacatgttcacaatgcactgggtaaaatcatcattgatagcaacaacaatccggaacattttctcactaccaacccatactatgattctcgggttgtgggcaaatattgtgagaaacgtgatcccaccttggcagttgtagcttataggcggggacaatgtgatgacgagcttatcaatgtgacaaacaaaaattctttgttcaaactgcaagcaagatatgttgttgagaggatggatggtgatctttgggagaaagttcttaaccctgataatgcctacagaaggcaacttattgatcaggttgtatctacagctcttcctgaaagcaagagccctgaacaagtatctgcagctgttaaggctttcatgactgctgatctacctcacgaattgattgagcttcttgagaagattgtgcttcagaattctgcattcagtgggaactttaatcttcagaatctgcttattttaacagcaataaaggctgatccgtccagagttatggattatattaatagactggataattttgatgggccagcagttggagaaatggctgttgaggctcaattatatgaggaagcatttgcaattttcaagaagttcaacttaaatgtccaagcagtcaatgtcttgctagatcatattcatagcattgatagagctgtggagtttgctttccgagttgaagaagatgctgtttggagtcaggtagccaaggctcaactaagggaagggctagtaagtgatgccattgagtcctttatacgagcagacgatgccacacagtttttggatgttatccgtgctgctgaagatggaaatgcttaccatgacttggtgagatacttgttgatggtaaggcataagacaaaagaacccaaggtggacagtgagctcatttacgcgtatgcaaagattgatcggctcagtgacattgaggagttcattcttatgccaaatgtagccaatcttcaaaatgttggtgaccgattatatgatgaagaactatatgaggctgctaaaatcatatttgcttttatatctaactgggccaagttagcagttacacttgtgaagttgaaacaattccaaggtgcagttgatgcagcaaggaaagctaacagtgcaaaaacatggaaggaagtttgctttgcatgtgttgacgcggaggagtttcgtttggcccagatatgtgggcttaatattattattcaggtggatgacttggaagaggtcagtgaatattaccaaaatagaggttgcttcaatgagctaatatcgcttatggagagtggtttaggattagaacgggcacatatgggtatctttacagagttaggagttctgtatgctagatatcgtcatgagaagcttatggagcatatcaaactatttgcgacccgactcaatattccaaaactcataagagcttgtgatgaacaacaacattggaaggagctgacatatttgtacatccaatatgatgagttcgataatgctgcaacaaccatcatgaaccattcacctgaagcatgggatcacatgcaattcaaagatgttgttgtcaaagttgctaatgtagagttgtattacaaggctgttcatttctatttacaagagcatccggatcttatcaatgatgttttgaatgtccttgcacttcgtgttgatcatgcacgtgttgttgacatcatgcgaaaggctggtcatctccgtcttgtcaagccatacatggttgcagttcagagtaacaatgtgtctgctgttaatgaagcccttaatgaaatatatgttgaggaggaagactatgatagattgcgcgagtcgattgatttgcacgataacttcgaccaaataggcctagcacagaagattgaaaagcatgagcttcttgagatgagacgtgttgctgcttatatttacaagaaggcaggtagatggaagcagtccattgccttgtcaaagaaggataacctttacaaagatgccatggagacagcctcgcaatctggtgaccgtgaacttgctgaggagttgcttgtttatttcattgatcagggaaagaaagaatgctttgcctcgtgtctatttgtttgctatgatttgatccgggcagacattgctcttgaattggcctggatgaacaatatgattgactttgccttcccatatctcctgcagtttatccgtgagtacaccggcaaagttgatgaactggtgaaggataaaattgaagcgcagaaccaagtgaaggctaaagaacaagaagagaaggaagtaattgctcaacagaatatgtatgctcagttgttgcctcttgctttgcccgcaccaccaatgcctggaatgggaggaggctttgcgcctccccctccaatgggtggattggggatgcctccaatgcctccttttggaatgccacccatgggcagctactgacatataagttctcggcaatgaactcaagtgtataccgagagcagcgtagcaacttgggagttttcaaacattttcttctggggttttaatgcagtattctttccttgcttctaatggaggaggaggttcagttcaaaataatttcaagtttctgttggggggtttgtgccatatttttgtaatatttttctttatagttgaggcatttttttgggctgcttgcacgagctagccgaggattttctgtatgtaaccaattttcttgtattaaaatgatgggtccaaagtataatacgaaatagacccactttgactcctagcccatgtttgtcatggcctagatttattccactttaccttgtgatggaaactacctgatttaagcttgttggcttcatgttttgtttgttatgtgcatcttttaaatacgtggttattgccacctgattttcaggcttg

SEQ ID NO: 5160 - DNA, 5505 bp, Malus domestica
ccgtcgatctgctccgcagccatggcggccgcgaacgctccgatcaccatgaaggaggccctaacgcttccgagcgttgggattaatccgcaattcataacgtttacacatgttactatggaatccgataagtacatatgcgttcgggagacttcgcctcagaacagtattgttattatcgatatgagtatgccgatgcaacctctgaggaggcctatcactgcggactctgcgcttatgaatccgaattccaaaattcttgccttgaaagctggagtccaaggtactactcaggatcaccttcaaatatttaacatcgagatgaaagcaaaactgaaatcacatcttatgccggagcagattgttttctggaagtggataaccccaaagatgttaggtttagtcactcagactacagtataccactggtcaattgaaggtgaatctgaacctgtaaaggtgtttgagcgaacagctaatctggctaacaatcagattataaattaccgctgtgatccttccgagaagtggttggttttgattggaattgctcctggtgcaccagagaggccacaattggtgaaaggaaatttgcaactcttctctgtggatcagcagcgcagtcaagctcttgaagcacatgctgcatcatttgcccaatacaaggttccagggaatgagaatccttcaactcttatttcttttgccactaagaccctcaatgctggacagattacatcaaagttgcatgttattgagctcggtgcccagccagggaaaccatcttttacgaagaaacaagcagatcttttctttcctccagattttaatgatgatttcccagtcgccatgcagatgtctcacaagtacagcttgatttatgtaattacaaagcttgggctactatttgtgtatgatttagagacagctagtgccgtttacagaaatagaattagtccggatccaattttcttgacaacggaggcttcatctgttggagggttttatgcggttaataggcggggccaggtgttgttggctacaattaatgagcaaacaattgtgccttttgtcagcggccagctaaacaatttggagcttgctgtcaatctggctaaaagaggaaatcttccaggtgctgagaatctggttgtccagcgttttcaagaactgtttgcccaaacaaagtacaaagaagctgctgagcttgctgcggagtccccacaaggaattctccgcacacctgatactgttgctaaatttcagagtgttcctgtccaagctgggcaaacaccacctttgttgcagtactttgggacactcttgacaagagggaagctcaatgcatttgaatcattggaattgtcacgtcttgtagtgaaccagaataagaagaaccttttggagaactggttggccgaggacaaactcgaatgcagtgaggaactgggagatcttgtgaagactgtggataatgatctggctttgaaaatatatattaaagccagagcaactcccaaagttgttgcagcttttgctgagcgaagggagtttgacaaaatactgatctactcaaagcaggttggctacacacctgactatctgttccttttgcaaacaattcttcgagcagatcctcagggtgctgttaattttgcattaatgatgtctcaaatggaaggtggttgtccagttgattacaacactataacagatctcttccttcagaggaaccttattcgtgaggcaaccgcctttctattggatgttttaaagccaaatcttccagagcatgcattcctgcaaacaaaggtccttgaaatcaatttagtgacctttcctaatgtggctgatgctattttagccaatggaatgttcagtcattatgaccgtcctcgtattgcccagctatgcgaaaaagctggtctttatgtgcgagctttgcaacattactcagagttgcctgatattaaacgtgtcatagtgaatacacatgcaatagagccacagtcacttgtggagttttttggcactctgtcgaaagaatgggcattggagtgcatgaaagatcttttattggtcaacttaagaggaaaccttcagatcattgtgcaggttgctaaggaatattctgagcagttgggtgttgatcaatgcatgaagctctttgaacagttcaagtcatatgaagggttgtacttcttccttggttcgtttttgagctcaagtgaggatcctgatatccacttcaagtacattgaggcagctgctaaaactggacaaatcaaggaggtggagcgagttacaagagaatcaaacttctatgatgctgagaagacaaagaacttcttaatggaagctaagctccccgatgcgcgtccattaattaatgtttgcgatcgttttggatttgttccagatctcacccactacttgtacacgaacaatatgcttcgttacattgaaggttacgttcaaaaggtgaaccctgggaatgctccattagttgtgggacagttgttagatgatgagtgccctgaagattttatcaaaggcttgattctttctgttcgttcattgcttccagtggagccccttgtggaggaatgtgagaagaggaatcgccttcgtttactcacacagttcttggagcatcttgtgagtgagggaagccaagatgtacatgtgcacaatgctttgggtaaaatcatcattgatagtggcaataatccagagcacttccttaccacaaacccatattatgattcacgtgttgttggtaaatattgtgagaaacgtgatcctaccctagctgttgttgcttaccgccgtggacaatgtgacgatgaacttattaatgtcacaaataagaactcattgttcaaattgcaagcaaggtatgtggttgagaggatggatgaagatctttgggggaaagttcttgaccctgagaatgagtacagaagacagcttattgatcaagttgtttctactgccttgcccgagagcaagagcccggagcaagtttctgcgtctgttaaggctttcatgactgctgatttgcctcacgaattaattgagcttcttgaaaagattgtgcttcaaaactctgccttcagtggaaactttaatctgcaaaacctgctaattttgacagccatcaaggcagatccgtctagagttatggattatattaataggctagataattttgatggacctgcagttggggaagtagctgtggaagctcaattgtatgaggaagcatttgcaatcttcaagaagtttaacttgaatgtccaagctgttaatgtcttgttggataacatccgaagcattgatagggctgtggagtttgccttccgtgtggaggaagatgctgtttggagccaggttgcaaaggctcaacttcgggagggtctagtgagcgatgctattgaatcatttatccgtgcggatgatgccacccaattcttggatgttattcgtgcttctgaggatgcagatgtgtaccatgacttggtgaagtaccttctaatggttaggcagaaggtcagagaacccaaggtggacagtgagctcatttatgcatatgcaaagattgataggcttgctgacatcgaagaatttattcttatgccaaatgtcgctaatctccaaaatgttggtgatcgcctatatgatgaggctctctatgaagctgcaaagataatatatgccttcatatctaactgggccaagttggctgtcacacttgtgaagctcaaacaatttcaaggtgctgttgatgcagcacgaaaagctaacagttcaaagacatggaaggaggtttgctttgcttgtgttgatgctgaggagttccgcttagctcagatttgtggtctcaacatcattatacaggtggatgatttggaagaggtcagtgaatactaccagaatagaggatgcttcaatgagcttatatctctaatggagagtggtcttgggttagagcgtgctcacatgggaatctttactgagttgggggttctatatgctagatatcgtccagagaaacttatggagcacatcaaattgttcgcaaatcgtctaaatatccccaagcttataagagcatgtgatgagcagcaacattggaaggagctgacctatctgtatattcaatatgatgagtttgataatgctgcaactaccatcatgaatcattcccctgaagcctgggatcacatgcagttcaaagatgtggcagttaaagttgctaacgtggagctatattacaaggctgtgcacttctacttgaaagagcacccggatctcattaacgatcttctaaatgtgctcgcgcttcgtgtagatcacacacgtgttgttgacatcatgcggaaggctggtcacctgcttcttgtgaagccatacatggttgcagttcagagcaacaatgtctctgctgtgaacgaggctttgaatgagatttatgttgaggaggaagactatgaaagattgcgcgaatcaattgatttgcatgatagctttgaccaaataggcctcgctcaaaagattgagaaacatgagcttctggaaatgagacgcgttgctgcttatatttacaagaaagctggaaggtggaagcagtccattggattgtcaaagaaagacaaactttacaaagatgccatggagacagcctcacaatctggtgaccgtgaactggccgaggagttgcttgtttacttcattgaacagggaaagaaagaatgctttgcatcgtgcctctttgtctgttacgatttgataaggccggacattgcccttgaacttgcatggatgaacaacatgatcgattttgctttcccatatctgttacagtttatccgtgaatacactggcaaagttgatgaactggttaaagacaaaattgaagcacaaaaggagatcaaggctaaagaacaagaagataaagaagttattgcacagcagaacatgtatgctcagttgctgcctcttgctttgcctgcaccaccaatccctggtatgagcgggggtatgggaggagggtatgctccaccgccacctatgggaggaatgccaccgatgggcatgccgccttatggcatgccaccaatgggcagcagctactgaggcatgttgaactatcccttcggagttcgatgtttgattttgatgttttagtcagtagggcaacctatttgatagaacttaccatttagtgtaattttatgaggttcacgagcccgtcacatggttttattttgttcttctgttgttttattatgggttggaaagggtgcagcttaaataattgtgtcataggttgtgtggatatgttctgttgtcttgtaatattcttttgtagcagaggcatttttgttttggctggtggttgagggcgagcttagaattttctcctctgtattatttgttctggtttttcgaacctgcccgagtccgagtataatacaaaacagtacactcatcattttggta

SEQ ID NO: 5161 - DNA, 5574 bp, Manihot esculenta
ctctcgatctcttgctcaccatggcggccactaacgctccgatcactatgaaggaagtcttaactttgccgagcattgggatcaatcctcagttcatcacgtttacaaatgttacaatggagtcggataagtatatatgtgtgcgggaaacggctccccagaatagtgtcgtgattgtggatatgaatatgccaatgcagccattgaggcggcctattactgcagactcggcactcatgaatccaaattctagaatccttgccttgaaagcccaactcccaggaactactcaggatcaccttcaaatatttaacattgaaatgaaagcaaaaatgaaatcccaccagatgcctgagcaggttgttttctggaagtggataagcccaaagatgctgggcttggtcacacagacctcagtttaccattggtcaattgaaggcaagattcctctttgtgattctgaccctgtcaagatgttcgacagaacagctaatttggtgaacaatcagataattaactacaaatgtgacccttctgagaagtggttggttcttattggaatagctcctggttcacctgagaggcaacaattggttaaagggaacatgcaacttttctctgtggatcagcagcgtagtcaagctcttgaagctcatgctgcgtcatttgcgcaatttaaggttccgggaaatgagaatccttctattctcatttcatttgccacgaaaacttttaatgctgggcagatcacatcgaagttgcatgttattgagcttggtgctcaaccagggaaaccagcatttacaaagaaacaagctgatcttttctttcctccagactttgctgatgactttcctgttgcaatgcagatatcccacaaatacagtttgatttttgtgatcacaaagcttgggctattatttgtttatgacttggagacagctactgctgtatacagaaatagaatcagtccggatccaatatttttgacagccgaagcttcatcagtgggggggttttatgctattaataggcggggacaggtgttgctagctactgtgaatgaagcaacacttgtgccatttgtcagtggccaattgaacaatttggagcttgctgtcaatcttgccaagaggggaaaccttcctggtgcagagaatttggttgtccagcgtttccaagagctgtttgctcaaacaaagtataaagaggcagctgagcttgctgcagagtcgcctcaagggattcttcgaacacctgatacagttgccaagtttcagagtgttcctgtgcaagctgggcaaacacctcctttactgcagtactttgggacgcttctaactagaggaaagcttaatgcatttgagtcattggaattatcacgccttgttgtcaatcaaaataagaagaatcttttagagaattggttggcagaggacaagttggagtgcagtgaggaacttggagaccttgtgaagaccgtggataatgaccttgcgcttaaaatatatatcaaagctagagctactccaaaagttgttgctgcttttgctgagaggagggagtttgacaaaattttgatttactcgaagcaggttgggtatactcctgactatttgttccttctgcaaacaattctccgttcagatcctcagggagcagtgaattttgctctgatgatgtcccaaatggagggaggttgtcctgttgattacaacaccatcactgatctgtttcttcagagaaacttgattcgtgaggcaacagcttttctgttggatgttttgaagccaaatctaccagaacatggttatctgcaaacaaaggtccttgaaatcaatttagtaacttttcctaatgtagctgatgctattctagccaatgggatgttcagccactatgatcgccctcgtattgctcaactttgtgaaaaagctggtctatacatccgagccctgcaacattactcagagttgccagatattaaacgtgtcattgttaatacacatgcaatagagcctcaggcacttgtcgagttttttggtactctttcacgagagtgggctttggagtgcatgaaggatcttttactggtgaatcttcggggcaaccttcagataattgtgcaggcagccaaggagtattgcgagcagttgggtatggatgcatgcataaaactctttgagcaattcaagtcatacgaagggctgtactttttccttggttcatttttgagttccagcgaggatcctgatatacacttcaagtacattgagtctgctgctaaaactggacaaataaaggaggttgagcgtgttactagggaatcaaatttttatgatgctgaaaagacaaagaacttcctaatggaggccaaacttccagatgctaggcctcttattaatgtgtgtgatcgttttggttttgtgggtgatctcacacactacctctacacaaataacatgcttcgctatattgaaggttatgttcagaaggtgaacccaggtaatgcacctttggttgtggggcagttgctggatgatgagtgccctgaagacttcattaagggacttattctttctgtccgttctttgcttcctgttgagccccttgtggaggaatgtgagaagagaaatcgacttcgtttgctcactcagttcttggaacatcttgtgagcgagggaagccaagatgtacatgtccacaatgctcttggtaaaatcattattgatagcaataacaatccagagcacttcctcacaaccaacccatactatgattcccggattgttggtaagtattgtgagaaacgtgatcctactctggctgttgtggcttaccgaagaggacaatgtgatgatgaacttgtcaatgtaacaaataagaactctttgttcaaattgcaagccagatacgtggttgaaaggatggacgctgatctttgggagaaggttcttaatcctgagaatgaatataggagacagcttattgatcaagttgtatctactgctttgcctgaaagcaagagccctgaacaagtttctgcagcagtcaaggctttcatgactgctgatctaccccatgagttgattgagctacttgaaaagattgtgctccaaaactctgcgttcagtggaaatttcaacctgcagaatctacttatattgactgccattaaagcagacccgtctagagttatggactacataaacagattagataattttgatggtcctgctgttggtgaagtggctgtagaagcgcagctatatgaggaagcattttctattttcaagaagttcaacttaaatgttcaagcagtaaatgtcttgttggacaatattcgaagcattgatcgtgcagtagagtttgcattccgtgttgaagaagatgctgtttggagccaggtggcaagggctcaactcagggagggactggtgagtgatgcaatcgagtcatttatccgtgcggatgatgctactcaattccttgaggtgattcgtgctgctcaggatgcaaatgtctatcacgatctggtgaggtacctccttatggttaggcagaagtcaaaagagcccaaggtggatagtgagcttatttttgcatatgcaaagatcgataggcttagtgacattgaggaattcattctcatgccaaatgtggctaatctccaaaatgtgggtgatcgtttgtttgatgaagctctgtatgaggctgcaaagataatatttgcatttatatcaaactggggcaagttggctagtacacttgtgaagctgcaccagtttcaaggtgctgttgatgcagcacgaaaagccaacagtgcaaagacatggaaggaagtttgctttgcttgtgttgatgctgaggagttccgtttggctcagatctgtggtctcaacattattattcaggtggatgatctggaagaggtcagtgaatattatcagaacagaggacacttcaatgaattaatatctcttatggagagtggcttagggttagaacgtgcacatatgggcatttttacagagttgggagtattgtatgctagatatcgtcctgagaagcttatggaacacattaaattgttctcaacccgtctcaatattcccaagctcatacgggcttgcgatgaacagcagcactggaaggaacttacctatttgtatatccaatatgatgaatttgataatgctgcaactaccataatgaaccattcccctgaggcgtgggatcatatgcaattcaaggatgttgcagtcaaggttgctaatgtggaactatattataaggctgtccatttctacttgcaagagcacccagagcttatcaatgatcttcttaatgtgctggcactacgtgtggaccatactcgagttgttgacattatgcggaaggcgggtcaccttcttttggtgaagccatatatggttgctgttcagagcaataatgtttctgctgtgaatgaggctttgaatcagatttatgtagaggaggaagactatgaaagattgcgtgaatcaattgatatgcatgacaactttgatcagattggccttgctcagaagattgagaaacatgaacttcttgaaatgagacgcgttgctgcatacatctacaagaaggctggaaggtggaagcaatccattgcattgtcaaagaaagacaacttgtacaaagacgcaatggagacagcatcacaatctggagaccgtgaacttgcggaggagttgcttgtttatttcattgaacagggcaagaaagaatgttttgcgtcatgcctgtttgtttgttatgatttgattcgggcagatgttgcccttgagctggcctggatgaataatatggttgactttgccttcccatacctgctgcagtttattcgtgaatacactggtaaagttgatgaactcattaaggacaaaattgaggctcagaaggaggttaaggcaaaagagcaggaagaaaaggaagttattgctcagcagaacatgtatgcccagttgcttcctcttgcattgcctgcacctccaatgccaggcatgggtgggccaactatgggtggaggttttgcggcaccgccaccaatggcgggaatgggaatgcctccaatgccaccgtttggaatgccacctatgggtagctattgacacatgcaggtgacctttttgtagaatttagctgtgaatccaagttgcttataaaggacatgcaaatttgggcttaccatatttggctttgtttactggtcttttggtgccttcattccttttcttcttttcttttcgtgtttgttttggtgggatgaaggctagatgaaataattgccatttttcgttcttatctttaggcgtgtggatatgtgttgtaatattctttcaatagggaggcatttttttgtttgggctgctggtagtgggtagccgattatttctcatgtctgtaatttgtccccttttcagtctaggaattggccgcgtatagtacgaaaatgtttcatacagatcagaatggaccaacttgagctttaatgcctttttttttaatagcaccatctccctgtattagact

SEQ ID NO: 5162 - DNA, 6031 bp, Vitis vinifera
aagccactgagccactttttctttttcttttcattacttccatttttctttagatgagatctgtgcctattctcgttttgattcctttcattctctctattcatttctcctagaattacccaactccttcgctccatctctctctcgtggagggttcaaggttttcttcgctgcttcagatcttgcagcggctcgaatcctcaccgacattggagcgctctcacctctcaattctcgattcaatcgcatctccgcatcggatttcggttctgaatcgtcgatctagccgccatggctgccgcaaacgcccctatcaccatgaaggaggttctgacgttgccgagtttgggaattagtcctcagtttataacgtttacacatgtcacgatggaatctgataagtatctatgcgttcgggagacggctccacagaacagtgttgtaatcattgatatgaatatgccaatgcagcctttgagaaggccgatcactgcggactcggcgctaatgaatcccaataccagaattcttgcattgaaagctcaacttccgggaaccacccaggatcacttgcaaatatttaatattgagatgaaagccaaaatgaaatcatatcaaatgcctgagcagattgttttctggaagtggattaccccaaagatgctgggcctggtcacgcagacctcagtatatcattggtcaatcgaaggtgattctgaacctgtaaaaatgtttgagaggactgctaatctggtaaacaatcagataattaactatcgatgtgatccatctgaaaagtggttggttttgattggaattgctccgggttcacctgagaggccacagcttgtcaaagggaatatgcagcttttctctgttgaacagcatcgtagtcaagctcttgaagctcatgctgcatcattcgccacgtttaaagttccagggaatgatcaaccttgtacactcattggttttgccacaaagtcctttaatgctggacagattgtctcaaagctacatgtcattgaacttggatccaacccagggaaaccaggatttacaaagaaacaggctgatcttttctttcctccagattttgctgatgattttccagttgcaatgcagatatcgcacaaatatggcttgatatatgtgattaccaagcttggattgctgtttgtgtatgacctggagtcggcttctgcagtatacagaaacaggattagtccagatccaatatttttgactgctgaagctacatctattggaggtttttatgccatcaataggcgagggcaggtgttacttgctactgtaaatgaggcagcaattgtgcctttcgtcagtggccaattgaacaacttggagctagctgtcaatctcgcaaaaaggggaaatctccctggtgcagagaacttggttgtccagcgtttccaagaattgtttgctcagacaaagtataaggaggctgctgagcttgctgctgaatctccacaaggaattctccgtacaccggacacagttgccaaatttcagagtgttcctatgcaatctgggcagactccacctttgctacagtactttggaacacttctaactagaggaaagctcaatgcatttgagtcattggaattatcacgcctggttgtgaatcagaacaagaagaatcttttggagaattggttagcagaggacaagctggagtgcagtgaggaacttggggatctagtgaagactgtggatactgaccttgcactcaaaatatatattaaagcgagagcaactccgaaagttgttgcagcctttgctgagcgtcgggagtttgacaaaattctgatatactcaaagcaggttgggtatactcctgattatttgttccttctgcaaaccattcttcgatcagatcctcagggagctgtaaattttgcgctaatgatgtctcaaatggagggaggttgtcccattgattttaatacgataactgatctctttcttcagaggaacttgatacgtgaagcaacagcatttttgttagatgttttgaagccaaatttacctgagcatggtttcctgcaaacaaaggtcctggaaatcaatctggtaacttacccaaatgttgcagatgctatattagcaaatgggatgtttagccattatgatcgtccacggattgcccagctttgtgaaaaagctggtctttatgtgcgagcccttcagcattatactgagttgccagatataaaacgcgtcattgtgaatacacatgcaattgagccacaggcacttgtagagttctttggtacgctttcacgagaatgggctttggagtgcatgaaggaccttcttctggtcaatctaagaggcaaccttcagataattgttcagactgccaaagaatattctgagcaattgggtgttgatcaatgcgtaaaactctttgagcaatttaaatcatacgaaggattgtacttttttctgggttcttatttgagctcaagtgaggatcctgacattcacttcaagtatattgaagctgctgctaaaactggacaaattaaggaggttgagcgtgtgactcgagaatcaaacttctatgatgctgaaaaaacaaagaacttcctaatggaagccaagcttccagatgcacggccgctgattaatgtgtgtgaccgttttggttttgtcccagatctcacacattacctatacacgaacaacatgcttcgatatattgaaggttatgttcaaaaggtgaaccctagtaatgcacctttagttgtggggcagctgctagatgatgaatgtccagaagatttcattaaaggtctaattctttctgtccggtcgctgcttcctgttgagccccttgtggatgaatgtgagaagagaaatcgactccgtttactcactcagttcttggagcatcttgtgagtgagggaagccaagatgtgcatgtccataatgctctgggtaaaatcattatagacagcaacaataatccagagcacttcctcactaccaacccatactatgattctcgtgttgtgggtaaatattgtgaaaagcgtgatcccaccctcgcagttgttgcttaccggagaggacaatgtgacgaagaacttataaatgtcacaaataagaactctttgttcaaactgcaagccagatatgtagttgaaaggatggattctgatctctgggagaaagttcttgaccctgataatgattatagaagacagctcattgatcaagtagtatctactgctttgccagaaagcaagagtccagaacaagtttctgcggctgttaaggctttcatgacagctgatctaccccacgagctaattgagcttcttgaaaagattgtgcttcaaaactctgcattcagtgggaactttaatctgcagaaccttcttatcttgacagccattaaagcagatccatctagagtgatggattacattaacaggctggataactttgatggtcctgccgttggtgaagttgcagtggaagcccaactgtttgaagaagcatttgcaattttcaagaagttcaacttgaatgtccaagctgtcaatgtgttactggataatatccaaagcattgagcgtgctgtggagtttgcattccgtgttgaagaagatgctgtttggagccaggtggccaaggctcaactaagggaggggttggttagtgatgcaattgagtcatttattcgtgcagatgatgccacccagttcctagatgttattcgtgctgctgaagatgcaaatgtttaccatgacttagtgaggtaccttttgatggttagacagaaggcaaaagagcccaaagtggacagtgagctcatttatgcttatgcgaagattgatcggctgggtgaaattgaagaattcattctcatgccaaatgttgctaatctccaaaatgttggtgatcggttgtatgatgaagccctatacgaggctgcaaaaataatatttgcttttatttctaattgggccaagttggcctgcacacttgtgaagttgagacagttccaaggtgctgttgatgcagcacggaaggctaacagctcaaagacatggaaggaggtttgctttgcttgtgttgatgcagaagagttccgcttagctcagatatgtggtctcaacattattatacaggtcgatgatttggaggaggtcagtgattattaccagaatagaggatgcttcaatgagctaatatcactcatggagagtggtctgggcttggagcgtgcacatatgggcatttttactgagttgggtgtcctgtatgctcgatatcgtcctgagaagcttatggaacacatcaaactgttttcaacccgtctcaacattcccaagcttatacgggcttgtgatgaacagcagcactggaaggaactcacttacttgtatatccaatatgatgagtttgacaatgctgcaaccactataatgaaccattctcctgatgcatgggaccacatgcagtttaaagatgttgcagtcaaagttgctaatgtggagctctattacaaggccgtgcacttttacttgcaagagcatcctgatctcattaatgatcttctaaatgtgcttgcacttcgagtagaccatactcgtgtggttgacataatgcggaaggcaggtcaccttcatcttgtgaagccatatatggttgcagttcagagtaacaatgtttctgctgtgaatgaggctttgaatgggatttatgttgaggaggaagactatgacagactgcgtgaatcaattgatatgcatgataactttgatcagattggccttgcacagaagattgagaaacacgagcttcttgagatgagacgtgttgctgcttatatttacaagaaagcaggcagatggaagcaatcaattgcattgtcgaagaaagacaacctgtacaaagacgcgatggagactgcctcgcaatctggtgaccgtgaacttgcagaggagttgcttgtttatttcattgagaagggaaagaaagaatgctttgcatcttgcctctttgtgtgctacgacttaattcgtccagacattgctcttgaacttgcctggattaacaatatggttgactttgccttgccatatctgttgcagtttatccgcgagtacgcaggcaaagttgatgaacttgttaaggacaagctggaagctcttaatgaagttaaggctaaagagaaggaagagaaggatgtaatcgcccagcagaatatgtatgctcagttgctgccccttgctttgcctgcacctccgatgcccggcatgggaggagctgggatggcaggaggttttgttccacctcccatgggtagtatgggaatgcctccaatgcctccttttggaatgccgccaatgggcacttattaatctgctggtgactgttgaaatcagaattagtggtggatattgattgcttgaggaggaaagcgaactagcagtttggagttccattttgtgttggtgggatttttgcgcttccacttctctctctttattattattttttttataatgtggcaagtgaaggtctagtccaaaataatgtcaattttctctggtgttttgtcataaggtgtggatatatttctttgtaatattcttttggtagcgggaggcaattttttttttgctgctggcagagggcaagctgaggattttctgtacttatttcttgcggtccaggacatatagccaagcataatacaaggacccttcatacagattatcaagtgttcacttgatatgtcccggactgttatttccaatttgttggttattaccatctctggtttatatccttttgttttgacatcctagaattaagcgtcttgtgttccctggtcacacatttgagttgtctctcattatttggttgttgttcatacatatttagtgtgaatttgtttatgctagtttcattttttggatcagaattctgaggcctttagccaattacattgccatggtgattgatacctcccagttttccatt

SEQ ID NO: 5163 - DNA, 5712 bp, Populus trichocarpa
cctccccactcctctctttagatctctctttcttttcttttgattccgagggaatattttagggttttatcgctgctttagatcttgcagcgatttgaatcctcaaccggttcaatttcaatcacagatccgattagcacactctgagccgtcgatctaatcagcaaccatggccgcggctaacgccccgatcaccatgaaggaagtcttaactttaccggctatcgggattagtcctcagtttattacgtttacaaatgtaacgatggaatcagacaagtatatatgtgtacgggaaacagcgccacaaaatagtgttgtaattatcgatatgaacatgccaatgcagccattgagacgccctatcactgcagattctgctctcatgaatccaaattctagaatccttgctttgaaagcccaacttccgggaactactcaggatcacttacaaatatttaacatcgagatgaaagcaaaaatgaaatcataccagatgcctgagcagattgtcttttggaagtggataacccctaagatgctgggcctggttacacagacatcagtttatcattggtctattgaaggtgattctgaaccagtgaagatgtttgagagaactgctaatttgcaaagcaatcagattataaactacaaatgtgacccttctgagaaatggttagttttgattggaattgctcctggctcacctgagcggcaacaattggttaaagggaacatgcaacttttctctgtggatcaacaacgtagccaagctcttgaagcacatgctgcatcatttgcacaatataaggttccaggaaacgagaacccttccactctgatttcttttgccacaaaatcttttaatgctgggcagattacatcgaagttgcatgttattgagcttggtgcccagccagggaagccatcgtttacgaagaaacaggcagatctgttctttcctcctgattttgctgatgactttcctgtggcaatgcagatatcccacaaatacagtttgatttatgcaatcacgaagcttgggctgctatttgtttatgatttggagacagctactgcagtataccgaaacagaattagtccagatccaatatttttgacagctgaggcttcaacggtgggagggttttatgccattaataggcgaggccaggtgttgttggctactgtaaatgaagcaatgattgtgccatttgttagtggccagttgaataatctggagcttgctgtcaatctagccaaaagaggaaaccttcctggtgctgagaatctggttgtccagcgtttccaagaattattcgctcaaacaaagtataaagaagctgctgagcttgctgctgagtcaccacaaggcattcttcgaactcctgacacagttgccaagtttcagagtgttccagtgcaacctgggcaaacccctcccttattgcaatactttgggacccttttaactagaggaaagcttaatgcatttgagtcattggaattgtcccgccttgtggtcaatcagaacaaaaagaatcttttggagaactggttggcagaggacaagttggagtgtactgaggaactgggagaccttgtgaagacagtggataatgatcttgctctgaaaatatatattaaagctagggcaacccctaaagttgttgcagcttttgctgagagaagggagtttgacaaaattttgatatactcgaagcaggttggctatgctcctgactatttattccttctgcaaacaattctccgtacagatccacagggtgctgttaactttgctttgatgatgtcccaaatggaaggtggctgtccagttgactacaataccattactgatctctttcttcagaggaacttgatccgtgaggcaacagcctttctgttggatgttttgaagccaaatttagcagagcatggttacctccaaacaaaggttctggagataaatctggtaacatttcctaatgtagctgatgctattctagccaatgggatgtttagccactatgatcgtcctcgtattgctcaactctgtgaaaaagctggtctttacatccgagccctgcagcattatacggatttgccagatattaaacgtgtgatcgtgaatacacatgcaatagagccacaggcacttgttgagttttttggcactctttcacgagaatgggctctggagtgcatgaaggatctcttactggttaatctaagaggcaaccttcagataattgttcagactgccaaggaatattgtgagcagttgggtgttgatgcatgcgtaaaacttttcgaacaattcaaatcatatgaagggttgtactttttcttggggtcatatttgagttccagcgaggatcctgatatacattttaagtacatcgaggcagctgctagaaccggacaaataaaggaggttgagcgtgttactagggagtcaaatttttatgatcctgaaaagacaaagaactttctgatggaagccaagcttccggatgcaaggcctctaataaatgtctgtgaccgttttggttttgttgctgatctcacacactacctctattcaagcaacatgcttcgttatatagagggttatgttcaaaaggtgaacccagggaatgctccttcagttgtcgggcagctgttagatgatgaatgcgccgaagactttatcaagggccttattctttctgtccgttctttgcttccagttgagccccttgtggaggaatgtgagaagagaaatcgacttcgtttgctcactcagttcttggaacatcttgtgagtgagggaagccaagatgtacatgttcacaatgctcttggtaaaatcatcattgatagcaataacaacccagaacacttcctcaccaccaatccttactatgattcccgggttgtgggcaagtattgtgagaaacgtgatcccacccttgctgttgttgcttaccggagaggacaatgtgatgaagaactcatcaatgtcacaaataagaactctttgttcaagttgcaagccagatatgtggttgaaaggatggatggtgatctttgggagaaggttctgaatcctgaaaatgaataccgaagacagcttattgatcaagttgtatctactgctttgccggaaagtaagagcccagagcaagtttctgctgctgttaaagctttcatgactgctgatctgccccatgaattgattgagcttcttgagaagattgtgctccaaaactctgcattcagtggaaatttcaatctccaaaacctacttatcttgacagcgattaaggctgatccttctagggttatggattatattaatagattagataactttgatggacctgctgttggggaagtggcagttgaagctcagctttacgaggaagcatttgcaattttcaagaagttcaacttgaatgttcaggctgttaatgttttattggataacatccaaagcattgaccgtgccgtggagtttgcattccgtgttgaagaagatgctgtttggagccaggtggccaaggcccaactcagagagggccttgtgagtgaagcaattgagtcatttattcgtgcagatgacgctactcaattcctggaagtcattcgtgctgctgaggatgcaaatgtctatcaagatttgttgaagtaccttctcatggttaggcagaagacaaaagagccaaaggtggatagtgagcttatttttgcatatgcaaagattgataggttgagtgacattgaggagttcattctcatgccaaatgtggcaaatctccaaaatgttggcgatcgcttatatgatgaagctctttatgaggctgcaagaattatattccaatttatagcaaactgggccaagttggcaagcacactagtgaagttgaaacagttccaaagtgctgttgatgcagctcggaaagccaacagtgccaagacatggaaggaagtttgctttgcttgtgttgatgcagaggagttccgtctggctcagatatgtggtcttaacatcattatacaggtggatgatttggaggaggtcagcgaatattaccagaacagaggatacttcaatgaattgatctctctcatggagagtggtttaggtttagaacgtgcacacatggggattttcacagagttgggagtgctgtatgctagatatcgtcctgagaaactcatggagcacattaaattgttctcaacccgtctcaacattcccaagcttatccgagcatgtgatgaacagcaacactggaaggaacttacctatttgtacattcaatatgatgaatttgataatgctgcaactaccattatgaaccattctccggaggcatgggatcacatgcaattcaaagatgttgctgtcaaagttgctaatgtagagctatattataaggccgtgcatttctacttgcaagaacatcctgatcttatcaatgatcttctcaatgtgctggcacttcgtgtggaccatactcgtgttgttgacattatgcggaaggctggtcatttgcttcttgtgaagccatacatgattgcagttcagagcaacaacgtgtctgctgtgaatgaggctttgaatcaaatttatgtagaagaggaggactatgaaagattgcgtgaatcaattgatttgcatgataactttgatcagattggccttgcacagaagattgagaaacatgagcttcttgaaatgaggcgtgtggctgcgtacatttacaagaaggcaggaagatggaagcaatccattgcattgtcaaagaaagataacctttataaagatgccatggagacagcatcacagtctggtgatcgtgaacttgcagaggagttgctggtttatttcattgaacagggcaagaaggaatgctttgcatcgtgcctctttgtttgttatgatttgattcggccagatgttgcccttgagcttgcctggatgaataatatgattgactttgctttcccgtacctgttgcagtttatccgtgaatacacaggcaaagttgatgaactcgtgaagtacaaaattgaggcgcagaaagaagtcaaggccaaagagcaggaagagaaggatgtaattgctcagcagaacatgtatgctcagttacttcctcttgctttgcctgcaccgcccatgcctggtatgggtggaccaacaatgggaggaggttttgctccaccaccacccatgggtggaatggggatgcctccaatgccaccttttggcatgccaccgatgggcagctactgatatgcaaacaaccaccctttttttgtagaattagttgcgaattcccagttgcttaaagaaaaaaaagtatcctagctgtttgggcttttgatatggcggtggtgtttttctgggcttgggtgccttcattcttcttgttttttttttgtgttcttttttggtgggacgaaggtgtaattgaaacaatgaacatggcatttttctgtcctaggtgtgtggataagtgatgtaatatttttttggtaggaatcattttttggctgctagtagcgagcaagcggaggatttcctgtatttgcaatattttttcccttgcggtctgggagctagccgagtataatacgaattgtttcatacaaatcataaaaccgtccaacttgatctgtaatggctctattttaatttcatcttttcccttttacttt

SEQ ID NO: 5164 - DNA, 5725 bp, Cajanus cajan
tctctctctcctttcgctttagagggtccaacttgcttccagatcttgcgccgatttggatcactcttttgactctctgtcttccaattctatcgccgccgcagatccgttctccgatccacgccgtcatggcggccgccaacgctccgattgccatgcgagaacctctcaccttgccgagcattggcataaatccgcagttcatcaccttcacgcatgtgacgatggagtccgataagtatatatgcgttcgagaaacggctccgcagaatagtgtcgttatcattgatatgaacatgccgatgcagcctttgaggaggcctatcaccgcagattccgctcttatgaatccgaattccagaatccttgctctgaaagctcaactacaaggaacaactcaagatcacctacaaatttttaacattgaaatgaaagcaaagatgaaatcttatcagatgcctgagcaggtggtcttttggaagtggattacccccaagttgttgggtcttgtgacacagacctctgtataccattggtcaatcgaaggtgactctgaacccgtgaagatgtttgagagaacagcaaatttggcaaacaatcaaataattaattatcgatgtgatccatctgaaaaatggttggtcttgattggtattgctccaggttcccctgagaggccacaattggttaaaggaaacatgcaactcttctctgtcgatcaacagcgcagccaggctcttgaagcacatgctgcagcatttgctcaatttaaagttcctgggaatgaaaatccttctactttaatttcttttgccactaagacacttaatgctggtcaaattatatccaagttgcatgttattgagttgggtgcacagccagggaagccatcatttacaaagaaacaagcagatcttttctttcccccagattttgctgatgattttccagtcgccatgcagatatcccacaaatacaatttgatttatgtgattacgaaacttggtctcctatttgtctatgatttggagacagctacagctgtatataggaacagaataagtccagatcctatatttttgacatcagaagctacatcagtgggaggcttttatgccattaacaggagaggccaggtgttattggctactgttaatgagcaaacgattgtgaattttgtcagtggtcaattaaacaatttggagctagcagttaatctcgccaagcgaggaaatcttcctggggctgagaaactggtggtagaacgtttccatgaactgtttgcccaaacaaagtataaagaagcagctgagcttgctgctgagtctccacaaggaatccttcggacacctgatacagttgccaaatttcagagtgttcctgtgcaagctgggcaaactcctccactgttgcagtattttggaacacttctaactagaggaaagctgaatgcctttgagtcattagaattgtcacggttggttgtgaaccagaacaagaaaaatcttttggagaattggttggcagaggacaagcttgaatgcagtgaagagctaggagatcttgtaaagactgtggacaatgatcttgctttaaaaatatacatcaaagccagagctactccaaaagttgttgctgcttttgctgagagaagagagtttgacaagattctgatatactctaagcaggttgggtacacacctgattatctcttccttttgcaaacaattctccggaccgatcctcagggtgctgttaattttgcattaatgatgtcacaaatggagggaggttgcccagttgattacaataccataactgatctgtttcttcagagaaacctgatccgtgaggcaacagcttttctcctagatgttttgaagccaaatctaccagaacatggtttccttcaaacaaaggtgttggagataaatctagttactttcccaaatgttgctgatgcaattttggctaacggcatgttcagccattatgatcgtcctcgtgttgcccaactttgtgaaaaagctggtctttatgtgcgagctttgcaacattacacagagttgccagatataaaacgtgtgattgtaaatacacatgcaattgagcctcagtcacttgttgaattttttggtactctgtcacgagaatgggcattagagtgcatgaaagacctattgctggtcaatcttagaggcaacctacagattattgtacaggttgctaaagaatattgtgaacaattaggcgttgatgcttgcataaagctttttgagcagttcaggtcatatgaagggttatactttttcttgggatcatatttgagctccagtgaggatcctgacattcactttaagtacattgaggcagcagcaaagactggacaaatcaaagaggttgagcgtgtgactagagaatcaagtttctatgatcctgaaaaaacgaagaactttctaatggaagctaagctaccagatgctcgacctctgataaatgtttgtgaccggtttggatttgttccagatctaacacactatctatacacaagcaacatgcttcgctacattgaaggttatgttcagaaggtgaacccagggaatgctccattagttgttgggcagcttctagatgatgagtgtccagaagattttatcaaaggcttgattctctctgttcgttcattattgccagtggagccccttgtggaggagtgtgagaagaggaatcggcttcgtttgctcacacagtttttggaacatctggtaagtgagggaagccaggatgtacatgttcacaatgcactgggtaaaatcatcattgatagcaacaacaatccagaacattttctcactaccaacccatactatgattctcgagttgtgggcaaatattgtgagaaacgtgatcccaccttggcagttgtggcttataggcgtggacaatgtgacgacgaacttattaatgtgacaaacaaaaattctttgttcaaactacaagcaagatatgttgttgagaggatggatggtgatctttgggagaaagtgcttaaccctgataatgcgtacagaaggcaacttattgatcaggttgtgtctacagctctgcctgaaagcaagagccctgaacaagtatctgcagctgttaaggctttcatgactgctgatctacctcatgaattgattgagcttctagagaagatagtgcttcagaattctgcattcagtgggaactttaatctgcagaatctgcttattttaacggcgataaaggctgatccctccagagttatggattatgttaacagactggataattttgatgggcctgcagttggagaaatggctgttgaagctcaattatatgaggaagcatttgcaattttcaagaagttcaacttaaatgttcaagcagtcaatgtcttgctagataatattcatagcattgatagagcggtggagtttgctttccgagttgaagaagatgctgtttggagtcaggtggccaaggctcaactaagggaagggctagtaagtgatgcaattgagtcatttattagagcagatgatgccacacagtttttggatgttatccgtgctgctgaagatggcaatgtttaccatgacttggtgaaatacttgctgatggtaaggcagaagacaaaagaacccaaggtggatagtgagctcatttatgcatatgcaaagatcgataggctcagtgaaattgaggagttcattcttatgccaaatgtagccaatcttcaaaatgttggtgaccgattgtatgatgaagaactatatgaggctgccaaaatcatatttgcctttatatccaactgggccaagttagcagttacacttgtgaagttgaaacaattccaaggtgcagttgatgcagcaaggaaagctaacagctcaaaaacatggaaggaagtttgcttcgcatgtgttgatgcagaggagttccgtttggcccagatatgtggacttaacattattattcaggtggatgacttggaagaggtcagtgaatattaccaaaatagaggttgcttcaatgagttaatatccctcatggagagtggtttaggattagaacgggcacatatgggcatcttcaccgagttaggagttctgtatgccagataccgtcctgagaagcttatggagcatatcaaactcttttcaacccgcctcaatattccaaaactcataagagcatgtgatgaacaacaacattggaaggagctgacctatctgtacatccaatatgacgagtttgataatgctgctacaaccatcatgaaccattcacccgaagcatgggatcacatgcaattcaaagatgttgttgtcaaagttgctaatgtggagttgtattacaaggctgttcacttctatttacaagagcatccagatcttatcaatgatgttctgaatgtccttgcacttcgtgttgatcatgcacgtgttgttgacatcatgcgaaaggctggtcatctccgtcttgtcaagccatacatggttgctgttcagagcaacaacgtgtctgctgttaatgaagccctgaatgaaatatatgttgaggaggaggactatgatagattgcgtgagtcaattgatttgcacgataactttgaccaaataggccttgcacagaagattgaaaagcatgagcttcttgagatgagacgtgttgctgcttatatttacaagaaggcaggtagatggaagcagtccattgccttgtcaaagaaggataacctttacaaagatgccatggagacggcgtctcaatctggtgaccgtgaacttgctgaggagttacttgtttatttcattgatcagggaaagaaggaatgctttgcctcgtgtctatttgtctgctatgatttgatccgggcagacattgttcttgaattggcttggatgcacaatatgattgatttcgccttcccatatctattgcagtttatccgtgagtacactggcaaagttgatgaactggtgaaggacaaaattgaaacacagatccaagtgaaggctaaagagcaagaagagaaggaagtaattgctcaacagaatatgtatgctcagttgttgcctcttgctttgcccgcaccaccaatgcctggaatgggaggaggctttgctcctccccctccaatgggtggattgggaatgcctccaatgcctccttttggtatgccacccatgggcagcagctactgacaagaaggtgatcatgtgttcggcaatgaactctagtctatacggagagcgacgtagcagtatgggagttttcacattttcttctggggttttaatgcagtattctttccttgcttctaatggaggtggaggttcaagtgaaaataatttcgagtttgtgtcataattttgtaatattttttttatagttgaggcatttttttgggctgcttggacgagctagccgaggattttctgtatgtaaccatttttcatgtattaaatgatggtccgaagtataatacgaaatagaccgacttcgactcctagcccatgtttgccatggcctagatatattcaacttttccttgtagctacattaaagcttgttggtatgctgttgtgtgcatcttatcttaaatacgtggtttattgccacttgatttctggtttgatcttggttttgaattcacatacatggtactattagtgcttgatcccttgcacccgac

SEQ ID NO: 5165 - DNA, 5910 bp, Cajanus cajan
gcttcatttgctctctcggtgtgtgtaataggagacgagatctatgcttctagtctcgtcattgtagacaccaactcaattccactccctttcttctccccgttttattcgtgtgtcagaactccaatatcctgtttccaggttctctctcctcttcgctttgaagagggtccaagtcttctcttccgctgcttccagatctcgcagcggtttggatcctcctcaagctctctcttctccactctttcactctccatccaccaattcaatcgccgctcgcagatccgactcttccattttcacttcctcgatctaagccaccatggcggccgcgaatgctccgatcaccatgaaagaagccctaactttgccgagcattggcatcaatacgcaattcatcactttcacgcacgtgaccatggaatcggataagtatatatgtgttagagaaaccgctccacagaatagcgtggttatcattgatatgaacatgccaaatcaacctttgaggaggcctatcactgctgattccgctcttatgaatccgaattctagaatccttgctttgaaagcccaactgcaaggtactactcaagatcatctacagatatttaatattgagatgaaagcaaagatgaaatcatatcagatgcctgagcaggtagtcttttggaagtggattagccccaagatgttgggtctcgtaacacagacctctgtataccactggtcaattgaaggtgactctgaacctgttaagatgtttgagagaacagcaaatttggcaaacaaccagataattaattatcgatgtgaccctacagaaaaatggttggtcttgattggcattgctcctggttccccagagaggcctcaattggttaagggaaacatgcaacttttttcagtggatcaacaacgcagtcaggctcttgaagctcatgctgcatcatttgcccaatttaaagttcctgggaatgaaaacccttctgttttgatttcttttgcctcaaagacacttaatgctggtcaaatcatatccaagttgcatgttattgagctgggtgcacagccagggaagccatcatttacaaagaaacaagcagatctttttttccccccagattttggtgatgattttccagttgccatgcagatatcccacaaatacaatttgatctatgtgattaccaaacttggcctactatttgtctatgatttggagacggctactgctgtatataggaacagaattagtccagatcctatatttttgacctctgaagctacatcagttggaggcttttatgccatcaacaggaggggccaagttttattggctactgttaatgaacaaaccattgtgaattttgtcagtggtcaattaaacaatttggagctagcagtcagtcttgccaaaagaggaaatcttcctggtgccgagaaactggtggttgagcgtttccatgaactatttgcccaaacaaaatataaagaagcagcagagcttgctgctgaatctccacaaggaatccttcgaactcctgacacagttgccaaatttcagagtgttcctgtgcaagccgggcaaactcctccattgttgcagtattttggaacacttttaacaaggggaaagctgaatgcctttgaatcattagaattgtcacggttggttgtgaaccagaacaagaaaaatctgttggaaaattggttggctgaggacaagcttgaatgcagtgaggagctaggggatcttgttaagactgtggacaatgatcttgctttaaaaatatatatcaaagccagagctactccaaaagttgttgctgcatttgctgagagaagggagtttgacaaaattctgatctactctaaacaggttgggtacacacctgactacctcttccttctgcaaacaattctccggacagatcctcagggtgctgttaattttgcattgatgatgtctcaaatggagggaggtagcccagttgattacaacactataaccgatctctttcttcagagaaatctgatccgggaggcaacagcttttctcttggatgttttaaagccaaatctaccagaacatgggttccttcagacaaaggtgttggagataaatctggtgactttccccaatgttgctgatgcaatattggctaatggcatgttcagccattatgaccgtcctcgtattgcccaactttgtgaaaaggctggcctttatgtgcgagctttgcaacattatacagagttaccagatataaaacgtgtgattgttaatacacatgcaattgagcctcagtcacttgtagagttttttggcacactgtcacgagaatgggcattagagtgtatgaaagacctattgctggccaatctaaggggcaatctacagatcattgtgcaggttgctaaagaatattgtgaacaattgggcgttgatgcctgcataaaactttttgagcagttcaggtcatatgagggactttactttttccttggatcatacttaagctccagtgaggatcccgacattcactttaagtacatagaggcagcagcaaagactggtcaaatcaaggaggttgagcgggtgacaagagaatcaaatttctatgatgctgagaaaacaaaaaacttcctgatggaggcaaagcttccagatgcgcggcctttaattaatgtttgtgatcgttttggatttgttccagatctaacacactatctatacacaaacaacatgcttcgctacattgaaggctatgttcagaaggtgaacccaggaaatgcacctttagttgttgggcagctgttagatgatgaatgtccagaagattttatcaaaggcttgattctttctgttcgttcattactgccagtagagccccttgtggaggaatgtgagaagaggaatcggcttcgtttgctcacacagttcttggaacatcttgtaagtgagggaagccaggatgtacatgttcacaatgcactgggtaaaattatcattgatagcaacaacaacccagaacatttcctcacaaccaacccatactatgattctcgagttgtgggcaagtattgtgagaaacgggatcccaccttagcagttgtagcttatcggcgaggacaatgtgatgatgaacttatcaatgttaccaacaaaaattctttgttcaaactgcaagcaagatatgttgttgagagaatggatgctgatttgtgggctaaagttcttgatcctgataatgagtatagaaggcaacttattgatcaggttgtatctactgctttgcctgaaagctcaagccctgaacaagtttctgcagctgttaaggctttcatgacagcagatctgcctcatgaattgattgaacttcttgagaagatcgtgcttcagaattctgccttcagtgggaactttaatttgcagaatcttcttattttgacagcaataaaggctgatccatccagagttatggattatgttaatagattggataattttgatggtcctgcagttggagaaatggctgtagaagctcagttatatgaggaagcatttgccatttttaagaagttcaacttgaatgtccaagcagtcaatgtgttgcttgataatattcatagcattgatagagctgttgagtttgctttcagagttgaagaagatgctgtttggagtcaggtggccaaggctcaactcagggaagggctagtaagtgatgcaattgagtcttttatccgagcagatgatgctacacaatttttagatgttatccgtgctgctgaagatggcaatgtttaccatgacttggtgaaatacttgctaatggtaaggcagaaagcaaaagaacccaaggttgacagtgagctcatttatgcatatgcaaagattgataggctgagtgacattgaggaattcattcttatgccgaatgttgctaatcttcaaaatgttggtgaccggttgtatgatgaagcgttatatgaagctgcaaaaatcatatttgcttttatatctaactgggccaagttggctatcacactggtcaagttaaaacagtttcaaggtgctgttgatgcagcgaggaaagctaacagctccaagacatggaaggaagtttgctttgcttgtgttgatgcggaggagtttcgtttggcccagatttgtggacttaacattattattcaggtggatgacttggaagaagtcagtgaatattatcaaaatagaggttgcttcaatgagctaatatctctcatggagagtggtttagggttggagcgggctcatatgggcatctttactgagttgggagttctgtatgctagataccgccctgaaaaactcatggagcatattaaactattctcaacccgcctcaatattcctaaactcatacgagcttgtgatgaacaacaacattggaaagaactgacttatttgtatatacaatatgatgagtttgataatgctgcaactaccatcatgaaccattcacctgaagcatgggatcacatgcaattcaaagatgttgttgttaaagttgctaatgtggagttatattacaaggctgttcacttctacttggaagagcatccagatcttatcaacgatgttcttaatgtcctggcactccgtgtggaccatgcacgtgttgttgatatcatgcggaaggctggccacctccgtcttgtgaaaccatacatggttgcagttcaaagcaacaatgtatctgctgttaatgaagcattgaatgagatatatgttgaggaggaagattatgatagattgcgtgaatcaattgatttgcacgataactttgatcaaataggccttgcccaaaagattgaaaagcatgagcttcttgagatgagacgagttgctgcttatatttacaagaaggcaggcaggtggaagcagtctattgctttgtcaaagaaggataacctttacaaagatgccatggagacagcctcacaatctggcgagcgtgaacttgctgaggagttgcttgtttatttcattgatcagggaaagaaagaatgctttgcctcgtgtctatttgtttgctatgatttaatacgggcagacattgttcttgaactagcttggatgcacaatatgattgacttcgccttcccatatctcttgcagtttattcgtgagtacacgggcaaagttgatgaactagtgaaggacaaaattgaagcacaaaatgaagtgaaggctaaagagcaagaagaaaaggaagtagttgcacaacagaacatgtatgctcaattgttgcctcttgctttgcctgcaccaccaatgcctggaatgggaggcccaggaggaatggggggaggctttgctcctccccctccaatgggtggactgggaatgcccccaatgcctccttacggcatgccacctatgggcagcagttactgacatgtaagcagtggtggcaagtatagcacgaactcagcccctataaagagcaatgtaggaacttcgaagttttgcatagaatatcttgtgtgatttggatgcagcattctttcgttgcttctggtggctgtgggagattcaagttaaaataatttgaggtttctgtttagattgtgtcataatagtcttgtaagtttactcttctttctgggttgtagttgaggcattttttgggctgctggttcgaggtaaccgacaaatttctgtattctaccatttttcttgtattaaatgagttagtctctggtagtagaccaaacaaaaatgaattagtcctagtgtatacgaaatttaccgactttaacagccagcttgatatgtgcatgtcgttgcctagatttctgctcttccttgttatggaggctccctaattagatcatgtcagcatgctgcttttcatattg

SEQ ID NO: 5166 - DNA, 5546 bp, Glycine max
ccgtcatggcggccgccaacgctccgatcgccatgagagaaactctcaccttgccgaccattggcattaatccgcagttcatcacgttcacgcatgtgacaatggagtccgataagtatatttgcgttcgagaaacggctccgcagaatagtgtggttatcattgatatgaacatgccgaatcagcctttgaggaggcctattaccgcagattccgctcttatgaatccgaattccagaatccttgctttgaaagctcaactccaaggaacaactcaagatcacctacaaatttttaacattgaaatgaaagcaaagatgaaatcttatcagatgcctgagcaggtggtcttttggaagtggattacccccaagttgttgggtattgtaacacagacctctgtataccattggtcaattgaaggtgactctgaacctgtaaagatgtttgagagaacagcgaatttggcaaacaaccaaataattaattatagatgtgatccttctgaaaaatggttggtcttgattggtattgttccaggttcccctgagaggccacaattggttaaaggaaacatgcaactcttctctgtggaacaacagcggagccaggctcttgaagcacatgctgcatcatttgctcaattcaaagttcctgggaatgaaaatccatctactttgatttcttttgccactaaaacacttaatgctggtcaaattatatccaagttgcatgttattgagctgggtgcacagccagggaagccatcattttccaagaaacaagcagatcttttctttcctccagattttgctgatgattttccagttgccatgcagatatcccacaaatacagtttgatttatgtgattaccaaacttggtctcctatttgtctacgatttggagacagctacagctgtatataggaacagaattagtccagatcctatatttttgacatcagaagctacgtcagttggaggcttttatgccattaataggagaggccaggtgttattggctactgttaatgagcaaacaatcgtgaattttgtcagtggtcagctaaacaatttggagctagcagttaatctcgccaagagaggaaatcttcctggtgctgagaaactggtggtagaacgtttccatgaactgtttgcccaaaccaagtataaagaagcagctgagcttgctgctgagtctccacaaggaatccttcgcacacctgatacagttgccaaatttcagagtgttcctgtgcaagctgggcaaactcctccactattgcagtattttggaacacttctaacaagaggaaagctgaatgcctttgagtcattggaattgtcacggctggttgtgaaccagaacaagaaaaatcttttggagaattggttggcagaggacaagcttgaatgcagtgaggagctaggagatcttgtaaagactgtggataatgatcttgccttaaaaatatacatcaaagccagagctactccaaaagttgttgctgcttttgctgagagaagggagtttgacaagattctgatatactctaagcaggttgggtacacgcctgactatctcttccttttgcaaacaattctccggacagatcctcagggtgctgttaattttgcattaatgatgtcgcaaatggagggaggttgcccagttgattacaacaccataactgatctgtttcttcagagaaatctgatccgtgaggcaacagcttttctgctagatgttctgaaaccaaatctaccagaacatgggtaccttcaaactaaggtgttggagataaatctagttactttcccaaatgttgctgatgcaattttggctaatggaatgttcagccattatgaccgtcctcgtattgctcaactttgtgaaaaagctggtctttatgtgcgatctttgcaacattacacagagttgccagatataaaacgtgtaattgtaaatacacatgcaattgagccacagtcactcgttgaattttttggtactctgtcacgagaatgggcattagagtgcatgaaagatctattgctggtcaatcttagaggcaacctacagattattgtgcaggttgctaaagaatattgtgaacaattgggcgttgatgcttgcataaagctttttgagcagttcaggtcatatgaagggctgtattttttcctgggatcatatttgagctccagtgaggatcctgacattcactttaagtacattgaagcagctgcaaagactggacaaatcaaagaggttgagcgtgtgactagagaatcaagtttctatgatcctgagaaaacaaagaactttctaatggaagctaagcttccagacgcacgacctctaattaatgtttgtgaccggtttggatttgttccggatctaacacactatctatacacaagcaacatgcttcgttacattgaaggttatgttcagaaggtgaacccagggaatgctcctttagtcgttgggcagcttttagatgatgaatgcccagaagattttatcaaaggcttgattctctctgttcgttccttactgccagtggagcctcttgtggaggagtgtgaaaagaggaatcggcttcgtttgctcacacagtttttggaacatcttgtaagtgagggaagccaggatgtacatgttcacaatgcactgggtaaaatcatcattgatagcaacaacaatccagaacattttctcactaccaacccatactatgattctcgagttgtgggcaaatattgtgagaaacgtgatcccaccttggcagttgtagcttataggcggggacaatgtgacgacgaacttatcaatgtgacaaacaaaaattctttgttcaaactacaagcaagatatgttgttgagaggatggatggtgatctttgggagaaagttcttaaccctgataatacctacagaaggcaacttattgatcaggttgtatctacagctcttcctgaaagcaagagccccgaacaagtatctgcagctgttaaggctttcatgactgctgatctacctcacgaattgattgagcttcttgagaagattgtgcttcagaattctgcattcagtgggaactttaatctgcagaatctgcttattttaacggcaataaaggctgatccgtccagagttatggattatattaatagactagataattttgatgggcctgcagttggagaaatggctgttgaggctcagttatatgaggaagcatttgcaattttcaagaagttcaacttaaatgtccaagcagtcaatgtcttgctagataatattcatagcattgatagagctgtggagtttgctttccgagttgaagaagatgctgtttggagtcaggtggccaaggctcaactaagggaagggctagtaagtgatgccattgagtcctttatacgagctgatgatgccacacaatttttagatgttatccgtgctgctgaagatggcaatgtttaccatgacttggtgagatacttgctgatggtaaggcagaagacaaaagaacccaaggtggacagtgagctcatttatgcatatgcaaagattgataggctaagtgacattgaggagttcattcttatgccaaatgtagccaatcttcaaaatgttggtgaccaattgtatgatgaagaactatatgaggctgccaaaatcatatttgcctttatatctaactgggccaagttagcagttacacttgtgaagttgaaacagttccaaggtgcagttgatgcagcaaggaaagctaacagtgcaaaaacatggaaggaagtttgctttgcatgtgttgacgcagaggagttccgtttggcccagatatgtgggcttaacattattattcaggtggatgacttggaagaggtcagtgaatattaccaaaatagaggttgcttcaatgagctaatatccctcatggagagtggtttaggattagaacgggcacatatgggtatctttacagagttaggagttctgtatgctagatatcgttatgagaagctcatggagcatatcaaactatttgcgacccgactcaatattccaaaactcataagagcttgtgatgaacaacaacattggaaggagctgacctatttgtacatccaatatgatgagtttgataatgctgcaacaaccatcatgaaccattcacctgaagcatgggatcacatgcaattcaaagatgttgttgtcaaagttgctaatgtagagttgtattacaaggctgttcacttctatttacaagagcatccagatcttatcaatgatgttttgaatgtccttgcacttcgtgttgatcatgcacgtgttgttgacatcatgcgaaaggctggtcatctccgtcttgtcaagccttacatggttgcagttcagagtaacaacgtgtctgctgttaatgaagccctgaatgaaatatatgttgaggaggaagactatgatagattgcgcgagtcaattgatttgcatgataactttgaccaaataggccttgcacagaagattgaaaagcatgagcttcttgagatgagacgtgtcgctgcttatatttacaagaaggcaggtagatggaaacagtccattgccttgtcaaagaaagataacctttacaaagatgccatggagacagcctcacaatctggtgaccgtgaacttgctgaggagttgcttgtttatttcattgatcagggaaagaaagaatgctttgcctcgtgtctatttgtttgctatgatttgatccgggcagacattgctcttgagttggcctggatgaacaatatgattgactttgccttcccatatctcctgcagtttatccgtgagtacactggcaaagttgatgaactggtgaaggataaaatagaagcgcagaaccaagtgaaagctaaagagcaagaagagaaggaagtaattgctcaacagaatatgtatgctcagttgttgcctcttgctttgcctgcaccgccaatgcctggaatgggaggaggctttgcccctccccctccaatgggtggattggggatgcctccaatgccaccttttggtatgccacccatgggtagttactgacagataagttcggcaatgaactcaagtgtataccgagagcagtgtagcaacttgggagttttcaaacattttcttttggtgttttaatgcagtattctttccttgcttctaatggaagaggaggttcaggtcaaaataatttcaaatttctgttggggggtttgtgtcatatttttgtaatatttttttatagttgaggcatttttttgggctgcttgcacgagctagccgaggattttctgtatgtaaccatttttcttgtattaaatgatggtccaaagtattataatacgaaatagaacccactttgactccaagccaatgtttgtcatggcctagatttattccacttttccttgtgatggaaactacctgattaaagcttgttggcatgttttgtttgttatgtgcatcttctaaatacgtggtttattgcca

SEQ ID NO: 5167 - DNA, 5537 bp, Solanum lycopersicum
ttatctttgatctcgccatcatggcggctgccaatgctcccatcaccatgaaagagacccttacgttgcaaagtataggggtgaacccgcagttcatcacattcactaatgttaccatggaatcggataagtatatatgtgtaagggagacgtcgcctcagaatagtgtggtgattattgatatgaacatgccaatgcaacctttgaggcgtccaattacggctgattctgctcttatgaatcctaattctagaattttggctctaaaagctcaagttcctggaaccagtcaagatcacttgcagattttcaatattgaggcaaaacagaaaataaaatcatatcagatgcctgagcaggttgttttctggaaatggattacaccaaagatgttaggtcttgttacacaaacggctgtctatcattggccaattgaaggggactctgagcctgtaaagatgtttgatagaacggccaatttagccaacaaccaaataatcaactaccgatgtgatccttctgagaaatggttggttttgattggtattgccccaggttcaccagagaggcctcaactggtcaaaggaaacatgcaattattttcagtggatcagcaacgcagtcaagctctcgaggcacatgctgcagcatttgcctcattcagggttcctggaaatgaaagggattccatactcatttcctttgccacaaagtcttccaatgctggacaagtcacatcaaagttgcatgtcattgagcttggagcccagcctggcaaaccatcttttacgaagaaacaggcagatctcttctttcctccagattttgctgacgatttcccagttgccatgcagatatctcataaatacagtttaatttatgtcatcacaaagcttgggcttctctttgtctatgacctcgaaacagctactgcagtgtacagaaataggatcagcccagatcctatttttctgacagcagaagcttcatctattggtggtttctatgccatcaacaggcgaggccaagttttgcttgccacagttaatgaagcaactctagtaccttttgtcagtggccaattgaataatctggagcttgctgtcaatcttgccaaaagaggaaaccttcctggggctgagaatttagttgtccagcggttccaagagttgtttgcccagacaaagtacaaagaagctgcagagcttgcagcggaatcacctcaaggcatactccgtacgcctgacactgttgccaaatttcagagtgttcctgttcaagcagggcaaacacctcccttattgcagtactttgggacacttttaacgaaaggaaagctaaatgcttttgaatcattggaactgtcgcgccttgttgtcaaccagaataagaaaaacctgttggagaactggttggctgaggataagctggagtgtagtgaggaactcggggatcttgtgaagactgttgataatgaccttgccctaaagatatatatcaaagcaagagcgactccgaaagttgttgctgcatttgctgaacgcagggagtttgacaagattctgatatattccaagcaggttggatatacacctgattatttgttccttcttcaaacaattcttcgatctgatcctcagggagctgttaactttgcgctcatgatgtcccaaatggagggtggttgtcctgttgattacaatactatcaccgatctatttctgcagaggaatatgatccgtgaggcaacagcatttttattggatgttctgaaacctaaccttccagagcatggctttctgcagaccaaggtcttggaaatcaatctcgtgactttcccaaatgttgctgatgctatattagcaaatggaatgttcagtcattatgatcgacctcggattgctcaactttgtgagaaagctggtctttacgtgcgggctcttcagcactattccgaactgcctgatatcaagcgcgtcattgttaatacacatgcaattgagcctcaggcgttggttgagttttttgggaccctttcacgtgaatgggcacttgagtgcatgaaggacctccttgttatcaatatcaaaggaaaccttcaaataattgttcaggttgcaaaagagtactgtgagcagttgggtgttgatgcttgcataaagctttttgagcaatttaagtcctatgagggattatatttcttcctaggatcatatttgagttccagtgaggatcctgatatccattttaaatatatcgagtcagctgccaggactggtcaaatcaaggaggttgagcgtgtcacaagagaatcaaacttctatgatgcggaaaagacgaagaacttcttaatggaagccaaacttcctgatgctcggcctctaattaatgtttgtgaccgctttggttttgttcctgacctcacacactacctctataccaacaatatgctacggtatatagaaggttatgtccaaaaggtcaacccaggaaatgcacctttagtcgtagggcagcttttagatgatgagtgtcccgaggattttattaagggattgatcctgtctgtgcgttctctgcttccagttgagcccctagtggaagaatgtgaaaaaaggaatcgactccgcttgctgacacagtttttggagcatcttgtaagtgaaggaagtcaagatgtgcatgtacacaatgctctgggaaagatcatcatagatagcaataacaacccagagcacttcctcacaaccaatccatactatgactcacgcgttgttggtaaatattgtgaaaagcgtgatcctacccttgctgttgttgcatataggagaggtcaatgtgatgatgaacttatcaatgtgacaaacaagaactctttgttcaaacttcaagcaaggtatgtggttgagaggatggatggtgatatttgggagaaagttcttaaccctgaaaatgagtttagaaggcagcttattgatcaagttgtttccactgctctgcctgaaagcaagagtcctgagcaagtttctgcagctgttaaagctttcatgactgctgatcttccccatgaattgattgaacttcttgaaaagatagtgctccagaattctgcattcagtgggaacttcaatctgcagaatttgcttatcctgacagctatcaaagccgatccatccagagtgatggactatatcaatagacttgataattttgatggacctgcagtaggggaggttgctgttgaagcgcaactttatgaagaagcttttgcaatcttcaagaagttcaacttgaatgtccaggctgttaatgttctgcttgacaacattcgtgatattaaccgggctgtggagtttgcattccgagttgaagaagatgctgtttggagtcaggtggctaaagctcaactaagagaaggattagtgagtgatgctattgagtcgtttattcgtgcagatgacgccacccactttttggatgtaattcatgctgcagaggatgcagatgtttaccatgacctggtgaagtatctcctgatggtaaggcagaagacaaaggagcccaaagttgacagtgaactcatttatgcatatgctaaaattgatcgattgggtgacattgaagagtttattctcatgccaaatgttgctaatctacctaatgttggtgacaagttgtttgatgaaggcttatatgaggctgcaaaaatcatatttgctttcatttctaactgggccaagttggccagcacacttgtgaagttgaatcaatttcaaggtgctgttgatgcagcacgcaaggcaaatagtgcgaagacatggaaagatgtctgctttgcttgtgtcgatgctgaggagttccgattggctcaaatttgtgggcttaacattatagtgcaggtggatgacttggaggaagttagtgaatattaccaaaatagaggatgttttaatgaattaatctctcttatggagagtgggttgggtttggagcgtgcacatatgggtatcttcacagaacttggtgttttatatgctagatatcgtcacgagaagctcatggagcacattaaattattctccaccagactcaacattcccaagcttattcgtgcctgcgatgagcagcaacactggaaggaactcacatatttgtacatccaatatgatgaatttgataatgctgccaccactgttatgaatcactctccagatgcctgggatcatatgcagttcaaagacattgttgtcaaagttgctaatgtggagctttattacaaggctgtccacttttatttgcaagagcatcctgatctcattaatgaccttctaaatgttcttgcacttagagtagatcacacacgcgtagtggacataatgagaaaggctggtcaccttcgcctagtcaagccttacatgattgctgttcagagcaacaatgtttctgcggtgaatgaggcacttaatgaaatttatgtcgaggaagaagactatgataggctacgtgaatcaattgagttgcatgataactttgatcagataggccttgctcagaagatagagaagcatgagcttcttgagatgaggcgtgttgctgcttctatctataagaaagctggtaggtggaagcaatctattgctttgtcaaagaaagataatctctacaaagatgctatggagacagcctcacaatctggagatcgcgaacttgcagaggagttgcttgtttacttcatcgaacagggaaagaaagaatgctttgcatcatgcctctttgtttgttatgatttgattcggccagatgttgcccttgagcttgcctggatgaataatatgattgactttgcattcccttacctgttacagtttatccgtgaatacactggcaaggttgatgagctaataaaagataagattgaagctcaaagtgaagcaaaagccagagagaatgaagagaaggatgttatgaaacagcagaatatgtatgcacagctgctgccattggctttgcctgctccaccaatgccaggcatgggaggaggttttgctgcgccaccccctccaatgggtgggatgggaatgcctcccatgcctccatttggcatgccaccaatgggtccctactaatatgatggtgttcaatatactggtttaaacagaactgggcaggcaaaaagatgatctggggttcttttgcattttgtttagggttattgcccttgtatttttgtcacttgcgttgcagttgttgaccactcgtggaggctttgataaaataattgttctgttgtgtgttatagggtgttgatatatctctcctttgtaatattcttttagaagaggcattttttttttgtagttaggcagaaagggggaaatttttattatgaaggaccaaagagatgcattaattttgcatcttgcattgatttgctggggtcggttaagtttaaggtgcttcatctccagttttgtaattgtttctagcttcatttccctgagggtataattatattacattttttctttttgtggttc

SEQ ID NO: 5168 - DNA, 5455 bp, Arnica chamissonis
agccggcgattcaatcaaagcaagtctcatagatcatatccacaaatccacatctgatctgatctgcagtcgttctgatatcttttgccaccgccatggcggccgccaacgctccgattactatgaaagaggcactcacgttgcccagcgtagggatcaattcacagtttatcacatttaccaatgtcacaatggagtcggataagttcatatgtgtgcgtgaaacatcacctcagaacagtgtggtgattattgatatgagcatgcctatgcagccgctgaggaggccaattactgctgactcagctctcatgaatcccatttccaagatactcgctttgaaagctcaactgccgggaactactcaagaccacttacaaatatttaatatcgagatgaaagccaaagtgaagtcccatcagatgcctgagcaggttgtcttttggaagtggattagccctaagatgttgggcatggtgacccaaacctcggtatatcattggtcaattgagggtgattctgaacccacaaagatgtttgataggacagccaatttagcaaacaatcagataattaactacagatgtgatccatctgagaaatggttggtattgatcggaattgcccctggctccccagagagacctcagctagttaaagggagcatgcagcttttttctgttgatcagcagcgcagtcaagctcttgaagcacatgcagcatcatttgcatctttcaaggttcctggcaatgacaatccttctattcttatatcttttgcaacaaaaagctctaatgctggacaggttacatcaaagcttcatgtcattgagcttggtgcccaaccaggcaaaccctcatttactaagaaacaggcagatttgtttttccctcctgactttgcagatgattttccagttgcaatgcagatatcccacaaatatggtttgatatatgtaattaccaaactggggcttctgtttgtgtatgaccttgaaacggccactgctgtttataggaataggataagcccagatccaatcttccttacctctgaagcctcatcagttgggggcttctacgctgtaaatagacgtggccaggtgttacttgcaaccgttaatgagtcgacaattgtgccttttgttagtgggcaactgaacaacctggaacttgctgtcaatcttgctaaaagaggaaatcttcctggtgccgagaatttggttgttcaacggtttcaagaactgtttgctcaaaccaagtacaaagaagctgctgaacttgctgcagaatctcctcaaggaattctgcgtacaccagatacagtggccaaattccagagtgtacctgtccaagctggacaaacaccaccgttgttgcagtactttggaacccttttaactaaagggaagctgaatgcttttgaatcattggagctatctcgtcttgttgtcaatcagaacaagaagaatcttttggagaattggttggccgaggacaagctggaatgcagtgaggagcttggagatcttgtgaagaccgtggacaatgatcttgcattgaaaatttacatcaaagcaagagcaacaccaaaagttgttgcagcttttgctgagcggagggagtttgacaaaattctaatttactccaaacaggttgggtacacacctgattatttgttccttctgcaaacgattcttcgatcagatcctcagggtgctgttaattttgctttgatgatgtcccaaatggagggaggttgtccagttgattataacacaataacagatctttttcttcagaggaacttaatacgtgaggccactgctttcctcttagatgtccttaaacccgatctgcctgaacatgctctcttgcaaaccaaggttcttgaaatcaatcttgtgacattccctaatgttgctgatgctatattggcaaatgggatgtttagtcactatgatcgtcctcgcattgctcaactttgtgagaaagcaggttctttttgtccgagcccttcagcattatagtgaattgccagatattaaacgtgtcatcgtcaacactcatgcaattgagccacagtctcttgtagaattttttggtacactatcaaaggagtgggccctggagtgcatgaaggatcttttgctggtcaatctaaggggaaatcttcagataatcgtgcaggttgccaaagaatactgtgagcagttgggggttgaagcatgtatgaaactctttgagcaatttaaatcatatgaaggcttatacttctttttggggtcgtatttgagttccagtgaggatcctgatatccactttaagtacattgaggcagctgcaaagactggacaaatcaaggaagttgagcgggtaacaagagaatcaaacttttatgacgccgagaagaccaaaaacttcctgatggaagccaagcttcctgatgcaaggccgttgataaatgtgtgcgaccgttttggctttgtccctgatctgactcactatctctataccaacaacatgctccgttatatcgaaggttatgttcagaaggtcaaccctgggaacgcaccattagttgtaggacagcttctagatgatgagtgtcctgaggatttcatcaaaggcttgattctgtctgttcgttctttgcttccagtcgagcctcttgtggatgaatgtgagaagaggaaccgtctgcggttacttactcagtttttggagcatctcgtgagtgaaggaagtcaagatgtccatgttcacaatgctttgggtaaaattatcatagatagcaataataacccagagcatttcctaaccaccaatccctattatgattcacgtgttgtgggtaaatactgtgagaagcgtgatcccacacttgctgttgttgcataccgtagaggtcaatgtgacgaagaacttgtcaatgtcacaaacaagaattctctctttaagctgcaagccagatatgttgttgagagaatggatgctgatctatgggataaggttctcaaccctgagaatgaatacagaaggcaacttattgatcaagttgtatctaccgctttgcctgaaaccaaaagccctgagcaggtttctgctgctgttaaggcttttatgaccgctgatcttccccacgagctaatcgagcttcttgagaaaattgtacttcaaaactctgctttcagtggaaacttcaacctccaaaacctgcttattttaactgccattaaagctgatccatcacgagttatggactacatcaacagattagacaactttgatggacctgcagttggtgaggtggccgtagaagcacaactatatgaagaagcatttgcaatattcaaaaaattcaacttaaacgtgcaagcagtcaatgttctattggataacattcaaagtattccacgtgctgaagagtttgccttccgtgttgaagaagatgctgtctggagtcaggtggcgaaagctcaactaagagaagggttagtaagtgaggcaatagagtcattcattcgagccgatgacgcgacccacttcttggatgttattcgggcttctgaagacaccgaatgctaccatgatttagtgaaatatctactaatggttagacaaaagaccaaagagcccaaggtggatagtgagctcatatatgcatatgccaaaattgatagattgagtgacatcgaggagttcattctcatgcctaatgtagctaacctgcataatgttggtgatcgcttgtttgatgaagctttgtatgaagctgctaaaataatatatgcttttatctccaactgggctaagcttgctgtcacacttgtaaggctgcaacagtttcaaggtgctgttgatgctgctcgtaaagccaatagtgcaaagacatggaaagaagtttgctttgcttgtgttgatgctgaagagttccgtttggctcaaatttgtggtctgaatattattgtgcaggtggatgatctggaagaggttagtgaatactaccaaaacagaggatgcttcaatgagctaatatctctaatggagagtggtctaggtttggaacgtgctcacatgggcatcttcacagagttaggcgtcctttacgcccgttaccgtcacgagaagcttatggaacatatcaaactcttctcaacacgtctcaatatcccaaaactaatccgtgcttgtgatgagcaacaccactggaaggaactcacttatttgtatatccaatatgatgagtttgataatgctgcaactactgtcatgaatcattctcctgaagcttgggatcacatgcagttcaaggatattattgtcaaagtagcaaacgtcgagctttattacaagtctgttcacttttatcttcaagaacatcctgatcttataaatgatgttctcaatgttcttgcattacgtgttgaccatacacgtgtcgttgacattatgcgcaaggcggggcaccttcatcttgtgaaaccatacatggttgcagttcagagcaataacgtgtctgctgtaaacgaggcgttgaatgaaatatatattgaagaggaagactatgatagattgcgtgaatctattgatttacatgataactttgaccagatcggccttgcacaaaagattgagaaacacgagctacttgagatgaggcgtgttgcagcatatatctacaagaaggcaggcagatggaaacaatcaattgcattgtccaaaaaggacaaggtgtacaaagatgccatggagactgcctcacaatctggggatcgtgagctcgctgaagagttgcttgtttacttcattgagcagggaaagaaagaatgctttgcttcatgcctctttgtttgctatgatttaattcgtccagatgttgcccttgagctcgcttggttgaacaacatgattgatttcgccttcccatatctgcttcagtttatccgtgaatataccggcaaggttgatgatctaatcaaggacaagatcgaagcggtcaaggaaagtaaagccaaggagaatgaagagcaggatgtcctcaagcagcagaatatgtacgcccagctattgccacttgcgctacctgcaccaccaggtatgggtggtggatacggtcaaccaccgccaatgggaatgccaccaatgccgccattcggcatgcctccgatgggctcttactgattttgtgatggcaaagatgagaaatttacgcgggttccacttcgtacgggcaactttcttgtggttaataataataatgggaattatgtgtttttgtagggtgtggataagtttttcttgtaatattcttcgggttgctgtagcggaggcgttttttgttgttacggttgagtatgattatatatcgtataccaaaactaggtctgtatatcttactttttccatgatttcttcttagcattgattgtattatactattatgtgatgtcta

SEQ ID NO: 5169 - DNA, 5588 bp, Euphorbia peplus
tgattcgctagggtttcaatcgctgctgctacagatctcgcagcgattcgaacccctcgccttgctttttccacttcaatttcactcgcagatccgcttccctaacttttgagccgccgctcgatctcgccgcctccgtcgccatggcggccgctaatgctccgatcgccatgaaggaagtgttaactttgcctagcattgggatcaatccgcagttcatcacatttacaaatgttactatggagtcggataagtatatatgtgtaagggaaactgctccgcagaatagtgttgtgattattgatatgagtatgcctaatcagcctttgagaaggcctattacggcggattctgcgcttatgaatcccaactctagaatccttgctttgaaagcccaaatccaaggaactacccaggatcacctacagatatttaacattgaaatgaaagctaaattgaaatcataccagatgcctgagcaggttgtcttttggaagtggataagcccaaaaatgctgggcttggtcacacagacttcagtttatcattggtcaactgaaggtgaatctgaacctgtcaagatgttcgacagaacagctaatttggtgaacaatcaggttataaattatcgatgtgacccttctgagaagtggttggttttgattggaatagcgcctggctcacccgagcgtccacaattggttaaagggaacatgcaacttttctccgtagaacaacagcgcagtcaagctcttgaagcacatgctgctgcatttgcacagtttaaggttcctggaaatgagactccttctactctcatttcttttgcaacgaaaagtttcaatgctgggcagattacatcaaagttacatgtcattgagcttggtgcccagccaggcaaaccgtcattctcgaagaaacaggctgatcttttctttcctccagactttgctgatgacttccctgttgctatgcagatatcgcacaaatacagtttgatctatgtgatcaccaagcttgggctgctttttgtttatgatttggagaccgcgacagccgtatacagaaatagaatcagtccagatcccatatttttgacatctgaagcttcatcagtgggaggattttactctattaataggcgaggccaggtgctattggccacagttaacgaagcaacaattgtttcatttgttagtggacaattgaataatttggagcttgctgttaatcttgccaaaagaggaaatcttcctggtgcagagaatttggttgtccagcgtttccaagagctgtttgctcaaacaaaatataaagaggctgctgagcttgctgctgaatctccacaaggaatccttcgaacgccagacacagttgccaaatttcagagtgttccagtgcaatctgggcaaacaccccctctattgcagtattttgggaccctcctaacaagaggaaagcttaatgcattcgagtcattggaattatcacgcctggttgttaatcagaacaaaaagaatctcttggaaaattggttggcagaagacaaattggagtgcagtgaggaacttggagacctcgtgaagactgtggataatgacctggcactaaagatttatattaaagccagagctacaccaaaggttgttgcagcttttgctgagaggagggagtttgacaagattttgatttactcaaagcaggttgggtacaaccctgattatttgttcctcttgcaaacaattctacggtcagatcctcagggagcagtaaattttgctttaatgatgtctcaaatggagggaggatgtccagttgattacaataccatcactgatctttttctccagaggaacctgatacgtgaggcaacagcgtttttgttggatgttttgaagccgaatctgccagaacatggttttctacagacaaaggtcctggaaattaacttggttacatttccaaatgttgctgatgctattctagccaatggaatgttcagccactatgaccgccctcgtattgctcaactatgtgaaaaagctggtttatatatacgagccctgcaacactatgctgagttgccagatatcaagcgtgtgattgttaatacgcatgcaatagagccccaggcacttgtagaattttttggtactctttcacgggaatgggctttggagtgcatgaaggatctgctgctggtcaaccttagaggcaacctgcaaataattgtgcagactgcaaaggaatactgtgaacagttgggtgttgatgcgtgcataaaacttttcgagcaatttaaatcctacgaaggactctactttttcctgggatcatatttgagttcaagtgaggatcctgaaatacacttcaagtacattgagtctgctgctaaaactggacagataaaggaagttgaacgcgttactagagaatcgaatttttatgatgctgaaaagacaaagaactttctgatggaggccaagcttccagatgcaagacctctgattaatgtttgtgatcggtttggttatgtggctgatttaactcactacctgtactcaaacaatatgcttcgctatattgaaggttatgtgcagaaggtcaacccaagtaatgcccctctagtcgttggacaactgctggacgatgagtgccccgaagacttcattaagggcttgattctttctgttcgttctttgcttcctgttgagcctcttgtggaggaatgtgagaaaagaaatcgacttcgtttgctcactcagttcctggagcatctcgtgagtgagggaagccaagatgtacatgttcacaatgctcttggtaaaatcattattgatagcaataacaatcctgagcacttcctcacaaccaacccttactatgattctcgggttgttggaaaatattgcgagaaacgtgatcctactctggctgttgttgcgtatagaaggggacaatgtgatgaggaacttatcaatgtcacaaacaagaactctctgttcaaattacaagccagatatgtggtggaaaggatggatggtgatttgtgggagaaggttcttgttcctgagaatgaatacagaagacagctcatcgatcaagttgtttctactgctttgcctgaaagcaagagcccagaacaagtttctgcagcagtaaaggctttcatgactgctgatctgccccatgaattaattgaacttctggagaagattgtgcttcaaaactctgctttcagtggaaatttcaacctgcaaaatctacttattctgacagctattaaggcagatccatctagagttatggattacatcaacagattagataattttgatggacctgctgttggggaggtggcagtagaagctcagctatatgaggaggcatttgcaattttcaagaagttcaacttaaatgttcaggctgtcaatgttttgcttgataatcttagaagcgttgaccgtgcagtggaatttgcattccgtgttgaagaggatgctgtttggagccaggtagctaaggctcaactgagggagggcctggttagtgatgcgattgaatcatttattcgtgcagacgatgctactcaatttctggaggtcattcgtgctgctgaagatgcaaatgtatatcatgacttggtgaagtacctcttgatggttaggcagaagacaaaagaacccaaggttgacagtgagcttatttttgcatatgcaaagattgataggcttggtgaaattgaggaatttattctcatgccaaatgtggcgaatttgcaaaatgttggtgatcgtttgtttgatgatgctttatacgaggcagccaaaataatcttcgcattcatttcaaactgggccaagttggctgtcacccttgtgaggctgaaacagttccaaggtgctgttgatgcagcacgaaaagccaacagcgcaaagacatggaaagaagtttgctttgcttgtgttgatgcggaggagttccgtttggctcagatatgtggtctcaatattattgttcaggtagatgatttggaggaggtcagtgaattttaccagaacagaggatatttcaatgaactaatctcccttatggagagtggtttagggttagaacgtgctcatatgggtattttcacggagttgggagtcctgtatgctagatatcgtcctgagaagctcatggagcatattaagttgttctcaactcgtcttaatatcccaaagttgatacgtgcttgtgacgagcaacaacattggaaggagctaacctatttgtacatacaatatgatgaatttgataatgctgcaaccactattatgaaccattcgccggaagcttgggatcacatgcagttcaaagatgtagctgtgaaggttgcaaatgttgaactgtattacaaggcagttcatttctacttgcaagagcatccagatctcatcaatgatcttctcaatgtgctggcactccgagtagatcatactcgtgttgttgacatcatgcgaaaggctggtcaccttctccttgtgaagccttatatggttgcagttcagagcaataatgtgtctgcggtgaacgaggctttgaatcagatatatgtggaggaggaagactatgagagattgcgcgagtcaattgatatgcacgacaactttgatcagattggtctggcccagaagattgagaaacatgaacttcttgaaatgaggcgtgttgctgcatacatttataagaaggcaggcagatggaagcagtccattgcattgtcaaagaaagataacctctacaaagatgccatggagacggcatcccaatctggtgatcgtgaacttgcagaagagttgcttgtttatttcattgaaaagggcaagaaggaatgctttgcgtcatgtctctttgtttgttacgatttgatccgaccagatgttgctcttgaacttgcatggatgaataatatggttgattttgccttcccatacctcctgcagtttatccgtgagtacactggcaaagttgatgaacttgtgaaggacaaactagaggctcagaaggaaaacaaagccaaggaacaagaagagaaggatgtcattgctcagcagaatatgtacgcacagttactacctcttgctttgccagctccaccaatgccaggtatggctccgccaatgccgggtatggctggaggatacggacaaccaatgggaatgcctgcgatgccaccttacggcatgcctggttattgattttcaggtgatccttttttgtagagtcttagctgtgattccaagttgcttatttgaaagggcacgtgagctataggagtttcggctttacatatggcagtttttactgattctctgtgcctttgctcgatttcgtgcttgatttggtgcgttgaagatatagcttgtaataatgtgcattttttgttttaaagctttaggggtgtggatatgtgttgtaatattcttttttggtaggcatttttttggctgctcctccgagggcgagctgtggattttctgcatctgtattttgtttttttttccattcgccatgcagtttaggaactggccaaatatagtacg

SEQ ID NO: 5170 - DNA, 5400 bp, Eutrema halophilum
tctccttccatcacattttctcgttcacttgcttcagatctggcagcgatttcaattccttctccacactctctctctcgtctctctcttggccgttgacggtctcgtcccggccttggatctgattctcttgccgcgatctgaggtcaatcatggcggcagcaaacgcccccatcacgatgaaggaggtcctgacgcttcctagcattgggatcaatcagcaattcattacgtttacaaatgttacaatggagtctgacaagtatatatgtgtacgagagacggcaccacagaacagtgttgtaattatagatatgaatatgccgatgcagcctctaaggaggcctattactgcagattctgcccttatgaacccaaactccaggatccttgccttaaaagctcaagttccaggaactactcaggatcatctacagatatttaacattgaagcaaaagcaaagttgaaatctcatcagatgcctgaacaggttgccttttggaagtggattacaccaaagatgttggggctggtcacacaaaattccgtgtatcattggtcgattgaaggtgattctgagccagttaagatgtttgatagaacggccaatttggcaaacaatcaaattataaactacaagtgctctcctaatgagaagtggctggttttaattggaattgctcctggctctcctgagagagcacaattggtcaaaggaaatatgcagcttttttctgtggatcaacagcggagccaggccctggaagcacatgctgcgtcatttgctcagtttaaggtccctgggaacgagaatccttctattcttatatcctttgcaagcaagagctttaatgctgggcagataacatcgaagttgcatgtcattgagcttggtgcccaacctggaaaaccatcatttacaaaaaagcaggcagatctcttttttcccccagattttgctgatgattttcctgttgccatgcaggtctctcacaaatttggcttaatatatgtcatcaccaagcttggtttgttgtttgtatacgatctagagactgcttctgcggtctacagaaatcgtataagtccagacccaattttcttgacttctgaagcttcctcagttgggggtttctatgccattaataggagaggacaagttcttttggctacagtaaacgaggctaccatcataccttttattagtggtcaattgaacaatttggagcttgctgtcaatcttgccaaaagaggaaacctccctggtgcagaaaatctggttgttcagcgattccaagagctgttcgctcaaacaaagtacaaggaggctgctgagcttgctgctgaatctcctcaaggaattctaaggacacctgatacggtggctaaattccagagtgttcccgtacaagctgggcaaactcctccattgttacagtattttgggactcttttgactagagggaagctaaatgcgtatgagtcattggaactatctcggcttgttgtgaatcaaaacaagaagaacctcctggaaaactggttagcagaggataagttagaatgtagtgaagaactaggagaccttgtcaagactgtggataacgaccttgctctgaaaatatacatcaaagcccgggcaactccaaaagttgtagcagcttttgcagaaagaagggagtttgacaaaatactgatttactcaaagcaggttgggtacacacctgattacatgtttcttctgcaaaccatactccgtacggatcctcagggagcagtaaattttgcactaatgatgtctcaaatggaaggaggttgtccagttgacttcaacaccatcactgatctatttcttcagagaaatctgatccgagaagcgactgctttccttttggatgtgctgaagccaaatttagctgaacatgcttttctgcaaactaaggttctggagattaatttggtaacctttcctaatgtggctgatgcgattttagcaaatgggatgtttagccactatgaccggcctcgtattgcccaactttgtgaaaaggctggactttatatccaatccttaaagcattactcagagttacccgatataaaacgtgtaattgtgaacacacatgctattgagccacaggctcttgttgagtttttcggtactctttctagcgagtgggctatggagtgcatgaaggatcttttgctggtcaatttgagaggcaatcttcagataatcgttcaggcttgcaaagagtactgcgagcaacttggtgttgatgcatgtattaagctctttgagcagttcaaatcatacgaagggctatactttttcctaggttcatatttgagtatgagtgaggatcccgagattcacttcaagtacattgaagcagctgccaagactggtcaaataaaggaggttgagcgtgtgactagagagtcgaacttctatgatgctgaaaagacgaagaactttttgatggaagctaagcttcctgatgcccgacctttgataaatgtctgcgaccgtttcggctttgtgcctgatcttactcattacctttacacaaacaatatgcttcgttacattgaaggttacgttcaaaaggtgaaccctgggaatgctcccttagttgtggggcagttgcttgatgatgaatgccctgaagattttataaaaggcctcattctctctgttcgttcattgctacctgttgaaccccttgtggaagaatgcgagaagagaaatcgactccgtctcctcactcagttcctggagcatctagttagcgagggaagccaagatgttcatgtccataatgccttgggtaaaattattatcgacagtaacaacaaccctgagcatttcctgaccaccaacccgtactatgactctcgggttgtgggtaagtactgcgagaaacgtgatcctaccctggctgttgtggcatacagaagaggacaatgtgacgaggaactcatcaatgtcaccaacaaaaactctttgttcaagttacaagccaggtatgtagtggagaggatggatggtgatctctgggataaggttcttgatgaaaacaatgattatagaagacaacttattgaccaagtcgtttctactgctttacctgaaagcaagagcccagagcaagtttctgcagctgttaaagcattcatgactgccgatttgccgcacgagcttattgagcttcttgaaaagattgtgcttcaaaactctgccttcagtggaaacttcaatctacaaaatctgcttatattgacagctatcaaggcagatccatctagagttatggattacattaacaggctggacaactttgatggacctgctgttggagaagtggcagttgaagcccaattgtatgaggaagcctttgctatttttaagaaatttaacttaaatgttcaggctgtcaacgtattgctggatagcgtcaaaagcattgagcgtgctgttgagtttgctttccgagtcgaagaagatgctgtctggagccaagtcgcaaaggctcaactcagggaaggactagtcagtgatgcaattgaatccttcatccgtgctgatgatgccactcatttcttggaggtcatacgtgctactgaagatgctaatgtctatgatgacttggtcagataccttctgatggttagacagaaggtgaaggaacccaaggttgatagtgagctcatctatgcatatgcaaagattgataggttaggtgagattgaagaattcattctgatgccaaacgttgctaacctacaaaatgttggtgatcgcctgtatgacgaagctctatatgaggctgctaaaataatctatgcgttcatatcaaactggggcaagttagctgtcacgcttgtgaagttgcaacagttccaaggtgctgttgatgctgcaaggaaagcaaacagtgcaaagacatggaaagaagtatgctttgcttgtgttgatgcagaggaattccggttggcccagatatgtggtcttaacattatcattcaggtggatgacctggaagaagtcagcgagttctaccaaaacagagggtgctttaatgaattaatctcacttatggagagtgggcttgggctggagcgtgctcacatgggtatcttcactgagttgggtgtactctatgctagatatcgttatgaaaaacttatggaacatatcaagttattctccactcgccttaatattcccaagcttatacgggcctgtgatgaacaacagcactggcaggaacttacctacctgtacattcaatatgatgagtttgataatgccgcgaccactgtcatgaaccattctcctgaagcatgggagcacatgcaattcaaagatattgttgccaaggttgcaaatgtcgagctgtactacaaggctgtgcacttctacttacaagagcatcctgatctaatcaatgatcttctcaatgtgcttgctttgcggttagatcacacacgtgttgttgatattatgcggaaggctggtcagttgcgtcttatcaagccatacatggttgcagttcagagcaacaatgtctctgctgttaatgaagctctgaatgagatatacgtagaggaagaagactacgataggttacgcgagtctattgatttccatgacagctttgaccagataggccttgctcagaagattgagaaacacgagcttgtagaaatgagacgtgtggctgcttatatctacaagaaagcagggagatggaagcaatcaattgctttgtcaaagaaagatagcatgtacaaagactgtatggaaactgcttcacaatctggcgaccacgaacttgcagaacaactgctggtttacttcatcgaacagggcaaaaaggaatgctttgctacgtgtctttttgtatgttatgatttaatccgaccagacgttgctctagaacttgcctggatcaacaatatgatcgactttgccttcccgtatctactccagtttatccgagagtacacgggcaaagtggatgagctaatcaaggacaagctggaggcacaaaaagaggtgaaggccaaagagcaggaagagaaagaagtcatgtcccaacagaacatgtacgcacaattattgccacttgctttacccgcaccaccgatgccaggaatgggaggtggtggatatggtccgccaccaccaatgggcggaatgccaggaatgcctcccatgccaccatttggaatgccgccgatgggtggctactaagacacacacttttgtttgaatcctcacatttggaaagtttacctgtcaagttatctgaaacacaatagagtcagccaatttcccggtgcagtgttcgtctgctacacgtccctggccagaacttgtctgggtgaataat

SEQ ID NO: 5171 - DNA, 5882 bp, Amborella trichopoda
cgccatggctgctgcaactgctccgatcactatgaaggaagctctgacgttgacaagcctgggtataaatcctcaatttatcacatttacacatgtgaccatggagtcagagaaatatatttgtgttcgagaaactgctcctcagaacagtgtggtgattattgacatgaatatgcctatgcaacctctgagacggcctattactgctgactcagctttgatgaaccccaacagcaggattcttgctctgaaagctcaaatacctggaactacacaagaccacttgcaaatatttaatatcgagatgaaggcaaaaatgaaatcacatcagatgccggagcaggttgtcttttggaagtggattactccaaagatgttgggcttggtcacacagacctcagtgtaccactggtcaattgaaggtgattctgagcctgtaaagatgtttgagcgaacagctaatttgctgaacaatcaaataatcaactatcggtgtgatccctctgaaaagtggcttgttttaattggaattgctcctggtgctgctgagaggccacaattggtcaaagggaacatgcaactcttctcagtcgatcagcagcgaagtcaagctctcgaagcacatgctgcatcatttgcatcaattaaagtggctggcaatgaaaatccttccactcttatttgttttgcctcaaaaaccactaatgcaggccagattacctcgaaattacatgtgatagaacttggtgctcagccaggtaagcctggctttacaaagagacaagcggacctttttttccctcctgattttgctgatgactttcctgtggcaatgcagatatcacataaatacagtttgatttatgtgatcacaaagcttgggcttctattcgtttatgacttggagactgcaacagcagtttacagaaaccgcataagccccgatccgattttcctaacgacagaggcttcgtcactgggaggattttatgctgtcaataggcgtggccaagtgcttcttgcaacggtcaatgaagcaaccattgttccttttgtcagtggtcagctaaacaacctggaactcgcagtgaatcttgccaaacgagggaatcttccaggggcagagaatttggttgtacagcgtttccaagagttgttttctcagactaaatacaaggaggctgcagaacttgctgcagattctccacaggggatcctccgtacccctgatactgtagctaagtttcagagtgttcctgttcaatccggacaaacgccaccactgctacagtactttgggacactactgacaaaaggaaagctgaatgcctttgagtctctggagttgtctcgcttggtcgtaaatcagaacaaaaagaatcttctggagaattggttagctgaagacaagcttgagtgtagtgaggaacttggggatcttgtgaagactgtggataatgatcttgccctcaagatatatattaaggcgagggctactccaaaagttgttgcagcctttgctgaacgaagggagtttgacaaaatactcatttactcgaagcaggttggttatacacctgattatctcttccttctgcaaacaattctgcgaacagatcctcagggagcggttaattttgcccttatgatgtcacaaatggaagggggttgcccagttgactataatacaattacggatctcttccttcagagaaatatgatccgagaggcaactgccttcctgttggatgttttgaaacccaatttgccagaacatgccttccttcaaacaaaggtcctggagattaatctggtaacgtttcccaatgtggctgatgctattttagctaatgggatgttcagtcactatgaccgacctcgggttgcccaactttgtgaaaaagcgggcttgtatatgcgtgcccttcagcactacacagagttgcctgatatcaaacgtgtcattgtgaacactcatgctattgagcctcagtcacttgtagagttctttggaaccctttccagggagtgggcactggagtgtatgaaagatcttttagtggttaatctgagaggaaaccttcaaataattgttcaggttgccaaagaatattctgagcagttgggagtggatgcttgtatcagaatttttgagcaatttaagtcctatgaaggtctttatttctttttggggtcgtatctgagctcaagtgaggatccagatattcatttcaagtatattgaggcagcagccaagacgggacaaataaaagaggtggagcgtgtcacaagagaatcaaacttctatgatcctgagaagacgaagaactttttaatggaagccaaacttccagatgcacggccattgataaatgtttgtgatcgttttggatttgtaccggatcttacccattacttgtactcgaacaacatgctgcgctatattgaaggctatgtccaaaaggtgagccctgccaatgctccattagtggttgggcagcttctagatgatgaatgcccagaagatttcatcaagggtcttattctttctgtccgttcactccttccggttgagccccttgttgaagaatgtgagaagagaaatcgccttcgtttgctcacccagttcttagaacatcttgttagtgaggggagccaagatgttcatgttcacaatgcattgggtaaaatcatcatcgacagcaacaacaacccagaacatttcctcaccaccaacccttactatgattcccgtgttgttggcaaatattgtgaaaagagggatcccactttggctgttgttgcatacagacgagggcagtgtgatgatgagctcatcaacgtcaccaataagaattctctctttaagctgcaggccaggtatgttgtagagaggatggaacctgagctctgggaaaaagtgctcaatcctgagaacacatacaggcggcaacttatcgatcaagttgtgtctactgctctacccgaaagcaagagcccagagcaggtctctgcagcagtgaaagcttttatgactgctgatcttcctcatgagcttatcgagctccttgagaagattgttctccaaaactctgcattcagtggaaacttcaatcttcaaaacctgcttattttaacagccatcaaggccgacaagtcacgggttatggattatatcaatagattggagaactttgatgggcctgccgttggtgaggttgcagtggagcatgagctttacgaagaagcttttgccatcttcaagaagttcagcttgaatgtgcaggcagtgaatgtccttttggacaacattcgtagcattgatcgtgcagtggagtttgctttcagagtcgaagaggatgctgtttggagccaagtggcaaaggcgcaactaaaagagggacttgtgagcgatgccattgaatcctttatcagagcagatgatgccactcagttcttggatgttattagagctgctgaggaaactaatgtgtaccatgatttggtcaagtatcttctcatggttaggcaaaaggttaaggagcccaaagtggacagtgagctcatctatgcttatgcaaagattgatagattgggtgaaattgaagagtttatcctttcacctaatgttgctaatcttcaaaatgttggagatcgcttgtacgatgaagccctatatgaggctgccaagatcatatttgcttacatttcgaactgggccaagctggctagcactcttgtcaagctcaagcaattccaaggtgcagtggatgcggctcgtaaagcaaacagctccaagacttggaaggaaatttgctttgcttgtgttgatgctgaggaattccgcttggctcagatatgtggtctcaatatcattgtccaggttgatgacttggaggaggttagtgactactaccagaacaggggatgcttcaatgagctgatctctcttatggaaagtggtctaggtttggagcgtgcccacatgggtatctttaccgagcttggcatcctctatgcaagatatcgtccagagaagcttatggagcacatcaaactctttgctactcgtctgaacattcctaagctcataagggtttgcgatgagcaacaacattggaaggagctcacttacctctatattcagtacgatgagtttgacaatgctgccaccaccatgatgaaccactctccagaggcatgggaccacatgcagttcaaagatgttgcagtcaaggtggccaatgtggagctctattacaaggcagtgcacttctatttgcaagagcatcctgaatacatcaatgacttgctccatgttcttgctctccgagttgaccatacgcgcgttgttgacatcatgcgcaaggctgggcagctgcatctcgtgaagccatacatggttgaagtacaaagcaacaatgttgctgctgtgaatgaggctctcaatgagatctacattgaagaagaggactatgacaggctcagagagtcgattgacttgcatgacaactttgatcagatcggccttgcacagaagcttgaaaagcacgagcttttggagatgagaagaatagcggcatacatttacaagaaggcaggaagatggagacagtctgtccaattgtctaagaaggacaacctttatcaggatgcaatggagacatcatctcaatcaggagacagggaactggctgaggagttgctcgtgtattttattgagcagggaaagaaagagtgcttcgcatcttgtctattcacttgctatgacttgatccgtcctgatgtggctttagagcttgcctggatgaacaatatgattgactttgttttcccatacctcctccagttcattcgtgaatacacgaccaaggtggatgaactcgtgaaggacaaacttgaggcactcaccgaaacgaaagtcaaagaaaaagaagagaaggatctcgttgcccaacagaatatgtatgctcagttgctgcctctcgccctgcctgctcctcctatggcagggatgggaagtggttttgcaccaccaccacccatgggtggcatggggatgcccccaatgccgccctttggcatgccaccaccgcctcccatgggtggttactgattctttttcattggtggctgtagctgatgagagataggttctcgcggcgacaaatatcattttgttgtgtattttgatggttgatattcttttggtagcagactttgtttcttgctgcccgttggtagggccagagtgatttaggtaggaaggaggtttgtgtttgttttatgatctggctaattgcccgtgtatagtccataaaaccacttgtgttgagcaggctctttaattctgtggcatcatcatttgggtgagatgatagtatttagaggcgtagtcgaggaagcactttgatgggtttggtttacgttggggagtgaagtttggcgattgaaacctttttttgtacgagtatctttttgatgttcaacatccttctctggcatgcattgttttggatgcttccattgagattttgagggcagtttattgctcgtttggctcaaatttgtggtttggatcatggttagtacttcgcttaatacatgactctttcacacctcttaagaaacaggtattttcttcaagtaccttagaaaatatcacttatgttttagagaaaatggcgttttacgtcactctctctttggatcttctacttgtttcttctcttttggttttttgaggggaactgtcttctcatcggtgtttctgtcattatctgactttttgtttgtgcatttgattttcttttcatagaaattggtatatgtacttcagcttgaatatagggttttacctgaatttcgatttagtattctaa

SEQ ID NO: 5172 - DNA, 5710 bp, Phaseolus coccineus
tctctccctcttttcgctttagaggggtccaacttgcttccagatctcgcaccgatttttgactcttcttcttcttccaattcaatcgctgccgcagatctcactcttccatccaagccgtcatggcggccgcgaacgctccgatcgccatgaaagaagctctcaccttgccaagcattggcataaatccgcagttcatcacgttcacgcatgtgacgatggagtccgaaaagtatatatgcgttcgagaaacgtctccgcagaatagtgtggttatcgttgatatgaacatgccgaatcagcctctgaggaggcctattactgcagattccgctcttatgaatcccaattccagaatccttgccttgaaagctcaactccaaggaacaacacaagaccacctacaaatttttaacattgaaatgaaagcgaagatgaaatcctatcagatgcctgagcaggtggtcttttggaaatggattagccccaagttgttgggtcttgtgacacaaacctctgtataccattggtcaattgaaggtgactcagaacctgtcaagatgtttgagagaacagcgaatttggcaaacaatcaaataattaattatcgatgtgatccttcagaaaaatggttggtcttgattggtattgctccaggttcccctgagaggccacaattggttaaaggaaacatgcagctcttctctgtggatcaacagcgaagccaggctcttgaagcgcatgctgcatcgtttgctcaatttaaagttcctgggaatgaaaatccttctattttgatttcttttgccactaagacacttaatgctggtcaaattatatccaagttgcatgttattgagctgggtgcacagccagggaagccatcgtttacaaagaaacaggcagaccttttctttcccccagattttgctgatgattttccagtttccatgcagatatcccacaaatacagtttgatttatgtgattacgaaacttggtctcctatttgtctatgatttggagacagctactgctgtatataggaacagaattagtcccgatcctatatttttgacatcagaagctacatcagttggaggcttttatgctattaacaggaggggccaggtgttattggctactgttaatgagcaaacgattgtgaattttgtcagtggtcaactaaacaatttggagctagcagttaatcttgccaagagaggaaatcttcctggggctgagaaattggtggtagaacgattccatgaactatttgcccaaactaagtataaagaagcagctgagcttgcagctgagtctccacaaggaatccttcggacacctgatacagttgccaaatttcagagtgttcctgtgcaagctgggcaaactcctccactattgcagtattttggaacacttctgacaagaggaaagctgaatgcctttgagtcattagaattgtcaaggttggtagtgaaccagaacaagaaaaaccttttggagaactggttggcagaggacaagcttgaatgcagtgaggatctaggagatcttgtaaagactgtggacaatgatcttgctttaaaaatatacatcaaagccagagctacaccaaaagttgttgctgcttttgctgagagaagggaatttgacaagattctaatatactctaagcaggttggctatacacctgactatctcttccttttgcaaaccattctccggacagatcctcagggtgctgttaattttgcattaatgatgtcgcaaatggagggaggttgcccagttgattacaacaccataactgatctgtttcttcagagaaatctgatccgtgaggcaacagcctttctcctagatgtcctgaaaccaaatctaccagaacatgggttccttcaaaccaaggtgttggagataaatctggttactttccctaatgttgcagatgcaattttggctaatggcatgttcagtcattatgaccgtcctcgtattgcccaactttgtgaaaaagctggtctttatgtgcgagctttgcaacattacacagagttatcagatgtaaaacgtgtgattgtaaatacacatgcaattgaaccacagtcactagttgagttttttggtactctgtcacgagaatgggcattagagtgcatgaaagacctattgcttgtcaatcttagaggcaacctacagattattgtgcaggttgccaaagaatattgtgaacagttaggcgttgatccttgcataaagctttttgagcaattcaggtcatatgaagggctgtattttttcctgggatcatatttgagctccagtgaggatcctgacattcactttaagtacattgaggcagcagcaaagactggacaaatcaaagaggttgagcgtgtgactagagaatcaagtttctatgatgctgagaaaacaaagaactttctaatggaggctaagcttccagatgcacgacctctgattaatgtttgtgaccgatttggatttgttccggatctaacacactacctatacacaagcaacatgcttcgctacattgaaggttatgttcagaaggtgaacccagggaatgctcctttagtcgttgggcagcttttagatgatgagtgtccagaagattttatcaaaggcttgattctctctgttcgttccttactgccagtggagccccttgtggaggagtgtgagaagaggaaccggcttcgtttgctctcacagtttttggaacatcttgttagcgagggaagccaggatgtacatgttcacaatgctttgggtaaaatcatcattgatagcaacaataatccagaacattttctcactaccaacccatactatgattctcgagttgtgggcaaatattgtgagaaacgtgatcccaccttagcagttgtagcttataggcgaggacaatgtgatgaagaacttatcaatgtgacaaacaaaaattctttgtttaaactacaagcaagatatgttgttgagaggatggatggtgatctttgggacaaagttcttaaccctgataatgcctacagaaggcaacttattgatcaggttgtatccacagctctgcctgaaagcaagagccctgaacaagtatcggctgctgttaaggctttcatgactgctgatctacctcatgaattgattgagcttcttgagaagatagtccttcagaattctgcattcagtgggaactttaatctgcagaatctacttattttaacagcaataaaggccgatccatccagagttatggattatattaatagactggataattttgatgggcctgcagttggagaaatggctgttgaggctcaattatatgaggaagcatttgcaattttcaagaagttcaacttaaatgtccaagcagtcaatgtcttgttagataatattcatagcattgatagagctgtggagtttgctttccgagttgaagaagatgctgtttggagtcaggtggccacagctcaactaagggaaggactagtgagtgatgccatcgagtcctttatacgagcagatgatactacacaatttttggatgttatccgtgctgctgaaaatgccaatgtttaccatgacttggtgagatacttgctgatggttaggcagaagactaaagaacccaaggtggacagtgagctcatttatgcgtatgcaaagattgataggctcagtgacattgaggaattcattcttatgccaaatgtagccaatctacaaaatgtcggtgaccgattgtatgatgaagaactatatgaagctgccaaaatcatatttgcctttatatctaactgggccaagttggcagttacacttgtgaagttgaaacagttccaaggtgcagttgatgcagcaaggaaagctaacagtgcaaaaacatggaaggaagtttgctttgcatgtgttgatgcagaggagttccgcttggcccagatatgtggacttaacattattattcaggtggatgacttggaagaggtcagtgaatattaccaaaatagaggttgcttcaacgagctaatatccctcatggagagtggtttaggattagaacgggcacatatgggtatcttcactgagttgggagttctatatgctagatatcgtcctgagaagcttatggagcatatcaaactatttgctacccgactcaacattccaaagcttataagggcttgtgatgaacaacaacattggaaggagctgacctatttgtacatccaatatgacgagtttgataatgctgcaacaaccatcatgaaccattcacctgaagcatgggatcacatgcaattcaaagatgttgttatcaaagttgccaatgttgagttgtattacaaggccgttcatttctatttacaagagcatcctgatcttatcaatgatgttctgaatgtccttgctctccgtgttgatcatgcacgtgttgttgacatcatgcgaaaggctggtcaactccgtcttgtcaagccatacatggttgcagttcagagtaacaatgtgtctgctgttaatgaagccctgaatgaaatatatgttgaggaggaagactatgatagattgcgcgagtcgattgattttcatgataactttgaccaaataggccttgcacagaagattgaaaagcatgagcttcttgagatgaggcgtgttgctgcttacatttacaagaaggcaggtagatggaagcagtccattgccttgtctaaaaaggataacctttacaaagatgccatggagacagcctcacaatctggtgaccgtgaacttgctgaggagttgcttgtttatttcattgatcagggaaagaaagaatgctttgcctcgtgtctatttgtttgctacgatttgatccgggcagacattgctctcgagttggcctggatgaacaatatgattgattttgccttcccatatctcttacagtttatccgtgagtacacgggcaaagttgatgagctggtgaaggacaagattgaagcgcagagccaagtgaaggctaaagagcaagaagagaaggaagtaattgcccaacagaatatgtatgctcagttgttgcctcttgctttgcccgcaccaccaatgcctggaatgggaggaggctttgccgctccccctccaatgggtggattggggatgcctccaatgcctcctttcggtatgccacccatgggcagcagctactgacaggaaaacgaccatgaactcaagtgtatacaatgaactctagtgtgtatacagagagcaaagtagcagcttgggtgtttttaaacattttcttctgggattttaatgcagtattctttccttgcttctattggaggaggttcaggccaaaataatttccattttctgttggggggtttgtgtcatatttttgtaatattttttatagttgagtcattttttgggctgctcttacgtgctagccgaggattttctgtatgtaaccatttttcttgtattaaatgatggtccaaaatataatacgaaatagtccgactttgaatcctggctcatgtttttcatggatttattccacttttccttgtgatggaagctgcctgattaaagcttgttggcatgctgtttctcctgtgcatcttatcttctaaaaaatgagtgttttatttcctcttcatttcacgtttgatcttggttttgacttc

SEQ ID NO: 5173 - DNA, 5222 bp, Flaveria ramosissima
ccatggcggccgctaacgctccgataacgatgaaagaagcacttacgttgcctagcatagggatcaatccgcagttcattacgtttaccaatgtaacgatggagtcggataagtttatatgtgtccgtgaaacatcacctcaaaatagcgtggtgatcatcgacatgaacatgccaatgcaaccactaaggaggccaattaccgctgactcggctcttatgaatccgatttccaagattctggctttaaaagctcaacttcctgggacaactcaagatcacctacagatattcaatattgagatgaaagctaaaatgaagtctcatcagatgcctgagcaggttgtcttttggaagtggattacgcctaagatgttgggcatggtaacccagacctcggtatatcattggtcgattgaaggtgattctgaacctgtgaagatgtttgataggacagccaatttatcaaataaccagataattaactacaaatgtgatccaactgagaaatggttggtgttgattggaattgcccctggctcacctgagaaacctcagctagtcaaaggaaacatgcaactattttctgttgaccagcagcgaagtcaagctcttgaagcacatgcagcatcatttgccagcttgaaagttccaggcaatgagaatccttcagttctcatttcttttgcaacaaaaagctctaatgctggacaggttacttcaaagctgcatgttattgagcttggtgcccaaccagggaagccctcattcactaagaaacaagcggatctctttttccctcctgactttgccgatgattttccagtggccatgcagatatccaacaaatatggtttgatttatgtcatcaccaagctgggtctcttatttgtatatgatcttgaaaccgctactgcagtttacagaaacagaataagcccagatcctattttcctgacatctgaagcttcgtcagttggaggtttctatgctgtaaatagacgtggacaggtgttacttgcgactgtgaatgaagcaacaattgtcccttttgttagtggacagttaaacaacctggagcttgctgtcaatcttgccaaacgaggaaacctacctggtgcagagaatttggttgttcaacgtttccaagagttgtttgctcaaaccaaatacaaagaagctgctgagctagctgctgaatctcctcaaggcattctccgtacaccagacacagttgcaaaatttcagagcgtacctgtgcaagctggacaaacaccaccattgttgcagtactttgggacccttctgacgaaaggaaaactaaatgcttttgaatccttagaactatctcgcttagttgtcaatcaaaacaaaaagaatcttctagagaattggctagctgaagacaagttggaatgtagtgaggaacttggagaccttgtgaagacggtggataacgatcttgctttgaaaatttacattaaagcaagagcaaccccgaaagttgttgcagcttttgctgagcgaagggagtttgacaaaatactcatctactccaagcaggttggatattcacctgattatttgttccttctgcaaacaattcttcgtacggatccacagggagctgttaattttgccttaatgatgtcccaaatggagggaggttgtcctgttgattacaacaccattacagatcttttccttcagaggaacttgatacgagaggcaacagcttttctattggatgttttgaaacccaacttgccagaacatgcacacctacaaactaaggtccttgaaatcaaccttgtaacattccctaatgttgctgatgccatattagctaacggtatgttcagtcactatgatcgtcctcgaattgctcaactttgtgaaaaagcaggtctttatgttcgagcacttcagcattacagtgaattaccagatatcaaacgtgtaattgtgaatactcaggcaatagagccacagtctcttgtagaattctttggaacactgtcaaaggaatgggcactggagtgcatgaaggatcttttactggttaatttgagaggaaaccttcagataattgttcaggttgcaaaggaatattgtgagcagcttggtgttgagtcatgtattaaactttttgagcagtttaagtcatatgaaggcctctacttctttttggggtcgtatctgagttccagtgaggatcctgacatacactttaagtacattgaggcggctgcaaagactggtcaaattaaagaggttgaacgtgtaacaagggaatcaaatttctatgatgctgaaaagaccaaaaactttttgatggaagccaagcttcctgatgcaagaccattgatcaatgtctgcgatcgctttggctttgttcctgatctcactcactatctctataccaacaacatgcttcggtatattgaaggctatgttcaaaaggtcaaccctgggaacgctccacaagttgtaggacagcttcttgatgacgagtgccctgaagatttcatcaaaggtttgattttatcagttcgttctctgcttccagttgagcctcttgtagatgagtgtgaaaagaggaaccgacttaggttattaactcaatttttggagcatttggtgagcgaaggaagtcaagatgtacatgttcataatgctttgggtaagattatcattgatagcaataacaacccggagcacttccttaccacaaacccatattatgattcccgtgttgtggggaaatactgcgagaagcgtgatcctacacttgctgtcgttgcttatcgcagaggccaatgcgatgatgaacttattaatgtcacaagcaaaaactctctattcaaactgcaagcaaggtatgtcgtggagaggatggatggtgatctttgggagaaggttctcaacccagagaatgaatatagaagacaactaattgatcaggttgtttctactgctttgccagagagcaaaagccctgagcaggtttctgctgctgttaaagctttcatgactgctgatcttcctcatgaactaatcgaactccttgagaaaatcgtcctccaaaactctgctttcagtgggaatttcaatctacaaaacctgcttattttgacagctattaaagcagatccatcacgagttatggattacattaataggttagataactttgatggacctgctgttggtgagatggctgtagaagcacaactttatgaagaagcatttgcaatatacaagaagttcaacttaaatgttcaagcagtcgatgttttgttggataatattcaaagtattccacgggctgttgagtttgcataccgtgttgaagaagatgctgtctggagtcaggtggcaaaagctcagctcagggaaggattagttagtgatgcaattgagtcatttattcgtgctgatgacgccactcaattcttggatgttattcgtgcttctgaagacacagaatgttaccatgatttggttaagtatcttttgatggttagaggcaagatcaaggagccaaaggtggatagtgagctcatttatgcatatgcaaagattgacagattgagtgatattgaggaatttatcctaatgccaaatgttgcaaatcttcataatgttggtgatcgtctgtttgatgaagcgttgtatgaagctgctaagataatatatgcttttatctccaactgggctaagcttgctgttacacttgtgagattgcaacagtttcaaggtgctgttgatgctgctcgtaaagcaaatagtgcaaagacatggaaagaagtttgctttgcttgtgttgatgccgaggaattccgcttggcacagatatgtgggctcaatattattgtgcaggtggatgatctagaagaggtgagtgaatattaccaaaatagaggatgcttcaatgagcttatatctcttatggagagtggtttaggactggaaagggctcatatgggcatcttcactgagttgggtgtcttatatgcccgataccgtcacgacaaactaatggagcacataaaactcttttcaacccgtctcaacattccaaagttaatccgtgcctgtgacgagcaacaacactggaaagaactgacttatttatacattcaatatgatgagtttgacaatgctgctacaactgtcatgaatcattccccagatgcttgggatcatatgcagtttaaggatattgcagttaaagtcgcaaatgtggagctttactacaaggcggttcatttctatttagaagaacatcctgaccttattaatgatgttcttaatgtccttgctctacgtgttgaccatacacgtgttgtagacatcatgcgcaaggcgggtcaacttccattagtcaaaccatacatggttgcagttcagagcaacaatgtatctgcagtcaatgaggcgttgaatgaaatttatgttgaagaggaagattatgatagattgcgtgaatctattgatttgcatgataactttgaccagattggccttgcacagaagatcgagaaacacgagcttcttgagatgaggcgtgtggctgcatacatttacaaaaaagctggtagatggaagcagtctattgcactgtctaaaaaagataaggtttacaaagacgcaatggagaccgcttcacaatctggagaccgtgaactggctgaagagttgcttgtttatttcatcgagcagggaaagaaggaatgttttgcttcctgtctatttgtttgttatgatctgatccgtccagatgttgctctggagctcgcttggctgaacaacatgattgattttgctttcccatatctgcttcagtttattcgtgaatataccggtaaagtcgatgaactgatcaaggacaagatcgaagcaattaaggaaagtaaggccaaggagaccgaggagcaggatattgttaaacaacagaatatgtatgctcaactactccctcttgcgctacctgctccgccgggtatgggcggaggattcgctccaccaccagccatgggtggaatggggatgccgccaatgcctccatttgggatgccgccaatgggttcttattgactttagcggatgggcgtaaatttgcttgttgattgaattgtagtgtggtgtttttgttctagtgtggatattcttttggttagacggaggtatttttttgcagcttgtagggcagcaaaacag

SEQ ID NO: 5174 - DNA, 5556 bp, Solanum phureja
ttatctttgatctcgccatcatggcggctgccaatgctccgatcaccatgaaagagacccttacgttgcaaagtataggggtgaacccgcagttcatcacattcaccaatgttaccatggaatcggataagtatatatgtgtaagagagacgtcgcctcagaatagtgtggtgattattgatatgaacatgccaatgcaacctttgaggcgtccaattacggctgattctgctcttatgaatcctaattctagaattttggctctaaaagctcaagttcctggaaccagtcaagatcacttgcagattttcaatattgaggcaaaacagaaaataaaatcatatcagatgcctgagcaggttgttttctggaaatggattacaccgaagatgttaggtcttgttacacaaacgtcagtctatcattggccaattgaaggggattctgagcctgtaaagatgtttgatagaacagccaatttagccaacaaccaaataatcaactaccgatgtgatccttctgagaaatggttggttttaattggtattgccccaggttcaccagagaggcctcaactggtcaaaggaaacatgcaattattttcagtggatcagcaacgcagtcaagctctcgaggcacatgctgcagcatttgcctcattcagggttcctggaaatgaaagggattccatactcatttcctttgccacgaagtcctccaatgctggacaaatcacatcaaagttgcatgtcattgagcttggagcccagccagggaaaccgtcttttacgaagaaacaggcagatctcttctttcctccagattttactgacgatttcccagttgccatgcagatatctcataaatacagtttaatttatgtcatcacaaagcttgggcttctctttgtctatgacctcgaaacagctactgcagtgtacagaaataggatcagcccagatcctatttttctgacagcagaagcttcatctattggtggtttctatgccatcaacaggcgaggccaagttttgcttgccacagttaatgaagcaactctagtaccttttgtcagtggccaattgaataatctggagcttgctgtcaatcttgccaaaagaggaaaccttcctggggctgagaatttagttgtccagcggttccaagagttgtttgcccagacaaagtacaaagaagctgcagagcttgcagcggaatcacctcaaggcatactccgtacgcctgacactgttgccaaatttcagagtgttcctgttcaagcagggcaaacacctcccttattgcagtactttgggacacttttaacgaaaggaaagctaaatgcttttgaatcattggaactgtcgcgccttgttgtcaaccagaataagaaaaacctgttggagaactggttggctgaggataagctggagtgcagtgaggaacttggggatcttgtgaagactgttgataatgaccttgccctaaagatatatatcaaagcaagagcaactccgaaagttgttgctgcttttgctgaacgcagggagtttgacaagattctgatatattccaagcaggttggatatacacctgactatttgttccttcttcaaacaattcttcgatctgatcctcagggagctgttaactttgcgctcatgatgtcccaaatggagggtggttgtcctgttgattacaacactatcaccgatctatttctgcagaggaatatgatccgtgaggcaacagcatttttattggatgttctgaaacctaaccttccagagcatggctttctgcagaccaaggtcttggaaatcaacctcgtgactttcccgaatgttgctgatgctatattagcaaatggaatgttcagtcattatgatcgacctcggattgctcaactttgtgagaaagctggtctttacgtgcgggctctgcagcactattccgaactgcctgatatcaagcgtgtcattgttaatacacatgcaattgagcctcaggccttggttgagttttttgggaccctttcacgtgaatgggcacttgagtgcatgaaggacctccttgttatcaatatcaaaggaaaccttcaaataattgttcaggttgcaaaagagtactgtgagcagttgggtgttgatgcttgcataaagatttttgagcaatttaagtcctatgaggggttatatttcttcctgggatcgtatttgagttccagtgaggatcctgatatccactttaaatatatcgagtcagctgccagaactggtcaaatcaaggaggttgagcgtgtcacaagagaatcaaacttctatgatgcggaaaagacgaagaacttcttaatggaagccaaacttcccgatgctcgacctctaattaatgtttgtgaccgctttgattttgttcctgacctcacacactacctctataccaacaatatgctacggtatattgaaggttatgtccaaaaggtcaatccaggaaatgcacctttagtcgtagggcagcttttagatgatgagtgtcccgaggattttattaagggattgatcctatctgtgcgttctctgcttccagttgagcccctagtggaagaatgtgaaaaaaggaatcgactccgcttgctgacacagtttttggagcatcttgtaagtgaaggaagtcaagatgtgcatgtacacaatgctctgggaaagatcatcatagatagcaataacaacccagagcatttcctcacaaccaatccatactatgactcacgcgttgttggtaaatattgtgaaaagcgtgatcctacccttgctgttgttgcatataggagaggtcaatgtgatgatgaacttattaatgtgacaaacaagaactctttgttcaaacttcaagcaaggtatgtggttgagaggatggatggtgatatttgggagaaagttcttaaccctgaaaatgagtttagaaggcagcttattgatcaagttgtttccactgctctgcctgaaagcaagagccctgagcaagtttctgcagctgttaaagctttcatgactgctgatcttccccatgaactgattgaacttcttgaaaagattgtgctccagaattctgcattcagtgggaactttaatctgcagaatttgcttattctgacggccatcaaagctgatccatccagagtaatggactatatcaatagacttgataattttgatggacctgcagtaggggaggttgctgtcgaagcgcaactttatgaagaagcttttgcaatcttcaagaagttcaacttgaatgtccaggctgttaatgttctgcttgacaacattcgtgatattaaccgggctgtggagtttgcgttccgagttgaagaagatgctgtttggagtcaagtggctaaaactcaactaagagaaggattagtgagtgatgctattgagtcgtttattcgtgcagatgacgccacccactttttggatgttattagtgctgcagaggatgcagatgtttaccatgacctggtgaagtatctcctgatggtaaggcagaagacaaaggagcccaaagttgacagtgaactcatttatgcatatgctaaaattgatcgattgggtgacattgaagagtttattctcatgcccaatgttgctaatctacctaatgttggtgacaagttgtttgatgaaggcttatatgaggctgcaaagatcatatttgctttcatttctaactgggccaagttggccagcacacttgtgaagttaaatcaatttcaaggtgctgttgatgcagcacgcaaggcaaatagtgcgaagacatggaaagacgtctgctttgcttgcgtcgatgctgaggagttccgtttggctcaaatttgtgggcttaacattatagtgcaggtggatgacttggaggaagttagtgaatattaccaaaatagaggatgttttaatgaattaatctctcttatggagagtgggttgggtttggagcgtgcacatatgggtatcttcacagaacttggtgttttatatgccagatatcgtcacgagaagctcatggagcacattaaattattctccaccagactcaacattcccaagcttattcgtgcctgtgatgagcagcaacactggaaggaactcacatatttgtacatccaatatgatgaatttgataatgctgccaccactgttatgaatcattctccagatgcctgggatcatatgcagttcaaagacattgttgtcaaagttgctaatgtggagctttattacaaggccgtccacttttatttgcaagagcatcctgatctcattaatgaccttctaaatgttcttgcacttagagtagatcacacacgtgttgtggacataatgagaaaggctggtcacattcgcctagtcaagccttacatgattgctgttcagagcaacaatgtttctgcggtgaatgaggcacttaacgaaatttatgttgaggaagaagactatgatagactacgtgaatcaattgagttgcatgataacttcgatcagataggccttgctcagaagatagagaagcatgagcttcttgagatgagacgtgttgctgcttctatctataagaaagctggtaggtggaagcaatctattgctttgtcaaagaaagataatctctacaaagatgctatggagacagcctcacaatctggagatcgcgaacttgcagaggagttgcttgtttacttcatcgaacagggaaagaaagaatgcttcgcatcatgcctgtttgtttgttatgatttggtccggccagatgttgcccttgagcttgcctggatgaataatatgattgactttgcattcccttacctgttacagtttatccgtgaatacactggcaaggttgatgagctagtaaaagataagattgaagctcaaagtgaagcaaaagccagagagaatgaagagaaggatgttatgaagcaacagaatatgtatgcacagctgctgccattggctttgcctgccccaccaatgccaggtatgggaggaggttttgctgcggcacctcctcaaatgggtgggatgggaatgcctcccatgcctccatttggcatgccacccatgggtccttactaatatgatggtgttcaatatactggtgttcttttgctttttgtttagggttgttgcccttgtatttttgtcacttaccatgcagttgttgactcatggacacaagtggaggctttgataaaataattgttctgttgtgtgtcatagggtgttgatatctcctttgtaatattcttttagaagaggcattttttttgtagttaggcagaaagggggaaatttttattattcaggaccaaagagatgcattaattttgcatcttgcattgatttgctggggtcggttaaggtgctttatctccagttttgtaattgtttctaggttcatttccctgagggtataattatgttacatactttttttttttttttttgtggttcctatgcgattgtcttcatgatatgttgttgtatgcagttgctgttatttctt

SEQ ID NO: 5175 - DNA, 5588 bp, Fragaria vesca
tgctggattcgcaaccagctgtagatccgagccgtcggttctgagccgtcgatctgcgcaaccatggcggcggctaacgctccgatcaccatgaaggaggccttgacgcttccgagcgtcgggattaatccgcaattcataacgtttacacatgttactatggagtcagataagtacatatgtgtaagggagacagcgccgcagaatagtattgtgattattgatatgagcatgccgaatcagcctttgaggaggcctatcactgcagactctgcacttatgaatccaaactccaaaatccttgctttgaaagctcaagtccagggatctactcaggaccaccttcaaatttttaacattgagatgaaagcaaaactgaaatcataccttatgcctgagcagatcgtcttttggaaatggataaccccaaagatgttgggccttgtcacacagactacagtatatcattggtcaattgaaggtgagtctgaacctgtaaaggtatttgagcgaacagctaatttggtgaacaatcagataataaattaccgttgtgatccttctgagaagtggttggttctgattggaattgctcccggtgctcctgagaggccacaattggttaaagggaacttgcaactcttctcagtggagcagcagcgcagtcaagctcttgaagcgcatgctgcatccttcgcccagtacaaggttccagggaatgagaacccttccattctgatttcctttgccaccaagacgctcaatgctggacagattacatccaagttgcatgttattgagctcggtgcccagtcagggaagccatctttttcaaagaaacaagcagatcttttctttcctccagattttgctgatgatttcccagttgccatgcagatgtctcacaagtacagtttaatttatgtaattacaaagctggggctactatttgtatacgacttagagacagctagtgcagtttacagaaatagaattagtccagatccaattttcttgactacagaagcttcttcagtgggaggcttttatgcggttaataggcggggccaggtgttgttggctaccattaatgagcaaacaattgtgccttttgtcagtggtcagttaaacaatttggagcttgctgtcaatctggcaaaaagaggaaatcttcctggtgctgagaatctggttgtccagcgtttccaagaactgtttgcccagacaaagtacaaagaagctgctgaactggctgctgaatccccgcaaggaattcttcgtacaccggatacagttgctaaatttcagagtgttcctgtccaagctgggcaaacacctcctttgttgcagtattttgggacactcttaacgagagggaagctgaatgcctttgagtcattggaattgtcacgtcttgttgtgaaccagaacaagaagaatcttttggagaactggttggcagaggacaaactggaatgcagtgaggaacttggagatcttgtgaagactgtggataatgatctggctttgaagatatacattaaagcccgagcaactccaaaagttgttgcagcgtttgccgagcgaagggaatttgacaaaatcctgatctactcaaagcaggttggctacacacctgactatctgttccttttgcaaacaattctccgagcagaccctcagggtgctgttaattttgcgttaatgatgtcccaaatggaaggtggttgtcctgttgattacaacaccattacagatctctttcttcagaggaatctgattcgtgaggcgaccgcttttctactggatgttttgaagccaaatctccctgaacacgcctttttgcagacaaaggtcctcgagattaacttggttacttttccaaacgtggctgatgccattttagccaatggtatgttcagtcattatgatcgtcctcgaattgcccagttatgtgaaaaagctggtctttatgtgcgagctctgcaacactactctgagttgcctgatattaaacgtgtcatagtgaatacacatgcaatagagccgcaatctctagtggagttttttggtactctgtcaaaggaatgggcactggagtgtatgaaggatctcttgctggtcaatttgagaggcaaccttcagataattgtgcaggttgctaaggagtactctgatcagttgggtactgatcaatgcatgaagctgtttgagcagttcaagtcatatgaaggattgtacttcttcctcggatcatttttgagttcaagtgaggatcctgaaatccacttcaagtacattgaggctgcagccaaaactggacaaattaaagaggtcgagagagtcaccagagaatcaaatttctacgatgctgagaaaacaaagaactttttgatggaagctaagctcccagatgcgcgaccccttatcaatgtttgtgaccgttttggttttgttccagatctcacccactacttgtacacaaacaatatgctccgttacattgagggttatgtccagaaggtgaatccttcaaatgctcctctagttgtgggacagttgctagatgatgagtgccctgaagattttatcaaaggcttgattctctctgtacgttcattgcttccagtggagccccttgtggaggaatgtgagaaaaggaatcgacttcgtttactcactcagttcctggagcatcttgtgagtgagggaagccaggatgtgcacgtccacaatgcattgggtaaaatcatcattgatagtggaaacaatccagaacacttcctcaccacgaacccatattatgattctcgtgtggtgggtaaatattgtgagaaacgcgatcctaccctggctgttgttgcttatcgacgtggacaatgtgatgatgagcttatcaatgttacaaataaaaactctttgttcaagttacaagcaagatatgtggttgagaggatggatgaggatctttgggctaaagctcttgaccctgagaatgaatatagaagacaacttatcgatcaagtggtttctactgccttgcccgaaagcaagagtccagaacaagtttctgcagctgttaaggctttcatgacagctgatttgccccatgaattaattgagcttcttgaaaagattgtgcttcagaactctgccttcagtgggaactttaatctgcagaatctgctaattttgacagccatcaaggcagatccgtctagagttatggattatattaataggctagacaatttcgatggacctgcagttggggaagtagctgtggaagcccaactctttgaggaagcatttgcaattttcaagaaattcaacttgaatgtacaggccgtcaatgtcttgcttgataatatccgaagcattgatagggctgtagaatttgcattccgtgtcgaagaggatgctgtttggagtcaggttggaaaggctcaactccgggaggggcttgtgagcgatgccattgagtcatttattcgggcggatgatgccacacaattcttggatgttattcgtgcttctgaggatgcagatgtttaccatgacttggtgagataccttctgatggttaggcagaagacaaaggagccgagggtagacagtgagcttatttatgcatatgccaagattgataggctagctgacattgaagagttcattcttatgccaaatgtcgccaatctccaaaatgttggtgatcgcctatatgatgaggccctctatgaggctgcaaaaataatttatgcttttatatccaactgggccaagttggctgtcacacttgtgaagctcaaacaattccaaggtgctgttgatgcagcacgaaaagccaatagtgcaaagacatggaaggaagtttgctttgcttgtgttgatgctgaggagttccgcttagctcaaatttgtggtctcaacatcatcatacaggtggatgatttggaggaggtcagtgaattctaccagaatagaggatgcttcaatgagctaatatctctaatggaaagtggtcttggcctagaacgtgcacacatgggaatctttactgagttgggagttctgtatgctagataccgtcctgagaaactaatggagcacatcaaactgttctcaactcggttaaatattcccaagctcatacgagcttgtgatgagcagcagcattggaaggagctgacctatttatacattcaatatgatgagtttgataatgctgcaacaaccatcatgaatcattcccctgaagcctgggatcacatgcagttcaaagatgtggcagttaaagttgcaaatgtggagctatactataaggctgtgcacttttacttgcaagagcatcctgatctcatcaatgatattctaaatgttcttgctctccgtgtagatcatacacgtgtggtggacattatgcgaaaggctggtcacctacttcttgtgaagccatacatggttgctgttcagagcaacaatgtctcagctgtgaatgaggctttgaatgagatatatgttgaagaggaagactatgaaagattgcgtgaatcaattgatttacatgacagctttgatcaaataggtcttgctcaaaagatcgaaaaacacgagcttctggaaatgaggcgtgttgctgcttatatttacaagaaagctggaaggtggaagcagtccattgctttatcaaagaaagataaactttacaaagatgccatggagaccgcatcgcagtctggtgaccgtgaacttgcagaggaattgcttgtttacttcattgaacagggaaagaaagaatgctttgcgtcatgcctctttgtctgttacgatttgattaggccagatactgctcttgaacttgcgtggatgaacaacatgatagactttgccttcccatatctgttacagtttatccgtgaatacaccggtaaagtggatgaactggtgaaggacagaattgaagctcagaatgaaatgaagtccaaggagaaggaagagaaagaagttatagcacagcagaacatgtatgcacaactgttgcctcttgctttgcctgctccaccaatgcccggtatgggcggaggtatgggaggcatgggcggagggtatggtcctccgcctcctatgggaggaatggggatgcctccgatgccaccttatggcatgccaccaatgggcagcagctactgagatgtgtgatgaacaattgttgtggaactcgatggcaaatttgttgtcatagtcagtagggcaacctgtctgatagaactttgcattttagtgtaattttattgggcttccctgcccgtctttctgattttgtcagtcatttgttttgatgggttgaaaaggtgcagtttaaataattgtcaataggttgtgtggataggaaaatcttgtaatattcttttgtatctgaggcattgtttttttcggatggtcgatgagggcgagcttagaattttctcctctgtattaatttgttctgtttttcaatcttgcctgggtataatacaaaacagtacactgatgattttggaatgcttttgttccactactattcaatatatgtgcaaattgatttagct

SEQ ID NO: 5176 - DNA, 5315 bp, Vinca minor
ctcacgttggcgagcatagggatcaatccacagttcatcaccttcacaaatgtcaccatggaatccgataagtatatatgtgttcgtgagacgtcaccacaaaacagcgttgttataattgatatgagtatgccaatgcaacctttgaggaggccgatcactgctgactcagctcttatgaaccccaataccagaatcttagctttgaaagcccaactccccggcaccactcaagatcacttacaaatatttaacatcgaggcaaaggctaaaatgaagtcatatcaaatgcctgagcaggttgccttttggaagtggatcaccccaaaaatgttgggtttagtcacacagaccgccgtgtatcattggactattgaaggtgaatcggaacctttaaaaatgtttgatagaacggctaatttggcaaacaaccaaataatcaattataggtgtgatccatctgaaaaatggttggttttggttggaattgcacctggttctcccgagagacctcaactggttaaaggaaatatgcaactatattcagtggagcagcagcgtagtcaagcccttgaagctcatgctgcatcatttgcttctttcagagtgccgggaaatgacaaggactctatccttatatcatttgcaacaaaatccacaaatgctggacaagttgtctcaaaactgcatgttattgagcttggagcccagccaggaaagccatcttttaccaagaagcaagccgatcttttcttccctcccgattttgctgatgactttcctgtagcaatgcagatttctcacaagtatagtttgatatatgtgatcacaaagcttgggcttctctttgtatatgacctggatacagccactgcggtttatagaaataggatcagcccagatcctatatttttgacctcagaggcttcatctgtggggggcttctatgcaatcaaccggcgaggacaggtattgcttgcgacagtgaatgaagcgacaattgtgccatttgtcagtggccagttaaacaatctggagcttgcagtaaatctcgctaaaagaggaaaccttcctggtgcagagaatttggttgtgcagcgcttccaggagttgtttgctcaaacaaaatataaggaagctgcggagcttgcagctgaatctccacaaggcattctacgaacgcctgacactgttgccaaatttcagagtgtacctgtccaagctggacaaacacctcctctcttgcagtactttggaacacttttaacccgaggaaagcttaatgcctttgagtcattagaattatcccgccttgtggtgaatcagaataagaaaaatcttttggagaactggttggctgaggataagttggagtgtagtgaggaacttggtgaccttgtgaagactgtggacaatgatcttgcactgaaaatatatataaaagcgagagcaactccgaaagttgttgcagcttttgctgagcggcgggaattcgacaaaattctgatatactccaagcaggttggatatacaccagattatttgttccttctgcaaacaattctgcgttccgatcctcagggagctgttaattttgcccttatgatgtctcaaatggagggaggctgccccgttgattacaacactataactgatctctttcttcagaggaacatgatacgtgaggccacagcatttttgttggatgttctaaagcccaatttaccagaacatgcgttccttcaaaccaaggtacttgaaatcaaccttgtcacattccctaatgtggctgatgctattttagcaaatggaatgtttagccactatgaccgcccacgtattgctcaactttgtgaaaaagccggtttatatatgcgagctcttcagcactatgctgaactgccagatatcaagcgtgtcattgtgaacactcatgcaattgagccgcagtctcttgtagaatttttcggtaccctttcacgagaatgggcattggaatgcatgaaggatctgctgctcgtcaacctaaggggcaaccttcagatcattgttcaagttgctaaagaatactgtgagcagatgggtgtcgatgcttgtatcaagctttttgagcagttcaagtcctatgaaggattatacttcttcttgggctcatatctgagctcaagtgaggaccctgatatacatttcaagtacattgaagccgccgcaaagactggacaaattaaggaagttgagcgtgtgacaagggagtctaatttttatgatgccgaaaagacaaagaacttcttgatggaagccaagcttccagatgctaggccactgatcaatgtgtgtgatcggtttggttttgttccggatttgactcactacttgtacacgaacaacatgctccggtatattgaaggatatgtacagaaggtcaatccaggaaatgctcctttagttgttgggcagctgctagatgatgagtgccctgaagattttatcaaaggactcattctttctgtgcggtctctgcttccagttgaacctcttgtggatgagtgtgagaaaaggaatcgactccggttgctaactcaatttttagagcatcttgtgagtgaaggaagtcaagatgtacacgttcacaatgctttgggaaagatcattattgacagtaataacaaccctgagcacttcctcactactaacccatattacgattcacgcgttgttggaaaatattgtgagaagcgtgatcctactcttgctgttgtggcctaccggagagggcagtgtgatgatgagctcatcaatgtaacaaacaagaattctctatttaagctgcaggccaggtatgtagttgaaagaatggatggtgatctatgggagatggttctgaaccctgagaatgagttcaggaggcagcttatagatcaagttgtatctactgctcttcctgagagcaagagccctgaacaagtttctgcagctgtcaaagcctttatgaccgctgatcttcctcatgaactgattgagcttcttgagaagattgtgcttcaaaactctgcattcagtggaaacttcaatttgcagaacttactgatactgactgctatcaaagcagatccctctagagttatggactatgttaatagactggataactttgatggacctgcagttggtgaagtggctgtggaagcccaattatatgaagaagcttttgcaattttcaagaagtttaatttgaatgtccaagctgtcaatgtcttattggataatattcgtgacatcaaccgtgcagtggagtttgcgttccgtgttgaagaagatgctgtctggagtcaggttgctaaagctcaattgagagagggattggtaagtgatgcaatcgagtcctttatccgtgcagatgatgccactcaattcttagaggtaataaaagctgctgaggatgctgaagtgtaccatgacctggtgaagtacctgctaatggttaggaagaaatccaaggaacctaaggttgatagtgagattatctatgcctatgctaaaattgataggctgagtgacatcgaagaatttattctcatgccaaatgttgctaatcttcctaatgtgggtgatcgcttgtacgacgaggctttatatgaggctgcaaaaatcatttatgccttcatttctaactgggccaagctggctgtcacattagtcaagttgaagcaatttcaaggtgctgttgatgctgcaaggaaggcaaacagctcaaagacatggaaagaagtatgctttgcttgtgttgacgctgaggagtttcgtttggctcagatttgcgggcttaacattattgtacaggtggatgacttggaagaagtcagcgagtactatcaaaataggggatgcttcaatgaacttatttctctcatggaaagcggattaggtttggagcgtgcacatatgggcatatttacagaattgggtgtgctttatgcaagataccgctatgagaagctcatggagcatatcaagttattttccacccgacttaacattcccaagctaatccgagcttgtgatgagcagcagcactggaaagaacttacttatttgtatattcaatatgatgaatttgacaatgctgccaccaccgtcatgaatcattccccagatgcttgggatcacatgcagttcaaggatattattgtgaaagtcgctaatgttgagctttactacaaggccgtacatttctatttgcaagagcatcctgatctcattaatgatgttctcaatgtccttgcacttcgtgttgaccatactcgtgtcgtggacataatgaggaaggctggccatctacgtcttgtgaaaccatacatggttgcagttcagagcaacaacgtttctgctgtgaacgaggctctgaatgagatctatgttgaggaggaagactacgacagattacgggaatcaattgatttgcatgatagctttgatcaaattggccttgcacaaaagattgagaaacatgagctgcttgagatgaggcgtgtagctgcttatatttacaagaaggcaggtaggtggaagcaatctattgctttgtcaaagaaagacaatctttacaaagatgcaatggaaacagcttcacagtccggggatcgtgaacttgccgaggagctgcttgtttatttcatcgaacaaggaaagaaggaatgctttgcatcatgcctctttgtttgttatgatttaattcgtgccgatgtcgctcttgaactggcttggatgaacaatatgatcgattttgccttcccttatctgttacagttcatccgtgaatacactggcaaagttgatgatttaatcaaggacaaaattgaagctatgaaagaagtgaaggccaaggagaatgaagagaaggacgtcattatgcagcagaacatgtatgctcaattgctgcctcttgctctgcctgcaccaccaggcatgggaggaggttttgctccacctccacctccacccatgggcggaatgggaatgccaccgggaatgggaatgccacctatgccgcaatatggtatgccaccaatggggtattgatcttggcaaatatacatatagtagaagtggatagtgcacatgtttgacccgggtggaaagatgaaaacgaaccagtttgggctcttcatagttgatgtttcttggttcacctcagatctttatatcattttgttagttgttgatggggggttcaatgcaggtttaagagttaaaaagaataatgttcgaagtgttgtttgtcatagggtgtggatatctttctttgtaatattctt

SEQ ID NO: 5177 - DNA, 5317 bp, Arabidopsis lyrata
ctccccttatattcgacgagtgactccgattggatcgctgtttcgtcatttctcactttctaaagaaaaacgaatctctctccaccatcattacctttctccttcacttgcctcagatctggctgcgatttcaaatcttctttagtttctctcgccgcgaactgaggtcaaacatggcggcggctaacgcgccaatcatcatgaaggaggtcctaacgcttccgagcgttgggatcggtcaacagttcatcacctttacaaatgtcactatggagtctgataagtacatatgtgtacgagagacggcaccacagaacagtgttgtaattatcgatatgaatatgcccatgcagcctttaaggagacctataactgctgattctgctcttatgaacccaaactcgaggatccttgccttaaaagctcaagttccaggaactactcaggatcatctacagatatttaacatcgaagcaaaagcaaagttgaagtcacatcagatgcctgagcaggttgctttttggaagtggatcacaccaaagatgctggggctggtcacgcaaacttctgtgtatcattggtcgattgaaggtgattctgagccagttaagatgtttgatcgaacggccaatttggcaaacaatcaaattataaactataagtgctctcctaatgagaagtggttggtcttgattggaattgctcctggctctcctgagagaccacaattggtaaaaggaaatatgcagcttttctcggtggatcaacagcggagccaggcccttgaagcacatgctgcatcatttgctcagtttaaggtccctgggaatgagaatccttctattcttatatcctttgcaagcaagagctttaatgctgggcagataacatcaaagttgcatgttattgaacttggtgcccaaccaggaaaaccatcatttacaaaaaagcaggcagatctctttttccccccagattttgctgatgattttcctgtggccatgcaggtctctcacaagtttaacttgatttatgtcatcaccaagcttggcctgctgtttgtatatgatctagagacagcttctgctatctacagaaatcggataagtccggacccaattttcttaacgtctgaagcttcctcacttgggggtttctatgccattaataggcgaggacaagttcttttggcaaccgtaaatgaggccaccataataccttttattagtggtcaattgaacaatttggaacttgctgtcaatcttgctaaaagaggaaacctccctggtgcagagaatctggtagtccagcggttccaagagttatttgctcaaacaaagtacaaggaggctgctgagcttgctgctgaatctcctcagggtattctacggacacctgatacagtggccaaattccagagtgttcctgtacaagcagggcaaactcctccattgttacagtattttgggacccttttgactagagggaagctcaatacatatgagtctttggaactatctcggcttgttgtgaatcaaaacaagaagaacctcttggaaaactggttagccgaggataagttagaatgcagtgaagaactcggagaccttgtcaagactgtggataatgaccttgctctaaaaatttacatcaaagctagagctactccaaaagtcgttgcagcttttgcagagcgaagggagtttgacaaaatactgatttattcaaagcaggttgggtacacacctgattacatgtttcttctgcaaacgatacttcgtacggatcctcagggagcagtaaattttgctttaatgatgtcccaaatggaaggaggttgtccagttgactacaacactatcactgatcttttccttcagagaaatctgatccgtgaagccactgctttccttctggatgttctgaagccaaacttacccgagcatgcttttctacaaactaaggttttggagatcaatttggtaacctttcctaatgtggctgatgcaatcttagcaaatgggatgttcagccattatgacaggcctcgtgttgctcagctttgtgaaaaggctggactttacatccaatccttaaagcattactcggagttacctgatatcaaacgtgtaattgttaacacacatgctattgagccacaggctcttgttgagtttttcggtactctttctagcgagtgggctatggagtgcatgaaagatctcttgttggtcaacctgagaggcaaccttcagataatcgttcaggcttgcaaggagtactgtgagcaacttggtgtcgatgcatgcattaaactctttgagcaattcaagtcatacgaagggctgtactttttcctaggttcatacttgagtatgagtgaggatcctgagattcacttcaagtacatcgaagcagctgccaagactggtcaaataaaggaggttgagcgtgtgactagagagtctaacttttatgatgctgaaaagacgaagaactttttgatggaagctaagcttcctgatgcccgacctttgataaatgtctgcgatcgttttggctttgtgcctgatcttactcattacctctacacaaacaacatgctgcgttacattgaaggttacgttcagaaggtaaatcctgggaatgctcccttagttgtggggcagttgcttgatgacgaatgccctgaagattttataaaaggcctcattctttctgttcgttcattacttcctgttgaaccccttgttgatgaatgtgaaaagagaaatcgactccgtctccttactcagttcttggagcatctagttagtgagggaagccaagatgtgcatgtccataatgccttgggtaaaattatcatagacagtaacaacaaccccgagcatttcctgaccaccaatccttactacgactctaaggttgtgggtaagtactgcgagaaacgtgatcccactctggccgtggttgcatacagaagaggacaatgtgacgaggaactcatcaatgtcaccaacaagaactctttgttcaagttacaagccaggtacgtagtggagaggatggatggtgacctctgggagaaggttcttacggaagaaaatgaatataggaggcaacttatcgaccaagttgtgtctactgctttacctgaaagcaagagcccagagcaagtttctgcagctgttaaagcattcatgactgctgatctgcctcatgagcttattgagcttcttgaaaaaattgtgcttcaaaattctgccttcagtggaaatttcaatctgcaaaatctgcttatactgacagctattaaggcagatccgtctagagttatggattacattaacaggctggataattttgatggtccagctgttggagaagtggcggttgacgctcaattgtatgaggaagcatttgcgatttttaagaagttcaacttaaatgttcaggctgtcaacgtattgttggataacgtcagaagcattgagcgtgctgttgagtttgctttccgggttgaagaagatgctgtttggagtcaagtcgctaaggctcagctcagggacggattagtcagtgatgctattgagtcctttatccgagctgatgatgccactcagttcctggaggtcatccgcgcctctgaagatactaatgtctatgatgacttggtgagataccttctgatggttagacagaaggtgaaggaacccaaggtggatagtgagctcatctatgcttatgcaaagattgaaaggttgggtgagattgaagaatttattctgatgcccaacgttgccaaccttcaaaatgttggtgaccgcttgtatgatgaagctctgtatgaggctgcaaagataatatatgcattcatatcgaattgggccaagttagccgtcacccttgtgaagttgcaacagttccaaggtgctgttgatgctgcaaggaaagcaaacagtgcaaagacatggaaggaagtctgctttgcttgtgttgatgctgaggaattccgactggcccaaatctgtggacttaacattatcatacaggtggatgacctggaagaagtaagcgagtactaccagaacagaggatgcttcaatgaattgatctcacttatggagagtggacttggtctggaacgtgctcacatggggatcttcaccgagttgggtgtcctgtacgccagatatcgttatgagaagcttatggaacacatcaagttgttctcgactcgcctcaatattcccaaacttatccgggcctgtgatgaacaacagcattggcaggaacttacctatctttacattcaatatgatgagtttgataatgctgcaaccactgtcatgaatcattctcctgaagcatgggagcacatgcaattcaaagacattgttgccaaggttgcgaatgttgagctttactataaggccgttcacttctacttgcaagagcaccctgatataatcaacgatcttctcaatgtgcttgctctgcggttagatcacactcgtgtcgttgatattatgcgcaaggctggtcacttgcgtcttatcaagccatacatggttgcagttcagagcaataatgtctctgctgtaaatgaagctctgaatgagatatatgtagaagaagaagactatgacaggttgcgcgagtctattgatttgcatgacagttttgaccagataggtctcgcccagaagattgagaaacacgagcttgtcgaaatgagacgtgtggctgcttatatctacaagaaagctggtagatggaagcaatcgattgctttatcaaagaaagataacatgtacaaggactgtatggaaactgcttcgcaatccggcgaccatgatcttgcagaacaacttctcgtctacttcattgaacaggggaaaaaggaatgctttgctacatgtctctttgtctgttatgacttaatccgaccagacgttgctctagaacttgcttggatcaacaatatgatagactttgccttcccgtatctcctccagtttatccgagaatactctggcaaagtggatgagctaatcaaggacaagctggaggcacaaaaagaggtgaaggccaaagaacaggaagagaaggatgtcatgtcccaacagaacatgtacgcccaattattgccattggctctacctgcccctccgatgccaggaatgggaggtggtgggtatggtccgccaccaccaatgggcggaatgccaggaatgcctccaatgccaccgtatggaatgcctccaatgggcggctactaaggccactggaaacaaaactatccagtcaagttatc

SEQ ID NO: 5178 - DNA, 5556 bp, Brassica rapa
gttcgattggatcgctgtttgtcatttctcactaccttaaggaaaaaaaaaaggtactctctctcctggccgttgacggtcccgtcccggccgtggatctgatttcgccgcgatctgaggtcaagcatggcggcagctaacgcccccatcacgatgaaggaggtcctaacgcttccgagcattgggatcaatcagcagttcatcacgtttacgaatgttactatggagtctgacaagtacatatgtgtacgagagacggcgcctcagaacagcgttgtgattattgatatgaatatgccgatgcagcctctaaggagacctattactgctgattctgctcttatgaacccgaactcgaggattcttgccttgaaagctcaagtgccaggaactactcaggatcatctgcagatatttaacatcgaagcaaaagcgaagttgaaatcacatcagatgcctgagcaggtttctttttggaaatggattacaccaaagatgttggggctggttacacaaacttccgtgtatcattggtcgattgaaggtgattctgagcctgttaagatgtttgatagaacggccaatttggcaaacaatcaaattattaactataagtgctctcctaatgagaagtggttggtgttgattggaattgcccctggctctcctgagagaccacaactggtgaaagggaatatgcagcttttctctgttgatcaacagcggagtcaggcccttgaagcacatgctgcttcatttgcccagtttaaggtccttgggaatgagaatccttctattcttatatcctttgcgagcaagagctttaacgctggacagataacatcaaaattgcatgtcattgagcttggcgcccaaccaggaaaaccatcattttccaagaagcaggcagatctcttcttccccccagattttgctgatgattttcctgtagccatgcaggtctctcacaaatttaacttgatatacgtcatcaccaagcttggcctgttgttcgtatacgatttagagacggcttctgccatctacagaaatcggataagcccagacccaatcttcttgacttctgaagcttcttcagttgggggtttctatgccattaataggcgaggacaagttctcctggctacagtaaatgaggctacgataataccttttatcagcggtcaattgaacaatttggaacttgctgtcaatctggctaaaagaggaaacctccctggtgcagaaaatctggttgtccagcggttccaagagttatttgctcaaactaagtacaaggaggctgctgagcttgctgctgaatctcctcaggggattctacggacacctgatacggtggctaaattccagagtgttccagtgcaagcagggcaaactcctccgttgttacagtattttgggacccttttgactagagggaagctcaattcatatgagtcattggaactatctcgtcttgttgtgaatcaaaacaagaagaacctcttggaaaactggttggcagaggataaattagaatgcagtgaagagcttggagaccttgtcaagactgtagataatgaccttgctctgaaaatatacatcaaagctcgagctactccaaaagttgtagcagcttttgcagagcgaagggagtttgacaaaatactgatttactcaaagcaggttgggtacacacctgattacatgtttcttttgcaaaccatactccgtacggatccccagggagcagtaaattttgctttaatgatgtcccaaatggaaggaggctgtccagttgactacaataccatcactgatcttttccttcagagaaacctgatccgtgaagcgactgctttccttctggatgttctggagccaaatttacctgagcatgcttttctgcaaactaaggttctggagatcaatttggtaacctttcccaatgtggctgatgcaattttagcaaatgggatgtttagccactatgaccggcctcgtgttgctcagctttgtgaaaaggctggactttatatccaatctttaaagcattactcggagttacctgatattaaacgtgtaattgtgaacacacatgctattgagccccaggctcttgtcgaattttttggcactctttctagcgagtgggctatggagtgcatgaaggatcttttgctggtcaacctgagaggcaaccttcagataatagttcaggcttgcaaggagtactgcgagcaacttggtgttgattcatgcattaaactctttgagcagttcaagtcttatgaagggctatactttttcctaggttcatatttgagtatgagtgaggatcctgaaattcacttcaagtacattgaagcagctgccaagacgggtcaaattaaggaagttgagcgtgtaactagagagtctaacttttatgatgctgaaaagacgaagaactttttgatggaagctaagcttcctgatgccagacctttgataaatgtctgcgaccgttttggctttgtgcctgatcttactcattacctgtacacaaacaacatgcttcgttacatcgaaggttacgtgcagaaggtgaaccctgggaatgctcccctggttgtggggcagttgcttgatgacgaatgcccagaagatttcataaaaggcctcattctttctgttcgttcattgcttcctgttgagccccttgtcgacgaatgcgagaaaagaaatcgactccgtctcctcactcagttcttggagcatctagttagtgagggaagccaagatgtgcatgtccataatgccttgggtaaaattatcatagacagtaacaacaaccctgagcatttcctgaccaccaacccttactacgactctaaggttgtgggtaagtactgtgaaaaacgtgatcccaccctggctgttgtggcatacagaagaggacaaagtgatgaggagctcataaatgtcacaaacaagaactctttgttcaagttacaagccaggtatgtagtggagaggatggatggtgacctctgggataaggttcttctggaagaaaatgagtatagaagacaacttattgaccaagttgtgtctactgctttacctgaaagcaagagcccagagcaagtttctgcagctgttaaagcattcatgactgctgatctgccacacgagcttatcgagcttcttgaaaagattgtgcttcaaaattctgccttcagcggaaacttcaatctgcaaaatctgcttatactgacagctatcaaggcagatccgtctagagttatggattacattaacaggctggataactttgatggtccggctgttggagatgtggcggttgatgcccaattatatgaagaagcgtttgcaatttttaagaagtttaacttaaatgttcaggctgtcaacgtattgctggacaacgtcagaagcattgagcgtgctgttgagtttgctttccgggtcgaagaagattctgtttggagccaagtcgccaaagctcaactcagggatgggctagtcagtgatgcaattgagtcttttattcgagctgatgatgccactcatttcttggaggtcatacgtgctactgaagatgctaatgtctatgatgacttggtcaaataccttcttatggttagacagaaggtgaaggaacccaaggttgatagtgaactcatatatgcttatgcaaagattgaaaggttgggtgagatagaggagtttattctgatgccgaacgttgctaacctacaacaagtgggcgatcgcctttatgatgaagctttgtatgaggctgcaaaaataatctatgcgttcatatcgaactggggcaagttagccgtcacacttgtgaagttgcagcagttccaaggtgctgttgatgctgcaaggaaagcgaacagtgcaaagacttggaaggaagtctgctttgcttgtgttgatgcagaagaattccgattggctcaaatatgtggacttaacattatcatacaggtggatgacctggaagaagtcagcgagtactaccagaacagaggatgcttcaatgaattaatctcacttatggagagtggacttggtctggaacgggctcacatggggatcttcaccgagttgggtgtactgtacgccagatatcgttatgagaagcttatggaacacatcaagctgttctcgactcgtctcaatattcccaagcttatccgcgcctgtgatgagcaacagcattggcaggaacttacctatctgtacattcaatatgatgagtttgataatgctgcaactactgtcatgaaccattctcctgaagcgtgggagcacatgcaattcaaagacattgtcgccaaggttgcaaatgtcgagctttactacaaggccgttcacttctacttgcaagagcaccctgatataatcaacgatcttctcaatgtgcttgctctgcggttagatcacacacgtgtggtggatattatgcgcaaggctggtcagctgcgccttatcaagccctatatggttgcagttcagagcaataatgtttccgctgtgaatgaagctctgaatgagatatacgtagaagaagaagactatgataggttgcgtgaatctattgatttgcatgacagctttgaccagataggcctcgctcagaagattgagaaacacgagcttgttgaaatgagacgtgtggctgcgtatatctacaagaaagctggtagatggaagcaatcaattgcattgtcgaagaaagataacatgtacaaggactgtatggaaactgcttcacaatccggcgaccatgaccttgcagaacaacttctggtttacttcattgaacaggggaagaaggaatgttttgccacatgtctctttgtctgctatgacttaatccgaccagatgttgctctggaacatgcttggatcaacaatatgctcgactttgccttcccgtatctcctccagtttatccgagagtactctggcaaagtggacgaactaatcaaggacaagctagaggcacagaaagaagtgaaggccaaagagcaggaagagaaggatgtcatgtcccaacagaacatgtacgcccagttattgcccctggctctacctgccccaccgatgccaggaatgggaggagggccagggatgggaggcggttacggtccgccaccacagatgggaggaatgcctggaatgcctccaatgccaccatatggaatgccaccgatgggcggctactaagactatcgaaaacaaaaactcatctctaccacagtggtattcgtctgcgtctactacagaactgtgaccgttactcgtacggaatgtttccttttttctctgattttataggggtgtggataataatctcgttacacttccgtttgtaataatattctttggggtctttagaagagtcatttttggttgaaggctattttactacatttaatacatttgagttttgtgaattttttgtttgtttgtctcgacttgatttgtcttgttggtgtgcctttgatcaacaaaaaaaaagattgaactaaa

SEQ ID NO: 5179 - DNA, 5749 bp, Populus trichocarpa
gtccatctagctcgcagtgacacacctcccttcctctcctctagatctctctttctgttcttttgattctgaaaaatattccagggtttaatcgctgctctagaccttgcagcgatttgaatccccaactttgctgactctcaagtcgacggttcaagttcaatcacagacctgattagctgattttgagccgtcgatctaatcagcaaccatggcggcagctaacgccccgatcaccatgaaagaagtcttaactttaccgtctatcggtattagccctcaatttattacgtttacgaatgtaacgatggaatcggacaagtatatatgtgtacgtgaaacagctccgcaaaatagtgttgtaattattgacatgcacatgccaatgcaaccgctgagacggcctatcactgcagattctgcactcatgaatccaaattctagaatccttgctttgaaagcccaacttccaggaactactcaggatcacttgcaaatatttaacattgagatgaaagcaaaaatgaagtcataccagatgcctgagcagattgtcttttggaagtggataaccccaaagatgctgggcctggtcacacagacctctgtttatcattggtcaattgaaggtgattctgaaccagtgaagatgtttgaaagaacagctaatttgcaaagcaatcagattataaactataaatgtgacccttctgagaaatggttggttttgattggaattgctcctggttcacctgagaggcaacaattggttaaagggaacatgcaacttttctctgtggatcaacaacgtagccaagctcttgaagcacatgctgcatcatttgcgcaatttaaggttccaggaaatgagaacccttccactctcatttcttttgccacaaaatctttcaatgctggacaggttacatcgaagttgcatgttattgagcttggtgcccagccagggaagccatcatttacaaagaaacaggcagatctgttctttcctcctgattttgtcgatgactttcctgtggcaatgcagatatcccacaaatacagtttgatttatgtgatcacaaagcttgggctactatttgtttacgatttggagacagctactgctgtgtacagaaacagaattagtccagatccaatatttttgacagccgaggcttcagtggtgggggggttttatgccattaataggcgaggccaggtgttacttgctactgtaaacgaggctatgattgtgccatttgttagtggccagttgaacaatctggagcttgctgtcaatcttgccaaaagaggaaaccttcctggtgctgagaatctggcaagttgtccagcgtttccaagaactgtttgctcaaacaaagtataaagaagccgctgagcttgctgctgagtctccacaaggaattctccgaactcctgacacagttgccaagtttcagagtgtacctgtgcaacctgggcaaactcctcccttattacaatattttgggacccttttaacaagaggaaagctcaatgcatttgagtcgttggaattgtcccgccttgtggtcaatcagaacaaaaagaaccttttggagaactggctggcagaggacaaattggagtgcaccgaggaactgggagaccttgtgaagactgtggataatgatcttgcgctgaaaatatatattaaagccagggcaactcctaaagttgttgctgcttttgctgagagaagggagtttgacaaaatcttgatttactcaaagcaggttgggtattctcctgactatttgttccttctgcaagcaatgctccgttcagatccacagggagcagttaactttgctttgatgatgtcccaaatggaaggtggctgtccagttgactacaacacaattactgatctgtttcttcagagaaacttgatccgcgaggcaacagcctttctgttggatgttttgaagccaaatttaccagaacacagttacctccaaacaaaggttctggagataaatctggtaacatttcctaatgtagctgatgctattctagccaatggaatgtttagccactacgatcgtcctcgaattgcacaactctgtgaaaaagctggtctctacatccgagccctgcaacattatacagagttgcctgatattaaacgtgtgattgtgaatacacatgcaatagagccacaggctcttgttgagttttttggaactctttcacgagaatgggctttggaatgcatgaaggatcttttagtggtcaatctaagaggcaaccttcagataattgttcaggctgccaaggaatattgtgagcagttgggtgttgatgcatgcgttaaactttttgagcaattcaagtcatatgaagggctgtactttttcttggggtcatatctgagttccagtgagaatcctgatatacattttaagtacatcgaggctgctgctagaacaggacaaataaaggaggttgagcgtgttactagagaatcgaatttttatgatcctgaaaagacaaagaactttctaatggaagccaaacttccagatgcaaggcctttgattaatgtttgtgaccggtttggctttgttgctgatctcactcactacctctactcaaacaacatgctacgctatatagaaggttatgttcaaaaggtgaacccagggaatgcacctttagttgtggggcagctgttagatgatgaatgccctgaagactttatcaagggtcttattctttctgtccgttctttgcttccagttgagccccttgtggaggaatgtgagaagagaaatcgacttcgtttgcttactcaattcttggaacatcttgtgagtgagggaagccaagatgtacatgttcataatgctcttggtaaaatcattattgatagcaataacaacccagaacacttccttaccaccaacccttactatgattcacgggttgtgggcaagtattgtgagaaacgtgatcccaccctggctgttgtggcataccggagaggacaatgcgatgatgaactcatcaatgtcacaaataagaactctttgttcaagttgcaagcaagatatgtggttgaaaggatggacggtgatctttgggagaaggttcttaatcctgaaaatgaataccgaagacagcttattgatcaagttgtatctactgctttgccagaaagcaagagcccagaacaagtttctgctgctgttaaagctttcatgacagctgatctgccccatgaattgattgagcttcttgaaaagattgttctccaaaactctgctttcagtggaaatttcaatcttcaaaacttacttatcttgacagcaattaaggcagatccttcaagggtcatggattatattaatagattagataactttgatggacctgctgttggggaagtggcagttgaagctcagttatatgaggaagcatttgcaattttcaagaagttcaacttgaatgttcaggctgttgatgtcttattggataacatccaaagcattgaccgtgctgtggagtttgcattccgtgttgaagaagatgctgtttggagccaggtggcgaaggcccaactcagagaggggctcttgagtgatgcaattgagtcatttatccgtgcagatgatgctactcaattcctggaagtcattcgtgctgctgaggatgcaaatgtatatcatgacttggtgaagtaccttctcatggttaggcagaaggcaaaagagccgaaggtggacagtgagcttatttttgcatatgcgaagactgataagttgactgacattgaggagttcattctcatgcctaatgtggctaatctccaaaatgttggtgatcgcttatataacgaaactctatatgaggctgcaagaataatattccaatttatagcaaactgggccaaattggcaatcacattagtgaagttgaaacagttccaaagtgctgttgatgcagctcggaaagccaacagtgcgaagacatggaaggaagtttgctttgcttgtgttgatgccgaggagttccgtttggctcagatatgtggtcttaacatcattatacaggtggatgatttggaggaggtcagtgaatattaccagaacagaggatacttcaatgaattgatctctctcatggagagtggtttaggtttagaacgtgcacatatgggcattttcacagagttgggagtgctgtatgctagatatcgtcctgagaagcttatggagcacattaaattattctcaactcgtctcaatattcccaagcttatacgagcatgtgatgaacagcaacattggaaggaacttacctatctgtacattcaatatgatgaatttgataatgctgcaactaccattatgaaccattctcctgaggcctgggatcacatgcaattcaaagatgttgctgtcaaagttgctaacgtggagctatattataaggctgtgcatttctacttgcaagaacatcctgatcttatcaatgatcttctcaatgtgctggcactccgtgtggaccatactcgtgttgttgacataatgcgaaaggcaggtcatttgcttcttgtgaagccatatatgattgcagttcagagcaacaatgtgtctgctgtgaatgaggctttgaatcaaatttacatggaggaggaagactatgaaagattgcgtgaatccattgatttgcacgataactttgatcagataggccttgcacagaaggttgagaaacatgagcttcttgaaatgagacgtgtggctgcatacatttacaagaaggctggaagatggaagcaatccattgcattgtcaaagaaagataacctatacaaagatgccatggagacagcatcacagtctggtgatcgtgaacttgcagaggagttgctggtttatttcatcgaaaagggcaagaaggaatgctttgcatcatgcctctttgtttgttatgatttaattcggccagacattgcccttgagcttgcctggatgaataatatgatcgactttgccttcccataccttttgcagtttgttcgtgaatacacgggcaaagttgatgaacttgtgaaggacaaaattaatgcacagaatgaagtcaagaccaaagagcaggaagagaaggatgtcattgctcagcagaacatgtatgctcagttacttcctcttgctttgcccgcgccgccaatgcctggtatgggtggaccaacaatgggaggaggttttgctccaccaccacccatgggtggaatggggatgcctccaatgccaccttttggcatgccaccaatgggcagctattgatacgcaaaccaccattttttttgtagaattagctggaaattcccagttgcttcaagaaaagaagtatactagttgttcgggcatttgatatgatggttttttctggactttggtgccttcattctttcttttagcgtttgttttgatgggatggaggtgtacttgaaatcatgaagttgccaattttccttggtcttaggtgtgtggataagtgttgtaatattcttttggttggagtcattttttggctgctggtagagaagcaagctgaggatttcctgtatctatattattttttcccttgcggtctagaagctagcccgagtatagtgcgaattgtttcatacaaatcataaaaccacctacgtaggtaatttgtaatggttttttgtttaattccacctttcttcttgtac

SEQ ID NO: 5180 - DNA, 5543 bp, Mimulus guttatus
gctttgttccttcttcaatcatggcggccgccaacgctccgatcaccatgaaagaagccctaacgttgactagcatagggatcaatcagcagtttatcacttttacaaatgtgaccatggaatctgataagtacatttgtgttcgtgagacgtcgcctcaaaacagtgtggtgattatcgatatgagcatgccaaatcagccgctgcggcggcctattactgcagattccgcgcttatgaatccaaatactagaattttggcattaaaagctcaacttgctggaaccactcaagatcacttgcaaatatttaacatcgaggcaaaagcaaagatgaagtcacatcagatgcctgagcaggcaagtggtattctggaagtggattacccctaagatgttgggtttggttacacaaacctcagtctatcactggttaattgagggtgattctgaacctgtaaagatgtttgatagaactgctaatctagccaacaaccaaataatcaattataaatgtgacccatctgagaagtggttggttttgattgggattgctcctggttcacccgagcggcctcaactggtcaaaggaaatatgcagctgttttctgttgatcaacaacgtagtcaagctcttgaagctcatgctgcatcatttgcttctttcagagtttcagggaatgataaggactctattcttatttcatttgcatctaaaacctctaatgctggtcagattacatctaagttgcatgttatcgagcttggtgctcagccagggaaaccatcttttacaaaaaagcaagctgatctgttcttccctccagattttgctgatgattttccagtggccatgcagatttcccataagtatagtcttctttatgtgattacgaagcttgggctgctctttgtatatgatctggaaactgccacagctgtatacagaaatagaatcagtcctgatcccatttttcttacatcagaagcttcatctgttggaggtttttatgcagttaataggcgaggccaggttttacttgctacagtaaatgaagcaactatagtgcctttcgtcagtggccaattaaacaatctggagcttgctgtcaatcttgccaaaagaggaaaccttcctggtgcggagaatttggttgtccagcgcttccaagaattgtttgctcagacaaagtataaggaggctgcggaactcgctgcagaatccccgcaaggcatactccggacacctgatactgtttccaaatttcagagtgttcctgttcaagctgggcagacaccaccattgctgcagtattttggaacactgttaaccaaaggaaagctcaacgcatttgagtctttggagttatctcgtcttgttgtcaaccagaacaaaaagaatctattggaaaactggttggctgaagataaactggagtgtagcgaggaactgggagaccttgtgaagactgttgataatgaccttgccctgaaaatatatatcaaagccagagctacaccaaaagttgtggcagcatttgccgagcgtcgggagtttgacaaaatcttgatatactcaaagcaggttgggtatactcctgactatctttttcttctgcaaaccattctccggtcagatcctcagggagctgttaatttcgcacttatgatgtctcaaatggagggaggttgtccagttgattacaataccataactgatctctttcttcagaggaacatgatccgtgaggcaacagcctttttgttggatgttctgaaaccaaatctgccagagcatgcattccttcaaactaaggccagtcctggagatcaatcttgtgacgtttccaaatgtggctgatgctattctggcaaatggcatgttcagccactatgacagaccacgaattgcacaactctgtgaaaaagcaggtctttatgtgcgagcacttcagcattattctgagctgcctgatgttaagcgtgtcattgtgaatactcatgcaattgagccacaggcacttgtagaattctttggtacactttccacggaatgggcactagagtgtatgaaagaccttttactcgtcaatttaagaggaaaccttcagataattgtccaggttgcaaaagaatattgtgaacaattgggagttgaagcatgtatcaagctgtttgagcagttcaagtcatatgaaggattatatttcttcttgggatcatatttgagctccagcgaggatcctgaaattcacttcaagtacatcgaagcagctgccaagactggacagattaaagaggtagagcgtgtaacgagggaatcagatttctataatcctgagaagaccaaaaactttttgatggaagcaaaactccctgatgcgcggccactgatcaatgtgtgtgaccgctttggttttgttcctgacctcactcattacttgtactcaagcaacatgctccgctacattgaaggttatgtgcaaaaggttaatccaggaaatgctccattagttgttggacagctcctagatgacgagtgtcctgaagatttcattaaaggcctgatcctttctgtccgttctcttcttccagttgagcctctggtggaggagtgcgaaaagaggaatcgacttcgcctacttactcagtttttggaacatctcgtgagtgaaggaagccaagatgttcatgtgcacaatgctttgggtaaaatcataatagatagcaacaacaatccagagcacttccttaccaccaatccgtattatgattcacgtgttgtgggtaaatactgtgagaagcgtgatcctacccttgctgttgttgcataccgaagagggcaatgtgatgatgaacttattaacgtgacaaataagaattctttgttcaagctgcaagccagatatgtagttgaaagaatggatgctgatctctgggccaaggttcttgatcctgaaaatgaattcagaaggttgctcattgatcaagttgtatctactgcgttgccggaaagcaaaagcccagagcaagtttctgcagctgttaaagcgtttatgactgctgatcttcctcatgaacttattgagttgcttgaaaagattgtgcttcagaactcagctttcagtgggaacttcaacctgcaaaacttacttatcttaactgcagtcaaggctgatccctctagggttatggactatgttaatagacttgataactttgatggcccggccgttggagaagtggctgtggaagctcaattgttcgaagaagcatatgctattttcaagaaattcaatttgaatgtccaggctgttaatgtgttgttggataatattcgagacattaaccgagccgtagagtttgcattccgtgttgaggaagatgctgtgtggagtcaagtggctaaagctcaactgagggaaggactagtaagcgatgcaattgaatcatttattcgtgctgatgatacaactcaattcctggaagtgatccgagctgcagaggatggggatgtttatcatgacctggttaagtatcttctcatggttaggcagaaaacaaaggagcccaaagtggacagtgagcttatttatgcatatgcaaagattgataggcttggtgaaattgaagagtttattctcatgccaaacgttgccaatctccctaatgttggtgatcgcttgtatgatgaagctttatacgaggctgcgaagattatttttgccttcatctctaattggggcaaattggcaattacacttgtgaagttgaagcaattccaaggtgctgttgatgctgcgcggaaagctaacagcgcaaagacgtggaaggaagtttgctttgcttgtgttgatgccgaggagttccgcttggctcagatttgtggtcttaacatcattgtacaggtcgatgatctggaagaggttagtgagtattatcagaacagagggtgctttaacgagcttatatcacttatggagagtggattaggattggaacgtgcgcatatgggtatctttacggagctgggtgtcctttatgctagatatcgccatgagaagctgatggagcacatcaaattattttcaactcgtcttaatattccgaagctgatccgagcatgtgatgaacaacagcactggcaagagctaacttacttgtacattcaatatgatgagtttgataatgctgcaacgactgtcatgaatcattcaccggaggcttgggaccacatgcaattcaaagatattattgtcaaagttgctaacgtggagctgtattacaaggccgtgcatttctatttgcaagagcatcctgatcttatcaacgatgtgctgaatgtccttgctcttcgcgtggatcacactcgtgttgtggacataatgaaaaaggcgggtcacttgcgtcttattaagccatacatggtagcagttcagagcaataatgtttctgcagtaaatgaagctctcaatgagatctatgtagaagaggaggattacgacaggctgcgtgaatcaactgacttgcacgataactttgatcagattggccttgcccaaaagattgagaagcatgagcttctggagatgaggcgtgttgcagcctacatttacaagaaggcaggccggtggaagcaatcaattgcattatcaaagaaagacaacctttataaagatgcgatggagacagcttcacaatctggcgaccgtgaacttgctgaggagttgcttgtttactttattgagcagggtaagaaggagtgctttgcatcgtgcctctttgtttgttatgacttaattcgcccagatgttgcacttgaacttgcctggatgaataacatgatcgattttgccttcccgtatctgttacagtttatccgggagtacacaggcaaagttgatgaactaattaaggacaagattgaggctgtgaaagaagtaaaggctaaagagaacgaggagaaagacgttatgatgcaacagaatatgtatgcacagttactgccacttgctttgccagcaccacctatgcctggtggtatgggagggggttatggcggccctcccccacccatgggcggtatgggtatgggtatgggtggtatgggtatgggaatgccgccaccatatggcatgccacctatggggtcctattgatttgtggattggagattcacttttgtcattacagcacagcacacactaattttttgggcttttatgttctactcaagcggggcaaaataggcagaggttgctctgcttaagagttcaagttggaaaataatgagtttggtgttgtccgtcgtagggttaaagggtgtgaatatagttctttgtaatattctttggtagttgaggcattttcttttagcagctttaggcgcacaagctgacgagaatttgtattttttgtacgtatactgatttctcaaatggcattttgtgttataattctgaattttgtaatacatcgactttttcttttcagaagcatattattctattatccagttatgtaataatttacatcatgttctag

SEQ ID NO: 5181 - DNA, 5412 bp, Eutrema halophilum
ctccccttatattcgacgagtgactccgattggatcgctgttcgtcatttctcactaccaaagaaaagaaaaaaaaaagaaagttatctatctccttcatcacctttctcgttcactagcctcagatctggcagcgatttcaaatcttcttcagtttctatcgcatcgctcctctctctcctggccgttgacggccccgtcccggccgtggatctgattctagccccggattctcttgctgcgatctgaggtcaaacatggcggcagcaaacgcccccatcacgatgaaggaggtcctgacgcttccgagcattgggatcaatcagcaattcatcacgtttacaaatgttactatggagtctgacaagtacatatgtgtacgagagacggcgccgcagaacagcgttgttattatagatatgaatatgccgatgcagcctctaaggagacccataactgcagattctgcccttatgaacccaaactcgaggatccttgccttaaaagctcaagttccaggaactactcaggatcacctacagatatttaacatcgaagcaaaagcaaagttaaaatcacatcagatgcctgagcaggttgctttttggaaatggattacaccaaagatgttggggctggtcacacaaacttcggtgtatcattggtcgattgaaggtgattctgagccagttaagatgtttgatagaacagccaatttggcaaacaatcaaattataaattataagtgctctcctaatgagaagtggttggtattgattggaattgctcctggatctcctgagagaccacaattggtaaaagggaatatgcagcttttctctgtggaccaacagcggagccaggcccttgaagcacatgctgcttcatttgctcagtttaaggtccccgggaatgagaatccttctattcttatatcctttgcaagcaagagctttaatgctgggcagataacatcaaaattgcatgtcattgagcttggtgcccaaccaggaaaaccatcatttacaaagaagcaggcagatctctttttccccccagattttgctgatgattttcctgtagccatgcaggtctctcacaaatttaacttgatatatgtcatcaccaagcttggcctgttgttcgtatacgatttagagacggcttctgctatctacagaaatcggataagtccagacccaattttcttgacttctgaagcttcctcagttgggggtttctatgccattaataggcgaggacaagttcttttggctacagtaaatgaggctacgataataccttttattagtggtcaattgaacaatttggaacttgctgtcaatcttgctaaaagaggaaacctccctggtgcagaaaatctggttgtccagcggttccaggagttatttgctcaaacaaagtacaaggaggctgctgagcttgctgctgaatcccctcagggaattctaaggacacctgatacagtggctaaattccagagtgttcctgtacaagcagggcaaactcctccattgttacagtattttgggacccttttgactagagggaagctcaatgtatatgagtctctggaactatctcggcttgttgtgaatcaaaacaagaaaaacctcttggaaaactggttggcagaggataagttagaatgcagtgaagaacttggagaccttgtaaagactgtggataatgaccttgctctgaaaatatacatcaaagctcgagctactccaaaagttgtagcagcttttgcagagcgaagggagtttgacaaaatactgatttactcaaagcaggttggctacacacctgactacatgtttcttctgcaaaccatactccgtacggatcctcagggagcagtaaattttgctttaatgatgtcccaaatggaaggaggttgcccagttgactacaacaccatcactgatctgttccttcagagaaatctgatccgtgaagcgactgctttccttctagatgttctgaagccaaatttacctgagcatgcttttcttcagacgaaggttctggagatcaatttagtaacatttcctaacgtggctgatgcaattttagcaaatgggatgttcagccactatgaccgccctcgtgttgctcagctttgtgaaaaagctggactttatatccaatctttaaagcattactcagagttacctgatattaaacgtgtaattgtgaacacacacgctattgagccacaggctcttgtcgagtttttcggtactctttctagcgagtgggctatggagtgcatgaaagatcttctgctggtcaacctgagaggcaaccttcagataatcgttcaggcttgcaaggagtactgtgagcaacttggtgttgattcatgcattaaactctttgagcagttcaagtcattcgaagggctatactttttcctaggttcatatttgagtatgagtgaggatcctgagattcatttcaagtacattgaagcagctgccaagactggtcaaataaaggaggttgagcgtgtgactagagagtctaacttttatgatgctgaaaagacgaaaaactttttgatggaagctaagcttcctgatgcccgacctttgataaatgtctgcgaccgtttcggctttgtgcctgatcttactcattacctgtacacaaacaacatgcttcgttacattgaaggttacgttcagaaggtgaaccctgggaatgctcccttagtggtgggacagttgcttgatgacgaatgccctgaagattttataaaaggcctcattctctctgttcgttcattgcttcctgttgaaccccttgttgaggaatgtgagaagagaaatcgacttcgtctcctcactcaattcttggagcatctagttagtgagggaagccaagatgtgcatgtccataatgccttgggtaaaattatcatagacagtaacaacaaccctgagcatttcctgaccaccaacccttactacgactccaaggttgtgggtaagtactgtgagaaacgtgatcccaccctggctgttgtggcatatagaagaggacaatgtgatgaggaactcatcaatgtcaccaacaagaactctttgttcaagttacaagccaggtacgtagtggagaggatggatggtgacctctgggagaaggttcttacggaagaaaatgaatatagaagacaacttattgaccaagttgtgtctactgctttacccgaaagcaagagcccagagcaagtttctgcagctgttaaagcattcatgactgctgatctgccgcatgagctcattgagcttcttgaaaagattgtgcttcaaaattctgccttcagtggaaacttcaacctgcaaaatctgcttatactgacggctatcaaggcagatccgtctagagttatggattacattaacaggcttgataattttgatggtccggctgttggagaagtggcggttgatgcccagctgtatgaggaagcatttgcgattttcaagaagtttaacttaaatgttcaggctgtcaacgtattgttggataacgtcagaagcattgagcgtgctgttgagtttgctttccgagtcgaagaagatgcagtgtggagccaagtcgctaaggctcaactcagggatggactagtcagtgatgcaatcgagtcctttatccgagctgatgatgccactcaattcctggaggtcatccgtgcctctgaagatacgaatgtctatgatgacttggtcagatacctgttgatggttagacagaaggtgaaggaacccaaggttgatagtgagctcatctatgcttatgcaaagattgaaaggttgggtgagattgaagaatttattctaatgccaaacgttgctaacctacaaaatgtcggtgatcgcctgtatgacgaagcgctgtatgaggctgcaaaaataatttatgcgtttatatcgaattgggccaagttagccgtcacacttgtgaagttgcaacagttccaaggtgctgttgatgctgcaaggaaagcaaacagtgcaaagacatggaaggaagtctgctttgcttgtgttgatgcagaggaattccggttggctcaaatatgtggacttaacattatcatacaggtggatgatttggaagaagtcagcgagtactaccagaacagaggatgcttcaacgaattaatctcacttatggagagtggacttggtctggaacgggctcacatggggatcttcacggagttgggtgtactatacgccagatatcgttatgagaagcttatggaacacatcaagttgttctcgactcgcctcaatattcccaagcttatacgggcctgtgatgaacaacagcactggcaggaacttacctatctttacattcaatatgatgagtttgataatgctgcaaccactgtcatgaaccattctcctgaagcatgggaacacatgcaattcaaagacattgtcgccaaggttgcgaatgtcgagctttactacaaggccgttcacttctacttacaagagcaccctgatataatcaatgatcttctcaatgtgcttgccctgcggttagatcacacgcgtgtcgttgatattatgcgcaaggctggtcacttgcgccttatcaagccatacatggttgcagttcagagcaacaatgtctctgctgtaaatgaagctctgaatgagatatacgtagaagaagaagactatgacaggttgcgtgagtctatcgatttgcatgacagttttgaccagataggcctcgctcagaagattgaaaaacacgagcttgtagaaatgagacgtgtggctgcgtatatctacaagaaagctggtagatggaagcaatcaattgctttgtcaaagaaagataacatgtacaaggactgtatggaaactgcttcacaatcgggtgaccatgaccttgcagaacaacttctggtttacttcattgaacaggggaaaaaggaatgctttgccacatgtctatttgtctgttatgacttaatcagaccagatgttgctctagaacttgcttggatcaacaatatgatcgactttgccttcccgtatctcctccagtttatccgagaatactctggcaaagtggatgaactaataaaggacaagatagaggcacaaaaagaagtgaaggccaaagagcaagaagagaaggaggtcatgtcccaacagaacatgtacgcccaattattgccactggctctacctgccccaccgatgccaggaatgggaggaggaggtcctccagggatgggaggaggttatggtccgccaccaccgatgggcggaatgcctccaatgccaccatttggaatgcctcctatgggcggctactaagacacccattggaaactatccgttcaaaagtagt

SEQ ID NO: 5182 - DNA, 5152 bp, Arabidopsis lyrata
gccgcgatctgaggtcaaacatggctgctgccaacgcccccatcacgatgaaggaggtcctgacgcttcctagcgtcgggatcaatcagcaattcatcacgtttacaaatgttactatggagtctgacaagtacatctgtgtacgagagacgtcaccgcaaaacagtgttgtaattatagatatgaatatgccgatgcagcctctaaggagacctattaccgcagattctgctcttatgaacccaaactcgaggatccttgccttaaaagctcaagttccaggaaccactcaggatcatctacagatatttaacattgaagcaaaagcaaagttaaaatcacatcagatgcctgagcaggttgtcttttggaagtggattacaccaaagatgttggggctggtcacacagaattccgtctatcattggtcaattgaaggcgattctgagccagttaagatgtttgatagaacagccaatttgaccaacaatcaaattataaactataagtgctctcctaatgagaagtggttggttttaattggaattgctcctggctctcctgagagacaacaattggttaaaggaaatatgcagcttttctctgtggatcaacagcggagtcaggcccttgaggcacatgctgcatcatttgcgcagtttaaggtccctgggaatgagaatccttctattcttatatcatttgcaagcaagagctttaatgctgggcagataacatcaaagttgcatgtcattgaacttggtgcccaacctggaaaaccatcatttacaaaaaagcaagcagatctctttttcccacctgattttgctgatgattttcctgttgccatgcaggtctctcacaaatttaacttgatatatgttatcaccaaacttggcctattgtttgtgtacgatctagagactgcttctgctatctacagaaatcggattagtccagacccaattttcttgacttctgaagcttcctcagttgggggtttctatgccattaataggcgaggacaagttcttttggctacagtaaacgaggctaccattataccttttattagtggccaattgaacaatttggagcttgctgtcaatcttgctaaaagaggaaacctcccaggtgcagaaaatctggttgtccagcggttccaggagttgttcgctcaaacaaagtacaaggaggctgctgagcttgctgctgaatctcctcaaggaattctaaggacacctgatacagtggccaaattccagagtgttcctgtacaagctgggcaaactcctccattgttacagtattttgggactcttttgactagagggaagctcaattcatatgagtcactggaactatctcggctggttgtgaaccaaaacaagaagaacctcctggaaaactggttggcagaggataagctagaatgcagtgaagaacttggagaccttgtcaagactgttgataatgatcttgctctgaaaatatacatcaaagctcgggcgactccaaaagttgtagcagcttttgcagaaagaagggagtttgacaaaatattgatttactcaaagcaggttgggtacacacctgattacctgtttcttctgcaaaccatactccgtacagatcctcagggagcagtaaattttgcattaatgatgtctcaaatggaaggaggttctccagttgactacaacaccatcactgatctttttcttcagagaaatctgatccgtgaagcgacttctttccttctggatgtgctaaagccaaatttacctgagcatgcttttctgcaaactaaggttctggagatcaatttggtaacttttcctaatgtggctgatgcggtattagcaaatggaatgttcactcactatgaccggcctcgtattgctcaactttgtgaaaaggctggactttatatccaatccttgaagcattactcagagttgcctgatataaaacgtgtaattgtaaacacacatgctatcgagccacaggctcttgttgagttttttggcactctttctagcgagtgggctatggagtgcatgaaggatctgttgctggtcaacctgagaggcaatctgcagataattgttcaggcttgcaaggagtactgtgagcaacttggtgttgatgcatgtattaagctctttgagcagttcaagtcatacgaagggctatactttttcctaggttcatatttgagtatgagtgaggatcctgagattcacttcaaatacattgaagcagctgccaagactggtcaaataaaggaggttgagcgtgtaactagagagtctaacttctatgatgctgaaaagacgaagaactttttgatggaagctaagctgcctgatgcacgacctttgataaatgtctgcgatcgttttggctttgtgcctgatcttactcattacctctacacaaacaacatgcttcgttacattgaaggttacgtacagaaggtgaaccctgggaatgctcccttagttgttgggcagttgcttgatgatgaatgccccgaagattttataaaaggcctcattctctctgttcgttcattgcttcctgttgaaccacttgtcgaggaatgtgagaagagaaatcgactccgtctcctcactcagttcttggagcatttagttagtgagggaagccaggatgtgcatgtccataatgccttgggtaaaattatcatagacagtaacaacaaccctgagcatttcctgaccaccaacccttactacgactctaaggtcgtgggtaagtactgcgagaaacgtgatcctaccctggcggttgtggcatacagaagaggacaatgtgatgaggaactcatcaatgtcactaacaaaaactctttgttcaagttacaagccaggtatgtagtggagaggatggatggtgatctctgggataaggttctcgatgaaaacaatgattatagaagacagcttattgaccaagttgtttctactgctttacctgaaagcaagagcccggagcaagtttctgcagctgttaaagcattcatgactgctgatttgccgcacgagcttattgagcttcttgaaaagattgttcttcaaaattctgccttcagtggaaacttcaatctgcaaaatctgcttatattgacagctattaaggcagatccatctagagttatggattacattaacaggctggacaactttgatggacctgcggttggagaagtcgcagttgaagcccaattgtatgaggaagcatttgctatcttcaagaagttcaacttaaatgttcaggctgtcaatgtattgctggataacgtcagaagcattgagcgtgcagttgagtttgcattccgggtcgaagaagattctgtttggagccaagttgctaaggcgcaactcagagaaggactagtcagtgatgcaattgagtcctttatccgtgctgatgatgccactcatttcttggaagtcatacgtgtctctgaagatactgatgtctatgatgacttggtcaaataccttctgatggttagacagaaggtgaaggaacccaaggttgatagtgagcttatctatgcatatgcaaagattgataggttaggtgagattgaagaattcattctgatgccaaacgttgctaatctacaaaatgttggtgatcgtctgtatgacgaagctctgtatgaggctgcaaaaataatatatgcgttcatatcaaactggggcaagttagccgtcacacttgtgaagttgcaacagttccaaggtgctgttgatgctgcaaggaaagcaaacagtgcaaagacatggaaggaagtctgctttgcttgcgttgatgcagaggaattccggttggctcaaatctgtggtcttaacattatcattcaggtggatgacctggaagaagtcagcgagtactaccagaacagagggtgcttcaatgaattaatctcacttatggagagtggacttgggcttgaacgtgctcacatgggtatcttcaccgagttgggtgtactctatgctagatatcgttatgagaaacttatggaacacatcaagttattttcaactcgcctcaatattcccaagcttatacgggcctgtgatgaacaacagcactggcaggaacttacctatctgtacattcaatatgatgagtttgataatgctgcgaccaccgtcatgaaccattctcctgaagcatgggagcacatgcaattcaaagacattgttgccaaggtagcgaatgttgaactgtactacaaggctgtgcacttctacttgcaagagcatcctgatctaatcaacgatcttctcaacgtgcttgcgttgcggttagaccatactcgtgttgttgatataatgcggaaggctggtcacttacgtcttatcaagccatacatgattgcagttcagagcaacaatgtctctgccgttaatgaggctctgaatgagatatacgtggaagaagaagactatgataggttgcgagagtctattgatttacatgacagctttgaccagattggcctcgctcagaagatcgagaaacacgagcttgttgaaatgagacgtgtggctgcttatatctacaagaaagcgggcagatggaagcaatcaattgcattatcaaagaaagacaacatgtacaaggactgtatggaaactgcttcacaatccggcgaacatgaacttgcagaacaactactggtgtacttcattgaacaggggaaaaaggaatgctttgctacatgtctgtttgtatgttatgacttaatccgaccagacgtggctcttgaacttgcatggatcaacaatatgatggactttgccttcccgtatctcctccagtttatccgagaatactctggcaaagtggatgagttaataaaggacaagctggaggcacaaaaagaggtgaaggctaaagagcaggaagagaaggatgttatgtcccaacagaacatgtacgcccaactattgccacttgctttacctgcaccaccgatgccaggaatgggaggtggtggtgggtatggcccgccaccacaaatgggcggtatgccaggaatgcctcccatgccaccatatggaatgccaccaatgggtggctactaatatccgcattggaaaattat

SEQ ID NO: 5183 - DNA, 5832 bp, Arabidopsis thaliana
aggcacttgtagcacgtcgtctctcctttggtttctctccttatattcgacgagtgactccgattggatcgctatttcgtcatttctcactttccaaaaagaaaaaaacgaatctctctccaccatcatcacctttctccttcacttgcctcagatctggctgcgatttcaaatcttccttagtttctctcgcatcgctcggccgttgacggtcccgtcctttccgtggatctgattctggccccggattctctcgccgcgatctgaggtcaaacatggcggctgctaacgcgcccatcattatgaaggaggtcctaacgcttccgagcgttgggatcggtcaacagttcatcacctttacaaatgttactatggagtctgataagtacatatgtgtacgagagacggcaccgcagaacagtgttgtaattatcgatatgaatatgccgatgcagcctttaaggaggcctataactgctgattctgctcttatgaacccaaactcgaggatccttgccttaaaagctcaagttccaggaactactcaggatcatctacagatatttaacattgaagcaaaggcaaagttgaagtcacatcagatgcctgagcaggttgctttttggaagtggatcacacctaagatgctgggactggtcacacaaacttctgtgtatcattggtcaattgaaggtgattctgagccagttaagatgtttgatagaacggctaatttggcaaacaatcaaattataaactataagtgctctcctaatgagaagtggttggtcttgattggaattgcccctggctctcctgagagaccacaattggtgaaaggaaatatgcagcttttctctgtggatcaacagcggagccaggcccttgaagcacatgctgcatcttttgctcagtttaaggtccctgggaatgagaatccttcgattcttatatcatttgcaagcaagagctttaatgctgggcagataacatcaaagctgcatgttattgaacttggtgcccaaccagggaaaccatcatttacaaaaaagcaggcagatctctttttccccccagattttgctgatgattttcctgtggccatgcaggtctctcacaagtttaacttgatttatgtcatcaccaagcttggcctgctgtttgtatatgatctagagacagcttctgctatctacagaaatcggataagtccggacccaattttcttaacgtctgaagcttcctcagttgggggtttctatgccattaataggcgaggacaagttcttttggcaacagtaaatgaggccaccataataccttttattagtggtcaattgaacaatttggaacttgctgtcaatcttgctaaaagaggaaacctccctggtgcagaaaatctggttgtccagcggttccaagagttatttgctcaaacaaagtacaaggaggctgctgagcttgctgctgaatctcctcagggcattctacggacacctgatacggtggccaaattccagagtgttcctgtacaagcagggcaaactcctccattgttacagtattttgggacccttttgactagagggaagctcaattcatatgagtctttggaactatctcggcttgttgtgaatcaaaacaaaaagaacctcttggaaaactggttggcagaggataagttagaatgcagtgaagaactcggagaccttgtcaaaactgtggataatgaccttgctctaaaaatatacatcaaagctagagctactccaaaagtcgttgcagcttttgcagagcgaagggagtttgacaaaatattgatttattcaaagcaggttgggtacacacctgattacatgtttcttctgcaaacgatactccgtacggatcctcagggagcagtaaattttgctttaatgatgtcccaaatggaaggaggttgtccagttgactacaacactatcactgatcttttccttcagagaaatctgatccgtgaagcgactgctttccttctggatgttctgaagccaaatttacccgagcatgcttttctgcaaactaaggttttggagatcaatttggtaacctttcctaatgtggctgatgcaatcttagcaaatgggatgttcagccattatgaccggcctcgtgttgctcagctttgtgaaaaggctggactttacatccaatctttaaagcattactcagagttacctgatatcaaacgtgtaattgtgaacacacatgctattgagccacaggctcttgtcgagttttttggtactctttctagcgagtgggcaatggagtgcatgaaagatctcctgttggtcaacctgagaggcaaccttcagataatcgttcaggcttgcaaggagtactgtgagcaacttggtgttgatgcatgcattaaactctttgagcaattcaagtcgtacgaagggctgtactttttcctaggttcatacttgagtatgagtgaggatcctgagattcacttcaagtacatcgaagcagctgccaagactggtcaaataaaggaggttgagcgtgtgactagagagtctaacttttatgatgcggaaaagacgaagaactttttaatggaagctaagcttcctgatgcccgacctttgattaatgtctgtgatcgttttggctttgtacctgatcttactcattacctctacacaaacaacatgctgcgttacattgaaggttacgttcagaaggtgaatcctgggaatgctcccttagttgtggggcagttgcttgatgacgaatgccctgaagattttataaaaggcctcattctttctgttcgttcattacttcctgttgaaccccttgttgcagaatgtgaaaagagaaatcgactccgtctcctcactcagttcttggagcatctagttagtgagggaagccaagatgtgcatgtccataatgccttgggtaaaattatcatagacagtaacaacaaccccgagcatttcctgaccaccaatccttactacgactctaaggttgtgggtaagtactgcgagaaacgtgatcccactctggctgttgtggcatacagaagaggacaatgtgacgaggaactcatcaatgtcaccaacaagaactctttgttcaagttacaagccaggtacgtagtggagaggatggatggtgacctctgggagaaggttcttacggaagaaaatgaatataggaggcaacttatagaccaagttgtgtctactgctttaccagaaagcaagagcccagagcaagtttctgcagctgttaaagcattcatgactgctgatttgccacatgagctaattgagcttctggaaaaaattgtgcttcaaaattctgccttcagtggaaatttcaatctgcaaaatctacttatactgacagctattaaggcagatccgtccagagttatggattacattaacaggctggataatttcgatggtccagctgttggagaagtggcagtggatgctcaattgtatgaggaagcatttgcgattttcaagaagtttaacttaaatgttcaggctgtcaacgtattgttggataacgtcagaagcattgaacgtgctgttgagtttgctttccgggtcgaagaagatgctgtttggagtcaagtcgctaaggcacagctcagggaaggactagtcagtgatgctattgagtcctttatccgagctgatgacaccactcagttcttggaggtcatccgagcctctgaagatactaatgtctatgatgacttggtcagataccttctgatggttagacagaaggtgaaggaacccaaggtggatagtgagctcatctatgcttatgcaaagattgaaaggttgggtgagattgaagaatttattctgatgcccaacgttgccaaccttcaacatgttggtgaccgtttgtacgatgaagctctgtatgaggctgcaaagataatatatgcattcatatcgaattgggccaagttagccgtcacccttgtgaagttgcaacagttccaaggtgctgttgatgctgcaaggaaagcaaacagtgcaaagacatggaaggaagtctgctttgcttgtgttgatgctgaggaattccgactggctcaaatctgtggacttaacattatcatacaggtggatgacctggaagaagtaagcgagtactaccagaacagaggatgcttcaatgaattgatctcccttatggagagtggacttggtctggaacgtgctcacatgggtatcttcaccgagttaggagtactgtacgccagatatcgttatgagaagcttatggaacacatcaagttgttctctactcgactcaatattcccaagcttatccgggcctgtgatgaacaacagcattggcaggaacttacctatctttacattcaatatgatgagtttgataatgctgcaaccactgttatgaatcattctcctgaagcatgggagcacatgcaattcaaagacattgttgccaaggttgcgaatgttgagctttactataaggccgttcacttctacttgcaagagcaccctgatataatcaacgatcttctcaatgtgcttgctctgcggttagatcacacgcgtgtcgttgatattatgcgcaaggctggtcacttgcgccttattaagccatatatggttgcagttcagagcaataatgtatctgctgtaaatgaagctctgaatgagatatatgcagaagaagaagactatgacaggttgcgcgagtctattgatttgcatgacagttttgaccagataggtctcgctcagaagattgagaaacacgagcttgttgaaatgagacgtgtggctgcttatatctataagaaagctggtagatggaagcaatcgattgctttgtcaaagaaagataacatgtacaaggactgtatggaaactgcttcgcaatccggcgaccatgatcttgcagaacaacttctcgtctacttcattgaacaggggaaaaaggaatgctttgctacatgtctctttgtctgttatgacttaatccgaccagacgttgctctagaacttgcttggatcaacaatatgatcgactttgccttcccgtatctcctccagtttatccgagaatactccggcaaagtggatgagctaatcaaggacaagctggaggcacaaaaagaggtgaaggccaaagaacaggaagagaaggatgtcatgtcacaacagaacatgtacgcccaattattaccactggctctacccgcaccaccgatgccaggaatgggaggtggcgggtatggtccaccaccacaaatgggtggaatgccaggaatgtcaggaatgcctccaatgcctccatatggaatgccaccgatgggcggctactaagacctttgggaaaacaagtatccatataagtaattgaaatctcatagtagcgcaatctgccatggtggtattcgcttactagaagactgtgaccgcggaattctgtcggaatgtttccttgttttgttttgttttataggtttgtgtggataataaaccagctttcgtctgtaatattctttgagggggtttaggtgagtcatttttgattgaggtcatttaaatattttcctttggaggagaggagactcctttatagtctttatcattttactctttgaccttttttcatatgagttgttctttccttctttctttcagcttatcttcacttcatttaaacctttttgagttatgttttttcgtacgacaaacttcctcttgttcttgcttcgataaatttcaaaatacagtgtctgatgaatcatcaccacttgat

SEQ ID NO: 5184 - DNA, 5482 bp, Brassica napus
ttcccggccttggatctgattctgccaccggcgcgatctgaggtcaatcatggcggcagcaaacgccccaatcacgatgaaggaggtcctaacgcttccgagcattgggatcaaccagcaattcatcacgtttacgaatgttactatggagtctgacaagtacatatgtgtacgagagacggcgccgcagaatagcgttgttattatagatatgaacatgccgatgcagcctctaaggagacctataactgctgattctgctcttatgaacccaaactccaggatccttgccttgaaagctcaagttccaggaactactcaggatcatcttcagatatttaacatcgaagcaaaagcgaagttgaaatcacatcagatgcctgagcaggttgctttttggaaatggattacaccaaagatgttggggctggtcacacaaacttccgtgtatcattggtcgattgaaggtgattctgagccagttaagatgtttgatagaacggccaatttggctaacaatcaaattattaactataagtgctctcctgatgagaagtggttggtgttgattggaattgctcctggctctcctgagagaccacaattggtaaaagggaatatgcagctattctctgtaaatcaacagcggagccaggcccttgaagcgcatgctgcttcatttgctcagtttaaggtccctgggaatgagaatccttctattcttatatcctttgcaagcaagagctttaatgctgggcagataacatcaaagttgcatgtcattgagcttggtgcacaaccagggaaaccatcattttcaaagaagcaggcagatctctttttccctcctgattttgcagatgactttcctgtagccatgcaggtctcacacaaatttaacttgatatatgtcatcaccaagcttggcctgttgtttgtatacgatctagagacggcttctgctatctacagaaatcggataagtccagacccaattttcttgacttctgaagcttcttccgttgggggtttctatgccattaataggcgaggacaagttcttttggctacagtaaacgaggctacgataataccgtttattagcggtcaattgaacaatttggaacttgctgtcaatctggctaaaagaggaaacctccctggtgcggaaaatctggttgtccagcggttccaagagttatttgctcaaacaaagtacaaggaggctgctgaacttgctgctgaatctcctcaggggattctacggacacctgatacggtggctaagttccagagtgttcctgtacaagcagggcaaactcctcccttgttacagtattttggaacccttttgactagagggaagctcaattcatatgagtctttggaactatcccgacttgttgtgaatcaaaacaagaagaaccttttggaaaactggttggcagaggataagttagaatgcagtgaagaacttggagaccttgtgaagactgtggataatgacctggctctgaaaatatacatcaaagctcgagctactccaaaagtcgtagcagcttttgcagagcgaagggagtttgacaaaatactgatttactcaaagcaggttgggtacacgcctgattacatgtttcttctgcaaacaatactccgtacggatcctcagggagcagtaaatttcgctttaatgatgtcccaaatggaaggaggttgtccagttgactacaacaccataactgatcttttccttcagagaaatctgatccgtgaagcgactgctttccttttggatgttctgaagccaaatttacctgagcatgcttttctacaaactaaggttttggagatcaatttggtaacctttcccaatgtggctgatgcaattttagcaaatgggatgttcagccactatgaccgccctcgggttgctcagctttgtgaaaaggctggactttatatccaatctttaaagcattactcagagttacctgatattaaacgtgtaattgtgaacacacatgcaattgagccgcaggctcttgtcgagttttttggtactctttccagcgagtgggctatggagtgcatgaaggatcttctgttggttaacctgagaggcaaccttcagataatcgttcaggcttgcaaggagtactgtgagcaacttggtgttgattcatgtatcaaactctttgagcagttcaagtcgtatgaaggactatactttttcctaggttcatatttgagtatgagtgaggatcccgagattcacttcaagtacattgaagcagctgccaagactggtcaaataaaggaggttgagcgtgtcactagagagtctaacttttatgatgctgaaaagacgaagaactttttgatggaagctaagcttcctgatgcccggcctttgataaatgtctgcgaccgttttggctttgtacctgatctgactcattacctgtacacaaacaacatgctacgttacattgaaggttacgttcagaaggtcaaccctgggaatgctcccttagttgtggggcagttgcttgatgacgaatgccctgaagattttataaaaggcctcattctctctgttcgttcattgcttccagtcgaaccccttgttgaggaatgtgagaagagaaatcgactccgtctccttactcagttcttggagcatctagttagtgagggaagccaagatacgcatgtccacaatgccttgggtaaaattatcatagacagcaacaacaaccctgagcatttcctgaccaccaacccgtactatgactctaaggttgtgggtaaatactgcgagaaacgtgatcccaccctggctgttgtggcatacagaagaggacaatgtgatgaagaactcatcaatgttaccaacaaaaactctttgttcaagttacaagccaggtacgtagtggagaggatggatggtgacctctgggacaaagttcttattgaagaaaatgagtatagaagacaacttattgaccaagttgtgtctactgctttacccgaaagcaagagcccagagcaagtctctgcagctgttaaagcattcatgactgctgatctaccgcatgagcttattgagcttcttgaaaagattgtgcttcaaaattctgcctttagtggaaacttcaatctgcaaaatctgcttatattaacagcaatcaaggcagatccgtctagagttatggattacattaacaggctggataattttgatggtccggctgttggagaagttgcagttgatgcccaattatatgaggaagcatttgcgatttttaagaagtttaacttaaatgttcaagctgtcaacgtattgttggataacgtcagaagcattgagcgtgccgttgagtttgctttccgggttgaagaggattctgtttggagccaagtcgctaaggctcagctcagagatggactagtcagtgatgcaattgagtctttcatccgtgctgaggatgccactcatttcttggaggtcatacgtgctactgaagatgctaatgtctatgatgacttggtcagataccttcttatggttagacagaaggtgaaagaacccaaggttgatagtgagctcatctatgcttatgcaaagattgataggttgggtgagattgaggaatttattcttatgccaaacgttgctaacctacaaactgtcggtgatcgcctgtatgacgaagcgctgtacgaggctgcaaaaataatttatgcgttcatttcaaactgggccaagttagccgtcacacttgtgaagttgcagcagttccaaggtgctgttgatgctgcaaggaaagcaaacagtgcaaagacatggaaggaagtctgctttgcttgtgttgacgcagaggaattccggttggctcaaatatgtggacttaacgtcattatacaggtggacgacctggaagaagtcagcgagttctaccagaacagaggatgcttcagtgaattaatctcacttatggagagtggactcggtctggaacgggctcacatggggatcttcaccgagttgggtgtactgtacgccagatatcgttatgagaagcttatggagcacatcaagttgttctccactcgcctcaatattcccaagcttatacgggcctgtgatgaacaacagcactggcaggagcttacctatctttacattcaatatgatgagtttgataatgctgctaccactgtcatgaaccactctcctgaagcatgggagcacatgcaattcaaagacattgttgccaaggttgcgaatgtagagctttactacaaggcagttcacttctacttgcaagagcaccctgatataatcaacgatcttctcaatgtgcttgctctgcggttagatcacacacgtgtcgttgatattatgcgcaaggctggtcaattgcgccttatcaagccttacatggttgcagttcagagcaacaatgtttctgctgtaaacgaagctctgaatgagatatacgtagaagaagaagactatgacaggttgcgcgagtctatcgatttgcatgacagctttgaccagataggcctcgctcagaagattgagaaacacgagcttgtagaaatgagacgtgtggctgcgtatatttacaagaaagctggtagatggaagcaatcaattgctttgtcaaagaaagataacatgtacaaggactgtatggaaactgcttcacaatccggcgaccatgaccttgcagaacaacttctcgtttacttcattgaacaggggaagaaggaatgctttgccacatgtctctttgtgtgttatgacttaatcagaccagatgttgctctagaacttgcttggatcaacaacatgattgactttgccttcccgtatctcctccagtttatccgagaatactctggcaaagtggacgaactaatcaaggacaagctagaggcacaaaaagaagtgaaggccaaagagcaggaagagaaggatgtcatgtcccaacagaacatgtacgcgcaactattgccactggctctacctgcgccaccgatgccaggaatgggaggaggtccagggatgggaggcggctatggtccgccaccacagatgggaggaatgccaggaatgcctccaatgccaccatatggaatgcctccgatgggcgggtactaagcctaagccatccgttcaagtaatcgagaactcatagtcgcgcgcgcaatctccaccgtggtggtatatgtcggaatgtttccttgtttgattttataggtgtatgtgtggataataaactcgtactttcgtttgtaatattctttgaggggtttttaggtgagtcatttttggttgaaggccatgttactatttttcttttgaggggggagagatgtaactcctaactagtctacttgtcattttactttgatctttctctcatgagttgctctttcttttcagtttattatttttcacttataattt

SEQ ID NO: 5185 - DNA, 5779 bp, Glycine max
gtctccacgtctttctctctctctctctcttcgttttgaagagggttcaagtcttctcttccgctgcttccagatctcgcagcagccatttggatcctactcaagctccttctcactcttcactcttccactctccatccacgaattcaattcgccggttgcagatccgattcttcgattttcacttcctcgattcaagccactatggcggccgcgaatgctccgatcaccatgaaagaagccctaactttgccgagcattggcatcaattcgcaattcatcacgttcacgcacgtgacgatggaatcggataagtatatatgtgttcgagaaaccgctccacagaatagcgtggttatcattgatatgaacatgccaaatcaacctttgaggaggcctataactgcggattctgctcttatgaatccgaattctagaattctcgctttgaaagcccaactgcaagggactactcaagatcacctacaaatatttaacattgagatgaaagcaaagatgaaatcatatcagatgcctgagcaggtagttttttggaagtggattagccccaaaatgttgggtctcgtaactcagacctctgtataccactggtcaattgaaggtgactctgaacctgttaagatgtttgagagaacagcaaatttggcaaacaaccagataattaattatcgatgtgaccctacagaaaaatggttggtcttgattggtattgctcctggttctcctgagaggccgcaattggtaaagggaaacatgcaacttttctctgtggatcaacaacgtagtcaggctcttgaagctcatgccgcatcatttgcccaatttaaagttcctgggaatgaaaacccttctgttttgatttcttttgcctcaaagacacttaatgctggccaagttatatccaaattgcatgttattgaactcggtgcacaaccagggaagccatcatttacaaagaaacaagctgatcttttcttccccccagattttgctgatgattttccagttgccatgcagatatcccacaaatacaatttgatttatgtgattacgaaacttggcctactatttgtctatgatttggagacagctactgctgtatataggaacagaatcagtccagatcctatatttttgacctcagaagctacatctgtgggaggcttttatgccataaacaggagaggccaggttttattggctactgttaatgaacaaaccattgtgaattttgtcagtggccaattaaacaatttggagctagcagttagtcttgccaaaagaggaaatcttcctggtgctgagaagctggtagtggaacgttttcatgaactgtttgcccaaacaaaatataaggaagctgcagagcttgcagctgaatctccacaaggaatccttcgaactcctgacacagttgccaaatttcagagtgttcctgtgcaagttgggcaaactcctcctttgttgcagtattttggaacacttttaacaaggggaaagttgaatgcctttgaatcattagaattgtcacggttggttgtgaaccagaacaagaaaaatctgttggaaaattggttggcagaggacaagcttgaatgcagtgaggagctaggagatctcgttaagactgtggacaatgatcttgctttaaaaatatatatcaaagccagagctactccaaaagttgttgctgcatttgctgagaggagggagtttgacaaaattctgatttactctaaacaggttgggtacacacctgactacctcttccttctgcaaacaattctccggacagatccgcagggcgctgttaattttgcattaatgatgtctcaaatggagggaggtagcccagttgattacaacacaataactgatctctttcttcagagaaatctgatccgagaggctacagcttttctcctggatgttttaaagccaaatctaccagaacatgggttccttcagacaaaggtgttggagataaatctggtgactttccccaatgttgctgatgcaatattggctaatggcatgttcagccattatgaccgtcctcgtattgcccagctttgcgaaaaagcgggcctttatgtgcgagctttgcaacattacacagaattaccagacatcaaacgtgtgattgttaattcacatgcaattgaacctcagtcacttgtagagttttttggtacactgtcaaaagaatgggcattagagtgcatgaaagacttactgctggccaatcttaggggcaacctacagatcattgtgcaggttgctaaagaatattgtgagcaattgggtgttgatgcctgcataaaactttttgagcaatttaggtcatatgaaggactgtactttttccttggatcatacttgagctccagtgaggatcctgatattcactttaagtacattgaggcagcggcaaagactggtcaaatcaaggaggttgagcgtgtgacaagagaatcaaatttctatgatgctgagaaaaccaaaaactttctgatggaggctaagcttccagatgcacggcctttgattaacgtttgtgatcgttttggatttgttccagatctaacacactatctatacacaaacaacatggttcgctacattgaaggctatgttcagaaggtgaacccagggaatgcacctttagttgttgggcagctgctagatgatgagtgcgcagaagattttatcaaaggcttgatcctttctgttcgttcattactgccagtggagccccttgtggaggaatgtgagaagaggtggaatcggcttcgtttgctcacacagttcttggaacatcttgtaagtgagggaagccaggatgtacatgttcacaatgcactgggtaaaattatcattgatagcaacaacaacccagaacatttcctcacaaccaacccatactatgattctcgagttgtgggcaagtattgtgagaaacgtgatcccaccttagcagttgtagcttatcggcgaggacaatgtgacgatgaacttatcaatgtcaccaacaaaaattctttgttcaaactgcaagcaagatatgttgttgagagaatggatggtgatttgtgggctaaagttcttgatcctgataatgaatatagaaggcaacttattgatcaggttgtatctactgctttgcctgaaagctcaagccctgagcaagtttctgcagctgttaaggctttcatgacagccgatctgcctcatgaattgattgaacttcttgagaagattgtgcttcagaattctgcattcagtggaaactttaatttgcagaatcttcttattttgacagcaataaaggctgatccatccagagttatggattatgttaatagattggataattttgatgggcctgcggttggagaaatggctgtagaagctcagttatatgaggaagcatttgccatttttaagaagttcaacttgaatgttcaagcagttaatgtgttgcttgataatattcatagcattgatagagctgttgagtttgctttccgagttgaagaagatgctgtttggagtcaggtggccaaggctcaactcagggatgggttagtaagtgatgcaattgagtcatttatacgagctgatgatgctacacaatttttagatgttatccgtgctgctgaagatggcaatgtttaccatgacttggtaaaatacttgctaatggtaagagggaaagcaaaagaacccaaggtcgacagtgagctcatttatgcatatgcaaaaattgataggctgagtgacattgaggagttcattcttatgccaaatgttgctaatcttcaaaatgttggtgaccggttgtatgatgaagcattatatgaagctgcaaaaatcatatttgcttttatatctaactgggccaagttggctatcacactggtcaaattacaacagtttcaaggtgctgttgatgcagcaaggaaagctaacagttcaaagacatggaaggaagtttgctttgcttgtgttgatgcggaggagtttcgtttggcccagatttgtggactcaacattattgttcaggtggatgacttggaagaagtcagtgaatattaccaaaatagaggttgcttcaatgagctaatatctctgatggagagtggtttagggttagaacgggcacatatgggcatctttactgagttaggagttctgtacgctagataccgccctgagaagcttatggagcatatcaaactattctcaacccgcctcaatattcctaaactcatacgagcttgtgatgaacaacagcattggaaagaactgacctatttgtatatacaatatgatgagtttgataatgctgcaactaccatcatgaaccattcacctgaagcatgggatcacatgcaattcaaagatgttgttgttaaagttgctaatgtggagttgtattacaaggctgttcacttctacttggaagagcatccagatcttatcaatgatgttctgaacgtccttgcacttcgtgtggaccatgcacgtgttgttgacatcatgcggaaggctggtcacctccgtcttgtgaaaccatatatggttgcagttcaaagcaacaacgtatctgctgttaatgaagcgttgaatgagatatatgttgaggaggaagattatgatagattgcgcgagtcaattgatttgcacgataactttgatcaaataggccttgcccaaaagattgaaaagcatgagcttcttgagatgagacgtgttgctgcttatatttacaagaaggcaggtaggtggaagcagtctattgctttgtcaaagaaggataacctttacaaagatgccatggagacagcctcacaatctggcgagcgtgaacttgctgaggagttgcttgtttatttcattgatcagggaaagaaggaatgctttgcctcatgtctatttgtttgctatgatttgatacgggcagacattgttcttgaactagcttggatgcacaatatgattgactttgctttcccgtatctattgcagtttattcgtgagtacactggcaaagtcgatgaactggtgaaggacaaaattgaagcacaaaatgaagtgaaggttaaagagcaagaggaaaaggatgtagttgcacaacagaacatgtatgctcaattgttgcctcttgctttgcctgcaccaccaatgcctggaatgggaggcccaggaggtatgggaggaggctttgctcctccccctccaatgggtggactggggatgcccccaatgcctccttatggcatgcctcccatgggcagcagtttttgacaagtttagcatgaacttggcccctgtgaagagcaatgtaggaacttcgaagttttgtgtagaagaatatcttgtgtgatttggatgcagcattctttctttgcttcgggtggcggtgggagatcccaatttaaaataatgtgaagtttctgtttagattgtgtcataatagtcttgtaagtttattgttttttctgggttgtagttgaggcattttttgggctgttggttctagctaaccgataaatttctgtattctaccatttttcttgtattaaatgagttagtcctaggtagaccaaacaaaaaatgaattgctcctagtatatatacgaaatttaccgactttaacagccagctttatatgtgcatgctgtggccaaaatttcctcacttgatgtggaagctacctgattaaatcctgttgacatgctgcttttcacatgcg

SEQ ID NO: 5186 - DNA, 5750 bp, Eutrema parvulum
ttatatgcacgtcgtctcctttggttctccccttatattcgacgagtgactccgattggatcgctgttcgtcatttctcactatcaaagaaaaaaagtatctctctctttctggttcacttgcctcagatctggcagcgatttcaaatcttcttcaggttctctcgcatcgctatctctctcctggccgttgacggtcccgtcccggccgtggatctgattctggccccggattctcttgcagcgatctgaggtcaaacatggcggcagcaaacgcccccatcacgatgaaggaggtcctaacgctcccgagcattgggatcaatcagcaattcatcacgtttacaaatgttactatggagtctgacaagtacatatgtgtacgagagacggcaccgcagaacagcgttgtaattattgatatgaacatgccgatgcagcctctaaggagacctataactgcagattctgctcttatgaacccaaactcaaggatccttgctttgaaagctcaagttccaggaactactcaggatcatctacagatattcaacatcgaagcaaaagcaaagttgaaatcacatcagatgcctgagcaggttgctttttggaaatggattacgccaaaaatgttggggctggtcacacaaacttccgtgtatcattggtccattgaaggtgattctgagccagttaagatgtttgatagaacggccaatttggcaaacaatcaaattattaactataagtgctctcctaatgagaagtggttggtgttgattggcattgctcctggctctcctgagagaccacaattagtaaaggggaatatgcagcttttctctgtggatcaacagcgaagccaggcccttgaagcacatgctgcttcttttgctcagtttaaggtccctgggaatgagaatccttctattcttatatcctttgcaagcaagagctttaatgctggacaaataacatcgaagttgcatgtcattgagcttggtgcccaagcaggaaaaccatcattttcaaagaagcaggcagatctctttttccccccagattttgccgacgattttcctgtagccatgcaggtctctcacaagtttaacttgatatatgtcatcaccaagctcggcctgttgtttgtatacgatttagagacggcttctgctatctacagaaatcggataagtccagacccaattttcttgacttctgaagcttcctcagttgggggtttctatgccattaataggcgaggacaagttcttttggctacagtaaacgaggctacgataataccttttattagcggtcaattgaacaatttggaacttgctgtcaatctggctaaaagaggaaacctccctggtgctgaaaatctggttgtccagcggttccaagagttatttgctcaaacaaagtacaaggaggctgcggagcttgctgctgaatcacctcaggggattctacggacacctgatacggtggctaaattccagagtgttcctgtacaagcagggcaaactcctccactgttacagtattttgggacccttttgacgagagggaaactcaattcatatgagtctttggaactatctaggcttgttgtgaatcaaaacaagaagaacctcttggaaaactggttggctgaggataagttagaatgcagtgaagaacttggagaccttgtcaagactgtggataatgaccttgctctgaaaatatacatcaaagctcgagctactccaaaagttgtagcagcttttgcggagcgaagggagtttgacaaaatactgatttactcaaagcaggttgggtacacacctgattacatgtttcttctgcaaaccatactccgtacagatcctcagggagcagtaaattttgctctaatgatgtcccaaatggaaggtggttgtccagttgactacaacaccatcactgatcttttccttcagagaaatctgatccgtgaagcgactgctttccttctggatgttctgaagccaaatttagctgagcatgcttttctgcaaactaaggttctggagatcaatttggtaacctttcccaatgtggctgatgcaattttagcaaatgggatgttcagccactatgatcgccctcgtgttgctcagctttgtgaaaaggctggactttatatccaatctttaaagcattactcagagttgcctgatattaaacgtgtaattgtgaacacacatgctattgagccgcaggctcttgtcgagtttttcggtactctttctagcgagtgggctatggagtgcatgaaggatcttctgctggtcaacctgagaggcaaccttcagataatcgttcaggcttgcaaggagtactgtgagcaacttggtgttgattcatgcattaaactctttgagcagttcaagtcgtatgaagggctatactttttcctaggatcatatttgagtatgagtgaggatcctgagattcacttcaagtacatcgaagcagctgctaagactggtcaaataaaggaggttgagcgtgtcactagagagtctaacttttatgatgctgaaaagacaaagaactttttgatggaagccaaacttcctgatgcccgacctttgataaatgtctgcgaccgttttggctttgtgcctgatctgactcattacctgtacacaaacaacatgcttcgttacattgaaggttatgttcagaaggtgaaccctggaaatgctcccttagttgtggggcaattgcttgatgacgaatgccctgaagattttataaaaggcctcattctctctgttcgttcattgcttccggttgaaccccttgttgaggaatgtgagaagagaaatcgactccgtctcctcactcagttcttggagcatctagttagtgagggaagccaagatgtgcatgtccataatgccttgggtaaaattatcatagacagtaacaacaaccctgagcatttcctgaccaccaacccttactatgactctaaggttgtgggtaagtactgcgagaaacgtgaccccaccctggctgttgtggcatacagaagaggacaatgtgatgaggagctcatcaatgtcaccaacaagaactctttgttcaagttacaagccaggtacgtagtggagaggatggatggtgacctctgggagaaggttcttacggaagaaaatgaatatagaagacaacttattgaccaagttgtgtctactgctttacccgaaagcaagagcccagagcaagtttctgcagctgttaaagcatttatgactgctgatctgccgcatgagcttattgagcttcttgaaaagattgtccttcaaaattctgccttcagtggaaacttcaatctgcaaaatctgcttatactgacagcaatcaaggcagatccgtctagagttatggattacattaacaggctggataattttgatggtccggctgttggagaagtggcggttgatgcccaattgtatgaggaagcatttgcgatttttaagaagtttaacttgaatgttcaggctgtcaatgtattgttggataatgtcagaagcattgagcgtgctgttgagtttgctttccgggttgaagaagatgctgtttggagccaagtcgctaaggctcaactgagggatggactagtcagtgatgcaattgagtcctttatccgagctgatgatgctactcagttcctggaagtcatccgtgcctcagaagatactaatgtttatgatgacttggtcagataccttcttatggttagacagaaggtgaaagaacccaaggttgatagtgagctcatctatgcttatgcaaagattgaaaggttgggtgagattgaagaatttattctgatgccaaacgttgctaacctacaaaatgttggggatcgcctgtatgacgaagctctgtatgaggctgccaaaataatttatgcgttcatatcaaactgggccaagttagccgtcacacttgtgaagttgcagcagttccaaggtgctgttgatgctgcaaggaaagcaaacagtgcaaagacatggaaggaagtatgctttgcttgtgttgatgcagaggaattccggttggctcaaatatgtggactgaacattattatacaggttgatgacctggaagaagtcagcgagtactaccagaacagaggatgcttcaatgaattaatctcacttatggagagtggacttggtctggaacgggctcacatggggatcttcaccgagttgggtgtactgtacgccagataccgttatgagaagcttatggaacacatcaagttgttctcgactcgcctcaatattcccaagcttatacgggcctgtgatgaacaacagcattggcaggaacttacctatctttacattcaatatgatgagtttgataatgctgctaccacggtcatgaaccactctcctgaagcatgggagcacatgcaattcaaagacattgttgccaaggttgcgaatgtcgagctgtactacaaggccgtacacttctacttggaagagcatcctgatataatcaacgatcttctcaatgtgcttgctctgcggttagatcatacacgtgtcgttgatattatgcgcaaggctggtcacttgcgcattatcaagccgtacatggtcgcagttcagagcaacaatgtctctgctgtaaatgaagctctgaatgagatatacgtagaagaagaagactatgacaggttgcgtgagtctatcgatttgcatgacagctttgaccagataggcctcgctcagaagattgagaaacacgagctcgtagaaatgagacgtgtggctgcctatatctacaagaaagctggtagatggaagcaatcaattgctttgtcgaagaaagacagtatgtacaaggactgtatggaaactgcttcacaatccggtgaccatgaccttgcagaacaacttctggtttacttcattgaacaggggaaaaaggaatgctttgccacatgtctctttgtctgttatgacttaatccgacccgatgttgctctagaacttgcttggatcaacaatatgattgactttgccttcccgtatctcctccagtttatccgagaatactctggcaaagtggatgaactaatcaaggataagctagaggcacagaaagaagtgaaggccaaagagcaggaagagaaggatgtcatgtcccaacagaacatgtacgcccaattgttgccactggctctacctgccccaccgatgccaggaatgggaggaggtccagggatgggaggcggatatggtccgccaccaccgatgggaggaatgccaggaatgcctccaatgccaccatttggaatgccaccgatgggcggctactaagactatcggaaacaaaaactatccattcaagtaatcgaaaactcatagtaatctctcgtctactgcaggactgtgaccggcatttgtcggaatgtttctttctttgcttttaataggtatgtgtggataataatctcgcactttcgtttgtaatattctttgggggttttaggtggtgagtcatttttggttgaaggccattttactatttttctttggaggggagagaggtgactccttaatagtctgcttgtcatttcacactttgatcttctctcatatgagttgttctttctttctttcagcttatcttcacttcattttcgatattttgtacccttttgagttttatgatttattgtttgtt

SEQ ID NO: 5187 - DNA, 5451 bp, Valeriana officinalis
tgaaggaatccctaacgctgccgagcatagggatcaatccacaatttatcacctttaccaatgttacgatggaatcagacaaatatatatgcgttcgcgagacatcgccacaaaacagtgttgtaataatagatatgagcatgccaacgcagcctttacggcggccaattactgcagactctgctcttatgaatcccaattctcgaatccttgcgctaaaagcccaacttccggggactacacaggatcacttgcaaatatttaacatcgagttaaaagccaaaatgaagtcatatcagatgcctgagcaggttgtattttggaagtggatctctccaaagctgttgggattggtcactcaaacgtcagtttatcactgggcaattgaaggtgaatctgaaccggcaaagatgttcgatagaaccgctaatttagcaaataatcagatcattaattatagatgcgatcctactgaaaagtggttggtcttgattggtattgctcctggttcgccggagagaccacaactggtcaagggaaacatgcaacttttttctgtcgatcagcagcgtagtcaagctctagaagctcatgctgcatcatttgccactttcaaggttccagggaacgagaatccttctattctaatctcttttgctacaaaaagctccaacgctggacaagttacatctaagttgcacgttattgagcttggcgcccagccaggaaaaccatcttttacgaagaaacaagccgatcttttctttcctcctgattttgccgatgattttccagttgccatgcagatatctcataaatatagtttgatatatgtcatcaccaagcttggacttctatttgtgtatgacctagagacagctactgcagtctatagaaatcggattagtccagatcctattttcttaactgcggaggcttcatctgttgggggtttctacgcaatcaacaggagaggacaggttcttcttgcaacagtaaacgaagcaacgatcgtgccttttgtcagcggccaattgaacaacctggagcttgctgtcaatcttgcaaagagagggaacttacccggtgctgagaatttggttgttcaacgtttccaagaattgtttgctcaaaccaagtacaaagaggccgctgaacttgctgcagaatcccctcaaggcattctccgtacacctgacacagttgccaaatttcagagtgttcctgtgcaatctggacaaacaccacctttgttgcaatactttggaacacttctaactagaggaaagcttaatgcatttgagtccttggaactctcccgtcttgttgtgaaccagaacaaaaagaatctgttagagaattggctagctgaagacaagttagaatgcagtgaagaacttggggacctcgtcaagaccgttgacaatgatctggctttaaaaatttacatcaaagcaagagctactccgaaagttgttgctgcttttgctgaaaggagggagtttgataaaattctgatatactcaaagcaggttggatacacacctgattacttattcttactgcaaacaattcttcgatcagatcctcagggagccgtaaattttgccctcatgatgtcccaaatggaaggaggttgtccagttgattacaacacaataacagatctctttcttcagaggaacttgatacgggaggcaaccgcatttttgcttgacgtcttgaaaccgaatttgcctgaacatggtttcttacaaaccaaggttcttgaaatcaatctagtgaccttcccaaatgtcgctgatgcaattttagcgaacggaatgttcagtcattatgaccgtcctcgcatcgcccaactctgtgaaaaagccggcctttttgtgcgagctcttcagcactacagtgaattgccagatatcaagcgtgtcattgtgaatactcatgcaattgagccacagtcacttgttgaattttttggcacactttcacgcgaatgggctctggagtgtatgaaggatcttttgttggtcaatctaaggggaaatcttcagataattgttcaggttgccaaagaatattctgaccaattgggtgttgaagcatgcttaaagcttttcgagcaattcaaatcatatgaaggactgtactttttccttggatcatacttgagttcaagtgaggatccggatattcacttcaaatacattgaggcagctgccaaaactggacagatcaaagaggttgagcgcgttaccagggaatcaaacttttacgacgctgagaaagcaaagaactttttaatggaagccaagcttccagatgcacgacccttaatcaacgtctgtgatcgatttggttttgttcccgatctcactcactacctatacacaaacaacatgcttcgttatatcgaaggttatgtccaaaaggtcaatccaggaaatgcacctttagttgtagggcagctgttggatgatgaatgcccggaagatttcatcaaaggcctgattctgtctgttcgttctcttcttcctgttgagcctcttgtagaggaatgtgaaaaaaggaatcgacttcgattacttactcagtttttggagcatcttgtgagtgaaggaagccaagatgtacatgtccacaatgctttgggtaaaataataattgatagtaacaacaatccagagcactttctcacaacaaacccatactacgattctaaagtagtgggtaaatattgcgagaagcgcgatccaacacttgctgttgtcgcatatcgcagaggacaatgtgacgatgaacttatcagtgttacaaacaggaactctttgtttaaattgcaagccaggtatgtggttgagagaatggacggcgatctatgggagaaggttcttaaccctgagaatgaatatagaagacagctcatcgatcaagttgtatctactgctttacccgaaagcaagagccccgaacaagtttctgcagccgtcaaagcattcatgactgctgatcttcctcacgaactgatcgaacttcttgaaaagattgtgctccaaaactctgctttcagtggaaacttcaatttacaaaacctgctcatattaaccgccataaaggctgacccatctagggttatggattacatcaacaggctagataacttcgacggtccagctgttggagaagttgctgtagaagcgcaattatatgaagaagcttttgcgattttcaagaaattcaacttgaacgttcaagctgtcaacgtgttattggacagtatccaaagcattcccagagctgttgaatttgctttccgtgttgaagaagatgctgtatggagccaggtggcgaaagctcaactcagagacggattagtaagtgatgcaattgagtcatttattcgagcagatgatgcgactcaattcttggatgttatacgtgctgccgaggatggagatgtttaccatgatttggttaaatatcttctcatggttagacaaaaaacgaaagaacctaaagtcgacagtgagcttatctatgcgtatgctaagattgataggttgggtgatattgaagaattcattttgatgcctaatgttgctaatttacatggcgtcggagaccgtttgtatgacgaggcactatacgaggctgcaaaaataatatatgcatttatttctaactgggctaagttagcggttactcttgttaagcttaatcaattccaaggcgctgttgatgctgcacgtaaggctaatagttcgaaaacatggaaggaagtttgttttgcttgtgtcgatgctgaggagttccgcttagctcagatatgcgggctcaatattatcatacaggtggatgacttggaagaagtgagtgaatattaccaaaacagaggatgcttcaatgaactaatatctctcatggagagtggtctaggtttggaacgcgcacacatgggcatcttcacggaattgggtgtactttatgccagataccgttacgagaagcttatggaacatattaaactgttttcaacacgtctcaacattccaaaacttatcagagcttgtgatgaacaacagcactggaaagaactcacctacttgtacattcagtatgatgaatttgataatgctgcaactactgtcatgaatcattcgccagatgcttgggatcacatgcagttcaaagatatcgctgttaaggtcgctaacgttgagctttattacaaagcggtgcacttttacttgcaagaacacccggaccttatcaacgatcttctaaatgtgcttgctcttcgtgttgatcatagtcgtgtcgttgacattatgcgaaaggcgggccacttacttctcgtgaagccatacatggttgcggttcagagcaacaatgtttcagcggtgaatgaagctttgaatgagatttacgtcgaggaggaagactatgaaagattacgagagtcaactgatttgcatgataactttgaccagataggtctcgctcaaaagattgagaaacacgagcttcttgagatgaggcgtgttgctgcttacatttacaagaaagcaggcagatggaagcaatccattgcattgtccaaaaaagacaagttatacaaagatgcaatggagacagcttcacaatctggtgatcgtgaacttgctgaggaattgcttgcgtatttcatcgaacagggcaagaaggaatgctttgcctcatgcctctttgtgtgctacgatttgattcgcgcagatgttgctcttgaaatggcctggatgaataatatgttggactttgccttcccatatctgttacagtttatccgtgagtacacaggcaaagttgacgaactgataaaggacaaaatcgaagccgcgattgaaatgaaggccaaggagaacgaagagaaggacacaattaaacaacagaatatgtatgcccagttgttgccgctggcattaccggcaccaccgatgccgggtatgggcggaatgggcggaggttatggaccaccaccgccaccaccgatgggtggaatgggcggcatgccgccaatgccaccgtatggcatgccaccgatgggctcgtattgatttcaattagggttattaaatgctagtttttatcatcgatggacgcgcttagcaagaaacgtggaaatttacagccggattagatgggattagatactacacagaggaggattccaccattttccgtcccctttttcttctaaagtattacttttttcggattatatgtggaggaactgctattgcctcgtgaataattttcaattttagtgttgtctgttatagtgtggataggcttgattttttttaactttcctcttgtaatattcttttgtagagtagacatttttatttttgaacagctagtgggcagctgtgaaggattattgttactgtttttcgatatatatgtaccaaa

SEQ ID NO: 5188 - DNA, 5596 bp, Lotus japonicus
ctccgatccacgccaccatggcggccgccgccaacgctccgatcaccatgcgtgaagccctcaccttgccgagcattggtataaatccgcagttcatcacgttcactcacgtgacgatggagtctgataagtacatatgcgttcgagaaacttctccgcagaatagcgtggtgatcgttgatatgagcatgccgatgcaacctttgaggaggcctattactgctgattctgctcttatgaatccgaattcgagaatccttgctctgaaagcccaactccaaggaacaactcaagatcacctacaaatatttaatattgaaatgaaggcaaagatgaaatcttaccagatgcctgagcaggtagtcttttggaagtggattactcccaagttgttgggtcttgtgacacagacatctgtataccattggtcaattgagggtgactctgaacctgtaaagatgttcgagagaacagcgaatttggcaaacaatcaaataattaattatcgatgtgatcctacagaaaagtggttggtcttgattggtattgctcctggttcccctgagaggccacagttggttaaaggaaacatgcaactcttctccgtggatcaacagcgcagccaagctcttgaagcacacgctgcatcatttgctcagttaaaagttcctgggaatgaaaatccttctactttgatttcgtttgccacgaagacacttaatgctggacaaattatatccaagttgcatgttattgagctgggtgcacaaccagggaagccatcatttacaaagaaacaagcagatcttttctttcccccagattttgctgatgacttcccagttgccatgcagatatcccacaaatacaatttgatttatgtgatcacgaaacttggtctcctatttgtctatgatttggagacggccactgctgtgtataggaacagaattagtccagatcctatatttttgacgtcagaagctacatcagttggaggcttttatgccattaacaggagaggccaggtgttattggctactgttaatgagcaaacaattgtgaattttgtcagtggtcaattaaataatttggagctagccgtcaatcttgccaagagaggaaaccttccaggtgctgagaagctggttgttgaacgtttccatgaactgtttgcccaaacaaagtataaagaagcagctgagcttgctgctgagtccccgcaaggaatccttcgtacacctgatacagttgccaaatttcagagtgttcctgtgcaagctggacaaactcctccactcttgcagtattttggaacccttttaactagaggaaagctgaatgcctttgaatcattagaattgtcacggctggttgtgaatcagaacaagaaaaatcttttggaaaattggttggcagaggacaagcttgaatgcagtgaggaactaggagatcttgtaaagactgtggacaatgaccttgccttaaaaatatatatcaaagccagagctactccaaaagttgttgctgcgtttgctgagcgaagggagtttgacaagattctcatatattctaagcaggttgggtacacacctgactatctcttccttttgcaaacaattctccggacagatcctcagggtgctgttaattttgcattaatgatgtctcaaatggagggaggttgtcctcttgattacaacaccataactgatctgtttcttcagagaaacttgatccgtgaggctactgcctttctcctagatgttttgaagccaaatttacctgaacatggtttccttcaaacaaaggttttggagataaatctggtaacgtttcccaatgttgctgatgctattttggctaatggcatgttcagccattatgatcgtccacgtattgcccaactttgtgaaaaagctggtctttatgtgcgagctttgcaacattacacagagttgccagatataaaacgtgtgatagttaatacacatgcaattgagccacagtcacttgttgagttttttggtactctgtcacgagaatgggccttagagtgcatgaaagatctgttactggtcaatcttagaggcaacctacagataattgttcaggttgctaaagaatattgtgaacagttgggcgttgatgcttgcattaagatttttgagcaattcaggtcctatgaaggactctatttcttccttggttcatatttaagctccagtgaggatcccgacatccacttcaagtacattgaggcagcagcaaagactggacaaatcaaagaggtcgagcgtgtgactagagaatcaactttctatgatcctgagaaaacgaagaactttctaatggaagctaagcttcccgatgcacgacctcttattaatgtttgcgatcgatttggatttgttcctgatctgacacactatctatacacaaataacatgcttcgctacattgaaggatatgttcagaaggtgaacccagggaattctcctctagttgttgggcagctgctagatgatgagtgtccagaagattttatcaaaggcttgattctctctgttcgttcattgctgccggtggagccactggtggaggaatgtgagaagaggaatcggcttcgtttgctttcacagtttctggaacatcttgtaagtgagggaagccaggatgcacatgttcataatgctctgggtaagatcatcattgatagcaacaacaacccagaacattttctcactacaaacccatactatgattctcgagttgtgggaaaatattgtgaaaaacgtgatcctaccttggccgttgtggcttataggcgaggacaatgtgatgatgaacttatcaatgtgacaaacaaaaattctttgttcaaactacaagcaaggtatgttgttgagaggatggatggtgacctttgggagaaagttcttaaccctgataatgcctacagaagacagcttattgatcaagttgtatctactgctctgcctgaaagcaagagccctgaacaagtctctgcagctgttaaggctttcatgactgctgatctacctcatgaattgattgagcttcttgagaagattgtgcttcagaattctgccttcagtgggaactttaatttgcagaatctgcttatcttgacagcaataaaggctgatacatccagagtcatggattatataaatagactggataattttgatggtcctgcagttggagaaatggctgttgaggctcagttatatgaagaagcatttgcaatttttaagaagttcaacttaaatgttcaagcagtcaatgtcttgctagataatattcatagcattgatagagctgaggagtttgctttccgagttgaagaggatgctgtatggagtcaggtggccaaggctcaactcagggaagggctagtaagtgaagcaattgagtcatttatacgagcagatgatgccacacaatttttggatgttatccgtgctgctcaaaataccaatgcttacaatgacttggtgagatacttgctgatggtaaggcaaaagacaaaagaacccaaggtggacagtgagctcatttatgcttatgcaaagatcgacaggctcagtgacattgaggagttcattcttatgccgaatgtggccaatcttcaaaatgttggtgaccgattgtatgatgaagagctatatgaggctgcaaaaattatatttgcttttatatctaactgggccaagttagcagtcacacttgtgaagttgaaacagttccaaggtgctgttgatgcagcaaggaaagctaacagctcaaaaacatggaaggaagtttgcttcgcgtgtgttgatgcagaggagttccgtttggcccagatatgtgggttgaacattattgttcaggtggatgacttggaagaggtcagtgaattttaccaaaatagaggttgcttcaacgagctaatatccctcatggagagtggtttaggattagaacgggcacatatgggcatctttaccgagttaggagttctgtacgctagataccgtcctgagaaacttatggaacatatcaaactatttgcaacccgactcaatattccaaaactcataagagcttgtgatgaacaacaacattggaaggaactgacctatttgtatatccaatatgatgagtttgacaatgcagcaacaaccatcatgaaccattcacctgaagcatgggatcacatgcaattcaaagatgttattgtcaaagttgctaatgtggagttgtattacaagtctgttcatttctatttgcaagagcatccagatcttctaaacgatgttttgaatgtccttgcacttcgtgttgaccatgcacgcgttgttgatatcatgcgaaaggctggtcatctccgtcttgtcaagccatacatggttgcagttcagagcaataacgtgtctgctgttaatgaagccctgaatgagatatatgtggaggaggaagactatgatagattgcgcgagtcaattgatttgcacgacaactttgaccaaataggcctggcacagaagattgaaaagcatgagcttcttgagatgagacgtgttgctgcttatatttataagaaggctggtaggtggaagcagtccattgccttgtcaaagaaggataacctttacaaagatgccatggagacggcctcacaatctggtgaacgtgaacttgctgaggagttacttgtttatttcattgatcagggaaaaaaggaatgctttgcctcgtgtctatttgtttgctatgatttaatcagggcagacgttgctcttgaactggcttggatccacaatataattgactttgccttcccatacgtgttacagcttctccgcgagtacactggcaaagttgatgaactggtgaaggacaaaattgaagcacagaaagaagtgaaggctaaagaacaagaagagaaggaagtaattcaacaacagaatatgtatgctcaattgttgcctcttgctttgcctgcaccaccaatgcccggaatgggaggaggctatgcccctccccctccaatgggtgggatggggatgcctccaatgcctccttttggcatgccacccatgggcagcagctactgatacaaggatggtggttagttcagcggtaagtctaagcgaagggcgaagtatcagtttgggagttttcgactattttcccgtgggattttaaggcagttctattctttctttgcttctaatggaggtggaggttcaagtcaataatttggtatttctgtgtgggagggggaggggggtgttgtgtcatagttttgtaatatttttttgtagatgaggcattttttgggctgctgcttcgacggagctagccgaggattttctgtataaaaccatttttcttgtattaaatgatttggtccaaggtattaatacgaaataggcgtacttcaattcctagtccatgtatgtcatggcttggatttattccaccaggataagtggaataaacaaatcttgttaatgtaaaaaaaaacaaagcttgttgtttgttgtgtgcatttcgtcattgtttcattatgtgatttgctact

SEQ ID NO: 5189 - DNA, 5540 bp, Silene vulgaris
ttttgttccgttgagttcttcgtcggctttgcgtcgcaatcatggcggccgctactgcaccgatcgttatgaaggaagttcttacgcttccgagcattggaattaatccgcaattcataacgtttaacaatgtgacgatggagtcggagaagtatatatgtgtgcgagaaacatcaccgcagaatagtgttgtcattgttgatatgaatatgccgatgcagcctctacgacggcctattactgctgattctgctctcatgaaccctaacacgcgaattctcgccttgaaagctcaactagctggcaccacccaggatcacttgcaaatattcaatattgagacaaaaacgaaggtgaaatcgcaccaaatgcctgagcaggttgtcttttggaagtggatcactccaaaattgcttgggcttgtcacacagacatctgtatatcattggtctattgaaggtgattcggcccctgctaaaatgtttgaaagaactggtaacttagcaaacaatcagattatcaactatagatgcgatccagctgaaaagtggttggtgctgattggtattgcacctggttcagctgagaggcctcaacttgttaaagggagcatgcaactatattctgtggatcagcagcgtagtcaagctcttgaagctcacgccgcatcatttgccacatataaagtacctggaaacgagaatccctctacccttattgtgtttgctacaaagtctatgaatgctggccaggttacttccaagttgcacataattgagctcggtgcccagccagggaagcccgggtttacgaagaaacaagctgacctattctttcctccagattttaatgatgattttccagtgtcaatgcagatatcccagaagtatggtttgatatatgttatcaccaagcttggtctgctgtttgtatatgaccttgagactgccagtgctgtttaccggaatagaattagtccagatccaatatttttgacatcagaggcttcatcatctggaggtttctatgccattaatagacgcgggcaggtccttcttgccaacgtcaatgaagctacaataataccttttgtcagtggccagttgaacaatttggagcttgcagttaatcttgctaaaagaggaaatcttcctggtgcagaaaatttggttgtccaacggttccaagagttgtttgcgcaaacaaagtacaaagaagctgcagagcttgctgctgattctccacagggcgtactgcgtacccctgatacagttgccaaatttcagagtgttcctgttcaagctgggcagacaccacctctattgcagtattttgggacactgctaaccaaaggaaagctcaatgcatttgagtcgttggagctgtctcgcctagttgtgaaccaaaataagaaaaatttacttgaaaactggctagcagaagacaaattagagtgcagtgaggaacttggagatctagtgaagactgttgacaatgaccttgctctgaagatatatattaaagccagagcaactccaaaagttgttgctgcctttgctgaacgcagagagtttgacaaaattcttgtgtactctaagcaggttggttacacaccggattacctattcctcctccaaactatccttcggacagatccacagggtgctgtcaattttgcactgatgatgtcccagatggagggaggatgtcccatggattataacacaattactgatctttttcttcagaggaatttgatacgtgaagcaacagcgtttctgttagatgttctgaagccaaatttgcctgaacatggttatttgcaaaccaaggttttggaaatcaatctcgttacctttcccaacgtcgctgatgccatattagccaatggtatgttcagtcattacgatcgttctagagttgcccagctttgtgaaaaggctggtctatacctgcaggctctcaagcattatactgatttgcctgatataaaacgtgtcattgtgaacacgcacgcgatagagcctcaggctctcgttgagttttttggtactctttctaaggaatgggcattagagtgcatgaaagaccttttacttgtcaacctcagaggcaatcttcagataattgttcagactgcgaaagagtactgtgagcagttgggtgttgatgcttgcatcaagctctttgagcagttcaagtcttatgaaggattgtattttttccttggatcatatctgagctccagcgaggatcctgatatccactttaaatacatcgaatcagctgcgaaaactgggcagctaaaagaagtagaacgcgtgactagagagtccaacttctatgatgccgaaaagacgaagaatttcttgatggaagccaagcttcccgatgcacggccactgattaacgtctgtgatcgtttcggttttgttccagatctcacacactacctttacacgagcaacatgcttcgctatattgaaggttatgttcagaaggttaaccctgggaatgcaccactagttgtggggcagcttcttgatgatgaatgtccagaagattttattaagggcttgatactctctgttcgttctctgcttccagttgagccgctggtggaggaatgtgagaagaggaatcgacttcgtttgcttactcagtttttagagcatctcgtgagtgaaggaagccaagatgttcatgtacacaatgctctgggtaaaatcataatagagagcaataacaacccagagcacttcctgacaactaacccatactatgattcacgtgtggttggcaagtactgcgagaaacgtgatcccaccctagcagttgttgcgtataggagagggcagtgtgatgacgagcttataaatgtcacaaacaaaaattctttgttcaagctgcaagcaaggtatgttgttgagagaatggatggggatctttgggagaaagtccttaaccctgagaatgagtaccgaaggcagctcattgatcaagttgtgtccactgctttgcctgaaagcaagagcccagaacaagtttctgcagcggttaaagcctttatgacagctgatctcccacatgaactgattgagcttcttgaaaagatagtcctacagaattctgcgtttagtggaaattcgaatttgcaaaatctccttatattgactgccatcaaagcagattcttctcgggttatggattatgtgaacaggctggataattttgatggacctgcagttggagaagtcgctgttgaagctcaactttatgaagaagcatttgccatcttcaaaaagttcaacttgaatgtgccggctgtaaatgtactattggacaatgttcaaagcattgaccgagcagtggaatttgcgttccgtgtcgaagaagatgctgtttggagtcaagtagccaaggctcaattgaggaccgggcttgttagtgatgctatagagtcatttatacgtgccgaagattccactcaatttttggatgtgattcgtgctgctgagggtgcagatgtctaccatgatttggtgaagtatcttcttatggtgaggcaacaaacaaaggaacctcgggtagatagtgagctcatttatgcttatgccaagattgataggttgagtgacatagaggagttcattctcatgccaaatgtggcgaaccttcaaaatgttggtgatcgcttgtttgacgaagctttatatgaagctgcaaagataatatttgcttttatttctaactgggctaagctagctgttactttagttagactaaagcaattccaaagtgctgttgatgcagcacgtaaagccaacagtgcaaagacttggaaggaagtttgctttgcatgtgttgatgccgaagagttcagattagctcagatttgcgggcttaacataattatacaggtggatgatatggaggaagtcagtcaattttaccagaacagaggttgtttcaatgagatcatctcattgatggaaagtggccttggattggaacgtgcacacatggggattttcactgaacttggggtcctttatgctaggtatcgccctgagaagcttatggagcacattaagctgttctcaacacgtctcaacattcccaagttgattagagcgtgtgatgaacaacaacactggaaggaacttacttttctctatatccaatatgatgaatttgacaatgctgcctctactgtgatgaaccactctcccgaggcatgggatcacatgcagtttaaagatgttgtggtcaaagtggcaaatgtggaactgtattataaagccgtgcacttctaccttcaagagcatcctgaccttattaatgatatgctcaatgtgctagctcttcgtcttgatcatacacgtgttgttgacataatgcgcaaggctggcaatctgcatttgatcaagccatatatgattgcagtccaaagcaacaacgtatctgctgtaaatgaggccctgaatgaaatatatgttgaagaggaagactatgaaagattgagagagtcgatcgatttacatgataactttgatcagataggacttgcacaaaagattgagaaacatgagctcttggagatgagacgagttgctgcttacatatacaagaaggcaggtagatggaagcagtccatagcattgtccaagaaagataaacactacaaggatgcaatggaaacctgctcccagtctggtgaccgtgaattagcagaggagttgcttgtttattttattcaggagggcaagaaggaatgctttgctgcatgccttttcgtttgttatgatgtaattcggccagatgttgctcttgaacttgcctggatgaacaatatgattgacttcgctttcccatacttgttacagtttatccgtgagtatacaggcaaagttgatgaccttatcaaggacaaaatcgaggcacagaagcaggtaaaggcgaaagaagaggagcagaaggatgtaattgctcaacagaacatgtacgctcagttgctgcctctagcattgccagcaccaccaatgccaggaatgggtggtggaggtggttatggacctcctccaatgggaggtatggggatgcccccaatgccacctttcggtatgccgcctatgggcccctactaatttccattcttaagtacgactccacttgcttcatttgaagcttcacgtcgatctgttgagttgcggctggaattttcggcatgctaattatccattggttgctcccagtactttgttatgttatatatagtcggaactggatagcaatggtcaacctgaaagaataatgttacatttttgcaaatttctcctgataatatgtatgtttaatgtacatctttgtagtatcattcttttgacagtgcggtcattctttcgggttgatgctctgctttgtacgcaagttagttgcctgtgttgagctttgggtgatgttggaggtcatttgataattccactaaattatcattttatgtatgccaatgtcatattcaacactaatttcatattcta

SEQ ID NO: 5190 - DNA, 5883 bp, Cicer arietinum
cttctctctctctctctctctctctctctctccattttcgcttttgagagtccaacttgtttccagatcttgaactcatttggatccttcttttgactcttcatcttccaattcaatcaccgccgcagatctgaccctccgatccaaatcatcatggcggctgccaacgctccgattctcatgagagaaaccctcaccttgccaagcattggtataaatccacaattcatcactttcacgcatgtgacgatggaatctgataagtatatatgcgttcgagaaacggctcctcagaatagtgtggttattgttgatatgaacatgccaatgcaacctttgaggagacctattactgctgattctgctcttatgaatcctaattctagaattcttgctttgaaagcccaactccaaggaacaactcaagatcaccttcaaatatttaatattgaactgaaagcaaagatgaaatcttatcagatgcctgagcaggtagtcttttggaagtggattagccccaagttgttgggtcttgtaactgtgacctctgtataccattggtcaattgaaggtgacgctgaaccagtaaagatgtttgagagaacagcaaatttagcaaacaatcaaataattaattacagatgtgaccctacagaaaaatggttggtcttgattggtattgctcctggttcccctgagaggccacaattggtgaaaggaaacatgcaactcttctctgtggatcaacaacgcagccaggctcttgaagcacacgcggcatcatttgctcaatttaaagttcctgggaatgaaaatccttctactttgatttcttttgccactaagacacttaatgctggtcaagttatatccaagttgcatgtcattgagctgggtgcacagccagggaagccttcatttacaaagaaacaagcagatctgttctttccccctgattttgctgacgactttccagttgccatgcagatatcccacaaatacagtttgatttatgtgattaccaaacttggtctcctatttgtatatgatttggagacagctactgctgtatataggaacagaatcagtccagatcctatatttttgacgtcagaagctacatcagtgggaggcttttatgccattaacaggagaggccaggtgttactggctactgttaatgagcaaacaattgtgaattttgtcagtggtcaattaaacaatttggagctagcagttagtcttgccaagagaggaaatcttcctggtgctgaaaagctggtagtggaacgttttcatgaactatttgctcaaacaaagtataaagaagcagctgagcttgctgctgagtctccacaaggaatccttcgtacacctgatacagttgccaaatttcagagtgttcctgtgcaagctggacaaactcctccactgttgcagtattttggcactcttttaacaagaggaaagctgaatgcgtttgaatcactggaattgtcacggcttgttgtgaatcagaacaagaaaaatctgttggagaattggttggctgaggacaagcttgagtgcagtgaggagcttggagatcttgtgaagactgtggacaatgatcttgctttaaaaatatatatcaaagccagagctactccaaaagttgttgctgcttttgctgagagaagggagtttgacaagattctgatatactctaagcaggttggatatacgcctgactatctcttccttttgcaaacaattctccgggcagatcctcagggggctgttaactttgcattaatgatgtctcaaatggaaggtggttgccctgttgattacaacaccataactgatctgtttcttcagagaaacctgatccgggaggcaactgcctttctcttagatgttttgaagccaaatctaccggaacatgggtaccttcaaacaaaggtgttagagataaatcttgtgactttccccaatgttgctgacgcaattttggctaatggcatgtttagccattatgatcgtcctcgtattgcgcaactttgtgaaaaagctggtctttatgtgcgagctttgcaacattacacagagttgccagatataaagcgtgtgattgtaaatacacatgctattgagcctcagtcacttgttgaatttttcggtactctatcacgagaatgggctttagagtgcatgaaagatctattgttggtcaatcttagaggcaacctacagataattgtgcaggttgctaaagaatattgcgaacaactgggcattgatgcttgcataaagatttttgagcaattcagatcatatgaaggactgtatttttccttggttcatatctgagctccagtgaggatcccgacattcactttaagtacattgaggcagcagcaaagactggacaaatcaaagaggtcgagcgtgtgactagagaatcaagtttctatgatcctgagaaaacaaagaactttctgatggaagcaaaacttccagatgcacgaccattgattaatgtttgtgaccgatttggatttgttccagatctaacacactatctattcacaagtaacatgcttcgctacattgaaggttatgttcagaaggtgaacccagggaatgctcctttagttgttgggcagctactggatgacgaatgtccagaagattttatcaaaggcttaattctctctgttcgttcgttactgccagtagagccccttgtggaagaatgtgagaagaggaaccggcttcgtttgctcactcagtttttggaacatcttgtaagtgagggaagccaggatgtacatgttcataatgcactgggtaaaatcataattgatagtaacaacaacccagaacattttctcactacgaacccatattatgattctcgagttgtgggcaaatattgtgaaaaaagggatcccactttggcagttgtggcttataggcgaggacaatgtgatgatgaacttatcaatgtgacaaacaaaaattcattgttcaaactccaagcaagatatgttgttgagagaatggatgctgacctttgggagaaagttcttatccctgataatgcctacagaagacaacttattgatcaagttgtatctactgctcttcctgaaagcaagagccctgaacaagtatctgcagctgttaaggctttcatgactgcagatctacctcatgagttgattgagcttcttgagaagattgtgcttcagaattctgcttttagcgggaactttaatcttcagaatcttcttattttgacagcgataaaggctgatccatccagagtaatggattacattaatagactggacaactttgacggtcctgcagttggagaaatggctgttgaggctcaattatatgaggaagcgtttgcaattttcaagaagttcaacttaaatgttcaagcagtcaatgtcttgctagataatattcatagcattgatagagctgtggagtttgctttccgagttgaagaagacgctgtgtggagtcaggtggccaaggctcaactcagggaaggtctagttagtgatgcaattgagtcctttatacgggcagatgatgcaacacaatttttggatgtcatccgagctgctgaagacggcaatgcttaccaggacttagtgagatacttgctgatggtaaggcagaagacaaaagagcccaaggtggacagtgagcttatttatgcatatgcaaagaatgataggctgagtgacatcgaggagttcattctcatgccgaatgtggccaatcttcaaaatgttggtgacagattgtatgacgaagagctttatgaggctgcaaaaattatatttgcttttatatctaactgggctaagttagcagtcacgcttgtgaagttgaaacagttccaaggtgctgttgatgcagcaaggaaagctaacagtgcaaaaacatggaaggaagtttgctttgcttgtgttgatgcagaggagttccgtttggcccagatatgtgggctgaacattattgtccaggtggatgacttggaagaggtaagtgaatattatcaaaatagaggatgcttcaatgaattaatatccctcatggagagtggcctaggattagaacgggcacatatgggcatattcacagagctgggagttctgtatgctagataccgtccggagaaacttatggagcatatcaaactatttgcaacccgactcaatattccaaaactcataagagcttgtgatgaacaacagcattggaaggaactgacctatttgtatatccaatatgatgagtttgataatgctgcaacaaccatcatgaaccattcacctgaagcatgggatcacatgcaattcaaagatgttattgccaaagttgctaacgtggagttgtattacaaggctgttcacttctatttgcaagagcatccagatcttatcaatgatgttctgaatgtccttgcacttcgggttgatcatgcacgtgttgttgacatcatgcgaaaggctggtcaccttcgtctggtcaagccatacatggttgcagttcagagcaacaatgtgtctgctgttaatgaagccttgaatgagatatatgttgaggaggaagactatgatagattacgggagtcaatcgatttgcatgataattttgatcaaataggccttgcacaaaagattgaaaagcatgaacttcttgagatgagacgtgttgctgcttatatttacaagaaggcaggtaggtggaagcagtccatcgccttgtcaaagaaggataatctttacaaagatgcaatggaaacagcctcacaatctggtgaacgcgaacttgctgaagagttacttgtctatttcattgatcagggaaaaaggaatgctttgcctcttgtctgtttgtttgctatgatttgatccgggtagacattgctcttgaactggcttggatgcataatatgatggactttgctttaccatatctcttacagtttatccgtgagtacactggcaaagttgatgaactggtgaagcacagaattgaatcgcagaacgaagagaaagctaaacaacaagaagagaaggaagtaattgcacaacagaatatgtatgctcaattattgcctcttgctttgcctgcaccgccaatgcctggaatgggaggaggctttgcccctcctcctccaatgggcggcggattcgggatgcctccaatgcctccttttggcatgccacccatgggcagcagctactgacagacaagggaccatggttagttcagccatgaactcaagtctaaatggagaccaacgcagcaggttgggaattttcataaaatttcacttgggatttaatgcagtattctttctttgcttctgattgaggtggaggtttaggtcaaaataatgtgtttgttgggggtttgtgccatagttttgtaatattttttgtagatgaggcattttttgggctgcttatacgagctagcggaggattttctgtatgtaaccatttttcttgtattaaatgatttggtcttcagtataatgtcaaatagaccgacttcaactcctggtccatgtttattatgttctggatttattccacaagaagtggaataaaatagagcttgttggcgtgtttgtcgtgtgtatcttttctactttgaagtacatggtttattgtggacttatttctccgtttttgttttgtagctcatacacattttcaggtgctaacagtgtacatcaatttgatacagctgcatgatctcttgtaacctacattttttacctaatacttattctgctgattttgtaaatagtaggctagtttttaagtcataagctaaagagatgaatagattcaaacaaaaata

SEQ ID NO: 5191 - DNA, 6020 bp, Phaseolus coccineus
ttctcttgctcggtgtgtctaataggagacgagatctatgcttatcgtctcgtcagtgtaaacaacaattcaattccactctccctcgttttattcgtgtcacgactccaatatcccgtttcgtttccacttctttctctttcctcttcgctttgaagagggtccaagtctttgcttccgctgctttcagatctcgcagcgatttggatcctcctcaagctctctccactctccttcactcttcctctctaaattcacgagttcaatcgccagttgcagatccgattcttcgattttctgttcctcgatctaagccaccatggcggccgcgaatgctccgattaccatgaaagaagccctaactttgccgagcattggcatcaatacgcaattcatcacgttcacacacgtgactatggaatcggataagtatatatgtgttcgagaaacctctccacagaatagcgtggttatcattgatatgaacatgccaaatcagcctttgaggaggcctatcactgcggattccgctcttatgaatcccaattctagaatccttgctttgaaagcccaactgcaagggacgactcaagatcatctacaaatatttaatattgagctgaaagcaaagatgaaatcatatcagatgcctgagcaggttgtcttttggaagtggattagccccaagatgttgggtcttgtaacacagacctctgtataccactggtctattgaaggtgattctgaacctgttaagatgttcgagagaacagcaaatttggcaaacaaccagataattaattatcgatgtgacccttcagaaaaatggttggtcttgattggcattgctcctggttcccctgagaggcctcaattggttaagggaaacatgcaacttttctctgtggatcaacaacgcagtcaggctcttgaagctcatgctgcatcatttgcccaatataaagttcctggaaatgaaaacccttctgttttgatttcttttgcctcaaagacacttaatgctggtcaggttacatcgaagttgcatgttatagaactcggtgctcagccagggaaaccatcatttacaaagaaacaagcagatcttttcttcccccctgattttgcggatgattttccagttgccatgcagatatctcacaaatacaatttgatttacgtgattacaaaacttggcctactatttgtctatgatttggagacagctactgctgtatacaggaacagaatcagtcctgatcctatatttttgacctcagaagctacatctgtgggaggcttttatgccatcaacagaagaggccaggtcttattggccactgttaatgaacaaaccattgtgaattttgtcagtggtcaattaaacaatttggagctagcagttagtcttgctaaaagaggaaatctacctggtgctgagaaactggtagtggaacgttttcacgaactgtttgcccaaacaaaatataaagaagctgcagagcttgcagctgaatctccacaaggaatacttcgaactcctgacacagttgcaaaatttcagagtgttcctgtgcaatctgggcaaactcctccactgttgcagtattttggaacacttttaactaggggaaagctgaattcctttgaatcattagaactgtcgcggttggttgtgaatcagaacaagaaaaatctgttggagaattggttagcagaggacaagcttgaatgcagtgaggaactaggagatcttgtcaagactgtggataatgatcttgctttaaaaatatatatcaaagccagagctacaccaaaagttgttgctgcatttgctgagagaagggagtttgacaaaattctgatatactctaaacaggttggatacacacctgactacctcttcctcctgcaaacaattctccggacagatcctcagggtgctgtaaattttgcattaatgatgtctcaaatggagggaggtagcccagttgattacaacactataactgatctctttcttcagagaaatctgatccgagaggcaactgcttttctccttgatgttttaaaaccaaacctaccagaacatgggttccttcagactaaggtgttggagataaatctggtgactttccccaatgttgccgatgcaatattagctaatggcatgttcagccattatgatcgtccttgtattgcccaactttgtgaaaaagctggtctttatgtgcgagctttgcaacattacacagagttgccagatgtaaaacgagtgattgttaatacacatgcaattgaacctcagtcacttgtagagttttttggtacactgtcacgagaatgggcattagagtgcatgaaagatttattgctggccaatcttaggggaaaccttcagatcattgtgcaggttgccaaagaatattgtgaacaattgggtgttgatgcctgcataaaaatttttgagcagtttaggtcgtatgagggattgtactttttccttggatcttacttgagctccagtgaggatcctgacattcactttaagtacattgaggcagcagcaaagactggtcaaatcaaggaggttgagcgcgtgactagagaatcaaatttctatgatgctgagaaaacaaaaaattttctgatggaggctaagcttccagatgcacgacctttgataaatgtttgcgatcgctttggatttgttccagatctaacacactatctgtacacaagcaacatgcttcgctacattgaaggctatgttcagaaggtaaacccagggaatgcacccttagttgtgggtcagctgttggatgatgaatgcccagaagattttatcaaaggcttgattctttctgtccgttcgttactgccagtggagccccttgtggaggaatgcgagaagaggaatcggcttcgtctgctcacacagttcttggaacaccttgttagtgagggaagccaggatgtacatgttcacaatgcactgggtaaaattatcattgatagcaacaacaacccagaacatttcctcacaaccaatccatactacgattctcgagttgtgggcaagtactgtgagaaacgtgatcccaccttagctgttgtagcttatcggcgaggacaatgtgatgatgaacttatccttgtcaccaataaaaattctttgttcaaactgcaagcaagatatgttgttgagagaatggatggtgatctgtgggccaaagttctcgatcctgataatgactatagaaggcaacttattgatcaggttgtatccactgctttgcctgaaagctcaagccctgagcaagtttctgcagctgttaaggctttcatgacagctgatctgcctcatgaactgattgaacttcttgagaagattgtgcttcagaattctgcattcagtgggaactttaatttgcagaatcttcttattttgacagcaataaaggccgatccatccagagttatggattatgttaatagattggataattttgatgggcctgcagttggagaaatggctgtagaagctcagttatttgaggaagcctttgccatttttaagaagttcaacttgaatgttcaagcagtcaatgtgttgcttgataatattcacagcattgatagagctgtagagtttgctttcagagttgaagaagatgctgtttggagtcaggtggccaaggctcaactcagggacgggctagtaagtgatgcaattgaatcatttatacgagcagatgacgctacacaatttttagatgttatccgtgctgctgaagatgccaatgtttaccatgacttggtgaaatacttgctgatggtaagacagaaagcaaaagaacccaaggttgacagtgagctcatttatgcatatgcaaagattgataggctaagtgacattgaggagttcattcttatgccaaatgttgccaatcttcaaactgttggtgaccgattgtatgatgaagcattatacgaggctgcaaaaatcatatttgcttttatatctaactgggccaagttggccatcacactggtcaaattaaaacagtttcaaggtgctgttgatgcagcaaggaaagctaacagctcaaagacatggaaggaagtttgctttgcttgtgttgatgcagaggagtttcgtttggcccagatttgtggactcaacattattattcaggtggatgacttggaagaagtcagtgaatattaccaaaatagaggttgcttcaatgaactaatatctctcatggagagtggtttagggttagaaagggctcatatgggcatctttaccgagctgggagttctgtatgctagataccgccctgagaagcttatggagcatatcaaactattctcaactcggctcaatattcccaaacttatacgagcttgtgatgaacaacaacactggaaagaattgacctatttgtatatacaatatgatgagtttgataatgctgcaactaccatcatgaaccattcacctgaagcatgggatcacatgcaattcaaagatgttgttgttaaagttgctaatgtggaattgtattacaaggccgtgcacttctacttggaagagcatccagatcttataaatgatgttctgaatgtccttgcacttcgtgtggatcatgctcgtgttgttgacatcttgcggaaggctggtcacctccgtcttgtgaaaccatatatggttgcagttcaaagcagcaatgtatctgctgttaatgaagctttgaatgagatatatgttgaggaggaagactatgatagattgcgcgagtcaattgatttgtatgataactttgatcaaataggccttgcccaaaagattgaaaagcacgagcttcttgagatgagacgagttgctgcttatatttacaagaaggcaggtaggtggaagcagtctattactttgtcaaagaaggataacctatacaaagacgccatggagacagcctcacaatctggagagcgtgaacttgctgaggagttgcttgtttatttcatcgaccagggaaagaaggaatgttttgcctcatgtctatttgtttgctatgatttgatccgggcagacattgttcttgaactagcttggatgcacaatatgattgactttgccttcccatatatattgcagtttattcgtgagtatactggcaaagtcgacgagctagtgaaggacaaaattgaagcacaaaacgaagtgaaggttaaagagcaagaagaaaaggatgtagttgcacaacagaacatgtatgctcaattattgcctcttgctttgcctgcaccaccaatgcctggaatgggaggccccgcaggtatgggaggaggctttgctcctcctcctccaatgggtggacttgggatgcccccaatgcctccttatggcatgccacccatgggcagtagttactgacatgtacgccatggtggcaagtgtagcatgaactcgatccctatgaagagcgatatataggaacttcaaagttttgcatagaatatcttgtgtgatttggatgcagcattctttctttgcttctggtggtgctgggaggttccaagttaaaataatgtgaagtttctgtttagtttgtgtcgtaatagtgttgtaagtttattgtttttctgggttgtagttgaggcattttttgagctgtgctggttctagctaaccataaatttctgtattctaccatttttcttgtattaaatgagttagccttaggtagaccaaacaaaaaatgaattactcctagtatatacgaaatttacgaccttaacagccaggttgatcatgcatgtcaaagcctagatttccgcacttcctagttgtggaagctacctaattaaatcttgttggcatgctgctttattgtgatttgatttcacctatagtcgcaattacgatgaatcaactatttctattccataaagactagatatccatcacctgatatgttgagcattatcaataaaatgtcacaaagtcttaa

SEQ ID NO: 5192 - DNA, 5793 bp, Medicago truncatula
ctccactgtcatcattttccttttccttaaaaaatccactctctttcttaaatcccgctttattagtgtcacttgcacctctttttcttcttcttttttcatttctcttctctctctctctgagagtccaagctgtttccagatcttgtactgatttgaactccgattcaaccaccgctgtagatctcaatctccgatccatttcaccatggcggccgccgccaacgctccgatcctcatgcgtgaagctctcactttgccaagcattgggattaatccacagcacataacattcacgcatgtgacgatggaatctgataagtatatatgcgttcgagaaactgcgccgcagaatagcgtggttattgttgatatgaacatgccaaatcagcctttgaggagacctattactgctgattctgctcttatgaatcctaattctagaattcttgctttgaaagctcaactccaaggaacaactcaagatcatttacaaatatttaatattgaacttaaagcaaagatgaaatcgtatcagatgcctgagcaggtagtcttttggaagtggattagccccaagttgttgggtcttgtgacacagacttctgtataccactggtcaattgaaggcgactctgaacctgtaaagatgtttgagagaacagcaaatctggcaaacaatcaaataattaattatcgatgtgaccctaccgaaaaatggttggtcttgattggtattgctcctggttcccctgagaggccacaattggtgaaaggaaacatgcaactattctccgtggaacaacagcgcagccaggctcttgaagctcatgcggcttcatttgctcaatttaaagttcctgggaatgaaaatccgtctactttgatttcttttgccaccaagacagttaatgccggtcaagttatatccaagttgcatgtcattgagctgggtgctcagccagggaaaccttcatttacaaagaaacaagcagatctgttctttcctcctgattttgctgatgattttccagtttccatgcagatatcccacaaatacagtttgatttatgtgattaccaaacttggtcttctatttgtctatgatttggagacggctactgctgtttataggaacagaatcagtccagatcctatatttttgacgtcagaagctacatcagtgggaggcttttatgccattaacaggagaggccaggtgttactggctacggttaatgagcaaacaattgtgaattttgtcagtggtcaattaaacaatttggagctagcagttaatcttgccaagagaggaaatcttcctggtgctgagaagttggtagtagaacgtttccatgaactatttgctcaaacaaagtataaagaggcagctgagcttgctgctgagtctccgcaaggaatccttcgtacacccgatacagttgccaaatttcagagtgttcctgtgcaagctgggcaaactcccccattgttgcagtattttggaactcttttaactagaggaaagctgaatgcctttgaatcactcgaactgtcacggcttgttgtgaatcagaacaaaaaaaatctgttggagaattggttggccgaggacaagcttgagtgcagtgaggagcttggagatcttgttaagactgtggacaatgatcttgctttaaaaatatatatcaaagccagagctactccaaaagttgttgctgctttcgctgagaaaagggagtttgacaagattctgatatactctaagcaggttggatatacacccgactatctcttcctcttgcaatcgatactccgtactgatcctcagggtgctgttaattttgcattaatgatgtctcaaatggaaggtggttgtccagttgattacaacaccataactgatctgtttcttcagagaaacctgatccgtgaggcaactgcctttctcctagatgttttgaagccaaacctaccagaacacgggttccttcaaacaaaggtgttagagataaatcttgtgactttccccaatgttgctgatgcaattttggctaacggcatgtttagccattatgaccgtcctcggattgcccaactttgtgaaaaagctggtctttatgtgcgagcgttgcaacattacacagagttgccagatataaaacgtgtgattgtaaatacacatgcaattgagccacaggcacttgttgaattttttggcactctatcaaaagaatgggctttagagtgtatgaaagatctattgctggtcaatcttagaggcaacctacagataattgtacaggttgctaaagaatactgtgaacaacttggcgttgatgcttgcataaagatttttgagcaattcaggtcatatgaaggactgtattttttccttggttcatatttgagctccagtgaggatcccgacattcactttaagtacatcgaggcagcagcaaagactggacaaatcaaagaggtcgagcgtgtgactagagaatcaagtttctatgatcctgagaaaacaaagaactttctaatggaagctaagcttccagatgcacggccactaattaatgtttgtgaccggttcggatttgttccagatctaacacactatctatacacaagtaacatgcttcgctacattgagggttatgttcagaaggtgaacccagggaatgctcctttagttgttgggcagctgcttgatgatgagtgtccagaagattttatcaaaggcttaattctctctgttcgttcattactgccagttgagccccttgtggctgaatgtgagaagaggaatcggcttcgtttgctcacacagtttttggaacatctagtaagtgaaggaagccaggatgtacatgttcataatgcactgggtaaaatcatcattgatagtaacaacaacccagaacattttctcactacaaacccatactatgattctcgagttgtgggcaaatattgtgaaaagcgggatcccacgttggcagttgtggcttataggcgtggagtatgtgatgatgaacttatcaacgtgacaaacaaaaactccttgttcaaactacaagcaagatatgttgttgagaggatggatgctgacctttgggagaaagttcttaaccctgataatacctacagaagacaacttattgatcaagttgtgtctaccgctcttcctgaaagcaagagccctgaacaagtatctgcatcagtgaaggctttcatgactgctgatctacctcatgagttgattgagcttcttgagaagattgtgcttcagaattctgctttcagcgggaactttaatcttcagaatcttcttattttgacagcaataaaggctgattcttccagagtaatggattatgtcaatagactggataactttgatggtcctcaagttggagaagtggctgtcgaggctgagttatatgaggaagcgtttgcaattttcaagaagtttaacttaaatgttcaagcagttaatgtcttgctagataatattcatagcatagatagagctgtggagtttgctttccgagttgaagaagatgctgtttggagtcaggtggccaaggctcaacttagggaaggtctagttagtgatgcaattgagtcatttatacgagcagatgatgccacacaatttctggatgtcatccgagctgctcaagacggcaatgcttaccaggacttggtgaggtacttgctgatggtaaggcagaaaacaaaagaacccaaggtggacagtgagcttatttatgcctatgccaagattgataggctgagtgatattgaggagttcattctaatgccaaatgtagccaatcttcaaaatgttggtgacagattgtatgatgaagagctatacgaggctgcaaaaatcatatttgcttttatatctaactgggctaaattagcagtcacacttgtgaagttgaaacagttccaaggcgctgttgatgcagcaaggaaagctaacagtgcaaaaacatggaaggaagtttgctttgcatgtgttgatgaagaggagttccgtttggcccaaatatgtgggctgaacattatcattcaggtggatgacttggaagaggtaagtgaatattaccaaaatagaggctgcttcaatgaattaatatccctcatggagagtggcctaggactagaaagggcacacatgggcatattcacggagctgggagttctgtatgctagataccgtccggagaagcttatggagcatatcaaactatttgcaacccgactcaatattcctaaactcataagagcttgtgatgaacaacaacattggaaggaactgacctatttgtatatccaatatgatgagtttgataatgctgcaacaaccatcatgaaccattcgcctgaagcatgggatcacatgcaattcaaagacgttattgccaaagtcgctaatgttgagttgtattacaaggctgttcacttctatttgcaagagcatccggatcttatcaatgatgttctgaatgtccttgcacttcgggttgaccatgcacgggttgttgatatcatgcgaaaggctggtcacctccgtctggtcaagccatacatggttgcagttcagagtaataatgtgtctgctgttaatgaagccttgaatgagatatatgtggaggaggaagactatgatagattgcgtgagtcaatcgatttgcatgataattttgatcaaataggccttgcacaaaagattgagaagcacgagcttcttgagatgagacgtgttgctgcttatatttacaagaaggcaggtaggtggaagcagtccattgccttgtcaaagaaggacaacctttacaaagacgcaatggaaacagcatcacaatctggtgaacgtgaacttgctgaggagttgctcgtttatttcattgaccagggaaagaaggaatgcttcgcctcgtgtctgtttgtttgctatgatttgatccgggtagatgttgctcttgaactggcttggatgcataatatgattgacttcgctttcccatatctcttacagtttatccgtgagtacactggcaaagttgatgaacttgttaagcacaaaattgaatcccagaatgaagtgaaggctaaagaacaagaagagaaggaagtaattgcacagcagaatatgtatgctcaattattgccacttgctttgcctgcaccaccaatgcctggaatgggaggaggaatgggaggaggctatgcccctccccctccaatgggtggcggaatggggatgcctccaatgcctccttttggcatgcccatgggcggctactgaacaaggaagggaccatagttagttcagcaatgaactcgagtctaaaaatggagaccaaggcggcaggttgggagtttacataaattttccggtgggattttaatgcagtattctttctttgcttctgattgaggtggaggtttagatcaaaaataatttcaagtttctgttggggggtttgtgctatagttgtcatatttttttgtagatgaggtattttttggtctgcttatacaagctagcggaggattttctgtatgtaaccatttttcttgtatttaaatgatttggtctttaagtataatgtcaaatagtcgacttcgaccttagtccgtgtttatcatggcctggattaattccacaaggaaaagtggaataaacaaagcctgttggtttgtttgttgtgtgtatcttgtcttttttaaaatacatggtttattgcgacttatttcttaatttcttttcgt

SEQ ID NO: 5193 - DNA, 5652 bp, Arabidopsis thaliana
acctttctcgttcacttgcttcagatctggcagcgatttcatttcttctccagtctttctctcgtctcggttctatctcctggccattggcggtcaggacttctcagccgtatatttgattccgtccccggatttactcttgctgtgatctgaggtcaaacatggcggctgccaacgcccccatcacgatgaaggaggtcctgacgcttccgagcatcgggatcaatcagcaattcatcacgtttacaaatgttactatggagtctgacaagtatatctgtgtacgagagacgtcaccgcaaaacagtgttgtaattatagatatgaatatgccgatgcagcctcttaggaggcctattactgcagactctgctcttatgaacccaaactcgaagatccttgccttgaaagctcaagttccaggaactactcaggatcatctacagatatttaacattgaagccaaagcaaagttgaaatcacatcagatgcctgagcaggttgtcttttggaagtggattacaccaaagatgttggggctggtcacacagaattccgtctatcattggtcaattgaaggtgattctgagccagttaagatgtttgatagaacagccaatttggccaacaatcaaattataaactataagtgctctcctaatgagaagtggttggttttaattggaattgctcctggctctcctgagagacaacaattggtaaaaggaaatatgcagcttttctctgtggatcaacagcggagtcaggcccttgaggcacatgctgcatcgtttgcgcagtttaaggttcctgggaatgagaatccttctattcttatatcatttgcaagcaagagctttaatgctgggcagataacatcaaagttgcatgtcattgagcttggtgcccaacctggaaaaccatcatttacaaaaaaacaagcagatctcttttttccccctgattttgctgatgattttcctgttgccatgcaggtctctcacaaatttaacttgatatatgttatcaccaaacttggcctgttgtttgtgtacgatctagagactgcttctgctatctacagaaatcggattagtccagacccaattttcttgacttctgaagcttcctcagttgggggtttctatgccattaataggcgaggacaagttcttttggctacagtaaacgaggctaccattataccttttattagtggccaattgaacaatttggagcttgctgtcaatcttgctaaaagaggaaacctcccaggtgcagaaaatctggttgtccagcggttccaggagttgttcgctcaaacaaagtacaaggaggctgctgagcttgctgctgaatctcctcaaggaattctaaggacacctgatacagtggccaaattccagagtgttcctgtacaagctggacaaactcctccattgttacagtattttgggactcttttgactagagggaaactcaattcatatgagtcactggaactatctcggctggttgtgaaccaaaacaagaagaacctcctggaaaactggttggcagaggataaactagaatgcagtgaagaacttggagaccttgtgaagactgtggataatgatctcgctctgaaaatatacatcaaagctcgggcgactccaaaagttgtagcagcttttgcagaaagaagggagtttgacaaaatactgatttactcaaagcaggttgggtacacacctgattacctgtttcttctgcaaaccatactccgtacagatcctcagggagcagtaaattttgcattaatgatgtctcaaatggaaggaggttctccagttgactacaacaccatcactgatctttttcttcagagaaatctgatccgtgaagcgacttctttccttctggatgtgctaaagccaaatttacctgagcatgcttttctgcaaactaaggttctggagataaatttggtaacttttcctaatgtggctgatgcggtattagcaaatgggatgttcacccactatgaccggcctcgcattgctcaactttgtgaaaaggctggactttatatccaatccttgaagcattactcagagttacctgatataaaacgtgtaattgtaaacacacatgctatcgagccacaggctcttgttgagttttttggcactctttctagcgagtgggctatggagtgcatgaaggatctgttgctggtcaacctgagaggcaatctgcagataattgttcaggcttgcaaggagtactgtgagcaacttggtgttgatgcatgtattaagctctttgagcagttcaagtcatatgaagggctatactttttcctaggttcatatttgagtatgagtgaggatcctgagatccatttcaagtacattgaagcagctgccaagactggtcaaataaaggaggttgagcgtgtaactagagagtctaacttctatgatgctgaaaagacgaagaactttttgatggaagctaagctgcctgatgcacgacctttgataaatgtctgtgatcgtttcagctttgtgcctgatcttactcattacctctacacaaacaacatgcttcgttacattgaaggctacgtgcagaaggtgaaccctgggaatgctcccttagttgtcgggcagttgcttgatgatgaatgccctgaagattttataaaaggcctcattctctctgttcgttcattgcttcctgttgaaccacttgtcgaggaatgtgagaagagaaatcgactccgtctcctcactcagttcttggagcatttagttagtgagggaagccaagatgtgcatgtccataatgccttgggtaaaattatcatagacagtaacaacaaccctgagcatttcctgaccaccaacccttactacgactctaaggttgtgggtaagtactgcgagaaacgtgatcctaccctagcagttgtggcatacagaagaggacaatgtgacgaggaactcatcaatgtcactaacaaaaactctttgtttaagttacaagccaggtatgtagtggagaggatggatggtgatctgtgggataaggttctcgatgaaaacaatgattatagaagacagcttattgaccaagttgtgtctactgctttacctgaaagcaagagcccagagcaagtttctgcagctgttaaagcattcatgactgctgatttgccgcacgagcttattgagcttcttgaaaagattgttctacaaaattctgccttcagtggaaacttcaatctgcaaaatctgcttatattgacagctattaaggcagatccgtctagagttatggattacatcaacaggctggacaactttgatggacctgcagttggagaagtcgcagttgaagcccaattatatgaggaagcatttgctatcttcaagaagttcaacttaaatgttcaggctgtcaatgtattgctggataatgtcaggagcattgagcgtgcagttgagtttgcattccgggtcgaagaagattctgtttggagccaagtcgctaaggcgcaactcagggaaggactagtcagtgatgcaattgagtcctttatccgtgctgatgatgccactcatttcttggaggtcatacgtgtctctgaagatactgatgtctatgatgacttggtcaaataccttctgatggttagacagaaggtgaaggaacccaaggttgatagtgagctcatctatgcatatgcaaagattgatcggttaggtgagattgaagaattcattctgatgccaaacgttgctaatctacaacatgttggtgatcgtctgtatgacgaagctctctatgaggctgcaaaaataatctatgcgttcatatcaaactggggcaagttagccgtcacacttgtgaagttgcaacagttccaaggtgctgttgatgctgcaaggaaagcaaacagtgcaaagacatggaaggaagtctgctttgcttgcgttgatgctgaggaattccggttggctcaaatatgtggtcttaacattatcattcaggtggatgacctggaagaagtcagcgagtactaccagaacagagggtgcttcaatgaattaatctcacttatggagagtggacttgggcttgaacgtgctcacatgggtatcttcaccgagttgggtgtactctatgctagatatcgttatgagaaacttatggaacacatcaagttattttcaactcgcctcaatattcccaagcttatacgggcctgtgatgaacaacagcactggcaggaacttacctatctgtacattcaatatgatgagtttgataatgctgcgaccaccgtcatgaaccattctcctgaagcatgggagcacatgcaattcaaagacattgttgccaaggtagcgaatgttgaactgtactacaaggctgtgcacttctacttgcaagagcatccggatataatcaacgatcttctcaacgtacttgcgttgcggttagaccatactcgtgttgttgatataatgcggaaggctggtcacttgcgtcttatcaagccatacatgattgcagttcagagcaacaatgtctctgctgttaatgaggctctgaatgagatatacgtggaagaagaagactacgataggttgcgagagtctattgatttacatgacagctttgaccagattggcctcgctcagaagatcgagaaacacgaacttgttgaaatgagacgtgtggctgcttatatctacaagaaagcgggcagatggaagcaatcaattgcattatcaaagaaagacaacatgtacaaggactgtatggaaacggcttcacaatcaggcgaacatgaacttgcagaacaactactggtgtatttcattgaacagggcaaaaaggaatgctttgctacatgtctctttgtatgttatgacttaatccgaccagacgtggctctagaacttgcctggatcaacaatatgatggactttgccttcccgtatctcctccagtttatccgagagtactctggcaaagtggatgagctaataaaggacaagcttgaggcacaaaaagaggtgaaggccaaagagcaggaagagaaggatgtcatatcccaacagaacatgtatgcccaaatgttgccacttgctttacctgcaccaccgatgccaggaatgggaggtggtggtgggtatggtcctccaccacaaatgggcggtatgccaggaatgcctcccatgccaccatatggaatgccaccgatgggcggctactaaagcagaccagcttatgctttaatatccgcatttggaaaagtatcagtagcgcatagagtcggcccaatttgctagggcggtgttcatctgctagctagcttatatgtctgaccagaatttgtctgggaataatgtggataataacctcctttcgttgtaatattctgttgggtttaggtgagtaatttttttttaactttttgtcaaaagccatttttgagtatatatactcaactctcttactcatatgagttttgtagttgtactttccttcagcatttcattccattcgactttcgatttattaaaccgttgatcagtttcaccttgttgttattcatatatgaaacaattaatatcgagaaggactaaataaatc

SEQ ID NO: 5194 - DNA, 5702 bp, Brassica rapa
ctccccattatattcgacgagtgactagattagatcgctgttcgtcatttctcactagcaaaggcaaaaaaaaaaagcatctctctccttcttcatttctcgttcacttacctcagatctggcatcgatttcaaaatcctctctcgcatcgctcctctctctctcctgaccgtgaacggtctcttcccggccttggatctgattctgccaccgccgcgatctgaggtcaatcatggcggcagcaaacgccccaatcacgatgaaggaggtccttacgcttccgagcattgggatcaaccagcaattcatcacgtttacgaatgttactatggagtctgacaagtacatatgtgtacgagagacggcgccgcagaacagcgtggtgattatagatatgaacatgccgatgcagcctctaaggagacctataactgcggattctgctcttatgaacccaaactccaggatccttgccttgaaagctcaagttccaggaaccactcaggatcatcttcagatatttaacatcgaagcaaaagcgaagttgaaatcacatcagatgcctgagcaggttgcattttggaaatggattacaccaaagatgttggggctggtcacacaaacttccgtgtatcattggtcgattgaaggtgattctgagccagttaagatgtttgatagaactgccaatttggcaaacaatcaacttattaactataagtgctctcctgatgagaagtggttggtgttgattggaattgctcctggctctcctgagagaccacaattggtaaaagggaatatgcagctattctctgtaaatcaacagcggagccaggcccttgaagcgcatgctgcttcatttgctcagtttaaggtccctgggaatgagaatccttctattcttatatcctttgcaagcaagagctttaatgctgggcagataacatcaaagttgcatgtcattgagcttggtgcacaaccaggaaaaccatcattctcaaagaagcaggcagatctctttttccccccggattttgcggatgactttcctgtagccatgcaggtctcacataaatttaacttgatatatgtcatcaccaagcttggcctgttgtttgtatacgatctagagacggcttctgctatctacagaaatcggataagtccagacccaattttcttgtcttctgaagcttcttccgttgggggtttctatgccattaataggcgaggacaagttcttttggctacagtaaacgaggctacgataataccgtttattagcggtcaattgaacaatttggaacttgctgtcaatctggctaaaagaggaaacctccctggtgcggaaaatctggttgtccagcggttccaagaattatttgctcaaacaaagtacaaggaggctgctgaacttgctgctgaatctcctcaggggattctacggacacctgatacggtggctaagttccagagtgttcctgtacaagcagggcaaactcctcccttgctacagtattttggaacccttttgactagagggaagctcaattcatatgagtctttggaactatcccgacttgttgtgaatcaaaacaagaagaaccttttggaaaactggttggcagaggataagttagaatgcagtgaagaacttggagaccttgtcaagactgtggataatgacctggctctgaaaatatacatcaaagctcgagctactccaaaagtcgcagcagcttttgcagagcgaagggagtttgacaaaatactgatttactcaaagcaggttgggtacacgcctgattacatgtttcttctgcaaacaatactccgtacggatcctcagggagcagtaaatttcgctttaatgatgtcccaaatggaaggaggttgtccagttgactacaacaccataactgatcttttccttcagagaaatctgatccgtgaagcgactgctttccttttggatgttctgaagccaaatttacctgagcatgcttttctacaaactaaggttttggagatcaatttggtaacctttcccaatgtggctgatgcaattttagcaaatgggatgttcagccactatgaccgccctcgggttgctcagctttgtgaaaaggctggaccttatatccaatctttaaagcattactcagagttacctgatattaaacgtgtaattgtgaacacacatgcaattgagccgcaggctcttgtcgagttttttggtactctttccagcgagtgggctatggagtgcatgaaggatcttctgttggttagcctgagaggcaaccttcagataatcgttcaggcttgcaaggagtactgtgagcaacttggtgttgattcatgcatcaaactctttgagcagttcaagtcgtatgaaggactatactttttcctaggttcatatttgagtatgagtgaggatcccgagattcacttcaagtacattgaagcagctgccaagactggtcaaatcaaggaggttgagcgtgtcactagagagtctaacttttatgatgctgaaaagacgaagaactttttgatggaagctaagcttcctgatgcccggcctttgataaatgtctgcgatcgttttggctttgtacctgatctgacccattacctgtacacaaacaacatgcttcgttacattgaaggttacgttcagaaggtcaaccctgggaatgctcccttagttgtggggcagttgcttgatgacgaatgccctgaagattttataaaaggcctcattctctctgttcgttcattgcttccagtcgaaccccttgttgaggaatgtgagaagagaaatcgactccgtctccttactcagttcttggagcatctagttagtgagggaagccaagatacgcatgtccacaatgccttgggtaaaattatcatagacagcaacaacaaccctgagcatttcctaaccaccaacccgtactatgactctaaggttgtgggtaagtactgcgagaaacgtgatcccaccctggctgttgtggcatacagaagaggacaatgtgatgaagaactcatcaatgtcaccaacaaaaactctttgttcaagttacaagccaggtacgtagtggagaggatggatggtgacctctgggacaaggttcttgtggaggaaaatgagtatagaagacaacttattgaccaagttgtgtctactgctttacccgaaagcaagagcccagagcaagtctctgcagctgttaaagcattcatgactgctgatctcccgcatgagcttattgaacttctggaaaagattgtgcttcaaaactcggccttcagtggaaacttcaatctgcaaaatctgttaatattgacagctatcaaggcggatccgtctagagttatggattacatcaacaggctagataattttgatggtccggctgttggagaagttgcggttgatgcccaattatatgaggaagcatttgcgatttttaagaagtttaacttaaatgttcaagctgtcaacgtattgttggataacgtcagaagcattgagcgtgccgttgagtttgcttttcgggttgaagaggattctgtttggagccaagtcgctaaggctcagctcagagatggactagtcagtgatgcaattgagtcatttatccgtgctgaggatgccactcatttcctggaggtcatacgtgctactgaagatgctaatgtctatgatgacttggtcagataccttcttatggttagacagaaggtgaaagaacccaaggttgatagtgagctcatctatgcttatgcaaagattgataggttgggtgagattgaagaatttattctgatgccaaacgttgctaacctacaaactgtcggtgatcgcctgtatgacgaagctctgtacgaggctgcgaaaataatctatgcgttcatttcaaactgggccaagttagccgtcactcttgtgaagttgcagcagttccaaggtgctgttgatgctgcaaggaaagcaaacagtgcaaagacatggaaggaagtctgcttcgcttgtgttgatgcagaggaattccggttggctcaaatatgtggacttaacgttattatacaggtggatgacctggaagaagttagcgagttctaccaaaacagaggatgcttcagtgaactaatctcacttatggagagtggcctcggtctggaacgggctcacatggggatcttcaccgagctgggtgtactgtacgccagatatcgttatgagaagcttatggagcacatcaagttgttctccactcgcctcaatattcccaagcttatacgggcctgtgatgaacaacagcactggcaggaacttacctatctttacattcagtatgatgagtttgataatgctgctaccactgtcatgaaccactctcctgaagcatgggagcacatgcaattcaaagacattgttgccaaggttgcgaatgttgagctttactacaaggccgttcacttctacttgcaagagcaccctgatataatcaacgatcttctcaatgtgcttgctctgcggttagatcacacacgtgtcgttgatattatgcgcaaggctggtcaattgcgccttatcaagccctacatggttgcagttcagagcaacaatgtttctgctgtaaacgaagctctgaatgagatatacgtagaagaagaagactatgacaggttgcgcgagtctatcgatttgcatgacagctttgaccagataggcctcgctcagaagattgagaaacacgagcttgtagaaatgagacgtgtggctgcgtatatttacaagaaagctggtagatggaagcaatcaattgctttgtcgaagaaagataacatgtacaaggactgtatggaaaccgcttcacaatccggcgaccatgaccttgcagaacaacttctcgtttacttcattgaacaggggaagaaggaatgctttgccacatgtctctttgtgtgttatgacttaatcagaccagatgttgctctagaacttgcttggatcaacaacatgattgactttgccttcccgtatctcctccagtttatccgagaatactctgggaaagtggacgaactaatcaaggacaagctagaggcacagaaagaagtgaaggccaaagagcaggaagagaaggatgtcatgtcccaacagaacatgtacgcgcaactattgccactggctctacctgcgccaccgatgccaggaatgggaggaggtccagggatgggggggggttatggtccgccaccaccaatgggaggaatgccaggaatgcctccaatgccaccatatggaatgcctccgatgggcgggtactaagcctaaaccatccgttcaagtaatcgagaactcatagtcgcgcgcgcaatctccaccgtggtggtatatgtcggaatgtttccttgtttgattttataggtgtatgtgtggataataaactcgtactttcgtttgtaatattcttttgagaggttttaggtgagtcatttttggttgaaggccatgttactattttcttttgagggggagagatgtaaactcctgactagtctacttgtcaatttactttgatctttctctcatgagttgctctttcttttcagcttattatttttcacttataatttccgacattttatatgagttttatgaattaatttttgtt

SEQ ID NO: 5195 - DNA, 5787 bp, Plantago ovata
ctctctctagaggaaccccaactcggcaactcccgtctttctctctctagatctctcatttctgattcacaccgggagggttcaagggtttctgtcgctgatttagatctccgaacaatttccgccagttttccgatttcattttctagatccagtcttctgaccttggagcttcgattcgtcgcccatcatggcggctgccaatgctccgatgaccatgaaggaggtccttacgttgactagcatcgggatcaattcgcagttcgttacatttacacatgtcacgatggaatctgataagtatatatgtgtacgtgagactgcgcctcaaaacagtgtggtgattattgatatgaacatgccaatgcaacctttgaggcggcctatcactgcagattctgcactgatgaatccgaattccaaaattttggcgctgaaagcacaacttcccgggactgctcaagaccatttacaaatttttaacatcgaggcgaaggcaaagatgaagtcacatcagatgcctgagcaggttgtattttggaagtggattaccccaaagatgttgggtttagttacccagtcatcggtatatcactggtcaattgagggtgaatctgaacctgtaaaaatgttcgagagaactgcaaatttatcaaataatcaaataatcaactataagtgtgatccttcagagaagtggttggttctgattgggattgctcctggttcacctgaacgtcctcaactggttaaaggaaatatgcagttgtattctgtggatcaacaacgcagtcaagctcttgaagcacatgctgcttcgtttgccactttcagggttccaggaaacgataaggattccattcttatttcttttgctacaaaaacctccaatgctggccaactttcgtcaaaattgcacattattgaactcggtgctcaaggaggaaaaccttcttttacgaaaaagcaagcagatcttttctttcctccagatttcaatgatgactttccagtggccatgcagatatcgcacaagtttggtctgatctatgtgatcacgaagcttgggctgctttttgtgtacgatttggaaactgccacagctgtttacagaaataggattagtccagaccccatttttcttacatcagaagcttcctctattggcggcttctatgcaattaatagaagaggccaagttttgcttgccacagtgaatgaggcaactattattcctttcatcagtggccaactgaacaatttggaacttgccgttaatctagcgaaacgaggaaatcttcctggtgcagaaaatttggttgtccaacgtttccaagaattatttgctcagacaaagtacaaagaggctgctgagcttgctgcagaatctccacaaggcatccttaggacacctgacactgttgccaaatttcagagtgttcctgttcaagctggggtgacaccaccattgctgcagtattttgggacattgttaaccaaagggaagctaaatgcattcgagtctttggagttatctcgtcttgttgtcaaccagggcaaaaagaatctgttagagaattggttggctgaagataaacttgaatgtagcgaggagcttggagaccttgtgaagactgttgacaatgacatggcactgaaaatctatatcaaagctagagcaacgccaaaagttgtggcagcctttgccgagcgtcgggaatttgacaaaatcttgatttactcaaaacaggttggctatacaccggattatctgttccttctgcaaacaattctccgctcagatcctcagggagctgtaaattttgcccttatgatgtctcaaatggagggaggttgtcctgttgattacaataccattaccgatctcttccttcagcgtaatatgattcgtgaagctacagcatttctgttggatgttctgaaaccaaatttgcctgagcacgcatttctccaaactaaggtccttgagatcaaccttgtgacatttcctaatgtagctgatgctattttggcaaatggcatgtttagtcattatgacagacctcgcattgcgcaactttgtgagaaagctggtctttatgtgcgagcacttcagcattattcagagctgcctgatataaagcgtgttattgtgaatacccatgcaattgagccacagggactggtggaattcttcggtacactgtccaaggaatgggcactggagtgcatgaaggatcttttgctggttaatttgagaggaaaccttcagataattgttcaggttgcgaaagaatactgtgaacaattgggagttgatgcatgtattaagctatttgagcagttcaaatcctacgaaggattatatttcttcttaggatcatacttgagctccagtgaggatggtgacattcactttaaatacatcgaagctgctgcaaaaactggacaaattaaagaggtggagcgtgtaacacgcgaatcaaatttctatgatcctgaaaagactaagaactttttaatggaggctaagctccctgatgcacgcccacttatcaacgtgtgcgaccgctttggttttgtcccagaccttacacattacttgtactcgaacaacatgcttcgctatatagaaggatatgtccaaaaggtcaatcctggaaatgctccattagttgttgggcagcttctagatgacgaatgtcctgaagatttcattaagggactgatactctctgtccgttctctgcttccagtagaacctttggtggatgagtgtgagaaaaggaaccgacttcgcctgctgactcagttcctagagcatctagtgagtgaagggagccaagatgtgcatgtgcacaatgctctgggtaaaattataatagatagcaacaataatcccgaacatttcctcactaccaatccatattatgattcacgtgttgttggtaagtactgtgagaagcgtgatcctactcttgctgttgtcgcataccggagaggtcaatgtgatgatgaacttataaatgtgacaaacaagaactccctcttcaagctgcaggccaggtatgtggttgagagaatggatggtgatctctgggctaaagttcttgatcctgagaatgaattcagaagattgctcattgatcaagttgtatccactgccctgcctgaaagcaaaagtccagagcaagtttctgcagctgttaaggcatttatgaccgcagaccttcctcatgaattgattgagttgcttgaaaagattgtgctacaaaactcggcattcagtgggaactttaaccttcaaaacttactcatcttaactgcaatcaaggctgatccatctagggttatggactatgtcaacagacttgataattttgatggcccagctgttggagaggtggccgtggaggcccaattgtatgaagaggcttatgctattttcaagaagttcaatttgaatgtgcaggctgtgaatgtcttgttggataatatccgggacattaaccgagctgttgaatttgcatatcgtgttgaagaagatgctgtttggagccaggtggctattgctcagcttagagaaggattagtaagcgatgcaattgaatcgtttattcgcgctgatgatgccacccgtttcctagaagtcattaaagccgcggaagatatggatgtttatgatgatctggttaagtatcttctcatggttaggcagaaaacaaaggagcccaaagtggacagtgagcttatctatgcatatgccaagattgatagactgggggagattgaggaatttattcttatgccaaatgttgccaatctgcccaatgttggtgatcgattgtttgatgaagcattgtacgaggctgcaaagattatctttgcctttatttcaaactggggaaaattggctgtcacactggttaggctgaagcaatttcaaggtgcagttgatgcggcacggaaagctaacagttctaaaacttggaaggaagtttgctttgcctgcgttgatgctgaggaatttcgtttggctcaaatatgcggtctcaacatcattgtacaggtggatgacttggaagaggttagtgagtactatcaaaacagggggtgctttaatgagcttatctctcttatggagagtggtttgggactggaacgtgcccatatgggaatcttcacggagttgggtgttctgtatgccagataccgccatgagaagctcatggagcacatcaaattattctccactcgcctcaatatcccaaagctgatccgtgcatgtgacgaacaacagcactggcaggaattgacttacctgtacattcaatatgacgagtttgataatgctgctacaaccgtaatgaaccattctccagaagcttgggagcacatgcaattcaaagatattattgtaaaagttgccaatgttgagctatactacaaagctgtgcacttctatttgcaagaacacccagatctcatcaatgatgttctgaatgtgcttgctcttcgtgtggatcacacacgtgtggtggatataatgagaaaggctggtcatctccgtctcatcaagccatatatggtcgctgttcagagcaataatgtatctgcagtgaatgaagctcttaatgagatttatgtagaggaggaggattacgagagattacgcgaatccactgatttgcacgatagctttgatcaaattggccttgctcagaagattgagaagcatgagctgcttgaaatgaggcgtgttgcagcctatatttataagaaagcaggcaggtggaaacaatcaattgcattgtcaaagaaagacaacctctacaaagatgcaatggagactgcttcccagtctggcgatcgtgaacttgctgaggaattgcttgtttacttcatcgaacagggcaagaaagagtgttttgcttcatgcctctttgtctgctatgatctgattcgtccagatgttgcacttgaacttgcgtggatgaacaacatgattgactttgccttcccatatttgttacagttcatccgtgaatatactggcaaagttgatgaattaattaaagacaagattgaagctgtaaaagaagccaaggctaaagagaatgaagagcaggatattgtgaagcaacagaatatgtatgctcagttgctgcctcttgctttgccggcaccaccaggcatgggtgctcctggaatgggaggttatggtggaccacctcctcctccgcctatgggtatgggcggtatgggcatgcctccaatgccacctttcggcatgccaccaatgggctcctactagtgtgttggaaatagaaatccagatattaatgcagatagttgttgcttgatgtgacgagggctgtttagtgagaactggaaggggaggatgccagaaggtatgaatgggttcattatgattttgctcctcatctgtgtatgccttgtcactttttggggatgttactgtggtgcgtctagtccaagtttgggaaaacattattgataccggtgttgtttagagtgtggatatgatatctgttttgtaatattctttgggtaggtgagggcattttttgcagctttaggcggcaagctgaggataatttgtatgttatattagtagcaagttgagttgccatattataagggactgctaagtttgatcttttttgagttttatcagtattaattatggtttggtcacctgttaattggttcatgttattttgtatttgacgacgttctttatgacagttaatgaattcatccaga

SEQ ID NO: 5196 - DNA, 5797 bp, Glycine max
gcttcgcttgctcggtgtgtcaataggagacgagatccattcttctcgtctcgtcattgtagacgacacgccagttcagttccactccctttcttctccctcgttttattcgtgtcagaccttcaatttcccgtttcgtttccacgtctttctctctctcctcttcgttttgaagagggtccaagtcttctcttccgctgcttccagatctcgcagggatttggatcctcctcaagctccttctctctcttcactcttccaccctccatcggcgaattcaattcgccggttgcagatccgaatcttcgatttccagttccttgatctaagccaccatggcggccgcgaatgctccgatcaccatgaaagaagccctaactttgccgagcattggcatcaattcgcaattcatcacgtttacgcacgtgacgatggaatcggataagtatatatgtgttcgtgaaaccgctccacagaatagcgtggttatcattgatatgaacatgccaaatcaacctttgaggaggcctatcaccgcggattccgctcttatgaatccgaattctagaattcttgctttgaaagcccaactgcaaggaactactcaagatcacctgcaaatatttaacattgagatgaaagcaaagatgaaatcatatcagatgcctgagcaggtagtcttttggaagtggattagccccaagatgttgggtctcgtaacacagacctctgtataccactggtcaattgaaggtgactctgaacctgttaagatgtttgagagaacagcaaatttggcaaacaaccagataattaattatcgatgtgaccctacagaaaaatggttggttttgattggcattgctcctggtgcacctgagagggcacaattggtaaagggaaacatgcaacttttctcagtggatcaacaacgtagtcaggctcttgaagctcatgctgcatcatttgcccaatttaaagttcctgggaatgaaaatccttctgttttgatttcttttgcctcgaagacacttaatgctggtcaagttatatccaagttgcatgttattgaactgggagcacaaccagggaggccatcattcacaaagaagcaagctgatcttttcttccccccagattttgctgatgattttccagttgccatgcagatatcccacaaatacaatttgatttatgtgattacgaaacttggcctactatttgtctatgatttggagacagctactgctgtatataggaacagaatcagtccagatcctatatttttgacctcagaagctacatctgtgggaggcttttatgccatcaacaggagaggccaggttttattggctactgttaatgaacaaaccattgtgaattttgtcagtggccaactaaacaatttggagctagcagttagtcttgccaaaagaggaaatcttcctggtgctgaaaagctggtagtggaacgttttcatgaactgtttgcccaaacaaaatataaggaagctgcagaacttgcagctgaatctccacaaggaatccttcgaactcctgacacagttgccaaatttcagagtgttcctgtgcaagctgggcaaactcctcctctgttgcagtattttggaacacttttaacaaggggaaagctgaatgcctttgaatcattagaattatcacggttggttgtgaaccagaacaagaaaaatctgttggaaaattggttggcagaggacaagcttgaatgcagtgaggagctaggagatctcgttaagactgtggacaatgatcttgctttaaaaatatatatcaaagccagagctactccaaaagttgttgctgcgtttgctgagaggagggagtttgacaaaattctgatttactctaaacaggttgggtacacacctgactacctcttccttctgcaaacaattctccggacagatcctcagggcgctgttaattttgcattaatgatgtctcaaatggagggaggtagcccagttgattacaacacaataactgatctctttcttcagagaaatctgattcgagaggcaacagcttttctcctggatgttttaaagccgaatctaccagaacatgggttccttcagacaaaggtgttggagataaatctggtgactttccccaatgttgctgatgcaatattggctaatggcatgttcagccattatgaccgtcctcgtattgcccaactttgtgaaaaagctggcctttatgtgcgagctttgcaacattacacagaattaccagacatcaaacgcgtgattgttaatacacatgcaattgaacctcagtcactcgtagagttttttggtacactgtcaaaagaatgggcattagaatgcatgaaagacttactgctggccaatcttaggggcaacctacagatcattgtgcaggttgctaaagaatattgtgagcaattgggcgttgatgcctgcataaaactttttgagcaatttaggtcatatgagggactgtactttttccttggatcatacttgagctccagtgaggatcctgacattcactttaagtacattgaggcagcagcaaagactggtcaaatcaaggaggttgagcgtgtgacaagagaatcaaatttctatgatgctgagaaaaccaaaaactttctgatggaggctaaacttccagatgcacggcctttgattaatgtttgtgatcgttttggatttgttccagatctaacacactatctatacacaaacaacatggttcgctacattgaaggctatgttcagaaggtgaacccagggaatgcacctttagttgttgggcagctgctagatgatgaatgcgcagaagattttatcaaaggcttgatcctttctgttcgttcattactgccagtggagccccttgtggaggaatgtgagaagaggaatcgacttcgtatgctcacacagttcttggaacaccttgtaagtgagggaagccaggatgtacatgttcacaatgcactgggtaaaattatcattgatagcaacaacaacccagaacatttcctcacaaccaacccatactatgattctcgagttgtgggcaagtattgtgagaaacgggatcccaccttagcagttgtagcttatcggcgaggacaatgtgacgatgaacttatcaatgtcaccaacaaaaattctttgttcaaactgcaagcaagatatgttgttgagagaatggatggtgatttgtgggctaaagttcttgatcctgataatgaatatagaaggcaacttattgatcaggttgtatctactgctttgcctgaaagctcaagccctgagcaagtttctgcagctgttaaggctttcatgacagccgatctgccccatgaattgattgaacttcttgagaagattgtgcttcagaattctgcattcagtggaaactttaatttgcagaatcttcttattttgacagcaataaaggctgatccatccagagttatggattatgttaatagattggataattttgatgggcccgcagttggagaaatggctgtagaagctcagttatatgaggaagcatttgccatttttaagaagttcaacttgaatgttcaagcagtcaacgtgttgcttgataagattcatagcattgatagagctgttgagtttgctttccgagttgaagaagatgctgtttggagtcaggtggccaaggctcaactcagggatgggctagtaagtgatgcaattgagtcatttatacgagctgatgatgctacacaatttttagatgttatccgtgctgctgaagatggcaatgtttaccatgacttggtgaaatacttgctaatggtaagagggaaagcaaaagaacccaaggtcgacagtgagctcatttatgcatatgcaaaaatagataggctgagtgacattgaggagttcattcttatgcctaatgttgctaatcttcaaaatgttggtgaccggttgtacgatgaagcattatatgaagctgcaaaaatcatatttgcttttatatctaactgggccaagttggctatcacactggtcaaattacaacagtttcaaggtgctgttgatgcagcaaggaaagccaacagctcaaagacatggaaggaagtttgctttgcttgtgttgatgcagaggagtttcgtttggcccaaatttgtggactaaacattattattcaggtggatgacttggaagaagtcagtgaatattaccaaaacagaggttgcttcaatgagctcatatctctcatggagagtggtttagggttagaacgggcacatatgggcatctttactgagttaggagttctgtatgctagataccgccctgagaagcttatggagcatatcaaactattctcaacccgcctcaatattcctaaactcataagagcttgtgatgaacaacagcattggaaagaattgacctatttgtatatacaatatggtgagtttgataatgctgcaactaccatcatgaaccattcacctgaagcatgggatcacatgcaattcaaagatgttgttgttaaagttgccaatgtggagttgtactacaaggctgttcacttctacttggaagagcatccagatcttatcaatgatgttctgaacgtccttgcacttcgtgtggaccatgcacgtgttgttgacatcatgcggaaggctggtcacctccgtcttgtgaaaccgtatatgattgcagttcaaagcaacaatgtatctgctgttaatgaagcgttgaatgagatatatgtcgaggaggaagattatgatagattgcgcgagtcaattgatttgcacgataactttgatcaaataggccttgctcaaaagattgaaaagcatgagcttcttgagatgagacgtgttgctgcttatatttacaagaaggcaggtaggtggaagcagtctattgctttgtcaaagaaggataacctttacaaagatgccatggagacagcctcccaatccggggagcgtgaacttgctgaggagttgcttgtttatttcattgatcagggaaagaaggaatgctttgcctcatgtctatttgtttgctatgatctcatacgggcagacattgttcttgaactagcttggatgcacaatatgattgactttgccttcccatatctattgcagtttattcgtgagtacactggcaaagtcgatgaactagtgaaggacaaaattgaagcacaaaatgaagtgaaggctaaagagcaagaagaaaaggatgtagttgcacaacagaacatgtatgctcaattgttgcctcttgctttgcctgcaccaccaatgcctggaatgggaggctttgctcctccccctccaatgggtggactggggatgcccccaatgcctccttatggtatgccacccatgggcagcagtttttgaagagtatagcatgaactcggtccctatgaagagcaatgtaggaacttccaagttttgcgtagaacaatatcttgtgtgatttggatgcagcattctttctttgcttcggttggcggtgggatatcccaagttaaaataatgtgaagtttttcggtttagattgtgtcataatagtcttgtaagtttattgttttttctgtgttgtagtcgaggcattttttgggctgctgattctagctaaccgataaatttctgtattctaccatttttcttgtaataaatgagttagtcctaggtagaccaaacaaaaaatgaattacatctagtatatataagaaattttccgactttaacagcca

SEQ ID NO: 5197 - DNA, 5552 bp, Cajanus cajan
cactccaattccccttcgatcatggccgccaacgcccccatcgccatgcgagaagccttaacgttgggaagcgtcggaatcaacccgcagttcatcaccttcacgcacgtcaccatggagtcggacaagtacatttgcgtcagggaaaccgcgccgcagaacagcgtcgtcatgatcgacatgtccatgcccatgcagcctctccgacgccctatcacagccgattccgctctcatgaaccctaacaccagaattctcgcgcttaaagctcaagttccaggcaccacgcaggatcatttgcaagtgttcaacattgaatccaaagccaagataaaatcgtatcaaatgagccaacaggttgtattttggaagtggataaccccaaagacactaggcatagtcactcagtcatctgtgtatcattggtcaattgaaggtgagggtgagccagtgaagatgtttgaccgaacagctaatttggcgaataatcagattatcaattatcgttgtgatcctgctgaaaagtggttggttttgattggaattgcccctggttctccggagagaccacaacttgttaaaggaaatatgcaactcttctctgtggatcaacaacggagccaggctcttgaagcacatgctgcctcatttgccacatttagagttgctggcaatgataaggattcaactcttatttgttttgcatcaaagagcatcaatgctggacaggttgtgtcaaagatgcatgtcattgaacttggtgcccagccaggcaagccatcatttacaaaaaaacaagcagatctcttcttccctccagactttgctgatgactttcctgtatcaatgcagatttcaaataagtatggcttgatatatgttattacaaaacttgggcttttatttgtctatgatctggagagtgccactgcagtttacagaaatcgaatcagtcccgatcctatatttttgactgcagaagcatcatcagtagggggcttttatgctataaatagacgtggccaggtgttgcttgctactgtgaatgaggcaaccattgtaccctttgttagtggccagttaaataatttggaacttgctgttagtcttgctaaaagaggaaacctccctggtgcagaagaattggttgttaagcgttttcaagaattatttgctcagaccaaatataaggaagccgcagagcttgctgctcaatcgccacaaggagtacttcgtacttctgatacgattgcaaaatttcagagtgtacctgtgcaagctgggcaaacaccaccactgttgcaatactttggaactctgttaaccatgggaaaactgaatgcttttgagtcgctggaactctcacgacttgttgtaaatcagaacaaaaagaatcttttggaaaattggctggcagaggataaacttgaatgcagcgaggagcttggtgaccttgttaagacagtagataatgaccttgcattgaaaatttatatcaaagctagagccacaccgaaagttgttgcagcttttgcggagaggagggaatttgacaagatcctgatatattctaagcaggttggatatacacctgattatatgttccttcttcaaacaattttacgaacagacccccagggtgctgtaaattttgctctgatgatgtctcaaatggagggaggatgccccattgactataacacgataactgatctctttcttcagaggaatttgatccgtgaggcgacagcctttttgttggatgtgctgaagccaaaccttcctgaacatggatatcttcaaacaaaggttctggaaattaatcttgtgacctttccaaatgtcgctgatgctatattagccaatggcatgttcagccattatgatcgcccacgtattggacaactatgtgaaaaagccggccttttcatacgggctcttcagcattataccgagttgcctgacatcaaacgtgttattgtgaatacacatgccattgagccacaggctttagttgagttctttggaaccctttctcgagaatgggcacttgagtgtatgaaagatcttttgctggtcaatcttaggggcaatcttcaaataattgtgcagacagctaaggaatattctgagcagctgggagttgatgcatgcattaaactctttgagcaattcaaatcctatgaagggctatactttttcttgggtgcatacttgagctccagtgaggatcctgatattcacttcaagtacattgaggctgctgctaaaactggacaaattaaggaggtagagcgtgtaactagggaatcaaatttttatgatgctgagaagacaaagaattttcttatggaggccaagcttcctgatgcacgtccattgattaatgtgtgcgatcgttttggttttgttccggatctcacccattatctttatacaagcaacatgcttcgctatattgaaggttatgttcaaaaggtcaatcctggaaatgctcctctagttgtaggacagttgttagatgatgaatgccctgaagattttattaaaggtcttatactttcagttcgttctcttctgccagttgagcctttagttgaagaatgtgagaagaggaatcgtctccgcctgcttactcaattcttggagcatcttgtaagtgaaggaagccaggatgtgcatgtacataatgccctgggtaaaatcattattgacagcaacaacaatcctgagcattttctcacaaccaatccatactatgattcacgtgttgttggtaaatattgtgaaaagagggatcctacccttgctgttgttgcttaccgaagagggcaatgcgatgatgagcttgttaatgttaccaataaaaactccttgttcaaactccaagcaagatatgtagtggaaaggatggactctgacctctgggagaaagtcctaaatcctgagaatgagtttagaagacagttgattgatcaagtggtgtctactgctttgcctgaaagcaagagtcctgagcaagtttcagctgcagtgaaagcttttatgactgctgatcttcctcacgagttgattgagcttcttgaaaagattgtactacaaaattctgcttttagtggaaactttaatctgcaaaatttgctgatccttactgcagtcaaggcagatccttctagagttatggattacataaacaggttggacaactttgatgggcctgcagtaggggaggtggctgtggaggcacaactatatgaagaggcatttgttattttcaagaaatttaatttgaatgttcaggctgttaatgtcctgttggataaccttcagacaattgatcgggccgtggagtttgctttccgggttgaagaagatgctgtttggagccaggtggctaaagcacaacttagagaaggcttagtgagtgatgcaattgagtcgtttattcgtgcagatgatgcagatcatttcctagaggttataaaagctgctgaagatgcagatgtataccatgacctggttaagtatcttcacatggttaggcagaagaccaaagagcccaaggtggacagtgagcttatctatgcttatgctaagattgaacggcttggagaaattgaagagtttatactgatgccaaatgttgccaatttaccaaatgttggagatcgcttatatgatgaggctttgtatgaagctgccaaaattatatttgctttcatttctaactgggctaagttggcagtcacattggtgaagcttaagcagttccaaggtgctgttgatgctgccaggaaagcaaacagttcaaaaacatggaaggaagtttgtttcgcctgtgttgatgctgaggaattccgcttagcccagatttgtggtctcaatgtcatcattcaggtggatgatttggaggaggttagcgagttttatcagaacagaggatgcttcaatgaactcatatctctaatggagagtgggttaggattggagcgtgcacacatgggtatcttcactgagttgggagttctttatgcaagatatcgtcctgagaagctaatggaacacattaaattgttctcaactcggctcaacattccaaagcttattcgggcatgtgatgaacagcagcattggaaagaacttacttacctatacatccaatatgatgagtttgataatgctgcagccactgtaatgaatcactctccagaagcatgggaccacatgcaattcaaagatgttattgttaaagttgcaagtgtggagctctactataaggctgttcacttctacttacaagagcatccagatatcataaatgatatgttaaatgtgattgctctccgtgtggaccatactcgcgtagtagatataatgaggaaggctggccacctcagattagttaagccttacatgattgctgttcaaagcaacaatgtgtctgctgtcaatgaagctttgaatgaaatttatgtcgaggaagaggactatgacagactacgagaatcaatagatctgcatgacaattttgatcagataggtcttgcacagaagattgagaagcatgaacttcttgagatgaggcgtgttgctgcatacatttacaagaaagtaggaagatggaagcaatccattgctttgtcaaagaaagacaatctttacaaggactgtatggaaacatgctctcaatctggtgaccgggaactctcagaggatttgcttatctactttattgatcagggaaagaaagagtgctttgcgtcatgcctctttgtgtgttatgatattatacggccagatgtggctcttgagctagcttggatgaacaatatgattgattttgcttttccatatctcttacagtttattcgagagtattcaggcaaggtagatgagcttatcaaggataaaattgaagcacaaaatgaggagaaagccaaggaaaaggaggagaaggatgtaattgcccagcagaatatgtatgcccagttgctacctcttgctttgccggcacctccaatgccaggaatgggaggaggttataccccttccccacctccaccacctatgggtggaatggggatgccaccaatgcctccttttggcatgcctccgatggggggcggcagctactgatcctgcccgaggagagaattttgcgatagtttagaacatctcatttttgcattcaaggtttagggttaaagaatttgacgtggtggcagcaagcatcggtcttctagtcggatactacttttcaatgattgcggctttcttcattgaaagtttgagttacttatttcttttgcttctttattttgggattgtttgtggtcattctggtgagagagccaagatggccaaatgatcctgattgtatctttttgaggtattggcttggttgccgcctgtataggttattttctctaattattatttgtttccatagttgtgaagtcacataaatgtattactgattaggacttaatttttttgttctttcgtggtatataaacgactttcatataatatttaaaatgttctcttactgt

SEQ ID NO: 5198 - DNA, 5606 bp, Solanum phureja
caaggacatactcaagtactagtagttagaactcaacaattgttccccaattcattttttcacatcttcagtgcttaacaacgcattttagaagaaccctttactctttcgatttctctttttttctctggatctcttggagggtttcttctttttctgagatctcgtctcgcagatcgccatcatggcggctgctaatgctccaatcactatgaaagaggcccttacattgtcaagtataggggttaacccgcagttcattacgttcacaaatgtaaccatggaatcagacaagtatatatgtgttcgggagacctcaccacaaaatagtgtggtcattattgatatgagtatgccaatgcagcctttgcgccgccctattactgctgactctgctcttatgaatcccaattccagaattttggctctaaaagctcaagtaccaggaactactcaagatcacttacaaattttcaatattgaggcaaagcagaaaataaagtcatatcagatgcctgagcaggttgttttctggaagtggattaccccgcagattttaggtatcgtcacacagacgtcagtctatcattggccaattgaaggtgatactgagcctataaagatgtttgatagaacagccaatctagccaataatcaaataatcaattatcgttgtgatccttcagagaaatggttggttttgattggtattgccccaggttcgccggagaggccccaactggtcaaaggaaatatgcaattatattcagtggatcagcaacgaagtcaatctctagaggcacacgctgcatcatttgcatcattcagagtacctggaagtgatagagattccatactcatttcttttgccacgaaatccttgaatgctggacaggttatatcaaaattgcatgtcattgagctgggagctcagccagggaaaccttcgtttacgaaaaaacaggcggaccttttcttccctccagattttgctgatgatttcccagtttccatgcagatatctcataagtatagtttagtttatgtcatcacaaagcttgggcttcttttcgtctacgacctggaaacagctactgcggtatacagaaataggattagcccagaccctattttcctgacagctgaagcttcgtcaattggtggtttctatgccatcaacaggcgaggccaagtgttgctagccacagtaaatgaaacaactatcataccttttgtcagtggacaattgaacaatctggagcttgctgtcaatcttgccaaaagaggaaatcttcccggtgccgagactttggttgtccagcgcttccaagaattgtttgcccaaaccaagtacaaagaggctgctgagcttgctgcggaatcacctcagggcattctccgtacgtctgatactgttgccaaatttcagagcgttcctgttcaagcagggcaaacacctcctcttttgcagtactttgggacacttttgacaaaggggaagctcaatgcttttgagtcattggaattgtcacgccttgttgtcaaccaaaataagaagaaccttttggagaactggttagctgaggataagctggagtgcagtgaggaacttggcgatcttgtgaagactgttgataatgatctcgccttgaagatatacatcaaagcaagagcaactccaaaagttgttgctgctttcgccgagcgcagggagtttgacaagattctgatatattccaagcaggttggctatacgcctgactatctgttcctcctgcaaacaattcttcgatctgatcctcagggagctgttaactttgcactcatgatgtcccaaatggagggcggttgtccagttgattataatacaatcactgacctttttctacagaggaacatgatccgcgaggcaacagcatttttgttggatgttctgaaacctaaccttccagaacatggtttcttgcagactaaggtattggaaatcaatcttgtgactttccccaatgtagcagatgctatattagcaaatggaatgttcagtcactatgatcgacctcgaattgctcaactttgtgaaaaggctggtctatacgtgcgggctctgcagcattatactgaactccctgatatcaagcgtgtcattgtgaacacacatgcaattgagcctcaggctctggttgagttctttgggactgtttcacgtgaatgggctctcgagtgtatgaaggacctgctagtgatcaatatcaaaggcaaccttcaaataattgtgcaggtagcgaaagagtattgtgagcagttgggtgttgatgcctgcataaagctttttgagcaattcaagtcttatgatgggttgtacttcttcttgggatcatatttgagttccagtgaagatcccgaaattcacttcaagtatgttgaggctgctgccaagactggacaaatcaaggaagttgaacgtgtgacaagagaatcaaacttttatgaccctgaaaagacgaagaacttcttgatggaagccaaacttcctgatgctcggcctttaattaatgtttgtgaccgttttggttttgttcctgatctcacacactacctctataccaataacatgctacggtatattgaaggttatgtccaaaaggtcaacccagcaaatgctcctttagttgtgggacagctattggatgatgagtgtcctgaggattttattaaaggcttgatcctttctgttcgttctctgctacctgttgagccccttgtggatgaatgtgaaaagaggaaccgcctccgactgcttactcagttcttggagcatcttgtgagtgaaggaagccaagatgtgcatgtacacaatgctctgggtaagatcatcatagatagcaacaataacccagagcacttcctgacaaccaacccatactatgattcacgtgttgtgggtaaatattgtgagaagcgcgatcctacccttgctgttgttgcatataggagagggcaatgtgatgatgaacttattaatgtaacaaacaagaactctttgttcaaactacaagccaggtatgtcgttgagaggatggatggtgacctctgggagaaagttcttaaccctgaaaatgagttcagaaggcagcttatcgatcaagttgtctccactgctttgcctgagagcaaaagcccagaacaagtttctgctactgttaaagctttcatgactgctgatcttccgcatgaattgattgaacttcttgaaaagattgtcctccagaattctgcattcagtgggaactttaatctgcaaaacttgcttatcttgacagccattaaagccgatccatctagagttatggattatatcaacaggcttgataattttgatggacctgccgtaggggaggtagctgtagaagcccaactttatgaagaagcttttgcaatcttcaagaagttcaatttaaatgtccaggctgtcaatgttctgctagataatattcgtgatataaaccgtgctgtcgagtttgccttccgagttgaagaagatgctgtttggagccaagtggctaaagctcaactgagagaaggattagtcagtgatgctattgagtcatttatccgtgcagatgataccacccaatttttggatgtcattcgtgctgcagaggatgccgatgtttaccatgacttggtgaagtatctgctgatggtaaggcaaaagacaaaggagcccaaggttgacagtgaactaatctatgcatatgctaaaatagatcgattgagtgacattgaagagtttattctcatgccaaatgttgccaatctaccgaatgttggtgaccggttgtatgatgaagccctgtatgaggctgcaaagatcatatttgcttttacttctaactgggccaaattggctatcacacttgtgaagctaaatcaatttcaaggtgctgttgatgcagcacgcaaagcaaatagttcaaaaacatggaaagaagtctgctttgcttgtgtcgatgctgaagagttccgcttagctcaaatttgtgggcttaacattatagtacaggtggatgatctggaggaagtgagtgagtattaccaaaacagaggatgtttcaatgaattgatctcccttatggagagtgggctgggtttggagcgagcccatatgggtatcttcacagaacttggtgtcctttatgccagataccgttatgagaagctcatggaacacataaaattattttccacccgtctcaacattcccaagcttattcgtgcctgtgatgagcagcaacactggaaagaactaacttatttgtatatccaatatgatgaatttgataatgctgccactaccgtcatgaatcattctccagatgcttgggatcatatgcagttcaaagacattgctgtcaaagttgctaatgtggagctttattacaaggccgtccacttctatttgcaagaacatcctgatctcatcaatgatcttctaaatgttcttgcacttagagtggaccacacccgtgtagtcgacataatgagaaaggctggtcatcttcgcctagtgaagccttacatgattgctgttcaaagtaacaatgtttcttctgtaaatgaggcccttaatgagatatatgttgaagaagaagattatgatagattacgtgaatcagtagatttgcatgataacttcgaccagattggtcttgcgcagaagatagagaagcacgagcttcttgagatgaggcgtgttgctggttatatctataaaagggctggtcggtggaaacaatccattgctctgtcgaagaaagataatctttacaaagatgcaatggagactgcctcacaatctggggatcgtgaacttgctgaagagttgcttgtttacttcattgaacagggaaagaaagaatgctttgcgtcatgcctgtttgtttgttatgatttgattcgcccggatgttgcccttgagctagcatggatgaataatatgattgactttgcattcccatacctgttacagtttattcgtgaatataccggcaaggttgatgagctgataaaagataaaatagaggctcaaagtgaagcaaaagccaaagagaatgaagagaaggacgttatgaagcagcagaatatgtatgcacagttgctgcctctggctttgccggctccaccaatgccgggtatgggaggaggttttggtccatcccagccacctccaatgggcggaatgggaatgcctccatttggtatgccacccatgggtccctactaattcagtgttacttcagataccggtgtaatcaacatacacaacaagagaagcacacaaatgggtcctcttttttgttagagttagggctttgattgctgacgaacacaaacggaggctagataaaataaccattctgttgtgtgtcgtagggtgctgatatctcctttgtaatattcttttagaagaggcaattttttgcagctaggcagcagatggagaaatattacattacaattatctagaaccatgtagagatgcattatatagtattttgtgctactttctaggtcgtcaaggattaatttccaaagttctgtaagta

SEQ ID NO: 5199 - DNA, 5745 bp, Solanum lycopersicum
aagaaccctcttccaccccctctctctctctagatctctttctcctctttgttctctctccgtttcttcttcctttttcccctcgaagggtttgagggttgcttcttcatcggagatctcccgtcgttccggtcgcaattccgttgagatctcgtcatcatggcggcagctaatgctccgatcactatgaaagaggccctaacgttgcaaagtataggggttaatccgcagttcatcacgttcaccaatgttaccatggaatcagataagtatatatgtgtacgggagacttcaccacaaaatagtgtggtgattattgatatgaacatgccaatgcagcctttgaggcgcccaattacggcagactctgctcttatgaatcctaataccagaattctggctctaaaagctcaagttccaggaactactcaagaccacttacaaattttcaatattgaggcaaagcagaaaattaaatcacatcagatgcctgagcaggttgttttctggaagtggattacccctaagatgttaggtctcgtcacacaaacctcagtgtaccattggccaattgaaggtgattccgagcctgtaaagatgtttgatagaacagccaatctagctaacaaccaaattatcaactatcgatgtgatccttcagagaaatggttggttttgattggtattgccccaggttcgccagagaagccccaactggtcaaagggaatatgcaactattttcagtggatcagcaacgcagtcaagctcttgaggctcatgctgcgtcatttgcctcaataagagtacctgggaatgatagggattccatactcatttcttttgcctcgaaaacttcaaatgctgggcaggttacatcaaagttgcatgtcattgagctaggcgcccagccagggaagccttcattttcaaagaaacaggcagatcttttctttcctccggattttgctgatgatttcccagttgccatgcagatctctcataagtatggtttaatttatgtcatcacaaagcttggtcttctgtttgtctatgacttggaaacagctactgctgtgtacagaaataggatcagcccagatcctatttttctgacttcagaagcttcatcaatcggtggtttctatgccgtcaacaggcgagggcaagtgttgctagccacagtaaatgaagcaacaattattccttttatcagtggccaattgaataatctagagcttgctgtcaatcttgccaaaagaggaaaccttcctggtgctgagaatttggttgtccagcgctttcaagatttgtttgctcaaaccaagtacaaagaggctgctgagcttgctgcagaatccccccaaggcatactccgtacaccggatactgttgctaaatttcagagtgttcctgttcaagcagggcaaacacctcctctgttgcagtactttggtacactcttgactaaagggaagctcaatgcattcgagtctttggaactttcacgacttgttgtcaaccagaataagaagaacctcttagagaattggttggctgaagataagctagagtgtagtgaggaacttggcgaccttgtgaagactgttgataatgaccttgccttgaagatctacatcaaagcaagagcaacaccaaaagttgttgccgcttttgctgagcgcagggagtttgacaagattctgatatactcaaagcaggttggatatactcctgactatttgttcctgctgcaaacaattcttcgatccgatcctcaggcatctcctcttgggttccatctggccccaatcttcctcctctcggacttggatttggaccatgaaggtgctgttaattttgcactcatgatgtctcaaatggagggagggtgtcctgttgattacaatacaatcaccgacctatttcttcagaggaacatgatccgtgaggcaacagcatttttgttggatgttctgaagcctaaccttccagagcatggttacctgcagactaaggtcttggaaatcaaccttgtgactttcccaaatgttgctgatgctatattagccaatggaatgttcagtcattatgatcgaccacgaattgctcagctttgtgaaaaagctggtctttatattcgggctttgcagcactacagtgaactacctgatatcaagcgcgtaattgttaatacacatgccattgagcctcaggctctggttgagttctttgggactgtctcacgtgaatgggcgcttgagtgcatgaaggaccttctggtgatcaatatcaaaggcaaccttcaaataatagttcaggttgcaaaggagtactgtgagcagttgggtattgatgcctgcattaagctttttgagcagttcaagtcgtacgatgggttgtacttcttcttgggatcatatttgagttcgagtgaggatcctgatatccactttaagtatatcgaagcagctgccaggactggacaaatcaaggaggttgagcgcgtgacaagagaatctaacttctacgaccctgaaaagacaaagaacttcttgatggaagccaaacttcctgatgcccgacctctgatcaatgtttgcgaccgctttggttttgttcctgatctcacacactatctgtacactaacaatatgctacgatatattgagggttatgttcaaaaggtcaatccaggaaatgctcctttagttgtggggcagcttttagatgacgagtgtccagaggatttcattaaaggcttgatcctttctgttcgttctctgcttcctgttgagccccttgtggctgaatgtgaaaaaaggaaccgactgcgactgcttacacagtttttggagcatcttgtgagtgaaggaagccaagatgtgcatgtacacaatgctcttggtaagatcatcatagagagcaataataacccagagcatttcctcacgaccaacccatattatgactctcgtgttgtgggtaaatattgtgagaagcgtgatccgactcttgctgttgtggcctatagaagagggcaatgtgatgatgaacttattaatgtaacaaataagaactctctgttcaaacttcaagccaggtatgtcgttgagaggatggatggtgatctttgggataaagttcttgtccctgagaatgagtttagaaggcagctcatagatcaagttgtctccactgctctgcctgaaagcaagagtccagaacaagtttctgcagctgttaaagcgttcatgacagctgatcttcctcatgaactgattgagcttcttgaaaagattgtgctccaaaactctgcatttagtgggaactttaatctgcagaatttgcttatcttgacagccattaaagctgatccatctagagttatggactatatcaataggcttgataattttgatggtcctgcggttggggaggttgctgttgaagcacagctctatgaagaagcttttgcgatcttcaagaagttcaacttgaatgttcaggctgtcaatgttctgcttgacagcatccgtgatataaatcgtgctgtggagtttgcattccgagttgaagaagatgctgtttggagccaggttgccaaagctcaactcagagagggattagtgagtgatgctattgaatcatttattcgggcagatgatgctacccaattcttggatgtcattcatgctgcagaagatgcagatgtttatcatgacttagtgaagtatttgctgatggtaaggcaaaagactaaggaacccaaggttgacagtgaactcatttatgcttatgctaagattgatcgattgggcgaaattgaagaattcattttaatgccaaatgttgctaatctaccaaatgttggtgatcgcttgtatgatggagcgttgtatgaggctgcaaagatcatatttgcttttatttctaattgggctaagttggcaagcactcttataaagttgaatcaattccaaggtgctgttgatgcagcccgtaaagcgaacagtgcaaaaacatggaaagaagtctgctttgcttgtgttgatgctgaggagttccgcttagctcaaatttgtgggcttaacattatagtgcaggtagatgatttggaggaagtgagtgaattttaccaaaacagaggatgtttcaatgaattaatctctcttatggagagtgggcttgggttggagcgcgcccatatgggtatctttacagaacttggtgttctatatgccagataccgtcatgagaagctcatggagcacataaaattattctccacccgtctcaacattccaaaacttattcgtgcctgtgatgagcagcaacactggaaggaactcacgtatttgtatatccaatatgatgaatttgataatgctgccactactgttatgaatcattctccagatgcttgggatcatatgcagttcaaagatatagttgtgaaagttgctaatgtggaactttattacaaggccgtccacttctatttgcaagagcatcctgatctgatcaatgatcttttaaatgttctagcactcagggtggaccacacacgtgtagtggatataatgagaaaggcgggtcaccttcgcctagtgaagccttatatgattgctgttcaaagcaacaatgtttctgctgtgaatgaggcccttaacgagatatatgttgaagaggaagactatgatagactacgtgaatcaattgaattgcatgatagctttgatcagattgggcttgcacagaagatagagaaacatgagctccttgagatgaggcgtgttgctgcttctatttataaaaaggctggtcggtggaagcaatccattgctctatcgaagaaagataatctttacaaagatgcaatggaaacagcctcacaatctggggatcgtgaacttgctgaggagttgcttgtttacttcattgaacagggaaagaaagaatgctttgcaacatgcctatttgtttgttatgatttgatccgcgcagatgttgcccttgagctagcatggatgaacaatatgatcgacttcgcattcccttatctattacagtttatccgtgaatacactggcaaggtagatgagctgataaaagataagattgaggctcaaaaagaagcaaaagccaaagagaatgaagagaaggatgttatgaagcagcagaatatgtatgctcagctgcttcctctggctttgcctgctccgccaatgccaggtatgggaggtgctggtatgggtggaggttttgctccgccaccacctcaaatgggtggaatgggaatgcctccgatgcctccatttggcatgccaccaatgggttcctactaatctgacggtgttatcctctggtgtaaaacaaagcattatgaagaaaggacacaatcgggcttttttaaattttattttatttagtctccccctctgaggtttcttttcaagtaccttgcagttagtttctgaagaggagggcacaagtggagactacgagaaataattgtttctgttgtgtgtcatagtgtgttgatatctctccttgtaatattcttttagaaaaaggcattttttgcagttaggcagcaagttgaggatattttgtagacaactttgtaaagatgcattatattgctttttaactggtttttctggggttggtgtttaattttcttcagttttcaattgttgtaatttttccaggtggtatgcttttggataaaatcacgttgaatg

SEQ ID NO: 5200 - DNA, 5697 bp, Medicago truncatula
cttcaccccgtttctttccttcatttcgtgtcaaaacccaattcaactttcaacgactctctctctctagagggtccaagtcttcacctcttctactcatagatctcgcattctctctcatcttcttccatttccagttcttcgatctcagcaatcatggcggccgcgaacgctccgatcgccatgaaagaagtcctaaccttaccgagtgttggaatcaatgcacaattcatcacattcacgcatgtgacgatggaatcagacaagtatatatgtgttcgagaaacgtctccacagaatagtgttgttattgttgatatgagcatgccaaatcaacctttgaggaggccaattactgcggattccgctcttatgaatcctaattctagaatccttgctttgaaagcccaactccaagggactacacaggatcacctacaaatatttaacattgaattgaaaacaaagatgaaatcgcatcagatgcctgagcaggtagtcttttggaagtggattagccccaaaatgttgggcctcgtgacacaaacctcagtataccactggtccattgaaggtgattctgaacctgttaaggtatttgagagaacagcaaatttggcgaacaaccagataatcaattatcgatgcgaccctacagaaaaatggttggtcttgattggtatcgctcctggttcccccgagagggcacaattggttaaagggaacatgcagcttttctccgtggatcagcagcgtagtcaggctcttgaagctcatgctgcatcatttgcccaattcaaagttcctgggaatgaaaatccgtctgttttgatttcttttgcctcaaagacatttaatgctggtcaagttatatcgaagttacatgtcattgaactgggcgcacagccagggaagccatcatttacaaagaaacaagcagatctcttcttccctccagattttgctgatgactttccagttgcaatgcagatatcccacaaatatagtttgatttatgtgatcaccaaacttgggctactttttgtatatgatttggagacagctaccgctgtatataggaacaggattagtccagatcctatatttttgacatcagaagccacatcagcaggaggcttttatgccattaataggagaggccaagttttgttggccactgtcaatgaacaaacaattgtgaattttgtcagcggtcaattaaacaatttggagctagctgttagtcttgcgaaaagagggaatcttcctggtgctgagaagctggttgtggagcgttttcatgaattgttttcccaaacaaagtataaagaagcagcagagcttgctgctgaatctccacaaggaatccttcggacccctgacacagttgccaaatttcagagtgttcccgtgcaagctggtcaaacgccgccgctgctgcagtattttggaacacttttaacgagaggaaagctgaatgccttcgaatcattagaattgtctcggttggtagtgaaccagaacaagaaaaacctgttggaaaattggttggcagaggacaagcttgaatgcagtgaggagctaggagatctcgttaagactgtggacaatgatcttgctttaaaaatatacatcaaagccagagctactccgaaagttgttgctgcttttgctgagaggagggagtttgataagattctggtctactctaagcaggttggatacacacctgactaccttttcctcttgcaaacaattctccgaacagatcctcagggtgctgttaattttgcattaatgatgtctcaaatggagggaggtagcccaattgattacaacaccataactgatctgtttcttcagagaaacctgatccgtgaggcaacagcttttctcctggatgttttaaagccaaatttacctgaacatggattccttcaaacaaaggtgttggagataaatctggtcactttccctaatgttgctgatgctattttggctaatggcatgttcagccattatgaccgtcctcgtgttgcccagctttgtgaaaaagctggcctttacgtgcgagctttgcaacattacacagagttaccagatataaaacgtgttattgttaatacacatgctattgagcctcagtcacttgtagaattttttggtactctctcacgagaatgggcattagagtgcatgaaagacttgttactggccaatcttaggggcaatttacagattattgtgcaggttgccaaagaatattctgaacaattgagcgttgaaggttgcattaaaatttttgagcagtttaggtcatatgaagggctgtacttttttcttggctcatatttgagctccagcgaggaccccgacattcatttcaagtatattgaggcagcagcgaagactggtcaaatcaaggaggttgagcgtgtgacaagagaatccaatttctatgatgccgaaaaaacaaagaacttcctaatggaggctaagcttccagatgcacgacctttaatcaatgtttgtgatcgatttgggtttgttccagatctgacacactacctatacacaaacaacatgcttcgctacattgaaggttatgttcagaaggtgaacccagggaatgctcctttagttgttgggcagctgctagatgacgagtgccctgaagattttatcaaaggtttgattctttctgttcgttccttgctgccagtggagccccttgtggaggagtgtgagaagaggaatcgccttcgtttgctcacacagtttttggaacatctcgtgagtgagggaagccaggatgtacatgttcacaacgccctgggtaaaattatcattgatagcaacaacaacccagaaaattttctcacaaccaacccttactatgattctcgagttgtgggcaagtattgtgagaaacgcgacccaaccttggcagttgtagcttaccggcgaggacaatgtgatgaagaacttatcaatgtcaccagtaaaaattctttgttcaaactgcaagcaaggtatgtcgttgagagaatggacggcgatctttgggataaagttcttaatcctgataatgaatatagaaggcaacttattgatcaggttgtatctactgctttgcctgaaagctcaagccctgaacaagtttctgcaactgttagggctttcatgacagctgatctgcctcatgaattgattgaacttctcgagaagattgtccttcagaattctgcattcagtgggaaccacaatttgcagaatcttctcattttgacagcgataaaggctgattcatccagagttatggattatatcaatagactggataattttgacgggccttcagttggggaaatggctgtagaagcacagttgtatgaggaagcatttgcaatttacaagaagttcaacttgaatgttcaagcagtcaatgtgttgcttgataatattcgcagcattgatagagctgttgagtttgctttcagagttgaagaagacgctgtttggagtcagacggcaaaggctcaactcagggaagggcttgtaagtgatgcaatagagtcatttatacgagcagatgatactacacaatttttggatgttatccgtgctgctgaagatgccaatgtttaccatgacttggttaaatacttgttaatggtaagacagaaggcaaaagaaccaaaggttgacggcgagctcatttatgcatatgcaaaaattgacaggcttagtgacattgaagagttcattctgatgccaaatgttgctaatttgcaaactgttggggaccggttgtatgatgaagcattatacgaggctgcaaaaatcatatttgcctttatatctaactgggccaagttggctattacactggtcaaattacaacaattccaaggggcagttgatgcagctaggaaagctaacagctcaaaaacatggaaggaagtttgttttgcgtgtgttgatgcagaggagtttcgtttggcccagatatgtggactcaacattattattcaggtggatgacttggaagaggtcagtgaatattaccaaaatagaggttacttcaatgagttaatatctctcatggagagtggtttagggttagaacgagcacatatgggcatcttcaccgagctaggagttctttatgctagataccgccctgataagcttatggagcatatcaaactattctcaacccgcctcaatatcccaaaacttattagagcatgtgatgaacaacaacattggaaagaattgacctttttgtatatccaatatgatgagtttgataatgccgcaactaccatcatgaaccattcacctgaagcgtgggatcacatgcagttcaaggatgttgccgtcaaagttgctaatgttgagttgtattacaaggctgttcacttctatctggaagaacatccagacctcatcaatgatattctgaatgtccttgcacttcgtgtggaccacacacgtgttgttgacatcatgcgtaaggctggtcacctccgtcttgtgaagccatacatggttgcagttcagagcagcaacgtttctgctgttaatgaagccctgaatgagatatatgttgaggaggaagattatgatagattgcgggagtcaattgatttgcatgataatttcgatcaaataggccttgcacaaaagattgaaaagcatgagcttcttgagatgaggcgtgttgctgcttatatttacaagaaggcaggaaggtggaagcagtccattgctttatcaaagaaggacaacctttacaaagatgccatggagacagcttcacaatctggcgagcgtgaacttgccgaggagttgcttgtttatttcattgatcagggaaagaaggaatgctttgcctcatgtctatttgtttgctatgatttaatacgagcagacgttgttcttgaactagcttggatgcacaatatgattgactttgccttcccatacgtcttgcagtttatccgtgaatacactggcaaagttgatgagctagtgaaagacagaattgaagcacaaaatgaagtgaagtctaaagagaaagaagaaaaggacgtagttgcacagcagaacatgtatgctcaattgttacctcttgctttgcctgccccaccaatgcctggaatgggaggaccaggttatggaggaagctacgggcctccccctccagtgagtggaatggggatgccccaaatgcctccttttgggatgccacccatgggtagcagttactaaccagtatgcatgtatagcatgaatctgagattttatggagagcaatatagctgctgctttcaaaattttgtgtagattttctgtgcgaatcggatgcagcattcttttgtttgcttctgttagaggtggagattctagttaatttcatgttcttgtgaaggttgtaataatggtacagcaactagcaagtccttttcctttctcggtttgtagctaagccgaggtattttttgggctgctggtttgcgctagtcgataaatttctgtattccaacattttcttgtattaaaattatagtcccattataatacgaagtttactgactttaacttaacaaatttattagtgacttttaacaaaatttatcagttattaaggtagtattatcaagatatgccaaacttatgatcaagattctg

SEQ ID NO: 5201 - DNA, 5551 bp, Glycine max
cctccgattcatccccgctcaccatggccgcgaacgcccccatcatcatgcgcgaagccttaacgttggcaagtgtcggaatcaacccgcaattcatcactttcacgcacgtcaccatggaatcggacaagtacatttgcgtcagggaaaccgcgccgcagaacagcgtcgtcatgatcgacatgaccatgccaatgcagcctctccggcgccctatcaccgccgattccgcgctcatgaaccctaacaccagaattctcgcgcttaaagctcatgttccaggcagtactcaggatcatttgcaagtttttaacattgaatccaaagcgaagatgaaatcgtatcaaatgggccaacaggttgtgttttggaagtggataaccccaaagacactaggcatagtgactcagtcatctgtgtatcattggtcaattgaaggtgatggtgagccagtgaaggtgtttgaccgaacagctaatttggcgaataatcagattatcaactatcgttgtgatcctactgaaaagtggttggttttgattggaattgcccccggttcttctgatagaccacaacttgtaaaaggaaatatgcaactcttctctgtggatcagcagaggagccaggctcttgaagcacatgctgcctcatttgccacatttagggttgctggtaatgataaggattcaactcttatttgttttgcatcaaagagcatcaatgctggacaggttacgtcaaagatgcatgccattgaacttggtgcccagccaggcaagccatcattttcaaaaaagcaagcagatctcttcttccctccagactttgctgatgactttcctgtatcaatgcagatttcaaataagtatggcttgatatatgttatcacaaaacttgggcttttatttgtctatgatctagagactgccactgcagtttacagaaatcgaatcagtcccgatcctatatttttgaccacagaagcatcttcagaagggggcttttatgctataaatagacgtggccaggtgttgctcgctactgtgaatgaagcaaccattgtaccttttgttagtggccagttaaataatttggaacttgctgttagtcttgctaaaagaggaaacctccctggtgcagaagaattggttgttaagcgttttcaagaattatttgctcagaccaagtataaggaagctgcagagcttgctgcacaatcgccacaaggagtacttcgtactcctgacactgttgctaaatttcagagtgtacctgtgcaagctgggcaaacaccaccgctgttgcaatactttggaactctgttaaccatgggaaaactgaatgcttttgagtcactggaactttcacggcttgttgtaaatcagaacaaaaagaatctcttagaaaattggctagcagaggataaacttgaatgcagtgaggagctaggtgaccttgtgaagacagtggataatgaccttgcattgaaaatttatatcaaagctagagccacaccgaaagttgttgcagcttttgcagagaggagggaatttgataagatcctgatatattctaagcaggttggatacacacctgattatatgttccttcttcaaacaattttacgaactgacccccagggtgctgtaaattttgctctgatgatgtctcaaatggaaggaggatgccccattgactacaacaccataacagatctctttcttcagaggaatttgatccgtgaggcaacagcctttttgttggatgtactgaagccaaatcttcctgaacatggatatcttcaaacaaaggttctggaaattaatcttgtgacctttccaaatgttgctgatgctatattggccaatggcatgttcagtcattatgatcgcccacgtattggacaactatgtgaaaaggctggcctgttcatacgggctcttcagcattatactgagttgcctgacatcaaacgtgtcattgtgaatacacatgccattgagccacagggtttagttgagttctttggaaccctttctcgagaatgggcacttgagtgtatgaaagatcttttacttgtcaatcttaggggcaatcttcaaataattgtgcagactgctaaggaatattctgagcagttgggtgttgatgcatgcattaaactctttgaacaattcaaatcctatgaaggattatactttttcttgggtgcatacttgagctccagtgaggatcctgatattcacttcaagtacattgaggccgctgctaaaactgggcaaattaaggaggtagagcgcgttactagagaatcaaacttttatgatgcggagaagacaaagaattttcttatggaggccaagcttccagatgcacgtccattgattaatgtgtgtgatcgttttggctttgttccggatctcacccattatctttatactagcaacatgcttcgctatattgaaggttatgttcaaaaggtcaatcctggaaacgctcctctagtagtagggcagttgttagatgatgaatgccctgaagattttattaaaggtcttatactttcagttcgttctctcctgccagttgagcctttagttgaagaatgtgagaagaggaatcgtctccgcttgctcactcaattcttggagcatcttgtaagtgaaggaagccaggatgtacatgtacataatgccctgggtaaaatcattattgacagcaacaacaatcctgagcattttctcacaaccaacccatactacgattctcgcgttgtcggtaaatattgtgaaaagcgggatccgacccttgctgttgttgcttaccgaagagggcaatgtgatgatgagcttgttaatgttactaataaaaattccttgttcaaacttcaagcaagatatgttgtcgaaaggatggactccgacctctgggagaaagttcttaatcctgagaatgagtttagacgactgttgattgatcaagtggtgtctactgctttgcctgaaagcaagagtcctgatcaagtttcagctgcggtgaaagcttttatgactgctgatcttcctcacgagttgattgagcttcttgaaaagattgtactacaaaattctgcttttagtggaaacttcaatctgcaaaatttgctgatccttactgcagtcaaggcagatccttctagagttatggattacataaataggttggacaactttgacgggcctgcagtaggggaggtggctgtggaagcacaactatatgaagaggcattttctattttcaagaaatttaatttgaatgttcaggctgttaatgtcctactggataaccttcagactattgatcgtgctgtggagtttgctttccgggttgaagaagatgctgtttggagccaggtggctaaagcacaacttagagaaggcttagtgagtgatgcaattgagtcattcattcgtgcagatgattcaactcatttcttagaggttataaaggctgctgaagatgcagatgtataccatgacctggtaaagtatcttctcatggttaggcagaataccaaagagcccaaggtggacagtgagctcatctatgcttatgctaagattgaacaccttggagaaattgaagaatttatactgatgccaaatgttgccaatttaccaaatgttggagaccgcttgtatgatgaggctttgtatgaggctgccaaaattatatttgcttttatttctaactgggctaagttggcagtcacattggtgaagcttaaacagttccaaggtgctgttgatgctgccaggaaagcaaatagttcaaaaacatggaaggaagtttgtttcgcctgtgtcgatgctgaggaattccgcttagctcagatttgtggtctcaatgtcatcattcaggtggatgatttggaggaggttagcgagtactatcagaacagaggatgcttcaatgaactcatatctctaatggagagtgggttaggattggagcgtgcacatatgggtatctttactgagttgggagttctgtatgcaagatatcgtcctgagaagctaatggaacacattaagttgttctcaactcggcttaatattccaaagcttattcgagcatgtgatgaacaacagcattggaaagaacttacatacctatacatccaatatgatgagtttgataatgctgcaaccactgtaatgaatcactctccagaagcatgggaccacatgcaattcaaagatgtgatagttaaagttgcaagtgtggagctgtactataaggctgttcacttctacttcaaagagcatccagatgtaataaatgatatgctaaatgtgattgctcttcgtgtggaccatactcgtgtagtagatataatgcggaaggctggccaccttagattagttaagccgtacatggttgcagttcaaagcaacaatgtgtccgctgtcaatgaagctttgaatgaaatttatgttgaggaagaagactacgacagactccgagaatcaatagatttgcatgacaactttgatcagataggtcttgcacagaagattgagaagcatgaacttcttgagatgaggcgtgtagctgcctacatttacaagaaagcaggaagatggaagcaatccattgctttgtcaaagaaagacaatctttacaaggactgtatggaaacatgctctcaatctggtgaccgtgaactttcagaagatttgcttatctactttattgagcagggaaagaaagagtgttttgcatcatgcctctttgtctgttatgatattatacggccagatgttgctcttgagctatcttggatgaacaatatgattgattttgcttttccatatctcttacagtttattcgagagtatacaggcaaggtagatgagcttatcaaggacaaaattgaagcacaaaatgaggagaaagctaaggaaaaggaggagaaggaagtacttgctcagcagaatatgtatgcccagttgctaccgcttgctttgccagcacctcctatgcaaggaatggggggaggctatgccccttccccaccactacctatgggtggaatggggatgccaccaatgcctccttttggtatgcctccaatggatgggggctactgatctccctatttactggtgaaacttgatagtttagcatctctcattttttgctttcaaggtgactatcttagggttaaagagtttgacgtggtggcaccaagcatcagtcttctagtctgttactactttccaatgattgcggtttttttcaatgaaagttttccgagtcatgtattttgtttgttctttctttttggattgtttgatcattcttgtgagagccaagatggccaaatgatcatgcttgtatcttttcgaggcattggcttggttgcagccgtatagtttattttctctaattattatttgtttccatagctgtgaagtcataaatgttattactctgattaggacttaaaattcttgttctttcctggtatataaactttcatataatatttaaagtgatctcttactgt

SEQ ID NO: 5202 - DNA, 5700 bp, Prunus persica
cacgcagcagtccattcacaaattttgcgcgagaaaaactgcaaacaaactcgtcgaatagaccacgctcctcctcctcttctgcatttacattcccatactacttagatctgcagactctttctcttctctctctctctgcaatccaaaatcagaaggttttgctgtgccacattcttctccgcctatcgggtccctcctatagaagccccgacccaggcaccatggccgctgcgagtgcccccatgaccatgaaagagacactaacgttgcctagtattgggatcaatccccaattcattacgtttacgcatgtgactatggaatcggacaagtatatttgtgttagggaaacatcgccgcaaaatagcgtcgttatcatcgacatgaacatgcccatgcagccattgcgtcggcccattacggctgattcggctttgatgaaccccaattccagaattcttgctctaaaagctcaagttcaaggaactactcaggaccatttacaaatatttaacattgaaatgaaagcaaagatgaaatcacatcagatgcccgagcagattgtcttttggaagtggatcactccaaagatgctgggcctggtaacacagacctcagtatatcattggttaattgaaggtgattccgagcctacgaaggtctttgagcggacagctaatttggcaaataatcaaataatcaactaccgttgtgatccttctgaaaagtggttggtcttaataggaattgctcctggttcacctgagaggccacaactggtcaagggaaacatgcagcttttctctgtggaacagaaacgtagtcaggctcttgaagcacattctgcatcgtttgccacatttaaagttccagggaatgagaatccttcaattcttatttgttttgcctcaaagtcctttaatgctggacaagttacatcaaagctgcatgtaattgagcttggtgctcagccaggaaaaccatcatatacaaagaagcaagcagatctattctttcctccagactttgctgatgactttcctgtgtcaatgcagatatcagaaaagtatgggttgatatacgttatcacaaagcttgggcttctatttgtatatgacctagagacagcaactgccgtttatagaaatcgaatcagtccagatcctatatttttgacagctgaagcttcatccattgggggtttttatgcaatcaataggcgaggccaggtcttacttgccaccatcaatgaacaaacaattgtaccttttgttagtggccagttaaacaatttggggcttgcagttagtcttgcgaaaagaggaaaccttcctggtgctgaagacctggttgtccagcggttccaagaattgttttctcagacaaaatataaggaggctgcagagcttgccgcagaatctccaatgggaatactccgtactcctgatactgtcgctaaatttcagagtgttcctgtgcaagctgggcaaaccccaccattgttgcagtactttggaactttgttaactagaggaaaactcaatgcttatgaatcattggaattatcacgtttggttgtaaatcagaacaaaaagaatcttctggagaattggctggcggaggacaagctagaatgtagtgaagagcttggagatcttgtgaagacagtggacaacgaccttgctttgaaaatatacatcaaagcccgggcaactcctaaagttgttgcagcatttgctgagagaagggaatttgacaagattttgatatactcaaagcaggttgggtatacacccgattacttgttccttctgcaaacaattttgcggtcagatccccagggggctgttaattttgctctaatgatggctcaaatggaaggaggctgccctgttgactacaataccattactgatctattccttcagaggaacttgatccgtgaggcaactgcctttttgttggatgtgctgaagccgaatctacctgagcatggataccttcagtcaaaggttttggaaatcaatctcgtgacttttccaaatgttgcggatgctatattggccaatggtatgttcagtcattatgatcgtccacgcattggtcaactctgtgaaaaagctggtttgtatctgcgtgccttacagcattacactgagttgcctgatatcaaacgtgtcatcgtgaacacacatgcaattgaccctcaggctctcgttgagttctttggaactctttccgaagaatgggctcttgagtgcatgaaagatcttctactggtcaatcttaggggaaatcttcagattattgtgcagaccgccaaagagtattccgaacaactgggtgtagataaatgcataaaattattcgagcagttcaagtcctatgaggggttgtactttttcttaggctcatacttgagctccagtgaggatcctgatatccatttcaagtacattgaagcagctgcaaaaactggacagattaaggaggtggagcgtgtgacacgggaatctaatttttatgaccctgagaaggctaagaactttcttatggaagcaaagcttccagacgcacgtcctttgattaatgtctgtgatcgttttgggtttgttccagatctcacccattacctatatacaaacaatatgcttcgttacattgaaggttatgtccaaaaggtcaatccaggaaatgctcctttagttgtagggcagctattggatgatgaatgccctgaagatttcatcaaaggtcttattctttcagttcgttctcttctaccagttgagccccttgttgatgaatgcgaaaagaggaatcgtcttcgcttgctcactcaattcttggagcatctcgtgagtgagggaagccaagatgtacatgttcacaatgctctgggtaaaatcatcatagatagcggcaacaacccggagcattttctcacaacgaacccatactatgattcacgcgttgtgggtaaatattgcgaaaaacgggatcccacacttgctgttgttgcatatcgtagagggcaatgtgatgatgaacttattaatgtcacaaataaaaattccttgttcaaactccaggccagatatgttgtggagagaatggatgatgacctctgggctaaggtccttgatcctgataatgaatatagaaggcagctaatcgatcaagttgtatctactgccttgccagaaagcaagagccctgagcaagtttcagcaactgtcaaagcatttatgactgcagaccttccacatgagttgattgagcttcttgaaaagatagtgctccaaaattctgcttttagtgggaacttcaatctgcagaatctgttgattctgactgccatcaaggctgatccatccagagtcatggattatattaacagattagacaactttgatggacctgcagttggattaatggccgtagaagctcaattgtttgaggaagcattcgcaatcttcaagaaattcaatgcgaatgttgacgctgtgaatgtcctgttggataacattcagagcattgaccgagctgtagagtttgcattccgagttgaagaagatgctgtttggagccaggtggccaaggcccaactccgagaaggactagtgagtgatgcaattgagtcattcatccgtgcagatgatgccactcagtttttggatgtcatacgtgctgctgaggatgcaaatgtatatcatgacttggtaaggtaccttctgatggttaggcagaagaccaaggagcccaaggtcgacagtgaacttatttatgcatatgctaagattgatcggcttggtgaaattgaagagttcattcttatgccaaatgttgccaatctccaaaatgttggggatcgcttgtttgatgaagccctatatgaagcggccaaaatcatatttgcattcatttctaactgggctaagctggcatgcactcttgtgaagctaaatcagtttcaaggtgctgttgatgctgctcgaaaagctaacagctcaaagacgtggaagtttgtttgcttcgcatgcgttgatgctgaggagtaccgactagctcagatttgtggactcaacatcatcatccaggtggatgatttggaagaggtcagtgaatattaccagaacaggggatgctttaatgagctcattagtctcatggagagtggactgggattggaacgtgcacatatgggcatttttacagagttaggagttctatatgcaagataccgtcctgagaagcttatggagcacattaaactgttttctacccgtctcaatattcccaagctaatacgagcttgtgatgaacaacagcactggaaagaattaacgtatttatatatccaatatgatgagttcgacaatgctgcaaccaccataatgaatcactccccggaagcatgggaccacatgcaattcaaggatgtgatagtcaaagttgcgagtgttgaactctactacagggctgtgcacttctacttacaagaacatcctgatcttatcaatgatgttcttaatgtgattgcacttcgtgttgaccacacccgagtggtggatataatgagaaaggctggtcacatccgtcttgtaaagccgtacatggttgcagttcagagcagcaatgtaactgctgtaaatgaagctctaaacgaaatatacatagaggaggaagactatgacagactccgtgaatcaatagatttgcacgacagctttgatcagataggtcttgctcaaaagcttgagaaacacgagcttcttgagatgagacgtgttgctgcatacatttataagaaagctggaagatggaagcaatccattgcattgtcaaagaaagacaatcactacaaagattgcatggagacatgctcacagtctggtgatcatgagctctctgaggaactgcttatctatttcattgagcagggaaagaaagagtgctttgcgtcatgcctctttgtttgttatgatttaatccggccagatgttgctcttgagcttgcatggatgaacaatataattgattttgccctcccatacctcctgcagtttattcgagagtacacaggtaaggtggatgaacttgttaaggacaaaattgaagctcaaaacgaggtgaaagccaaagagaaagaggagaaggaattggtcgctcagcagaatatgtatgctcaattgctgcctgccttgcctgcaccaccaggaatgggtggaggctatgctccgccaatgccaccaatgggtggtatgggaatgcctccaatgccaccttttggaatgccgcaaatgggcccgtcctactgatctttgaggcatttgaggttttatgagtgttctaacagcttccacagggcgaaagctagaatgtcatggactctcctgttatgctgaatctgattccatttcaaagttcacttctgtttttggaaatgaagggttgagccaagtattctcccactttcttgccaccacaacatcttcgtatggaggtttatggtcatctgttttagaaaaattttaaattcaaggtatcaattgtttttgcttggttgccaagtctgagctgagtaggtgttggtttagtaatctttgtgagacctaggatggcaaccgagcttgcacttggtcatggctgtagttgtggccatgctgctgctacatgtataggtaattttttgaa

SEQ ID NO: 5203 - DNA, 5683 bp, Zostera marina
aggaataggccagtcctcccccatctctctctactcgttatatttaatttcttctacctggatcccccatttcacctctcctttgccgctgtacactatacactacccaccgccatcgaggaaggcgaagagaacaggcgctatctcttcttcgtcttcttccttctgcctctgtaaccctagttctgggcatcatggcggcagcaaacgcccccatcacgatgaaggaagctttgactcttacgagtgttggcataaatccacaattcattacgtttactcatgtcacaatggaatcggataagtatatctgtgtaagggagacgtcaccacagaacagtgttgtaataattgacatgagcatgccaaatcagccattgaggaggccaatcacagcggactcggctttgatgaatcctaactccagaattcttgcactgaaagctcaactccctggaaccacccaggatcaccttcaaatattcaacattgagcagaaggctaaattaaaatcccatcagatgcctgagcaggttttgttttggaaatggatcactccgaagatgttagggttagtcacacaaacctcagtgtaccattggtcaattgaaggtgattctgagcctgtaaaggtgtttgaaagaacagctaatctagcgaataatcagataattaactaccgatgcgatccctctgaaaagtggctagttttaattggaattacacctgggacggctgagaggccgcaactggttaagggaaatatgcaacttttctccgttgagcaacagcgcagtcaagcacttgaagcccatgctgcatcttttgccacattcaaggttcctggaaatgaaaatccttccactcttatttctttgcttcaaagacaacgaatgcagggcagattacttcaaagttgcacgtaattgaacttggtgcccaaccaggtaaacctgggttttcaaagaaacaagctgatctttttttccctccagactttgctgatgacttccctgttgcaatgcagatatcaagcaaatacagcttgatatatgtggtcacaaaacttggacttttgtttgtttatgacctagagacagcaagtgctgtttacaggaatcgaattagtccagatcctatcttcttgacatctgaagcaacatcagctggtggcttttatgcagtcaatagaaaaggtcaagttcttcttgcaacagttaatgaggcaacaataattccttttgttagtggccagttgaacaatttggaacttgctgtcaatcttgctaaaagagggaatcttcctggagcagagaatttggttgtgcaacgttttcaggagttgttttctcagactaagtataaagaggctgcagaacttgctgcagaatctcctcagggtattcttaggactcaagagaccgttgcaaaatttcagagtgttccggtacaatctgggcaaaccccacctttgctacaatattttggcacattgttaactaaaggaaagctcaatgcttttgaatccctggaactctctcgcctggtcgtaaatcaaaataaaaaaaatttattggagaactggttagctgaagataaacttgattgcagtgaagaacttggggatcttgtgaaaactgttgacaatgatcttgctcttaaaatttatataaaagcaagagccaccccgaaagttgttgctgcttttgctgaaagaagggagtttgacaagattcttatttactcaaaacaagtaggatacacacccgactatctctttcttttacaaacaattctacgagcagatccccagggagcggttaattttgctttaatgatgtcacaaatggaaggtggatgtccagttgactacaacaccattacggatctcttccttcagagaaacttgatcagagaagctacagtcttttttgttggatgttttgaaaccaaatttaccggaacatgctttcctccagtcaaaggtgttggagatcaatcttgttacatatcccaatgttgctgatgctatattagctaatggaatgtttagtcactatgaccgacctcgaatagcccagctctgtgaaaaggctggcttgtatgcacgagctctccatcattattctgagttacctgatattaagcgtgtcattgtgaacacacatgccattgagcctcaggctcttgttgaattttttgggacactttctacagaatgggcccttgagtgtatgaaagatctcttacttgttaatttaagaggaaatcttcagataattgttcagactgccaaagaatattctgagcaattaggtatggagtcatgtatgaaactctttgagcagttcaaatcttatgagggcctctactttttcttgggatcatttttgagttccagtgaagatccagatattcattttaaatacattgaagcagcagcaaaaactgggcaagtaaaagaagttgagcgtgtgactagagaatctaatttctatgatcctgagaaaacaaaaaactttctgatggaggctaagcttccagatgcacgacccttgatcaatgtctgtgatcggtttggatttgttgctgatcttacacactatctgtacaccagtaacatgcttcgatatattgagggttatgttcaaaaggtgaacccaagcaatgctcctgtagttgtaggtcagcttcttgatgatgaatgtcctgaggatttcatcaaaggccttatcctttctatccggtctcttcttccagttgaacccttggtagatgaatgtgagaaaaggaatcgtcttcggttgctgacacaatttttggagcatcttgttagtgaagggagccaagatgttcatgttcacaatgctttgggtaaaatcataattgaaagcaacaataatccagagcattttcttactaccaatccttactacgattcacgtgttgttggtaaattttgtgagaaacgggatcccactttggctgttgttgcttataggcgtggtcaatgtgatgatgagcttattagtgtcacaaataagaactcgttgttcaaacttcaggcgaggtacgttgttgagagaatggaatttgatttgtgggacaaagttcttctccctgaaaatgaatataggagacagtttattgatcaggttgtatctactgcattgcctgaaagcaaaagtccagagcaggtctctgcagctgttaaagcttttatgactgcagatcttccacatgaactgattgagcttcttgagaagattgtgttacagaactctgccttcagtggaaatttcaatcttcaaaacttattgatcttaactgctattaaagctgatgcatcacgagtcatggattatattaacagattagataattttgacggaccagcagtgggagaagttgctgtagaagcacaactgtatgaggaaggttttgcaatatttaaaaagtttaatttgaatgtacaagctgttgatgtgctattggataaaatcgaaagcatagaacgggctgtggagtttgcatatcgtgttgaggaggatgctgtatggagtcaggttgccaaggctcaacttcgtgagggattggttagtgatgcaattgagtcattcattcgggctgatgataccactcagttcttagatgttattcgtgcttctgaggatgcaaatgtataccacgaccttgtcaaataccttcttatggtcaggcaaaagaccaaagagtcaagggttgatggtgagcttatttatgcatatgcaaaaatcgaccggttggctgatattgaggaatttatcataatgccaaatgttgcaaatctccaaaatgttggcgatcgtttatatgatgagcaattgtatgaggctgcaaaaatcatatttgcattcatttctaactgggctaagcttgctgtcacactcgtcaaactaatgcaattccagggagctgtggatgcagctcgtaaagctaatagttcaaagacatggaaggaagtttgttttgcctgtattgatgctgaggagttccgtttggctcaaatttgtgggcttaacataattgtacaggtcgatgacttggaagaggttagtgattactaccaagacagaggatgctttaatgaacttatttctctcatggaaagtggacttgggttggagcgggcacatatgggtattttcacagaattgggtgtgttgtacgcaagatatcgcccagagaaactcatggagcacattaaattatttgcaactcgtctcaacattcctaaactcataagagcttgtgatcagcagcaacattggaaagagcttacttatctgtatattcaatatgacgaatttgataatgctgccaccacaataatgaaccattctccagatgcatgggatcacatgcaatttaaagatgtttgtgtaaaaattgcgaatgtggatctttactataaggcagttcacttctatctagaagagcatcctgacttgataaatgatcttctcaatgtgcttgctcttcgtgttgaccatactcgtgttgtagacataatgcgaaaggctggttatttgcatattgtgaaaccttacatggttgcagtccagagcaacaatgtgtctgcagtgaatgaggcattaaatggaatatatgtcgaggaagaagattacgaaagactacgtgaatcaattgatatgcatgacaactttgatcagataggtcttgcgcagaagattgaaaaacatgaacttcttgaaatgagacgtgtagctgcatatatatataaaaaggcaggtcgatggaagcagtcgattgctctgtctaagaaagatagcatttacaaggatgccatggagacagcctcacaatctggtgaacgtgagcttgctgaagagttgcttgtttatttcattgataagggaaagaaagaatgttttgcttcgtgcctattcatttgctatgatttgatacgtccagatgtggcacttgaacttgcttggatgaataatatggttgattttgcattcccattcatgttgcagttcattcgggagtcaacaagcaaagtggatgaattagtgaaggataagattgaggctcaaaaagaagtcaaagctaaagatagtgaagagaaggaaatggtcgcacagcagaacatgtacgcgcaattgttacctcttgcattgccggctcctcctggtatgggtggagctgggatgagtggttcttttgggcaaccacccccaatgggttcgctagggatgcctcctatgccaccttatggtatgcctccaatgggaagttactgagtattttttgtgttgttattcgaggattcgtcgttatataaatggagtatacactggtttgaagtaacagacccaacaatgaataagcctggttgtcgattaatgtagattttagtcttgctctctactctttttataacaggtgatttgttttttagcccctctccacaatgagtttttagcccctctagcaatttcaagtatgcttctgttttaaatctgcactttgatttatcctctcaattgtattttgttgttgcgatgtatttttttctaatttgagaaatcaaaactattgatacaatattggttatatggattgattgtttaaccagttcatgtgctcagttggaattggctcttctttgatagttaag

SEQ ID NO: 5204 - DNA, 6033 bp, Brassica rapa
ataagataataaaacgacatcgtaactcattactcttttattagactcagccaaaaccttccttcacagctagagtctcctcttcacttcatacttctcatctagccacttctaactcttctaacggtcctctgcttcctttgcacataagccaaaggcacagctagcttatcacctagcatagggtaccaacatgtcaatatcactgtctgttttgtgacaaaacccggcccatttaccagctcggatcaaacccgacccgacccgttaatttgcacgtcgtctccttttgttctctctcatttatattctacgagtgactccgatcggatcgctgttcttcatcacttttctcgttcactcgcctcagatctggcagcgatctcaaatcttctccagcttctcccgcatcgctcttctctctcttggccgttgacgatcccgtcccggccgttggatctgattctctcgctgcgatctgaggtcaaacatggcggcagcaaacgccccaatcacgatgaaggaggtcctaacgctaccgagcgttgggatcaatcagcaattcatcacgtttacaaatgttactatggagtctgacaagtacatatgtgtacgagagactgcaccgcagaacagcgttgtgattatagatatgaatatgccgatgcagcctctgaggaggcctatcactgcagattctgctcttatgaacccaaactctaggatccttgccttgaaagctcaagttccaggaactactcaggatcatctacagatatttaacatcgaagcgaaagcaaagttgaagtctcatcagatgcctgagcaggttgctttttggaaatggattacaccaaagatgttgggcctggtcacacaaacttctgtgtatcattggtcgattgaaggtgattctgagccagttaagatgtttgatagaacggccaatttggcaaacaatcaaattattaactacaagtgctctcctaatgagaagtggttggtgttgattggaattgctcctggctctcctgagagaccacagttggtaaaagggaatatgcagcttttctctgtggatcaacagcggagccaggcccttgaagcacatggtgcttcatttgcccagtttaaggtccctgggaatgagaatccttctattcttatatcctttgcaagcaaaagctttaatgctggacagataacatcaaaattgcatgtcattgagcttggtgcccaaccaggaaaaccatcatttacaaagaagcaggcagatctctttttccccccagattttgctgatgattttcctgtagccatgcaggtctctcacaaatttaacttgatatatgtcatcaccaagcttggcctgttgtttgtatacgatttggagacggcttctgctatctacagaaataggataagtccagacccaattttcttaacttccgaagcgtcctcagttgggggtttctatgccattaataggcgaggacaagttcttttggctacagtgaacgaggctacgataatacctttcattagcggtcaattgaacaatttggaacttgctgtcaatctggctaaaagaggaaatctccctggtgcagaaaacctggttgttcaacggttccaagagttatttgctcaaacaaaatacaaggaggctgctgagcttgctgctgaatctcctcaggggattccacggacacctgatacggtggctaaattccagagtgttcctgtacaagcagggcaaactcctccattgttgcagtattttggggcccttttgactagagggaagatcaattcatatgagtctttagtactatctcggcttgttgtgaatcaaaacaagaagagcctcttggaaaactggttggcagaggataagttagaatgcagtgaagaacttggagaccttgtcaagactgtggataatgaccttgctctgaaaatatatatcaaagctcgagctactccaaaagttgttgctgcttttgcagagcgaagggagtttgacaaaatactgatttactcaaagcaggttgggtacacacctgattacatgtttcttctgcaaaccatactccgttcggatccccagggggcagtaaattttgctttaatgatgtcgcaaatggaagggggttgtccagttgactacaacaccatcactgatcttttccttcagagaaatctgatccgtgaagcaactgctttccttctcgatgttctgaagccaaatttacctgagcatgcttttctgcaaactaaggttctggagatcaatttggtaacctttccaaatgtggctggtgcaattttagcaaatgggatgttcagccactatgacctccctcgtgttgctcagctttgtgaaaaggctggactttatatccaatctttaaagcattactcagagttacctgatataaaacgtgtgattgtgaacacacatgctattgagccacaggctcttgttgagtttttcggtactctttccagcgaatgggctatggagtgcatgaaggatcttctgctggtcaacctgagaggcaaccttcagataatcgttcaggcttgcaaggagtactgtgagcaacttggtgtcgatcaatgcattaaactctttgagcagttcaagtcgtacgaagggctatactttttcctaggttcatatttgagtatgagtgaggatcctgagattcacttcaagtacattgaagcagctgcgaagactggtcagataaaagaggttgagcgtgtgactagagagtctagacttttatgatgctgaaaagacgaaaaactttttgatggaagctaagcttcctgatgcccgacctttgataaatgtctgcgaccgtttcggctttgtgcctgatcttactcattacctgtacacaaacaacatgcttcgttacattgaaggttacgttcagaaggtgaatcctgggaatgctcccttagttgtggggcagttgcttgatgacgaatgccctgaagattttataaaaggcctcattctttctgttcgttcattgcttcctgttgaacccctcgttgaggaatgcgagaagagaaatcgactccgtctcctcactcagttcttggagcatctagttagtgagggaagccaagatgtgcatgttcataatgctttgggtaaaattatcatagacagtaacaacaaccctgaacatttcctgaccaccaacccttactacgactctaaggttgtgggcaagtactgtgaaaaacgtgatcccaccctggctgttgtggcatacagaaggggacaatgtgatgaggaactcatcaatgtcaccaacaagaactctttgttcaagttacaagccaggtatgtagtggagaggatggatggtgacctttgggataaggttcttgtggaagaaaacgaatatagaagacaacttattgaccaagttgtgtctactgctttacccgaaagcaagagcccggagcaagtttctgcagctgttaaagcattcatgactgctgatctgccgcatgagcttatcgagcttcttgaaaagattgtgcttcaaaattctgccttcagtggaaacttcaatctgcaaaatctgttaatattgacagctatcaaggcggatccgtctagagttatggattacatcaacaggctagataattttgatggtccggctgttggagaagtggcggttgatgcccaattgtatgaggaagcatttgccattttcaagaagtttaacctaaatgtccaggctgtcaacgtattgttggatcacgtcggaagcattgagcgtgccgttgagtttgctttccgggtcgaagaagattctgtttggactcaagtcgccaaggctcaactcagggatggactagtcagtgacgcaatcgagtccttcatccgagctgatgatgccactcatttcctggaggtcatccgcgcctgtgaagatactgatgtttatgatgacttggtcagataccttcttatggttagacagaaggtgaaggaacccaaggttgatagtgagctcatctatgcttatgcaaagatcgaaaggttgggtgagatcgaagaatttattctgatgccgaacgttgctaacctaccaaatgtgggtgatcgcctgtatgacgaagctctgtacgaggctgcaaaaatcatttatgcgttcacatcgaactgggccaagttagccgtcacacttgtgaagttgcagcagttccaaagtgctgttgatgctgcaaggaaagcaaacagtgcaaagacatggaaggaagtttgcttcgcttgtgttgatgctgaagaattccgcctggctcaaatatgtggacttaacgttatcatacaggtggacgacctggaagaagtcagcgagtactaccagaacagaggatgcttcagtgaattaatctcactgatggagagtggacttggtctggaacgggctcacatgggaatcttcaccgagttgggtgtactgtacgccagatatcgttacgagaagcttatggaacacatcaagttgttctcgactcgcctcaatattcccaagcttatacgggcctgtgatgagcaacagcattggcaagaacttacctatctttacattcaatacgatgagtttgataacgctgcaaccactgtcatgaaccattctcctgaagcatgggagcacatgcaattcaaagacattgtcgccaaggttgcgaatgtggagctttactacaaggccgttcacttctacttgcaagagcaccctgatataatcaacgatcttctcaatgtgcttgctctgcggttagaccacacacgtgtcgttgatattatgcgcaaggctggtcagttgcgacttattaagccctacatggttgcagttcagagcaacaatgtgtctgctgtaaatgaagctctgaatgagatatacgtagaagaagaagactatgacaggttgcgcgagtctactgatttgcatgacagttttgaccagataggcctcgctcagaagattgagaaacacgagcttgtggaaatgagacgtgtggctgcgtatatctacaagaaagctggtagatggaagcaatcaattgcattgtcgaagaaagataacatgtacaaggactgtatggaaactgcttcacaatccggcgaccacgaccttgccgaacaacttctagtatacttcattgaacaggggaaaaaggaatgctttgctacatgtctctttgtgtgttatgacttaatccggccagatgttgctctagaacttgcttggatcaacaacatgattgactttgccttcccgtatctcctccagtttatccgagaatactctggcaaagtggatgaactgatcaaggacaagctagaggctcagaaagaagtgaaggccaaagagcaggaagagaaggatgtcatgtcccaacagaacatgtacgctcaattattgccactggctctacctgcaccaccgatgccgggaatgggaggaggtccagggatgggaggcggttatggtccgccaccaccaatgggaggaatgccgggaatgccgggaatgcctccgatgccaccgtatggaatgccaccgatgggcggctactaagactatcagaaacaaaagctaaacgttcaagtaatcagttgcgcaatctctaccacggtggtattcgtcagaatgtttccttctttgtttgattttataggtatgtgtggataataatctcgtacttttgtttgtattattctttggggggggggggggggtgtggggggagtcgtagatgagtcatttttggttaaaaaacattttactacatttctttggaggggagagaggtgactcctatagtctttatcattttactttgaccttctcgcatgttggttgttctttctttcagcttattatttccacttataatttcctgtcgtttaataatttgaagaaaatgacgagaactaataaatatatcagttacaaagatagaggtatacaaatgcaagagtcgaga

SEQ ID NO: 5205 - DNA, 5596 bp, Phaseolus coccineus
cttggatccacgcccgccatggccgcgaacgcccccatcgccatgcgcgaagccttaacgttgggaagcgtcggcatcaacccgcagtttatcaccttcacgcacgtcaccatggagtcggacaagtacatttgcgtcagggaaaccgcgccgcagaacagcgtcgtcatgatcgacatggccatgcccatgcaaccgctccgacgcccaatcaccgctgattccgctctcatgaaccctaacgccagaattctcgcgcttaaagctcaagttccgggcactactcaggatcatttgcaagtgtttaacattgaaacgaaagcgaagatgaaatcgtatcaaatgagccaacaggttgtgttttggaagtggataactccaaagacgctaggcgtagtgactcagtcatccccggtgaaggtgtttgaccggacagctaatttggcgaataatcagattatcaattaccgttgtgatcctacggaaaagtggttggttttgattggaattgcccctggttcttctgagagaccacaacttgtgaaaggaaatatgcaactcttctctgtggatcaacagcggagccaggctcttgaagcacatgctgcatcatttgccacatttagagtacctggcaatgataaggattcaactcttatttgttttgcatccaagagcatgaatgctgggcaggttgcatcaaagatgcatgtcattgaacttggcgcccagccaggcaagccatctttttcaaaaaaacaagcagatctcttcttccctccagactttgctgatgacttccctgtatcaatgcagatttcaaataagtatggtttgatatatgttatcacaaaacttggtcttttatttgtctatgatctcgagactgccactgcagtttatagaaatcgaatcagccccgatccaatatttttgacagcagaagcctcaacagcagggggcttttatgctataaatagacgtggccaggtgttgcttgctactgtgaatgaagcaaccatcgtaccttttgttagtggccagttaaataatttggaacttgctgttagtcttgctaaaagaggaaacctccctggtgcagaagaattggttgttaagcgttttcaagaattatttgctcagaccaaatataaagaagctgcagagcttgctgcacaatcaccacaaggagtacttcgaactcctgatactgttgctaaatttcagagtgtacctgtacaagctgggcaaacgccaccgctgttgcaatactttggaactctgttaaccatgggaaaactcaatacttttgagtcactggaactgtcacgacttgttgtaaatcagaacaaaaagaatcttttggaaaattggctggcagaggataaacttgaatgcagtgaggagcttggtgaccttgtgaagacagtggataatgatcttgctttgaaaatttatatcaaagctagagcaacaccgaaagttgttgcagcttttgcagagaggagggaatttgacaagatcctgatatattcaaagcaggttggatacacacctgattatatgttccttcttcaaacaattttacgaacagacccccagggtgctgtaaattttgctctgatgatgtctcaaatggaaggaggatgcccaattgactacaacacaatcactgatctatttcttcagaggaatttaatccgtgaggcaacggcctttttgttggatgtgctgaagccaaaccttcctgaacatggatatcttcaaacaaaggttttggaaattaatctggtaacctttccaaatgtcgctgatgctatattggccaatggcatgttcagtcattatgatcgcccacgtattggacaactatgtgaaaaggctggccttttcattcgggctcttcagcattattctgagttgccagacatcaaacgtgtcattgtgaatacacatgccattgagccacaggcattagttgagttttttggtaccctttctcgagaatgggcactagagtgtatgaaagatcttttacttgtcaatcttaggggcaatcttcaaataattgttcagactgctaaggaatattctgaacagctgggtgttgaggcatgcattaaactatttgagcagttcaaatcctatgagggactatactttttcttgggtgcatacttgagctctagtgaggatcctgacattcacttcaagtacattgaggctgctgctaaaactggacaaattaaggaggttgagcgtgtgaccagggaatcaaacttttatgatgctgagaagacaaagaattttcttatggaggccaagcttcctgatgcacgaccattgattaatgtctgtgatcgttttggatttgttccagatctcacccattatctttatactagcaacatgcttcgatatattgaaggttatgttcaaaaggtcaatcctggaaatgctcctctagttgttggacagttgttagatgatgaatgccctgaagattttattaaaggtcttatactttcagttcgttctcttctgccagttgagcctttagttgaagaatgtgagaagaggaatcgtctccgcttgcttactcaattcttggagcatcttgtaagtgaaggaagccaggatgtgcatgtacataatgctctgggtaaaatcattattgacagcaacaacaatcctgagcattttctcacaaccaatccatattacgattctcgtgttgttggtaaatattgtgaaaagcgggatcctacccttgctgttgttgcttaccggagagggcaatgtgatgatgagcttgttaatgttactaataaaaactccttgttcaaactccaagctagatatgttgttgaaaggatggactctgacctctgggagaaagttcttaatcctgagaatgagtttagaagacagttgattgatcaagtggtgtccactgctttgcctgaaagcaagagtccagagcaagtttctgctgcggtgaaagcttttatgactgccgatcttccacatgagttgattgagcttcttgaaaagattgtgctacaaaattctgcatttagtggaaattttaatctgcaaaatttgctgatccttactgcaatcaaggcagatccttcaagagttatggattacattaataggttggacaactttgatggacctgcagtaggggaggtagctgtggaagcacaactatatgaagaggcatttgctattttcaagaaatttaatttgaatgttcaagctgttaatgtcttgctggataacctccaaactattgatcgtgctgtggagtttgcttttcgggttgaggaagatgctgtttggagccaggtggctaaagcccaacttagagaaggcttagtgagtgatgcaattgagtccttcattcgtgcagacgattcaactcatttcttagaggttattaaggcttctgaagatgcagatgtataccatgacctggtgaagtatcttctcatggttaggcagaagaccaaagagcccaaggtggacagtgagctcatttatgcttatgctaagattgaccgtcttggagaaattgaagagtttatactgatgccaaatgttgccaatttaccaaatgttggagaccgcttgtatgatgagacattgtatgaggctgcaaaaattatatttgcttttatttctaactgggctaagttggcagtcacattggtgaagcttaaacagttccaaggagctgttgatgctgccaggaaagcaaacagttcaaaaacatggaaggaagtctgttttgcgtgtgttgatgctgaggaattccgcttagctcagatttgtggtctcaatgtcatcattcaggtggatgatttggaggaggttagcgagttttatcagaacagaggatgcttcaacgaactcatatctttaatggaaagtgggttaggattggagcgtgcacatatgggtatctttactgagttgggagttctatatgcaagatatcgagaggagaagctaatggaacacattaagttattctcaactcggcttaacattccaaagcttattcgggcatgtgatgaacagcagcattggaaagaactcacttacctattcatccaatatgatgagtttgataatgctgcaaccactgtcatgaatcactctccagaagcatgggaccacatgcaattcaaagatgttatagttaaagttgcaagtgtagagctctactataaggctgttcacttctacttacaagagcatccagatgtaataaatgatatgttaaatgtgattgctcttcgtgtggaccatactcgtgtagtagatatcatgcggaaggctggccaccttagattagttaagccgtacatggttgcagttcaaagcaacaatgtatctgctgtcaatgaagctctgaatgaaatttatgttgaggaagaggactatgacagacttcgagaatcaatagatctgcatgacaactttgatcagataggtcttgcacagaagattgagaagcatgaacttcttgagatgaggcgtgttgctgcatacatttacaagaaagcaggaagatggaagctatccattgctctgtcaaagaaagacaatctttacaaggactgtatggaaacatgctctcagtctggtgatcgtgaactctcagaagatttgcttatctactttattgagaagggaaagaaagagtgttttgcatcatgcctctttgtctgttatgatattatccggccagatgttgctcttgagctagcttggatgaacaacatgattgattttgctttcccatatctcttacagtttattagagagtatactagcaagatggacgagcttatcaaggacaaaattgaagcacaaaacgaggagaaagctaaggaaaaggaggagaagaatgtgattgctcagcagaatatgtatgcccagttgctaccgcttgctttgccggcacctccaatgccaggaatgggtggaggttatgccccttccccacctccaatgtctggaatgggtggaggctatgccccttccccacctccaccacctatgggtggaatggggatgccaccaatgcctccttttggcatgcctccaatggggggcggctactaataccccaatccacatcaatggagagaattttgcgattttttttactggtgaagctagatagtttagaatatctcattttttgcattcaaggtaactatttcttagggttaaagaatttcacgtggtggcaccaagcatcatccttcaagcctagcctagcctgatactacttcccaatgattgcggctttctacaatgaaacttttctgcactacttatttcttttccgattgtgtccttttgaggcattggcttgttgcgacctgtatagtttattttctctaattatttgttttcgtagttgtgaagtcataaatgtttattgattaggacttaaagttcttgttcttagtatatagactttcatataatattttaaatgatctcttactgtatgttggtttcattctttcaatgatataaattagcccataattttttaattcgattccataaa

SEQ ID NO: 5206 - DNA, 5627 bp, Abies balsamea
taaagccttcgtgttctacctctccaccatcaacccttgcgagggttgcgatttcagagcaccgttcggctcccagatcttatacttcaactacggcctgatcggtgccgggttcgattccggtattggcttcagcgtcaccgttttctgcgaatattttccagcttggcattgcagggtttggttgaatatcgacgggtttttggcagatcgactgttctaggttttgtagaggaattgtctgcgtttgattagaatcagggtgttttctcttttcgttcgaggaattgcagtttgagatcgaggttatctggttccggcgccatggctgcagctagcgccccaatcactatgaaggaggtcctgacgttgccaagcctcgggattaatccacagtttatcacgtttactcatgtcactatggagtcagacaagtacatctgtgtacgggaaacttctcctgcgaacagtgttgttatcattgatatgaacatgcctatgcagccactgagaaggcctatcacagcagattcagctttaatgaatcctaacagtagaattctcgctttaaaagctcaaatacctggcagtacccaggatcacttacaaatttttaatattgagatgaaggcaaagatgaagtcctatcaaatgcctgaacaggttgtcttttggaagtggataacaccaaagatgttgggacttgttacacagaattcagtctatcactggtccttggaaggggatgcggagcctgcaagaatgtttgatcgaactggcaatttaactggcaaccagataataaactatcgatgtgatccatctgagaaatggcttgttttgattggaattgctccaggggcacctgagaggcctcaacttgttaaggggaacatgcagctgttttctgtagatcagcagcgcagtcaagctttagaagctcatgctgcagcatttgcatcttttaaggttcctggcaacgaaaatccttccatccttatttcatttgcttcgaagaccatggctgcagggcagcttacttcaaagctacatgtgattgagcttggtgcacagccaggtaaaccaggtttttcgaagaaacaggcagatcttttttttccgccagattttgcagatgattttcctgtggcaatgcagatatcaaacaagtatagtctgatttatgtcatcacaaagctgggacttctatttgtctatgatctggatactgctacagcagtttacaggaatcgtatcagtccagatcccattttcttaacaacagaagcttcgtcacttggtggattctatgctatcaatcgccgaggccaagtgttgcttgcaactgtcaatgaagcaactattgtgccttttgttagtggacagctgaataatctagagcttgctgtgaatcttgctaaaagaggaaaccttcctggggctgaaaatttggttgtccagcgtttccaggagttgtttactcaaatgaagtacaaagaagctgcagaactagctgccgagtcaccccaaggcatcctccgcactccagatactgtagcaaaattccagagtgttccagtacagcctgggcagacaccaccccttctccagtattttgggactcttctgacaaggggaaagttgaatgcttttgagtctttggaactttcacgattagttgtgaatcagaacaagaaaaatcttttggagaactggctcgctgaggataagctggagtgcagtgaggaactgggtgatcttgtgaagactgtggacaatgaccttgctttaaaaatttatataaaagcaagggctacccccaaggtagttgcagctttcgccgagagaagagaatttgacaaaatacttatttactccaaacaggttggatacactccagattatttattcctcctccagactattttgcgctctgatccacagggtgctgtaaactttgcactaatgatgtctcaaatggaaggtggttgtccacttgactacaatacaattacagatttgttccttcagcgtaacatgatccgtgaagcaacgtcctttttattggatgttttgaagcctaacttgccagaacatgggtaccttcaaaccaaggttcttgagatcaacttggtcactttcccgaatgttgctgatgcaatcctggcaaacggaatgtttagtcactatgaccgtccccgtattgcacaattatgtgagaaagctggcttatatatgcgtgcacttcagcactatacagagttgcctgatatcaaacgtgttattgtcaacactcatgctattgagcctcaggcactggttgagttttttggtactctttcaagagagtgggcattggagtgcatgaaagacctgctcctggttaacctaaggggaaacctccagataattgtacaggctgcaaaagagtattctgatcaactgggtgcggactcatgtatcaaactctttgagcagttcaagtcatatgaagggctttatttctttttaggttcatatttggtctccagtgaggaccccgagattcactttaaatacattgaagcagcagccaaaactggtcaaatcaaagaggtggagcgtgtaaccagagagtcaaacttctatgatgcggagaagacaaagaattttctgatggaagcgaggcttccggatgcccgtcccctaataaatgtttgcgatcgatttggttttgtaccagatcttactcactacttatattcaaacaacatgctgcggtacattgaaggctatgtccagaaagttaatccaagcaatgctcctttagttgttggccaactacttgatgatgactgtccagaggatttcattaaaggacttattctgtcagttcgttctctccttcctgttgaacctcttgttgaagaatgtgagaaaaggaatcggcttcgactgctgacccaattcttagaacatcttgtaagtgaaggaagtcaagatgtacatgttcacaatgccctgggtaaaatcattattgatacaaataacaatccagaacactttcttacaacaaatccctactatgattcacgtgtggtgggtaaatactgtgagaaaagggatccaacactggcagttgttgcatataggcggggacaatgtgacgatgaacttattgatgttaccaataaaaattctctgttcaaactccaggccaggtatgttgttgagcggatggagcctgatctctgggaaaaagttcttactcctgaaaatccattccgaaggcaactcattgaccaggttgtatcgactgctttaccagagagcaagaatccagatcaggtctctgcaactgtgaaagcattcatgactgctgatctcccacatgagttgattgagcttctagagaagattgtgctacaaaattctgcatttagtggaaaccccaatctgcagaatcttctcattcttacagccattaaggctgacaagtcgcgcgtaatggattatatcaacagacttgataactttgatggtccggctgttggagagattgctgttggagcagagttgtatgaggaagcttttgccattttcaaaaaattcaacttaaatgtgcaggcagtaaatgtgcttttagataacatccgaagcattgaacgtgctgttgagtttgcatcacgtgttgaggaggatgcagtttggagtcaagttgcaaaggcccaactcagggatgggttggtcagtgatgctattgaatcatttattcgtgcggatgatgctacacagttccttgatgtgattagggcagctgagcaagcgagtgtttatcatgacttagtcaaataccttctgatggtacggaaaaaggttaaagagccaaaggttgatagcgagcttatctatgcatatgctaagattgacagacttggtgaaattgaagaattcatactgtcacctaatgtagctaatctccaaagtgtgggagaccgtctatttgatgaagctctctatgaggctgcaaagataatttttgcttttatttccaactgggcaaaacttgctagcactcttgtgaagctaacacagttccaaggagcagttgatgctgctcgcaaggcaaacagttcaaagacgtggaaggaagtttgctttgcctgtgttgatgctgaggagtttagattggctcaaatatgtgggctgaacatcattgtgcaggtggatgacttggaagaggtcagtgattattatcagaataggggccgctttgatgaactaatttctctaatggaaagtggcttggggttggagcgtgcacatatgggtatctttacagagcttggtatcctgtatgctagatatcgtccagacaagcttatggagcatattaagttgttctcaacacgactcaacattcccaagctcatccgtgtttgcgatgagcagcagcactggaaggagcttacatatctatacattcaatatgatgagtatgacaatgctgcagcaacaatcatgaaccattctccagaggcatgggatcacatgcaattcaaagatgttgtagtcaaggtggccaatgtcgagttatactacaaggcagttcacttttatttgcaagaacatccagaccttatcaatgaccttttgaatgtcctctctcttagggtggatcatacacgcgtggttgacataatgcgcaaggctggacatctccatcttgtgaaaccatacatggttgcagtccagagcaataacgtggctgctgttaatgaggcattgaatggaatttatgtagaagaggaagattatgacagacttcgagaatctatagatttgcatgataactttgaccagataggtcttgcacagaaggttgagaaacatgaacttcttgagttccgtcgcattgctgcctacatttacaaaaaagcaggaagatggaggcagtctgttgcattgtccaaaaaggataatctttacaaggatgctatggagactagttctcaatctggtgatcgcgagcttgcagaggaattgcttgtgtattttgtggaacagggcaagaaagaatgctttgcttcatgcttgttcacatgctatgacttgatcaggcctgatgtggccttggagcttgcatggatgaacaatatgattgacttttcattcccatacctacttcagttcattcgcgagtacactacaaaagtggatgagctagtcaaggataagttagagaatcttcaagaagtgaagtccaaggagaaggaagaaaaggatcttgttgcgcagcagaatatgtatgcccaacttcttccccttgctttaccagcgcctccaatgcctggtatgggagggggtatgggtggttttcaaccaggtatgggcggaatgggaatgcctcctatgccagcttatggtatgccgcctatgggtgggtattgatgacttgcgagacctttacagaccatatttacttgaaggacagtcgctatcaaatgaggtgtttatatgtgatattaacaagagtgctactgagggtgttttcacctggatgcagcatagtttggcatgcgcatgttgccattttttttagactaatgttcagtatgattttgtagcttggaatggtttaggtgagg

SEQ ID NO: 5207 - DNA, 5689 bp, Pseudotsuga menziesii
gttctcttcctcttccccaccatcaacccttgcgagggttgcgatttcagagcactgttcagctccaagatcttctttttcaacagcggccggatcggtatcgggttcgaatccggtatcggctacagggtcaccgttttttgcgaatttttgcgggcttagcattgcagggtttagttgaatatcgacggatttttggcagatcaactgatttaggttttgtcgaggaattgactgcgttcgattggaattagagtgttttcgtttttcgtttgaggaattacagttcgagatcgaagtttcctctgtctggcgccatggctgcagctagcgccccgatcaccatgaaggaggtcctgacgttgccaagcctcgggattaatccacagtttatcacgtttactcatgttactatggagtcagacaagtacatctgtgtacgggaaactgctcctgcaaacagtgtagtgatcattgatatgaatatgcctatgcagccattgagaaggcctattacagcagattcagctttaatgaatcctaacagcagaattctcgctttaaaagctcaaatacctagcagtactcaggatcacttgcaaatttttaatattgagatgaaggcaaagatgaagtcatatcaaatgcctgaacaggttgtcttttggaagtggataacaccaaaaatgttgggacttgttacacagacttcagtctatcactggtcggtggaaggggatgctgagcctgcaagaatgtttgatcgaactggcaatttaactggtaaccaaataataaactatcgatgcgatccatctgagaagtggcttgttttaattggaattgctccaggggcccctgagaggcctcaacttgttaaggggaacatgcaactgttttctgtagatcagcagcgtagtcaagctctggaagctcatgctgcagcatttgcatcgtttaaggttcctgggaatgaaaatccatcgatccttatttcatttgcttcaaagaccatggttggagggcagcttacttcaaagctacatgtgattgagcttggtgcacagccaggtaaaccaggattttcaaagaaacaggcagatctcttttttccaccagattttgcagatgattttccagtggccatgcagatatcaaacaagtatagtctgatatatgttatcacaaagcttggacttctatttgtctatgatttggatactgctacagcagtttacaggaatcgtatcagtccagatcccattttcttaacaacagaagcttcatcagttggtggattctatgccatcaatcgccgaggacaagtgttgcttgcaactgtcaatgaagcaactattgtgccttttgttagtgggcagctgaataatctagaacttgctgtgaatcttgctaaaagaggaaaccttcctggagctgaaaacttggttgtccagcgtttccaggagttgttttctcaaatgaagtataaagaagctgcagaactagctgctgagtcaccccaaggcatcctccgcacaccagatacagtagcaaaattccagagtgttccagtacagcctgggcagacaccacctcttctccaatattttgggactcttctgacaaggggaaagctgaatgcctttgagtctttggaactttcacgactagttgtaaatcagaacaagaaaaaccttttggagaactggcttgctgaggacaagctggagtgcagtgaggaattgggggatcttgtgaagactgtggacaatgaccttgctttaaaaatatatataaaagcaagggctacaccaaaggtagttgcagcttttgccgaaagaagagaatttgataaaatacttatatactccaaacaggttggatacacaccagattacttatttctcctccagactattttgcggtctgatccacagggtgctgtaaactttgcactaatgatgtctcaaatggaaggtggttgcccacttgactacaacacaattacagatttgttcctacagcgtaacatgatccgtgaagcaacatcctttttattggatgttttgaagcctaatttgccagaacatgggtatcttcaaactaaggttcttgagatcaacttggtgactttcccaaatgtagctgatgcaatcctcgcaaatggaatgtttagtcactatgatcgtccccgtattgcacagttatgtgagaaagctggcttatatatgcgtgcacttcagcattacacagagttgcctgatatcaaacgtgttattgtcaacactcatgctattgagccacaggcactggttgagttttttggtacactttcaagagagtgggcactagagtgcatgaaagatctgctccttgtcaacctaagaggaaacctccagataattgtacaggcagcaaaagaatattctgatcaactgggtgttgattcatgtatcaaactctttgagcagttcaagtcatatgaaggactctatttctttttaggttcatatttgagctccagtgaggaccccgatattcactttaaatacattgaagcagcagccaaaactggtcaaatcaaggaggtggagcgtgtaaccagggagtcaaacttctacgatgcagagaagacaaagaattttctgatggaagctagacttccagatgcccgtcccctgataaatgtttgcgaccgatttggttttgtacctgatcttactcactacttgtattcaaacaacatgctgcggtacattgaaggatatgtccagaaagtcaatccaagcaatgctcctctagttgttggccaactacttgatgatgattgtccagaggatttcattaaaggtcttattctgtcagttcgttctctccttcctgtagaacctcttgtcgaagaatgtgagaaaaggaatcggcttcgactgcttacccaatttttagaacatcttgtgagtgaaggaagtcaagatgtacatgttcacaatgccctgggtaaaatcattattgatacaaataacaatccagaacacttccttacaacaaatccctactatgattcacgtgtggtgggtaaatactgtgagaaaagggatccaacactggcagttgttgcatataggcggggtcaatgtgacgatgaacttattgatgttaccaataaaaattctcttttcaaactccaagccaggtatgttgttgagcgaatggagcctgagctctgggaaaaagtacttactccagaaaatccattccgaaggcaactcattgaccaggttgtatcgactgctttaccagaaagcaagaatccagaccaggtctctgcaacagtcaaagcgtttatgactgctgatctccctcatgaattgattgagcttctagagaagattgtgctacaaaattctgcatttagtggaaaccccaatctacaaaatcttctcattcttacagccattaaggctgacaagtctcgtgtgatggattacatcaacaggctggacaacttcgatggccctgctgttggagagattgctgttggagcagagttgtttgaggaagcctttgccattttcaaaaaattcaacctaaatgtgcaggcagtaaatgtgcttttagataacatccgaagcattgaacgggctgttgagtttgcatcacgtgttgaggaagatgctgtttggagtcaagttgcaaaggcccaactcagggagggactggtcagcgatgctattgaatcatttattcgtgctgatgatgctacagagttccttgatgtgataagggcggctgagcaagcgagtgtgtatcatgacttagtcaaatacctgttgatggtacgtaaaaaggttaaagagcccaaggttgatagcgagcttatctatgcatatgctaagattgacagacttggtgagattgaagaattcatactgacacctaatgtagctaatctgcaaagtgtgggagaccgtttatttgatgaagctctctacgaggctgcaaagataatttttgcctttatttccaactgggcaaaacttgctagcactcttgtgaagctaagacagttccaaggagcagttgatgctgctcgcaaggcaaacagttcaaagacatggaaggaagtttgctttgcctgtgttgatgctgaggagtttagattggctcaaatatgtgggctgaacattattgtgcaggtggatgacttggaagaggtcagtgattattatcagaataggggccgctttgatgaactgatttctctaatggagagtggcttggggttggagcgcgcgcatatgggtatctttacagagctgggtatcctttatgctagatatcgtccagacaaacttatggagcatattaagttgttctcaacacggctcaacattcccaagctcattcgtgtttgtgatgagcagcagcactggaaagagcttacatatctatacattcaatatgatgagtacgacaatgctgcagcaacaatcatgagtcattctccagaggcatgggatcacatgcaattcaaagatgttgtggtcaaggtggccaatgttgagttatattacaaggcagttcacttttatttgcaagaacatccagaccttatcaatgaccttctgaatgtcctctctcttagggtggatcatacacgtgtggttgacataatgcgcaaggctggatatctgcatcttgtaaagccatacatggttgcagttcagagcaataatgtggctgctgtaaacgaggcattgaatggaatttatgtagaagaagaagattatgacagactgcgagaatctatagatttgcatgataactttgaccagataggtcttgcacagaaggttgagaaacatgaacttcttgagttccgccgcattgctgcctacatttacaagaaagcaggaagatggaggcagtctgttgcattgtccaaaaaggataatctttacaaggatgctatggagactagttctcaatctggtgatcgtgagcttgcagaagaattgctcgtctattttgtggaacagggcaagaaagaatgctttgcttcatgcttgttcacatgctatgacttgatcaggcctgatgtggccttggagcttgcatggatgaacaatatgattgacttttcattcccatacttacttcagttcattcgagagtacaccacaaaggtggatgacctggttaaggataagctggaaaatcttcaagaagtaaagtccaaggagaaggaagaaaaggatcttgttgcccagcagaatatgtatgcccaacttcttccccttgctttaccagcacctccgatgcctggtatgggaggtggaatgggaatgggtggttttcaaccaggtatgggtggaatgggaatgcctcctatgccagcttatggtatgccacctatgggtgggtattgatgatttgcaaaaccttttcagacaatatttacttgaaggaagtcgctagcaaatgaggtgtttatatgtgatattagcaagagtgccactcatggtggtttcacctggatgcagcatagtttggcagaagcatgttgccaatttttttagactcgtgttcagtatgattttgtagaatgggatggttaggtgagggcggatgttttcttttgatatgacctgatttggtcattttccgaatgttagtttttctaattttt

SEQ ID NO: 5208 - DNA, 5169 bp, Glycine max
aacactaacaatccacgctcaacatggccgcgaacgcccccatcgccatgcgcgagaccttaacgttggcaagtgtcggaatcaacccgcaattcatcactttcacgcatgtcaccatggaatcggacaagtacatttgcgtcagggaaaccgcgccgcagaacagcgtcgtcatgattgacatgaccatgccaatgcagcctctccgacgccctatcactgccgattccgctcttatgaaccctaacaccagaattctcgcgcttaaagctcaagttccaggcagtactcaggatcatttgcaagtttttaacattgaatccaaagcgaagatgaaatcgtatcaaatgagccaacaggtggtgttttggaagtggataacaccaaagacactaggcatagtgactcagtcatctgtgtaccattggtcaattgaaggtgatggtgagccggttaaggtgtttgaccgaacagctaatttggcgaataatcagattatcaactatcgttgtgatcctactgaaaagtggttggttttgattggaattgcccccggttcttctgagagaccgcaacttgtaaaaggaaatatgcaactcttctctgtggatcaacagaggagccaggctcttgaagcacatgctgcctcatttgccacatttagggttgctggcaatgataaggattcaactcttatttgttttgcatcaaaaagcatcaatgctggacaggttacgtcaaagatgcatgtcatcgaacttggtgcccagccaggcaagccatcattttcaaaaaagcaagcagatctcttcttccctccagactttgctgatgactttcctgtatcaatgcagatttcaaataagtatggcttgatatatgttatcacaaaacttgggcttttatttgtgtatgatctagagactgccactgcagtttacagaaatcgaatcagtcccgatcctgtatttttgaccacagaagcatcttcagatgggggcttttatgctataaatagacgtggccaggtgttgctcgctactgtgaatgaagcaaccattgtaccttttgttagtggccagttaaataatttggaacttgctgttagtcttgctaaaagaggaaacctccctggtgcagaagaattggttgttaagcgttttcaagaattatttgctcagaccaagtataaggaagctgcagagcttgctgcacaatcaccacaaggagtacttcgtactcctgacactgttgctaaatttcagagtgtacctgtgcaagctgggcaaacgccaccgttattgcaatactttggaactctgttaaccatgggaaaactcaatgcttttgagtcactggaactgtcacggcttgttgtaaatcagaacaaaaagaatctcttggaaaattggctagctgaggataaacttgaatgcagtgaggagcttggtgaccttgtgaagacagtggataatgaccttgcattgaaaatttatattaaagctagagccacaccaaaagttgttgcagcttttgcggagaggagggaatttgataagatcctgatatattctaagcaggttggatacacacctgattatatgttccttctccaaacaattttacgaacagacccccagggagctgtaaattttgctctgatgatggctcaaatggaaggaggatgccccattgactacaacacaataactgatctctttcttcagaggaatttgatccgtgaggcaacagcctttttgttggatgtgctgaagccaaatcttcctgaacatggatatcttcaaacaaaggttctggaaattaatcttgtgacctttccaaatgttgctgatgctatattggccaatggcatgttcagtcattatgattgcccacgtattggacaactatgtgaaaaggcgggcctgttcatacgggctcttcagcattatactgagttgcctgacatcaaacgtgtcattgtgaatacacatgccattgagccacaggctttagttgagttctttggaaccctttctcgagaatgggcactcgagtgtatgaaagatcttttacttgtcaatcttaggggcaatcttcaaataattgtgcagactgctaaggaatattctgagcagttgggtgttgatgcatgcattaaactctttgagcaattcaaatcctatgaaggactatactttttcttgggtgcatacttgagctccagtgaggatcctgatattcacttcaagtacattgaggccgctgctaaaactggacaaattaaggaggtagagcgtgtaactagagaatcaaacttttatgatgcggagaagacaaagaattttcttatggaggctaagcttccggatgcacgtccattgattaatgtgtgtgatcgttttggctttgttccggatctcacccattatctttatactagcaacatgcttcgctatattgaaggttatgttcaaaaggtcaatcctggaaatgctcctctagttgtaggacagttgttagatgatgaatgccctgaagattttatcaaaggtcttatactttcagttcgctctctcctgccagttgagcctttagttgaagaatgtgaaaagaggaatcgtctccgattgcttactcaattcttggagcatcttgtaagtgaaggaagccaggatgtacatgtacataatgccctgggtaaaatcattattgacagcaacaacaatcctgagcattttctcacaaccaatccatactatgattctcgtgttgtcggtaaatattgtgaaaagcgggatccaacccttgctgttgttgcttaccgaagagggcaatgtgatgatgagcttgttaatgttactaataaaaactccttgttcaaactccaagcaagatatgttgtgcaaaggatggactctgacctctgggagaaagttcttaatcctgagaatgagtttaggcgacagttgattgatcaagtggtgtctactgctttgcctgaaagcaagagtcctgatcaagtttcagctgcagtgaaagcttttatgactgctgatcttcctcatgagttgattgagcttcttgaaaagattgtgctacaaaattctgcttttagtggaaacttcaatcttcaaaatttgctgatccttactgcaatcaaggcagatccttctagagttatggattacataaataggttggacaactttgatgggcctgcagtaggggaggtggctgtggaagcacaactatatgaagaggcattttctattttcaagaaatttaatttgaatgttcaggctgttaatgtcctactggataaccttcagactattgatcgcgctgtggagtttgctttccgggttgaagaagatgctgtttggagccaggtggctaaagcacaacttagggaaggcttagtgagtgatggaattgagtcattcattcgtgcagatgattcaactcatttcttagaggttataaaggctgctgaagatgcagatgtataccatgacctggtaaagtatcttctcatggttaggcagaataccaaagagcccaaggtggacagtgagctcatctatgcttatgctaagattgaatgccttggagaaattgaagaatttatactgatgccaaatgttgccaatttaccaaatgttggcgaccgcttgtatgatgaggctttgtatgaggctgccaaaattatatttgcttttatttctaactgggctaagttggcagtcacattggtgaagcttaaacagttccaaggtgctgttgatgctgccaggaaagcaaacagttcaaaaacatggaaggaagtttgtttcgcctgtgttgatgctgaggaattccgcttagctcagatttgtggtctcaatgtcatcattcaggtggatgatttggaggaggttagcgagtattatcaaaacagaggatgcttcaatgaactcatatctctaatggagagtgggttaggattggagcgtgcacatatgggtatctttactgagttgggagttctgtatgcgagatatcgtcctgagaagctaatggaacacattaagttattctcaactcggcttaacattccaaagcttattcgagcatgtgatgaacagcagcattggaaagagcttacttacctatacatccaatatgatgagttcgataatactgcaaccaccataatgaatcactctccagaagcatgggaccacatgcaattcaaagatgtgatagttaaagttgcaagtgtggagctgtactataaggctgttcacttctacttgaaagaacatccagatataataaatgatatgttaaatgtgattgctcttcgtgtggaccatactcgtgtagtagatattatgcagaaggctggccacctcagattagttaagccgtacatggttgcagttcaaagcaacaatgtgtctgctgtcaatgaggctttgaatgaaatttatgctgaggaagaagactatgacagactccgtgaatcaatagatctgcatgataacttcgatcagataggtcttgcacagaagattgagaagcatgaacttcttgagatgaggcgtgttgctgcctacatttacaagaaagcaggaagatggaagcaatccattgctttgtcaaagaaagacaatctttacaaggactgtatggaaacatgctctcaatctggtgaccgtgaactctcggaagatttgcttgtctactttattgagcagggaaagaaagagtgttttgcatcatgcctctttgtctgttatgatattatatggccagatgttgctcttgagctagcttggatgaacaatatgattgattttgcttttccatatctcttgcagtttattcgagagtatacaggcaagatagatgagcttatcaaggacaaaattgaagcacaaaatgaggagaaagctaaggaaaaggaggagaaggaagtacttgctcagcagaatatgtatgcccagttgctaccgcttgctttgccagcacctcctatgcaaggaatggggggaggttatgccccttccccaccaccacccatgggcggaatggggatgccaccaatgcctccttttggtatgcctccaatgggtgggggctactgatctccctattcacaaccggagagaattgtgataattt

SEQ ID NO: 5209 - DNA, 5680 bp, Solanum lycopersicum
gtttttcttttttctccataaggtacaacacgcaaggacatgctcgagtactagtagttagaactcaacaattgttccccaattcattccatattcgccatcttcagtgcttaccaaacgcattttagaagaacccttttctctctcgatttttctattgttctctgaatctctgggagggttacttcttttctgagatctcgtctcgcagatctccatcatggcggctgctactgcaccgatcattatgaaagagacccttacattgccaagtgcaggggttaaccagcagttcatcaacttcacaaatgtaacaatggaatcagaaaagtatatctgtgttcgggagacatcaccacaaaatagtgtggtcattattgatatgaatatgccaatgcagcctttgcgccgccctattactgctgactctgctattatgaatcccaattccagaattttggctctaaaagctcaagtaccaggaactactcaagatcacttacaaattttcaatattgaggcaaagcagaaaataaagtcatatcagatgcctgagcaggttgttttctggaagtggattaccccgcagattttaggtatcgtcacacagacgtcagtctatcattggccaattgaaggtgatactgagcctataaagatgtttgatagaacagccaatctagccaataatcaaataatcaattatcgttgtgatccttcagagaaatggttggttttgattggtattgccccaggttcgccagagaggccccaactggtcaaaggaaatatgcaattatattcagtggatcagcaacgaagtcaatctctagaggcacacgctgcatcatttgcatcattcagagtacctggaagtgatagagattccatactcatttcttttgccacaaaatccttgaatgctggacaggttatatcaaaattgcatgtcattgagctgggagctcagccagggaaaccttcgtttacaaaaaaacaggcggaccttttcttccctccagattttgctgatgatttcccagtttccatgcagatatctcataagtatagtttaatttatgtcatcacaaagcttgggcttcttttcgtctacgacctggaaacagctactgcggtatacagaaataggattagcccagaccctattttcctgacagctgaagcttcgtcaattggtggtttctatgccatcaacaggcgaggccaagtgttgctagccacagtaaatgaaacaactattataccttttgtcagtggacaattgaataatctggagcttgctgttaatcttgccaaaagaggaaatcttcccggtgccgagactttggttgtccagcgcttccaagaattgtttgcccaaacaaagtacaaagaggcagctgagcttgctgcagaatcacctcagggcattctccgtacgtctgatactgttgccaaatttcagagcgttcctgttcaagcagggcaaacacctcctcttttgcagtactttgggacacttttgacaaaagggaagctcaatgcttttgagtctttggaactgtcacgcctcgttgtcaaccaaaataagaagaaccttttggagaactggttagctgaggataagctggagtgcagtgaggaacttggcgatcttgtgaagactgttgataatgatctcgccttgaagatatacatcaaagcaagagcaactccaaaagttgttgctgctttcgctgagcgcagggaatttgacaagattctgatttattccaagcaggttggctatacacctgactatctgttcctcctgcaaacaattcttcgatctgatcctcagggagctgttaactttgcactcatgatgtcccaaatggagggcggttgtccagttgattataatacaatcactgacctttttctacagaggaacatgatccgtgaggcaacagcatttttgttggatgttctgaagcctaaccttccagaacatggtttcttgcagactaaggtgttggaaatcaatcttgtgactttccccaatgtagcagatgctatattagcaaacggaatgttcagtcactatgatcgacctcgaattgctcaactttgtgaaaaggctggtctatacatccgggctctgcagcactatactgaactccctgatatcaagcgtgtcattgtgaacacacatgcaattgagcctcaggctctggttgagttctttgggactgtttcacgtgaatgggctcttgagtgcatgaaggacctgctagtgatcaacatcaaaggcaaccttcaaataattgtccaggtagcgaaagagtattgtgagcagttgggtgttgatgcctgcataaagctttttgagcaattcaagtcctatgatgggttgtacttcttcttgggatcatatttgagttccagtgaggatcctgaaattcacttcaagtatgttgaggctgctgccaagactggacaaatcaaggaagttgagcgcgtgacaagagaatcaaacttttatgaccctgaaaagacaaagaacttcttgatggaagccaaacttcctgatgctcggcctctaattaatgtttgtgaccgttttggttttgttcctgatctcacacactacctctataccaataacatgctacggtatattgaaggttatgtccaaaaggtcaacccagcaaatgctcctttagttgtgggacagctattggatgatgagtgtcctgaggattttattaaaggcttgatcctttctgttcgttctctgctacctgttgagccccttgtggatgaatgtgaaaagaggaaccgcctccgactgctcactcagttcttggagcatcttgtgagtgaaggaagccaagatgtgcatgtacacaatgctctgggtaagatcatcatagatagcaacaataacccagagcacttcctgacaaccaacccatactatgattcacgtgttgtgggtaaatattgtgagaagcgcgatcctacccttgctgttgttgcatataggagaggccaatgtgatgatgaacttattaatgtaaccaacaagaactctttgttcaaactacaatccaggtatgtcgttgagaggatggatggtgatctctgggagaaagttcttaaccctgaaaatgagttcagaaggcagcttatcgatcaagttgtctccactgctctgcctgagagcaaaagcccagaacaagtttctgctactgttaaagctttcatgactgctgatcttccgcatgaactgattgaacttcttgaaaagattgtcctccagaattctgcattcagtgggaactttaatctgcaaaacttgcttatcttgacagccattaaagctgatccagctagagttatggattatatcaacaggcttgataattttgatggacctgctgtaggggaggtagctgtagaagcccaactttatgaagaagcttttgctatcttcaagaagttcaatttaaatgtccagggtgtcaatgttcttctagataatattcatgatataaaccgcgctgtcgagtttgccttccgagttgaagaagatgctgtttggagccaagtcgctaaagctcaactcagggaaggattagtcagtgatgctattgagtcatttatccgtgcagatgatacaacccaatttttggatgtcattcgtgctgcagaggatgctgatgtttaccatgacttggtgaagtatctgctgatggtaaggcaaaagacaaaggagcccaaggttgacagtgaactaatctatgcatatgctaaaatagatcgattgagtgacattgaagagtttattctcatgccaaatgttgccaatctaccaaatgttggtgaccggttgtatgatgaagccctgtatgaggctgcaaagatcatatttgcttttacttctaactgggccaaattggctatcacacttgtaaagctaaatcaatttcaaggtgctgttgatgcagcacgtaaagcaaatagttcaaaaacatggaaagaagtctgctttgcttgtgtcgatgctgaagagttccgcttagctcaaatttgtgggctcaacattatagtacaggtggatgatctggaggaagtgagtgaatattaccaaaacagaggatgtttcaacgaattgatctctcttatggagagtgggctgggtttggagcgcgcccatatgggtatcttcacagaacttggtgtcctttatgccagataccgtcatgagaagctcatggaacacataaaattattttccacacgtctcaacattcccaagcttattcgtgcctgtgatgagcagcaacactggaaagaattaacttatttgtatatccaatatgatgaatttgataatgctgccactaccgtcatgaatcattctccagatgcttgggatcatatgcagttcaaagacattgctgtcaaagttgctaatgtggagctttattacaaggccgtccacttctatttgcaagaacatcctgatctcatcaatgatcttctgaatgttcttgcacttagagtggaccacacccgtgtagtcgacataatgagaaaggcgggtcatcttcgcctagtgaagccttacatgattgctgttcaaagtaacaacgtttcttctgtaaatgaggcccttaatgagatatatgttgaagaagaagattatgatagattacgtgaatcagtagatttgcatgataacttcgaccagattggtcttgcgcagaagatagagaagcacgagcttcttgagatgaggcgtgttgctgcttatatctataaaagggctggtcggtggaaacaatccattgctctgtcgaagaaagataacctttacaaagatgcaatggagactgcctcacaatctggggatcgtgagcttgctgaagagttgcttgtttacttcattgaacagggaaagaaagaatgcttcgcgtcatgcctatttgtttgttatgatttgattcgcccggatgttgcccttgagctagcatggatgaacaatatgatcgacttcgcattcccatacctgttacagtttattcgtgaatataccggcaaggttgatgagctgataaaagataaaatagaggctcaaagtgaagcaaaagccaaagagaatgaagagaaggacgttatgaagcagcagaatatgtatgcacagttgctgcctctggctttgcctgctccaccaatgccgggtatgggaggaggttttggtccatcccagccacctccaatgggcggaatgggaatgcctccgatgcctccatttggtatgccacccatgggtccctactaatttaatgttacttcagatagtggtgtaagcaagagagaagcacacaaatgggtcctcttttttgttaagagttggggcttttttgcaattgattgctgacggaggctaagataaaatgaccattctgttgtgtcatagggtgctgacatctcctttgtaatattcatttagaagaggcaattttttgcagctaggcagcacattgagaatgttacaattatctaaaaccatgtagagatgcattattatatagtattttgtgctactttctaggttgtcaaggattaattgtcctaagttctgtaagtatcgtcatcttgtggataaaatctaattttaatgctttatttt

SEQ ID NO: 5210 - DNA, 5854 bp, Brassica rapa
cttttctcctttcatcctcacgtttctcgttcactcgccgctcagatctgtcagcgattccaattccttctacactctctcgtctcccatctcttccttctcgtccctgccacatagctgtctcttcccccagattctctcgcctcgcgaaactctggtaaaaaatggcggcagcaaacgcccccatcacgatgaaggaggtcctcacgcttccgagcgttgggatcaatcagcagttcatcacgtttacgaatgttactatggagtctgacaagtatatatgcgttcgagagacggctcctcaaaacagcgttgtaattatcgatatgagtatgccgatgcagcctctgaggaggcctattactgctgattctgctcttatgaacccagactccaggatccttgccttaaaagctcaagttccaggaactactcaggatcatctacagatatttaacatcgaagcaaaagcaaagcttaaatcacatcagatgcctgagcaggttgcgttttggaagtggattacactcaagatgttggggctggtcacacaaaactccgtgtatcattggtctattgaaggtgattctgaacctgttaagatgtttgatagaacggccaatttagcaaacaatcaaattattaactacaagtgctctcctaacgagaagtggttggttctaattggaattgctcctggccctcctgagagagcacaattggtaaaaggaaatatgcagcttttttctgtggatcaacagcggagccaggcccttgaagcacacgctgcctcatttgctcagtttaaggtccctggaaacgaaaatccttctatccttatatcctttgcaagcaagagctttaatgctgggcagataacatcaaagttgcacgtcattgagcttggtgcccaacccggaaaaccatcatttacaaaaaaacaggcggatctctttttccccccagattttgctgatgatttccctgttgccatgcaggtctctcacaaatttagcttgatatatgtcatcaccaagcttggattgttgtttgtatacgatctagaaactgcttctgctatctacagaaatcgaataagtccagacccaattttcttgacttctgaagcctcttcagttgggggtttctatgccattaatatgcgaggacaagttcttttggccacagtaaacgaggctactataataccttttattagtggtcaattgaacaatttggagcttgctgtcaatcttgctaaaagaggaaacctccctggtgcagaagagctggttgtcgagcggttcaaagagctgtttgctcaaacgaagtacaaggaggctgcagagcttgctgctgaatctcctcaggggattctaaggacacctgatacagtggccaaattccagagtgttcctgtacaagctgggcaaactcctccattgttacagtattttgggactcttttaactaaaggaaagctcaattcatatgagtcattggaactatctcggcttgttgtgaatcaaaacaagaagaacctcctcgaaaactggttagcagaggataaattagaatgcagtgaagaactgggagaccttgtcaagactgtggataatgaccttgctctgaaaatatatatcaaagcccgggcaactccaaaagttgtagcagcttttgcagaaagaaaggagtttgacaaaatcctgatatactcaaagcaggttgggtacacacctgattacatgtttcttctgcaaaccatactccgtacagatccacagggagcagtcaattttgcattaatgatgtctcaaatggaaggaggttgtccagttgacttcaacaccatcactgacctttttcttcagagaaatctgatccgagaagctactgcattccttttggatgtgcttaagccaaatttacctgagcatgcgtttcttcaaactaaggttctggagatcaatttggtaacctttcctaatgtggctgatgcgattttagcaaatgggatgttcagccactatgaccggcctcgtgttgctcaactttgtgagaaggctggactttttatccaatccttaaagcattactcagagttacctgatataaaacgtgtaattgtgaacacacatgctattgagccacaggctcttgttgagttttttggtaccctttctagcgattgggctatggagtgcatgaaggatcttttgctggtcaaccttagaggcaacctgcagataattgttcaggcttgcaaggagtactgtgaacaacttggtgttgatgcatgtattaagctctttgagcagtttaaatcatacgaaggcctttactttttcctaggctcatatttgagtatgagtgaggatcctgagattcacttcaagtacattgaagcagctgccaaaactggtcaaataaaggaggttgagcgtgtgactagagagtctaacttctatgatgctgaaaagacgaagaactttttgatggaagctaagcttcctgatgcccgacctttgataaatgtctgcgaccgtttcggctttgtacctgatctaactcattacctctacacaaacaacatgcttcgttacattgaaggttacgttcagaaggtgaaccctgggaatgctcccttagttgtgggtcagttgcttgatgatgaatgccctgaagattttataaaaggcctcattctctctgttcgctcattgctacctgttgaaccccttgtcgaagaatgtgagaagagaaatcgactccgtctcctcactcagttcttggagcatctagttagcgagggaagccaagatgttcatgtccataacgccttgggtaaaattatcatcgacagtaacaacaaccccgagcatttcctgaccaccaacccgtactatgactctcgggttgttggcaagtactgcgagaagcgtgatcctaccctggctgttgtggcatacagaagaggacaatgtgatgaggaactcgtcaatgtcaccaacaaatattctttgttcaagttacaagccaggtatgtagtggagaggatggatggtgatctttgggataaggttcttttggaagaaaatgaatatagaagacaacttattgaccaagttgtgtctactgctttacccgaaagccagagcccagagcaggtatccgctgctgttaaagcattcatgaccgctgatttgccgcacgagcttattgagcttcttgaaaaaatagtgcttcaaaactctgccttcagtggaaacttcaatctgcaaaatctgcttatattgacagctattaaagcagatccatctagagtgatggattacattaataggctggacaattttgatggacctgctgttggagaagtggctgttgaagcccagctgtacgaggaggcatttgctattttcaagaagtttaacttaaatgttcaggctgtcgacgtattactggataacgtcaaaagcattgagcgttctgttgagtttgctttccgggttgaagaagattctgtttggagtcaagttgcaaaggctcaactcagggaaggactagtcagtgatgcaattgagtcctttatccgtgctgaggatgccacgcatttcctggaggtcatacgtgctactgaagatgctaatgtctatgatgacttggtcagataccttctgatggttagacagaaggtgaaggagcccaaggttgatagtgagctcatctatgcatatgcaaagattgataggttaggtgagattgaagaattcattctgatgccaaacgttgctaacctaccaaatgttggtgatcgcctgtatgacgaagctctgtatgaagctgcaaaaataatctatgcgttcatatcaaactggggcaagttagctgtcacgcttgtgaagttgcaacagttccaaggtgctgttgatgctgcaaggaaagcaaacagtgcaaagacatggaaggaagtctgctttgcttgtgttgatgcagaggaattccggttggcacagatctgtggccttaacgttatcattcaggtggatgatctggaagaagtaagcgagttctaccagaacagagggtgcttcagtgaattaatctcacttatggagagtggacttgggttggaacgtgctcacatgggtatcttcacagagttgggtgtactatatgctagatatcgatatgagaaacttatggaacacatcaagctattctccactcgcctcaatatccccaagctcatacgggcctgtgatgaacaacagcactggcaggaacttacttatctctacattcaatatgatgagtttgataatgctgcgaccactgtgatgaaccattctcctgaagcatgggagcacatgcaattcaaagacattgttgccaaggttgcaaatgtcgagctctactacaaggctgtgcatttctacttacaagagcatcctgatctaatcaacgatcttctcaacgtgcttgctttgcggttagatcacacccgtgttgttgatattatgcggaaggctggtcagttgcgtcttatcaagccatacatggttgcagttcagagcaacaatgtctctgctgttaatgaagctctgaatgagatatacgtggaagaagaagactatgacaggttgcgcgagtccattgatttacatgacagctttgaccagataggcctcgcgcagaagatcgagaaacacgagcttgttgaaatgagacgtgtggctgcttatatctacaagaaagctggcagatggaagcaatcaattgctttgtcaaagaaagacaacatgtacaaagactgtatggaaactgcttcacaatccggtgaacatgaccttgcagaacaactgttggtttacttcattgaacagggcaaaaaggaatgctttgcgacatgtctctttgtatgttatgatttaatccgaccagacgttgctctagaacttgcctggatccacaacatgctcgactttgccttcccgtatctcctccagtttattcgagagtactcgggtaaagtggatgagctgatcaaagacaagctggaggcacaaaaagaggtgaaggccaaagagcaggaagataaggatgttatgtcccaacagaacatgtacgcccatttgttgccacttgctttacccgcaccaccgatgccaggaatgggaggtggtggtgggtatggtccgccaccaccaatgggcggaggaatgccaggaatgcctccgatgccaccatatggaatgccaccaatgggtggctactaagtggaaagttatcagaaccccataggccgtgttcggttattacatgtctctcttgctagaatttgactgggttagtgaaaggtgtagtggaaataatgttctccgtttagtttataagttgcggggatgctttcgttgtagtatgtaatataatcttgggaattagttgagtctttctttggttggaagccacttttctttcgaggatatttagactcatttagacatctttactcatgagtttgtagtttctcttctccaccttattttagagacattttctgacatgctttattcggactttgacttttattagtagactcagaatacttcctgttataaggttgcaaaagatttgatacgttgcatatagtcacacgtaaaacatcataatcatgtaacaaatcttctatttttacctatacgctgcgatcatcaaaagcagaatgatacagacacaaaagaaactcattttcttttatcatatttcacttgagcactatctaagaaggaattgtatcctttgtgctcgatgaaaccaagaaaatgtactagtcatgaaactgaaaatgata

SEQ ID NO: 5211 - DNA, 5383 bp, Distylium racemosum
taaatttagttcaaggtagagggcctttttaagttccggcgccatggcggccgctagtgcaccaatcaccatgaaggaggccttaacgttgccaagcctcgggataaatccacagtttattacattcactcatgtaactatggagtcagacaagtacatctgtgtgagggaaactgctcctcagaacagcgttgtgatcattgatgtcaataaccctgttccagtgatgagaagacctattacagcagattcggctttaatgaatcccaacagtagaattcttgctttgaaagctcaaataccagggaccacacaagatcatttgcaaatatttaacattgagatgaaagcaaaagtgaaatcgcatcaaatgcctgaacaggttgtcttttggaagtggattacaccaaagatgttgggacttgttacacagacatcagtgtatcattggtctttggaaggggagtctgagcctgtgaggatgtttgagagaactgccaatttagctggtaaccagataattaattatcgatgcgatcctaccgaaaagtggcttgttctgattggaattgctccaggagcacctgagaggccacaacttgttaaggggaacatgcaattgttctcagtagatcagcaacgcagtcaagctctagaagctcatgctgctgcctttgcaacatttaaggttgcagggaatgaaaatccttctattctcatttcttttgcttcaaaaacaatctctggagggcagcttacttcaaagctacatgttattgagcttggtgcacagccaggtaaacctggcttctcaaagaaacaggcagatctctttttccccccagattttgcagatgattttcctgtatccatgcagatatcacacaagtacagtttgatatatgtcattacaaagctgggacttctatttgtttatgatttagagactgctacagcagtttacagaaatcgtatcagtccagatccgatatttttaactgctgaagcatcatcaattggtgggttttatgctgttaatcgacgagggcaagttctgcttgcaactgtcaatgaagccactattgtgccatttgttagtggacagcttaataacttagagcttgctgtgaatcttgctaaaagaggaaaccttcctggggctgaaaatctggttgttcagcgtttccaagagttgtttggtcagatgaagtataaggaagctgctgaacttgctgcagagtctccacaaggcattcttcgcacgccagacactgtaacaaagttccagagtgttccagtacagcctgggcaaacaccgcctcttctccagtattttggtacattattgacaaaaggaaagttgaatgcatttgaatctttggaactttcaaggttagttgtaaatcagaataagaaaaatcttttggagaattggcttgctgaggacaagcttgaatgcagtgaggaattgggagatttggtcaagactgtggacaatgaccttgccttaaaaatttacataaaagcaagggctacacccaaagtggttgcagcatttgctgagagaagggaatttgacaaaatacttatttactcaaaacaggttggatacacacctgattacttattcctccttcagacaatcttgcgctctgatccccagggtgctgtaaactttgcactaatgatgtctcaaatggaaggtggttgtccacttgattacaatactattacagacctttttcttcagcgtaacatgattcgtgaagcaacatcatttttgctggatgtcttgaagcccaacttgccagagcatgctcatcttcaaactaaggttcttgagattaacctggtcactttcccaaatgtggctgatgcaatcctggcaaatggaattttcagtcactatgatcgtcctcgcattgcacagttgtgtgagaaagctgggttatatatgcgtgcacttcagcactacacagagttgcctgatatcaagcgtgtcattgtcaacactcatgctattgagccacaggcacttgtggagttctttggcaccctttcaagagagtgggcattggagtgcatgaaagaccttcttcttgtcaacctgaggggcaaccttcaaattattgtacagactgcaaaagaatattctgagcaattgggtgtggattcatgcatcaaactgtttgagcagtttaagtcttacgaagggctatatttcttcttgggttcttccttgagctccagcgaggatccggagatccacttcaaatacattgaagcagcagccaaaacaggacagatcaaggaggttgaacgtgtaactagggagtcaaacttctatgaccctgagaagacaaagaacttcctgatggaagcaagactcccagatgctcgtccactgataaatgtttgtgatcgatttggatttgttccagatcttactcattacttatatacaaacaacatgctgcgatacattgaaggctatgtacaaaaggtaaatccaagcaatgctcctttagttgttggtcaactacttgatgatgattgtccggaagacttcattaaaggtcttattttgtctgttcgttctcttctccctgttgaaccacttgttgaagaatgtgagaaaaggaatcgactccgattgcttacacaatttttagaacatcttgtgagtgaaggaagccaagatgtacatgtacacaatgcacttggtaaaatcattatcgatacaaataataatccagagcacttccttactacaaatccctactatgattcccgtgttgtcggtaaatactgtgagaagagggatccaactttggcagttgttgcgtataggcggggacaatgtgatgatgaacttattcatgttaccaataaaaattctcttttcaaactccaagcaaggtatgttgttgagcggatggaacctgagctttgggaaaaagttcttaacccagaaaatcccttccgtagacaacttattgatcaagttgtgtcaactgctttacctgaaagcaaaaacccagatcaggtgtctgcaacagtaaaagctttcatgactgctgacctgcctcatgagttgattgaacttctagagaagattgtgctacaaaattctgcatttagtggaaatccaaatctgcaaaaccttctcattctgacagctattaaggctgacaagtcacgtgtaatggactacattaatagattggacaactttgatggccctgcagttggagaaattgctgttggtgctgaattatatgaagaggcctttgccatctttaagaagttcaacttaaacgtacaggctgtaaatgtccttttagataacattcgaagcattgagcgggctgtagagtttgcatcacgagtggaggaggatgcggtttggagtcaagttgcaaaggcacaactcagggagggtctagtcagcgatgctattgaatcgtttattcgtgctgatgatgctacagaattccatgatgtcataagggcggctgagcaaatggaggtgtataatgacttagtcaagtacttacttatggtacggagaaaggttaaggagccaaaggttgatagtgagcttatctatgcatatgctaagattgacaggctgggtgaaatagaggaatttatactcacgccaaatgttgccaatcttcaaagtgtgggagaccgtctatttgatgaagctctttatgaggctgcaaagataattttcacctttatttccaactgggcaaaacttgcaagtacactagtcaaacttaaacaattccagggagcagttgatgctgctcgcaaggcaaatagttcaaagacatggaaggaagtctgttttgcctgcgttgatgctgaagagtttaggctggcccaaatatgtggtctgaacataattgtgcaggtggatgacttggaagaggtcagtgattactaccagaacagaggccgctttgatgaactcatatctttgatggaaagtggtttgggactggaacgtgcacatatgggcatctttacagagctgggtgtcctttatgctagatatcgtcctgacaagcttatggaacatatcaaattgttttcaacacggctcaacattcccaagcttatccgtgtttgcgatgaacagcagcattggaaggaacttacatatttatatattcagtatgatgaatatgacaatgctgcaacaacaatcatgaaccattctccagaggcatgggatcacatgcaattcaaagatgttgttgttaaagtggccaatgtggagttgtactacaaggcagtccacttctatttgcaagaacatccagatcttatgaatgacctcctgaatgtccttgcacttaaagtcgaccacacacgagtggttgacataatgcgtaaggctgggcacctccgacttgtcaaaccatacatggttgcagtacagagtaacaatgtggctgctgtaaatgaggctttgaatgagatctatgttgaagaggaagattatgacaggcttcgagaatctattgatttgcatgacaactttgatcagataggacttgcacagaagcttgagaaacatgaacttcttgaattacgtcggattgctgcctatatttacaagaaagcaggaagatggaggcaatctgttgcactgtctaaaaaggataatctatacaaggatgcaatggaaactgcttctcaatctggtgatcgtgaacttgctgaggaattgctcattttctttgtggaacagggcaagaaggaatgctttgcgtcgtgcttgttcacatgctatgacttgatcaggccagatgtggccttggaacttgcctggatgaataatatgattgacttttcattcccatatttgcttcagttcatccgagagtacacaatgaaagtcgacgagcttgtcaaggataagttagaagcccttcaagaagagaaatctaaggagaaagaagagaaagatatggttgctcaacagaatatgtacgctcagcttcttccccttgctctgccagcacctccaatgcctggcatgggagctcctggaatgggaatgccacccatgggcggaatgggaatgcctcctatgccagcttatggtatgccacctatgggtggctattgattggttgaagccttcgccttcatatagacaatatacatcaaagcatagacacgattatatgaggcttgtattggatattagctatagagcactgttggggtgatttccatctcagatgtgatagcttggcagagcatgttgccaaattgtaggaactcatgttcagtatgattttgtagattgggctggttaggtgagcgaatctttttgctatgacctgatatgggtcattttctg

SEQ ID NO: 5212 - DNA, 5935 bp, Pinus taeda
gatcggctgttctaggaatttttgtggaattggttacgttcgatcagaattaaggctttttcctttttcctccgaggaatcgctgtttgagatcggggttttctttcaccggcgccatggctgcagctagcgccccgatcaccatgaaggaggtcctgacgttgccaagcctcgggattaatccacagtttatcacctttactcatgtcactatggagtcagacaagtacatctgcgtacgggaaactgctcctgcgaacagtgttgtgatcattgatatgaatatgcctatgcagccattgagaaggcctatcacggcagattcagctttaatgaatcctaacagcagaattctcgctttaaaagctcaaatacctggcagtactcaggatcacttgcaaatttttaacattgagatgaaggcaaagatgaagtcatatcaaatgcccgaacaggttgtcttttggaaatggataaccccaaaattgttgggacttgttacacagacttctgtctatcattggaccttggaaggggatgctgagcctgcaagaatgtttgatcgaactgccaatttaactggtaaccaaataataaactatcgttgtgatccatctgagaaatggcttgttttaattggaattgctccaggggcacccgagaggcctcaactagttaaggggaacatgcagctgttttctgtagatcagcagcgcagtcaagctctagaagcccatgctgcagcatttgcatcttttaaggttcctgggaatgaaaatccttctatccttatttcatttgcttcaaaaaccatggttggagggcagcttacatcaaagctacatgtgattgagcttggtgcacagccaggtaaaccaggattttcgaagaaacaggcagatctcttttttccgccagattttgccgatgattttccagtggctatgcagatatcaaacaagtatagtctgatatatgtcatcacaaagctgggacttctgtttgtctatgatttggataccgctacagcagtttacaggaatcgtatcagtccagatcccattttcttaacaacggaagcttcgtcaattggtggattctatgctatcaatcgccgaggccaagtgttgcttgcaactgtcaatgaagcaactattgtgccttttgttagtggacagctgaataatctagagcttgctgtgaatcttgctaaaagaggaaaccttcctggagctgaaaacttggttgtccagcgtttccaggagttgttttctcaaatgaagtataaagaagctgcagaactagctgctgagtcaccccaaggcattctccgtacaccagatacggtggcaaaattccagagtgttccagtacagcctgggcagacaccaccccttctacaatattttgggactcttctgactaggggaaagttgaatgcgtttgagtctttggaactttcacgattagttgtaaatcagaacaagaaaaatctgttggagaattggcttgctgaggataagctggagtgcagtgaggatttgggggatcttgtgaagacggtggacaatgaccttgctttaaaaatttatataaaagcaagggctacccctaaggtagttgcagcttttgctgagagaagagaatttgacaaaatacttatatactccaaacaggttggttacacgccagactacttatttctcctccagactattttgcgctccgatccacagggtgctgtaaactttgcactaatgatgtctcaaatggaaggtggctgtccgctggactacaatacaattacagatttgttccttcagcgaaacatgatccgtgaagcaacatcctttttattggatgttctgaagcctaatttgccagaacatgggtatcttcaaacaaaggttctcgagatcaacctggtcactttcccaaatgtagctgatgcaatcctggcaaacggaatgtttagtcactatgaccgtccccgtattgcacaactgtgtgagaaagctggcttatatatgcgagcacttcagcattatacagagttgcctgatatcaaacgtgttattgtcaacactcatgctattgagcctcaggcattggttgagttttttggtactctctcaagagagtgggcattggagtgcatgaaagatctgcttcttgttaatctaagaggaaaccttcagataattgtacaggctgcaaaagaatattcggatcaactgggtgtagattcatgtatcaaactctttgagcagttcaagtcatatgaagggctctatttctttttgggttcatatttgagttccagtgaggaccccgatattcactttaaatacattgaagcagcagcaaaaactggtcaaatcaaagaggtggagcgtgtaaccagagagtcaaacttctatgatgcagagaagaccaagaattttctgatggaagcaagacttccagatgcccgtcccctgataaatgtttgcgaccgatttggttttgtaccagatcttactcactacttatattcaaacaacatgctgcggtacattgaaggctatgtccagaaagtcaatccaagcaatgctcctttagttgttggccaattacttgatgatgattgtccagaggatttcattaaaggtcttattctgtcagttcgttctcttcttcctgtagaaccgcttgttgaagaatgcgagaaaaggaatcggcttcgactgctgacccaattcttagaacaccttgtaagcgaaggaagtcaagatgtacatgttcacaatgcccttggtaaaatcatcattgatacaaataacaatccagaacacttccttacaacaaatccctactatgattcgcgtgtggtgggtaaatactgtgagaaaagagatccaactctggcagttgttgcatataagcggggccagtgtgatgatgaacttattgatgttaccaataaaaattctctgttcaaactccaagccaggtatgttgttgagcggatggagcctgacctctgggaaaaggtacttacccctgaaaatccattccgaaggcaacttattgaccaggttgtatcaactgctttaccagaaagtaagaatccagatcaagtctctgcaacagtgaaagcgttcatgactgctgatctcccacatgagttgattgagcttctagagaagattgtgctacaaaattctgcatttagtggaaaccccaatctgcaaaatcttcttattcttacagccatcaaggctgacaagtcgcgtgtaatggattatatcaacagactggacaacttcgatggccctgctgttggagagatagctgttggagcagagttgtttgaggaagcctttgcgattttcaaaaaattcaacttgaatgtgcaggcagtgaatgtgcttttggataacatccgaagcattgaacgggcggttgagtttgcatcccgtgttgaggaggatgcagtttggagtcaagttgcaaaggcacaactcagggaaggattggtcagcgatgctattgaatcatttattcgtgctgatgatgctacacagttccttgatgtgataagggcggctgagatagctggcgtgtatcatgacttagtcaaatacctgttgatggtacggagaaaggttaaagagccaaaggttgatagtgagcttatctatgcatatgctaagattgacagacttgctgatattgaggaattcatactgacacctaatgtagctaatctccaaggtgtgggagaccgtctatttgatgaagagctctatgaggctgcaaagataatttttgcctttatttccaactgggcaaaacttgctagcactcttgtgaagctaagacagttccaaggagcagttgatgctgctcgcaaggcaaacagttcgaagacttggaaggaagtttgttttgcctgtgttgatgcggaagaatttagattggctcaaatatgtggattgaacatcattgtacaggtagatgacttggaagaggtcagtgattattatcagaataggggccgctttgatgaattaatttctctaatggagagtggcttggggttggagcgcgcacatatgggtatctttacagagttgggtatcctgtatgctagatatcgtccagacaagcttatggaacatattaagttgttctcaacacggctcaacattcccaagctcatccgtgtttgtgatgagcagcagcactggaaggagcttacatatttatacattcaatatgatgagtacgacaatgctgcagcaacaatcatgaaccattctccagaggcatgggatcacatgcaattcaaagatgttgtggtcaaggtggccaatgttgagttatactacaaggcggttcacttttatttgcaagaacatccagatcttatcaatgatctattgaatgtcctctctcttagggtggatcatacacgtgtggtggacataatgcgcaaggctggacatctccatcttgtgaagccatacatggttgcagtccagagcaataatgtggctgctgtaaatgaggcattgaatgcaatttatgtagaagaggaagattatgagagacttcgggaatctatagatatgcacgataacttcgaccagataggtctcgcacagaaggttgagaaacacgaacttcttgagttccgccgtattgctgcctacatttacaagaaagcaggacgatggaggcagtctgttgccttgtccaaaaaggataatctttacaaggatgccatggagactagttctcaatctggtgaccgtgagcttgcagaagaattgcttgtatattttgtggaacagggcaagaaggaatgctttgcttcatgcttgttcacatgctatgacttgatcaggcctgatgtggccttggagctagcatggtttaacaatatgattgacttttcattcccgtacctacttcagttcattcgagagtacactacaaaagtggatgagctggttaaggataagttagaaaatcttcaagaagtgaagtccaaggaaaaggaagaaaaggatatggttgctcagcagaatatgtatgcccagcttcttccgcttgctttaccagcacctccaatccctggtatgggaggaggtatgggtatgggtggttttcaaccaggtatggctggaatgggaatgcctcccatgccagcttatggtatgccacctatgggttattgatgattttatatttgcttgaaggacagtcgcgctatcaaatgaggtgtttatatgtgatattagcaggagtgctactgagggtgttttcacctggacgcagcatagtttggcggatgaattggttgcagaatagttttggcgtacgaatgttgccaaattttttagacatgtttagtatgattttgtagattggaatggttaggtgagggcggatgttttcctttattacgaccggatgggtcattttccgaatgtttatcttttctaatttttccgcataatattctttaattgacattattctttagtgcaatctacatattcgatatgactattctattcccttttgttatgactattctattcccttttgttttttccttatccgtttcttcttaaagacggccactaggctgacccgttttcaagggaactaaattagtgaaggaaatgctcaacaattttaaagtaggatgacaggtggaggtatttttgttgaaagtgttaactgttagtctatatatacattgcatatatccacattcaaatagcaagcgacgcatctaagctaagcatgagctgaatgtattagtttggtcatctccacaatcgtgtttatgggagtgtcaaacgatacctgtactgcgcttttcctgtatgcgacgactatataaccgtctctttttctggaagcatttcgcttatacata

SEQ ID NO: 5213 - DNA, 5580 bp, Fragaria vesca
gcgccatggcctccgccgctgccaacgcccccatgaccatgaaagagcagctcacgctgccgagtattggtataaatccgcagttcattacgtttacgcatgtgacgatggaatcggataagtacatttgcgtcagggagacctcgccgcagaacagcgtggtcatcattgacatgagcatgcctatgcagccgttgcggcgacctattactgccgattcggctctgatgaatccgaattccaggattctcgctctcaaagctcaagtgcaaggaactactcaggaccatttacagatatttaatattgagctgaaaacgaagatgaaatcacatcagatgcctgagcagattgtgttttggaagtgggtcactcctaagatgctggggatggtcacagtgacctcagtatatcattggttaattgaaggggattctgagccaacaaaggtgtttgagcgtacagctaatttagcaaataatcaaattatcaactaccgttgcgatccctctgaaaagtggttggtcttaattggaattgcacctggttcttctgagaggccacaactggttaaaggaaacatgcagcttttctctgtggagcagcaacgtagtcaggctcttgaagcacatgctgcatcatttgccacaattaaagttgcagggaacgagaacccttcaactcttatatgctttgctgcaaagtcctctaacgccggacaagttacatcaaagttgcatgttattgagcttggtgcccagccaggaaaaccatcatatactaagaagcaagcagatctcttcttccctccggatttcgctgatgactttcctgtgtcaatgcagatatcagagaagtatgggttgatatatgtaatcacaaagcttggacttctgtttgtatatgacctagagacagcaactgcagtttatagaaatcgaatcagtccggatcctatatttttgactgctgaagcttcatctgttgggggcttttatgcagtcaataggcgtggtcaggtgttacttgcttctgtaaatgaacaaacaattgtaccttttgttagtggtcagttaaacaatttgggactcgcagttagtcttgccagaagaggaaatcttcccggtgctgaagacttggttgtccagcgattccaagaattgttctctcagacgaaatataaggaggctgcagagcttgctgcagattctccaatgggagtacttcgtacacctgaaactgttactaaatttcagagtgttcctgtgcaagctgggcaaacaccaccgttgttgcagtactttggaactttgttaactaaagggaaactcaacgcgtttgaatcattggaactgtcacgtttggttgtaaatcaaaacaagaaaaatctattggagaattggctagcagaggacaagcttgaatgtagtgaagagctaggagatcttgtgaagacagtggataatgaccttgctttgaaaatatacatcaaagccagggcaactccaaaagttgttgcagcctttgctgagagaagggaatttgacaagattttagtatactcaaaacaggttggatatacacctgattatatgttccttctgcaaacaattttgcggacagatgcccagggggctgtcaattttgctctaatgatgtctcaaatggagggaggttgccctattgactacaataccattactgatctgttccttcagaggaatctcattcgcgaggcaacggcctttttgttggatgtgctgaagccgaatctacccgagcatggcttccttcagacaaaggttttggaaatcaatcttgtgacttttcctaatgttgcggatgctatattggccaacggtatgttcagtcattatgaccgcccccgcgttggtcaactctgtgaaaaagctggtttgtatttgcgtgccttacagcattataccgagttgcctgatattaaacgagtcattgtgaacacacatgcaattgatcctcaggctcttgttgagttcttcgggactctttccatagaatgggctctcgagtgcatgaaagatcttctactggtcaatcttaggggcaatcttcagattattgtgcagactgccaaagagtattccgagcaactgggtgtagataaatgtataaagttgtttgagcagttcaagtcctatgaggggttgtactttttcttaggctcatacttgagctccagtgaggatcctgatatccactttaagtatattgaagcagctgcaaaaactggacagattaaggaggtggagcgagtgactcgtgaatctaacttttatgatgccgagaaggctaagaactttctaatggaagccaagcttccagatgcgcgtcctctaattaatgtctgtgatcgttttggctttgttcctgatctcactcattacctatatacgaacaatatgctccgttacattgaaggttatgtccaaaaggtcaatccgggaaatgctcctttagttgttgggcagcttttggatgatgaatgccctgaagatttcatcaaaggtcttattctatcagttcgttctcttctaccagttgaaccccttgttgatgaatgtgaaaagaggaatcgtcttcgcctgctcactcagttcttggagcatcttgtgagcgaaggaagccaagatgtacatgttcataatgctcttggtaaaatcatcatagatagtggcaacaatccggagcattttctcacaactaacccatattatgattcccgcgttgtgggtaaatattgtgaaaaaagagatccgacccttgctgttgttgcttaccgtagagggcaatgtgatgatgaacttgttaatgtaacaaataagaattcattgttcaaactccaggccagatatgttgtggaaagaatggatgatgacctctgggctaaggtccttgatcctgaaaatgagtatagaaggcagctcattgatcaagttgtctcaactgctttgcctgaaagcaagagccctgagcaagtttcagcaactgttaaagcgtttatgaccgcagaccttccacatgagttgattgagcttcttgaaaagatagtgctccagaattcagcttttagtggaaacttcaatctacagaatcttttaatcttgactgcaatcaaggctgatccgtccagagtcatggattatatcaatcgattagacaactttgatggacctgctgttggagtaatggctattgaagcccaactctatgaggaagcttttgcaatcttcaagaagttcaatttgaatgttgatgctgtcaatgttctgttggataacattcacagcattgaccgtgcggtagagtttgcattcagggttgaagaagatgctgtttggagccaggttgccaaggcccaattacgagaggggcttgtgagtgatgctattgagtcattcattcgtgctgatgatgccacccagtttttggatgtcatacgtgctgctcaggatgcagatgtgtatcatgacttggtaaggtaccttctgatggttaggcagaaggcgaaagagcccaaggtagacagtgaactcatttatgcatatgctaagattgatcgactcggtgatattgaagagttcattcttatgccaaatgttgctaatctcccaaatgttggggatcgcctgtatgatgaagaactatatgaagcagccaagatcatatttgcatttatttctaactgggccaagctggcgtgtactctagtgaagctcaagcagtttcaaggtgctgttgatgctgcccggaaagctaacagctcaaaaacttggaaggaagtttgctttgcatgtgttgatgctgaggaattccggttggctcaaatttgtggactcaacatcatcatccaggtggatgatttggaagaagtcagtgagttttaccagaacagggggtgctttaatgaactcattagtctcatggagagtggactaggattggaacgtgcacatatgggcatctttactgagttgggagttctatatgcgagataccgtcctgagaagctcatggagcacattaaactgttttctactcgtctcaacattcccaaacttatacgagcttgtgatgaacagcagcactggaaggaattaacatacttatatatacaatatgatgaatttgataatgctgcaaccaccataatgaaccactccccagaagcatgggaacacatgcaattcaaggatgtgatagtcaaagttgcaagtgttgagctttactatagggctgtgcacttttatttggaagaacatcctgatattatcaatgatgttctaaatgtgcttgcacttcgtgtggaccatacccgagtggtggatataatgcgaaaggctggtcacatccgtctggtaaagccatacatggttgcagtccagagcaacaatgtaacagctgtaaatgaagctctaaatgaaatatatgttgaggaggaagactatgacagacttcgtgaatctattgatttgcatgatagctttgatcagataggtcttgcacaaaagcttgagaaacatgagcttcttgagattagacgtgttgctgcatacatttataagaaagctggaagatggaagcaatccattgcattgtcaaagaaggacaaacattacaaagacgcaatggagacgtgctcacagtctggtgatcatgatctttccgaggaattgcttgtctatttcatcgagcagggaaagaaagaatgttttgcatcgtgtctctttgtttgttatgatttaatccggccagacgttgctcttgagctggcatggatgaacaatataatcgattttgccttcccatacatcctacagtttatgcgtgagtacacaggcaaggttgatgaacttatcaaagacaaaattgagtctcaaaaagaggtgaaagccaaagagcaagaggagaaggaattggttgcgaagcagaacatgtatgctcagttgctgcctgctttgcctgcacctccgggtatgggtggaggttttgctccacctccaatgccaccaatgccacagatgggtgggatggggatgcctcccatgcctccttttgggatgccacaaatgggcccttcctattaatatctgcaacattgaagttttgtgactgttctaacagcttctaccgggtgaagctaccagagatttgattctacattgtcacatggctgactgatgaaatggagggtgaagtgaaatattctcccactttcctggcagagcatcttctaacagagaattatcattttctttctgaaacttttttgtcacaatatcaaattcttttcagtcggctgtcaagtctgagctgagtagggcgttgttcgagttgtctctgtttcccccaggatggccaaggagcctgctcttgctaatgtcttggcttctgactacttaactacttgtataggttcatttttgaaacttaatttcagtagtatgaaatatttagtgaaattatgtacaaacgtcttccctttgatatgaaaccaatggcgctagtttactaaattatcagagtttatccttcagcatcttc

SEQ ID NO: 5214 - DNA, 5494 bp, Malus domestica
gcaccatggccgccgctaacgcccccatgaccatgaaagaggccctcacgctgcctagtattgggatcaatccccaattcattacgtttacgcatgtgactatggaatcggataagtacatttgtgttagggagacatcaccgcagaatagcgtcgttatcatcgatatgaacatgcccatgcagccgttgcgtcgacccattaccgccgactcggctttgatgaatcccaattccagaattcttgctctaaaagctcaagtccaaggaactgctcaggaccatttacaaatctttaacattgaaatgaaagcaaagatgaaatcacatcaaatgcctgagcaggttgtcttttggaagtggatcactccaaagatgctaggtctagtcactcagacctcagtatatcattggttaattgaaggtgattccgagcctacaaaggtctttgagcggacagctaatttggcaaacaatcaaataatcaactaccgttgtgatccttcggaaaagtggttggtcttaattggaattgctcctggttcagcagagaggccacaacttgtcaaaggaaacatgcagcttttttctgtggaacagaaacgtagtcaggctcttgaagcacatgctgcatcgtttgccacatttaaagttccagggaatgagcatccttcaattcttatttgttttgcctcaaagtcctccaatgctggacaggttacatcaaagatgcatgtaattgagcttggtgcccagcccggaaaaccatcatatactaagaagcaagcagatttattctttcctcctgattttgctgatgactttccagtatcaatgcagatatcggaaaagtatgggttgatatatgttgtcacaaagcttggacttttatttgtatatgacctagagacagcaactgcagtttatagaaatcgaatcagtccagatcctatatttttgacagctgaagcttcaactgttgggggtttttatgcaatcaataggagaggccaggtcttacttgccactataaatgaacaaacaattgtaccatttgttagtggtcagttaaacaatttggggcttgcagtgagtcttgcgaaaagaggaaaccttcctggtgctgaggacctggttgtccagcggttccaagagttgttttctcagacaaagtataaggaggctgcagagcttgccgcggaatctccaatgggaatactccgtactcctgatactgttgctaaatttcagagtgttcctgtgcaagctgggcaaaccccacctctattgcagtattttggaactcttttaactaagggaaaactcaatgcttatgaatcattagaactgtcacgtttagttgtaaatcagaacaaaaagaatcttttggagaattggctagcagaggacaagctagaatgtagcgaagagcttggagatcttgtgaagacagtggataatgacctcgctttgaaaatatacatcaaagctcgagcaacgcccaaagttgttgcagcatttgctgagagaagggaatttgacaagattttgatatactcaaagcaggttggatatacacctgattatttgttccttctccaaacaattttgcgggcagatccccagggggctgttaattttgctctaatgatgtctcaaatggagggaggttgccccattgactacaataccatcaccgatctgttccttcagaggaacttgatccgtgaagcaacagcctttttgttggatgtgctgaagccgaatctacctgagcatggattccttcagacaaaggttttggaaatcaatcttgtgacttttccaaatgttgcggatgctatattggccaatggtatgttcagctattatgatcgcccacgcattggtcaactttgtgaaaaagctggtttgtatttgcgtgccctacagcactacactgaattgcctgatatcaaacgtgtcatcgtgaacacacatgcaattgaccctcaggctcttgtcgagttctttggaactctctctgtagaatgggctcttgagtgcatgaaagatcttctgctggtcaatcttaggggcaatctccagattattgtacagaccgccaaagagtattgcgagcaactgggtgtagataagtgtataaaattgtttgagcagttcaagtcctatgaggggctgtacttcttcctaggcgcatatttgagctccagcgaggatcccgatattcatttcaagtacattgaagcagctgcaaaaactggacagattaaggaggtggagcgtgtgacacgggaatcaaatttttatgaccctgaaaaggctaagaactttttaatggaagcaaagcttccagacgcacgtcctctaattaatgtctgtgatcgttttggctttgttccagatctcacccattatctgtatacgaacaatatgcttcgttacattgaaggttatgtccaaaaggtcaatccaggaaatgctcctttagttgtagggcagctactggatgatgaatgtcctgaagatttcattaagggtcttattctatcagttcgttctcttctaccggttgagccccttgtcgaggaatgtgaaaagaggaatcgtcttcgcttgctcactcaatttttggagcatcttgtgagtgagggaagccaagacgtacatgtccacaatgctctgggtaaaatcatcatagatagcggcaacaatcctgagcattttctcacaactaacccatactatgattctcgcgttgtgggtaaatattgtgagaaaagggatcctacccttgctgttgttgcataccgtagagggcaatgtgatgatgagctcattaatgttacaaataaaaattccttgttcaaactccaggccagatatgtcgtggaaagaatggatgatgacctctgggctaaggtccttgatcctgaaaatgaatataaaaggcaactaatcgatcaagttgtatctactgccttgcctgaaagcaagagtcctgagcaagtttcagcaactgttaaagcatttatgactgcggaccttccacacgagttgattgagcttcttgaaaagatagtgctgcaaaattctgcttttagtgggaacttcaatctgcagaatctgttaattctgactgccatcaaaactgatccatccagagtcatggactatatcaatagattagacaactttgatggacccgcagttggagtaatggctgtagaagctcaattgtatgaagaagcatttgcaatcttcaagaagttcaatttgaatgttgatgctgtgaatgtcctgttggataacattcagagcattgaccgagctgtagagtttgcattccgggttgaagaagatgctgtttggagccaggtggccaaggcccaattgcgagagggattagtgagtgatgccatcgaatcattcatccgtgcagatgatgccacccactttttggatgtcatacgtgcttctgaggatgcagatgtatatcatgacttggtaaggtaccttctgatggttaggcagaagaccaaggagccgaaggtcgacagtgaacttatttatgcgtatgctaagattgatcggcttggtgatattgaagaattcattcttatgccaaatgttgccaatctccaaaatgttggggatcgcttgtttgatgaggccctatacgaagcagccaagatcatatttgcattcatttctaactggggtaaactagcatgcactcttgtgaagctaaatcagtttcaaggtgccgttgatgcagctcggaaagctaacagctcaaaaacgtggaagttcgtttgctttgcatgcgttgatgctgaggaattccgcttagctcagatttgtggactcaacatcatcattcaggtggatgatttggaagaggtctgtgagtattaccagaacaggggatgctttaatgagctcattagtctcatggagagtgggctagggttggagcgtgcacatatgggcatctttacggaattaggagttctctatgcaagataccgtcctgagaagcttatggaacacattaaactgttctctacccgtctgaacattcccaagcttatacgagcttgtgatgaacagcagcactggaacgaattaacatacttatatatccaatatgatgagtttgataatgctgcaactaccataatgaaccactccccagaagcatgggaccacatgcaattcaaggatgttattgtcaaagttgcaagtgtcgaactctactatagggctgtgcacttctacttagaagaacatcctgatgttattaatgatgttcttaatgtgattgcacttcgtgtcgaccacaccagagtggtggatataatgagaaaggctggtcacatctgtctcataaagccatacatggttgcagttcagagcaacaatgtaactgctgtaaatgaagctctaaatgaaatatacatagaggaggaagactatgacaggcttcgtgaatcaatagatttacacgacagctttgatcagatcggtcttgctcaaaagcttgagaaacatgagcttttggagatgagacgtgttgctgcatacatttacaagaaagcaggtagatggaagcaatccattgccttgtcaaagaaagacaatcattacaaagattgcatggagacatgctcacagtctggtgatcatgaactttcggaggaactgcttatctatttcattgagcaggggaagaaagagtgttttgctgcatgcctatttgtttgttatgatatgatccggccagatgttgccctcgagcttgcgtggatgaacaatataattgattttgccttaccataccttctgcagtttattcgagagtacacaggaaaggttgatgaacttattaaagacaaaatcgaagctcaaaacgaggtgaaagccaaagagaaagaggagaaggaattggttgcccagcagaatatgtatgctcagttgctgcctgccttgcctgcaccaccgggaatgggaggttatgctccaccaccaatgccgccaatgggagggatggggatgccgccaatgccaccatttggaatgccgcaaatgggcccctcttactaaattttgacacggattgaggttttacgagcgctctaacaactcctactggttgaaactagtatgtccggaactcttctgtcaggctgcaggcaattcgttttcaatgaagggttgagccggtacaacatctttgttttctgcgggtttatggtgacgtttatagaaattctttttaatttacagtatcaaattcttttttgcttggctgtttgagagatgtaggatggcaaccgtgcttgcacttagttcatggctatggttgtggcaacactcttactacctgtataggaaattttgttgaacttgttcttgttagtgtcaagaaacttttcattggtcaaatttttgtactaacacttcccacttggtgagttagacatttctttcca

SEQ ID NO: 5215 - DNA, 5671 bp, Populus trichocarpa
ggaagaaacacagacccgtttttcaccgatccacaaaagaacactctctctctctccccctctctctctggtttctgatcttgaaacctccgatctagggcaccatggctgctgccaatgccccaatcaccatgaaagaggctctaacgttgccgagcctcggtatcaacccacagttcataaacttcacgcatgtgactatggaatcagagaagtacatatgcatcagagaaacgtcgccacagaacagcgtggttattgtcgacatgaacatgcctatgcagcctctaagaaggcctatcactgccgattccgccttgatgaatcctaattctcgaattctcgctctcaaagcccaactgccgggaactactcaggatcatttgcagatatttaatatagaactgaaagcgaaagtgaaatctcatcaaatgcctgagcaggttgtgttttggaagtggattagccctaagatgctggccctggtaactcagacttcacctgtgaagatgtttgatagaacagctaatctacaaggtaatcagataatcaactatcgatgtgatccttcagaaaagtggctggtcctcattggaattgctcaaggtccaccagagaggccacaattagtcaaagggaatatgcagcttttctctgtggatcagcagcgtagtcaggctcttgaagcacatgctgcgtcatttgccacatttaaagttgcaggaaatgaaagcccttcaacccttatctcttttgcatcaaggtcgtttaatgctggacaactaacatcaaagttgcatgttattgaacttggtgctgtgccaggcaaaccttcatttaccaagaagcaagcagacctgttctttccaccagactttgctgatgattttcctgtgtcaatgcagatatcccaaaagtatggcttaatatatgcgatcacaaagcaaggacttctatttgtttatgacttagagactgccagcgcaatttatagaaatcgaatcagtccagatcctatatttttgactactgatgcttcttcagtaggtggcttctatgctgtcaataggagaggacaggttttgcttgccactgtaaatgaagcaactattgtgccttttgttagtggccagttaaacaatcttgaacttgctgttaatcttgccaaaagaggaaatcttcctggagctgagaatctggttgtccagcggtttcaagaattattttctcaatcaaagtataaggaggccgcagaacttgccgcagaatctccacaaggaatcctccgaactcctgatactgttgctaaattccagagcgttccagttcaagctgggcaaacaccaccattgttgcagtactttggaactctgttgactagaggaaagcttaatgcttttgaatcattggaattatcacgtcttgttgtaaatcagaataagaaaaatcttctggagaactggttggctgaggacaagcttgaatgcactgaagagcttggagatcttgtgaagaccgttgataatgaccttgcattgaagatatatatcaaagccagggcaactccaaaagttgttgcagcatttgctgagaggagggagtttgacaagattcttatatactcaaagcaggttggctacaaccctgattatttgttcctcctccaaacaatattgcggacagaccctcaggctgctgttaattttgctctaatgatgtctcaaatggagggaggttgcccagttgattacaacacaataactgatctattccttcagaggaatttgatccgcgaggcaacagcttttttgttggatgttctgaagccaaatttgcctgagcatggataccttcaaactaaggttttggagatcaatcttgtgacatttccaaatgttgcagatgctatattagctaatggtatgtttagtcactatgatcgcccacgtattggccaactctgtgaaaaagctgggttgtatattcgagcacttcagcactatactgagttgcctgatattaaacgtgttattgtgaacacacatgccattgagcctcaggctcttgtcgagttctttggtactctttctcgagaatgggctcttgactgtatgaaagatctacttcttgtcaacctgaggggcaaccttcagattattgtgcagactgccaaagaatactgtgagcaattgggtgtggatgcatgcataaagctctttgagcagtttaagtcatatgaaggactgtatttctttttgggttcatatttgagctctagtgaggatcctgaaatccacttcaagtacattgaagcagctgctaaaactgggcagattaaggaggtagaacgtgtgacacgtgaatcgaacttctatgatgctgaaaagacgaagaactttttaatggaagccaagcttcctgatgcacgtccactgatcaatgtctgtgatcgttttggttttgtcccagaccttacccactatctgtttgtcaacaatatgcttcgctatattgagggttatgttcaaaaggtcaatccaggaaatgctcctttagttgtaggacaactgcttgatgatgaatgtgctgaagatttcattaaaggccttattctgtctgttcgttctcttctgccagttgagcccttggtggaggagtgtgagaagaggaatcgtctccgcttgctcactcagttcttggagcatctagtcagtgagggaagccaagatgtgcatgttcacaatgctcttggtaaaatcattattgaaagtggtgacaatccagagcattttcttactaccaacccatattacgattcacgtgttgttggtaaatattgtgagaagcgcgatcccacccttgctgttgttgcctaccgaagaggacagtgtgatgatgaattaatcaatgtcacaaacaagaattcattgttcaaactgcaggccagatatgttgtagaacggatggatggtgatctctgggataaagcccttagtcctgataatgagtatagaaggcagttgattgatcaggttgtatcgactgctttgcctgaaagcaagagtcctgatcaagtttcagcagctgttaaagctttcatgacagccgatcttccacatgaactgatcgaacttcttgaaaagatagttcttcaaaattctgctttcagtgggaatttcaatctgcaaaacctgctcatcttgactgccatcaaggctgatccatcaagagttatggattacgttaataggctagacaactttgatggacctgcaattggggaggtggctgtggaagctcagttgtatgaagaagcatttgccattttcaagaagttcaatcttaatgttcaggccgtcaatgtcctgctggataatattcatagcattgatcgagctgtggagtttgcattccgggtggaagaagaagctgtctggagccaagtggccaaggcccaactgcgagaggggctagtaagtgaagcaattgagtcctttatccgtgcagatgatgctactcaattcttggaagtcataaaggcagctgaggatgcaaatgtatatcatgacttggtgaagtaccttctaatggtgaggcaaaagtcaaaggagcccaaggttgacagtgagctcatatatgcatatggtaaaattgatcaactgggtgaaattgaagaatttattctcatgcctaatgttgctaatctccaaaatgttggagatcgtttatatgacgaagccctgtatgaggcagcaaagattatatttagatttattagtaactgggctaagctagctgtcacacatgttaagctaaaagagtttcaaagtgctgttgacgcagctcgaaaagcaaacagctcgaaaacatggaaagaagtctgctttgcttgtgttgattctgaggaattccgcttggctcagatatgcggtctcaacattatcatacaggttgatgatttggaagaggtcagtgagtattaccagaacaggggatgctttagcgagctcatctctttaatggaaagtgggcttggtttggagcgtgcacatatgggcatcttcactgagttgggagttttatatgcgagataccgccctgagaagcttatggagcacatcaagttgttctcaactcgtctcaacatccccaagctaatacgtgcttgtgatgaacaacagcattggaaggaactgacatatttatacatccaatatgatgaatttgacaatgctgcaaccactataatgaaccactctccagaagcatgggaccacatgcaatttaaagatgttgtagtgaaagttgcaaatgttgagctctactacaaggctgtgcacttttatttgcaagagcatccagacctaatcaatgatcttcttaatgtgattgcacttcgtgttgaccatactcgagtagtggacataatgcgaaaggctggtcaactccgtctcattaagccatacatggttgctgttcagagcaacaatgtctctgctgtgaatgaagcattgaatgaaatttatattgaggaggaggactatgacagacttcatgaatctattgagttgcatgataactttgaccagataggccttgcacagaagattgagaaacatgagcttcttgagatgagacgtgttgcttctcatatatacaagaaagcaggaaggtggaagcagtcaattgctttgtcgaagaaagacaatctttacaaagattgtatggaaacttgttcacagtctggtgatcgtgaactttcagaggagttgcttgtctatttcatcgagcagggaaagaaagagtgctttgcagctgccctctttgtttgttatgatttgatccgaccagatgttgctatggagctggcatggatgaacaatatgattgattttgctttcccatatctcttgcagtttatccgtgagtacacaagcaaagtagatgagctcatcaagagcaaacttgaggctcttaatgaggcgaaggctaaagagaacgaggagaaggacatggttgctcagcagaatatgtatgcacagttgctgccccttgctttgcctgcaccaccaatgcctggaatgggtggtccagggatgagtggaggttttgcaccacctccaatgggtggaatgggaatgccaccttatggcatgccacccatgggcccctactaatcgggacgccaacctctgaaattatattctccagaattcattgtctgctactgaaggtgaattcagtcctttgcttccgggaggaaattgactgatactctgaactggtaccccgccattgcatttgctgtaatgtttatttctctcagaattctgtcgttaatagcagagcaagttttttctcaagtgaaggctgagccaagtgaataatatgttttcgacagatcgggttatgaaatttgttgtgattgtggcacttgaataggtgctttagttttatagctgtaataacattttgtttttgctaattgtcaaaggcacggtaattggattcacgtcagtgatttgaaattttgtaatcaccatgtttcttccatgtacaacagttaagtttatacttgaaaaatgatgttttccattgctgctggacttgtatctttcttgcaaagtaatttttatactcttgctatgtggcagtactgctgggtaatttt

SEQ ID NO: 5216 - DNA, 5440 bp, Eutrema parvulum
gttcactccctttctccttccatcacctttctcgttcacttgccgctcagatctggcagcgattttcaattccttctccactctctctcgtctcgcgtctctttctctctcttctggccgttgacggtctggtctcgtcccctgcccccggattctcttgccgtgcaatctgtagtcaatcatggcggcagcaaacgcccccatcactatgaaggaggtcctgacgctttcgagcgctgggatcaatcagcaattcatcacgtttacaaatgttactatggagtctgaaaagtatatatgtatacgagagacggcaccacaaaacagtgttgtaattatagacatgaacatgccgatgcagcctctaaggaggcctattactgcagattctgcgcttatgaacccaaactccaggatccttgccttaaaagctcaagttccagggactactcaggatcatctacagatatttaacatcgaagcaaaaacaaagctgaaatctcatcagatgcctgagcaggttgttttttggaagtggattacaccaaagatgttggggctggtcacacaaagttccgtgtatcattggtctattgaaggtgattctgagccagttaagatgtttgatagaacggccaatttggcaaacaatcaaattataaactacaagtgctctcctaatgagaagtggttgattttaattggaatcgctcctggctctccggagagagcacaattagtaaaaggaaatatgcagcttttttcggtggatcaacagcggagccaagcacttgaagcacatgctgcgtcatttgctcagtttaaggtccctgggaacgaaaatccttctattcttatatcctttgcaagcaagagctttaatgctgggcagataacatcaaagttgcatgtcattgagcttggtgcccaacccggaaaaccatcatttacaaaaaagcaggcagatctcttttttcccccagattttgctgatgattttcctgttgccatgcaggtctctcacaaatttagcttgatatatgtcatcaccaagcttggcttgttgtttgtatacgatctagagactgcttctgctgtctacagaaatcggataagtccagacccaattttcttgacttctgaagcctcctcagttgggggtttctatgccattaataggcgagggcaagttcttttggctacagtaaacgaggctaccataataccttttattagtggtcagttgaacaacttggagcttgctgtcaatcttgctaaaagaggaaaccttcctggtgcagaaaatctggttgtccagcggttccaagagcttttcgctcaaacgaagtaccaggaggctgctgagcttgctgctgaatctcctcagggaattctaaggacacctgatacagttgccaaattccagagtgttcctgtacaagctgggcaagctcctccattgttccagtattttgggactcttttaaatagagggaagctcaattcatatgagtcattggaactatctcggcttgttgtgaatcaaaacaagccgaaagtcctggaaggctggttaggagaagataagttagaatgcagtgaagaattaggagaccttgtcaagactgtggacagtgaccttgctctgaaaatctacatcaaagcccaggcaactccaaaggttgtagcagcttttgcagaaaaaggggagtttgacaaaatactgatttacgcacagaaggttgggtacacacctgattacctgtttcttctgcaaaccatactccgtacagatcctcagggagcagtaaattttgcattaatgatgtctcaaatggaaggaggttgtccacttgacttcaacactatcactgatctttttcttcagagaaatctgatccgagaagctactgcattccttttggatgtgctgaagccaaatttacctgagcacgcttttctgcaaacaaaggttctggagatcaatttggtaacctttcctaacgtggctgatgcgattttagcaaatgggatgttcagtcactatgaccggcctcgtattgctcaactttgtgaaaaggctggactttatatccaatccttaaagcattactcagagttacctgatataaaacgtgtaattgtgaacacacatgctattgagccacaggctcttgttgagtttttcgggactctctctagcgattgggctatggagtgcatgaaggatcttttgctggtcaacctgagaggcaacctgcagataatcgttcaggcttgcaaggagtactgcgagcaacttggtgttgatgcatgtattaagctgtttgagcagtttaaatcatacgaagggctatactttttcctaggctcatatttgagtatgagtgaggatcctgagattcacttcaagtacattgaagcagctgccaagactggtcaaataaaggaggttgagcgtgtgactagagagtctaacttctatgatgctgaaaagacgaagaactttttgatggaagctaagcttcctgatgcccgacctttgataaatgtctgtgaccgtttcggctttgtacctgatcttactcattacctatacacaaacaacatgcttcgttacatagaaggttacgttcagaaggtgaaccctgggaatgctcccttagttgtggggcagttgcttgatgatgaatgccctgaagattttataaaaggcctcattctctctgttcgttcgttgctacctgtggaaccccttgtcggggaatgcgagaagagaaatcgactccgtctcctcactcagttcttggagcatctagttagcgagggaagccaagatgtgcatgtccataatgccttgggtaaaattatcattgacagtaacaacaaccctgagcatttcctgaccaccaacccgtattatgactctcgggttgtgggtatgtactgcgagaaacgtgatcctaccgtggctgttgtggcatacagaagaggacagtgtgacgaggaactcgtcaatgtcaccaacaaaaactctttgttcaagttacaagctaggtatgtagtggagaggatggatggtgatctctgggataaggttcttgatgaaaagaatgattatagaaggcaacttattgaccaagttgtgtctactgctttacctgaaagcaagagcccagaggaagtttccgcagctgttaaagcattcatgactgctgatttgccgcacgagcttattgagcttcttgagaagattgtgcttcaaaactctgccttcagtggaaacttcaatctgcaaaatctgcttatattgacagctattaaggcagatccatctagagttatggattacattaacaggctggacaactttgatggacctgctgttggagaagtggcagttgaagcccaattgtatgaggaagcatttgctattttcaagaagtttaacttaaatgttcaggctgtcaacgtattgctggataacgtcaaaagcattgagcgtgctgttgagttttctttccgggtagaagaagatgctgtttggacccaagttgcaaaggctcaactcagagaaggactagtcagtgatgcaattgagtccttcatccgtgctgatgatgccactcatttcttggaggttatacgtgctactgaagatgctaatgtctacgatgacttggtcagataccttttgatggttagacagaaggtgaaggaacccaaggttgatagtgagctcatctatgcatatgcaaagatcgatagcttagttgagattgaagaattcattctgatgccaaacgttgctaacctacaaaatgttggtgatcgtctgtatgatgaagctttgtatgaggctgcaaaaattatctatgcgttcatatcaaactgggccaagttagctgtgacgcttgtgaagttgcaacagttccaaggtgctgttgatgctgcaaggaaagcaaacagtgcaaagacatggaaggaagtctgctttgcttgtgttgatgcagaggaattccggttggcccaaatctgtggccttaacattatcattcaggtggatgacctggaagaagtcagcgagttttaccaaaacagagggcgcttcaatgaattaatctcgcttatggagagtggacttgggctggaacgtgcccacatgggtatcttcactgagttgggtgtactctatgctagatatcgttatgagaaacttatggaacacatcaagctattctccactcgcctcaatattcccaagcttatacgggcctgtgatgaacaacagcactggccggaacttacctatctctacattcaatatgatgagtttgataacgctgcaacaactgtcatgaaccattctcctcaagcatgggagcacatgcaattcaaagacattgttgccaaggttgcaaatgtcgagctgtactacaaggctgtgcacttctacttacaagagcatccggatctaatcaacgatcttctcaacgtgcttgctttgcggttagatcacacgcgtgttgttgatattatgcagaaggctggtcagttgcgtcttatcaagccatacatggttgcagttcagagcaacaatgtctctgctgttaatgaagctctgaatgagatatacgtggaagaagaggactatgacaggttgcgcgagtctattgatttacatgacagcttcgaccagatagggcttgctcagaagatcgagaaacacgagcttgttgaaatgagacgcgtggctgcttatatctataagaaagcaggtagatggaagcaatcaattgctttgtcaaagaaagatagcatgtacaaagactgtatggaaactgcttcgcaatccggcgaccatgaccttgcagaacaacttctggtttacttcattgaacaggggaaaaaggaatgctttgcttcatgtctctttgtatgttatgatttaatccgaccagacgttgctctagaacttgcctggatcaacaatatgatcgactttgctttcccgtatctgctccagtttatccgagaatacacgggcaaagtagatgagataatcaaggacaagctggaggcacaaaaagaggtgaaggccaaagagcaggaagagaaggatgtcatgtcacaacagaacatgtacgcccaattattgccactcgctttgcccgcaccaccgatgccaggaattggaggtggtggtggatatggtccgccaccaccaacgggcggaatgcccggaatgcctggaatgcctcccatgccaccatttggaatgccaccaatgggtggctactaagacactacacatcaaattatgttttagttcgaaagttagccgctacaggttatcagaaagccataagagtcagcccaattttccgaagcggtgttcttctgcttcatgtctcttaacagaatttgactggtgaatgaa

SEQ ID NO: 5217 - DNA, 5163 bp, Eutrema halophilum
acctccattaccaccatggctgctgcaaacgctccgatcaacatgaaggagatcctaacgcttacgagcgttgggatcaatccgcaatccattaactttacgagtgtcacaatggagtcggacaagtacatttgtgtgagagaaacagcgccacagaacagtgttgtgattatagacatgagtatgcctacgcagcctttgaggagacccatcactgcagattctgctctaatgaatcccaatacaaggattcttgcgttgaaagctcaactacaaggaaccactcaggatcatctgcaaatattcaacattgaggctaaatcgaaaataaaatcacatcagatgcctgagcaggtcgtcttttggaagtggatttccccaaagatgttgggtttggtcacacaaacctctgtatatcactggtcgattgagggtgattctgcacctgttaagctgtttgataggacagcgaacttggcaaataatcagattataaactataaatgtgatccctcggaaaagtggctagttttgatcggaattgcccctggtgcacctgagagaccgcaattggtgaaagggaatatgcagcttttttctgtggatcagcagcgtagtcaagctcttgaagctcatgctgcttcatttgctcaatttaaggtccctggaaatgaaaatccttctacccttatctcatttgcaaccaagagtgtaaatgctgggcagatcacatctaagcttcatgtgattgagcttggtgcccaaccaggtaaaccatcttttagcaagaagcaagcagatctctttttccctccagattttcaagatgatttcccagttgctatgcaggtgtctcataaatacggtttgatatatgtcatcaccaagcttgggctactatttgtgtacgatctggagacagcgactgctgtgtacagaaatcggataagtccagatcccatatttttaacttctgaagcccagtcagttgggggtttttatgcaatcaataggagggggcaagttcttcttggaaccgtaaatgatgcaactatagtgccttttgttagtggccagctgaacaatttagagctcgctgtcagtcttgcgaaaagaggaaaccttcctggagcagaaaacttggttgtccaacgttttcaagagctttttgcgcaaacaaagtataaagaggctgctgagcttgctgcagaatctcctcagggaatccttcgaacacctgatacagttgctaaatttcagagtgttcctgttcaagctgggcaaacccctccgctgctacagtacttcgggacccttttaactaaagggaagcttaatgagtttgagtccttggagcttgctcgccttgttgtgaatcagaataaaaagaatcttctggaaaattggttggcagaggacaaattggaatgcagtgagacgctaggagaccttgtgaagactgtggacaatgatcttgcactgaaaatatacattaaagcgaaggtgacccccaaagttgttgctgcctttgcagaaaggagggagtttgacaaaattttaatctactcgaagcaggttgggtacacgcctgactacctatttctcttgcaaaccattcttcgaacagatcctcagggggctgtgaattttgctttaatgatgtcccaaatggagggaggatgcccagttgattataataccatcacagatctctttcttcagaggaacttgattagagaagccacagcatttttattggatgttctgaaaccaaatttacctgagcatggatttcttcagacaaaggtgctcgagatcaatttggtaacgtttcccaatgtggctgatgcaattcttgccaatgggatgttcactcactatgatcgtccgcgtattgctcaactctgtgaaaaagctgggctgttcattcaatctcttaagcactactcggagttgccagacatcaagcgtgttattgttaatacccatgcaattgaaccacaggctcttgtggatttttttggtaccctttcttgtgaatgggctttggagtgtatgagggaccttttgctggtcaatcttagaggaaatctgcagataattgtgcagacttgcaaagaatactgtgagcagttgggagtggattcatgtatcaaaattttcgagcaattcaagtcatatgaagggctgtactttttcttgggttcatatctcagtatgagtgaggatcctgagattcacttcaagtacattgaggctgctgcaaaaactggccagataaaagaagtggagcgtgtgacgagagaatccaatttctatgaccctgaaaaaactaagaactttctgatggaagctaaacttcctgacgctcgtccgctgatcaatgtttgtgatcgctttgggtttgtcccagatctcactcattacctctacaccagcaacatgcttcgttatattgaaggttatgtgcagaaggtgaatcctagcaatgcccccttagtcgtggggcaattgttggatgatgaatgcccagaggatttcatcaaaggtctcatcctttctgttcgttccttacttccagttgaacctcttgtcgaggagtgtgagaagagaaaccgacttcgccttctcactcagttcctcgagcatctggttagtgaaggaagtcaagatgtgcatgtccacaatgccctgggtaaaattataattgacagcaacaataatccagagcacttcctgactaccaacccttactatgactcccgagttgttggtaagtactgcgagaagcgggatcccacccttgcagttgtggcttaccaaagaggacagtgtgatgatgagctcatcaatgtcacaaataagaactcattgtttaaattgcaagctaggtatgttgttgaaaggatggatgaaaatctctgggataaggttcttatttctgaaaatgaatatcgaaggcagcttattgatcaggttgtatcaactgctttaccggaaagcaagagccctgaacaagtatcagctgctgttaaagctttcatgacagcagatctacctcatgagctcattgagcttctcgaaaagattgtgcttcagaactcagcttttagcgggaactccaaccttcaaaatctgctaattttgacagctatcaaggcagatccgtcaagagtcatggactatgttaacagattggataattttgatggacctgctgttggggaagtggctgtggaagcccagttgtatgaggaaggattttctattttcaagaaatttaatttgaatgttcaagccgttaatgtgctactagacaacattagaagtatcgagcgagctgttgagtttgcattccgtgtcgaagaggatacagtttggagtcaggttgctaaggcgcaacttagggaaggacttgttagtgatgcaatagagtcatttatccgtgctgatgatgccactcagttccttgatgttatccgtgctgctgaggatggggatgtttaccatgatttagttagataccttctgatggttaggcagaaagtaaaggagcccaaggttgacaatgaactgatatacacttatgcaaagattgacaggttgggtgacattgaagagtttattctgatgccgaatgtggcaaatttgcaaactgccggtgatcgtttatatgatgaagccatgtatgaggctgcaaagataatttatgcatttatatctaactgggccaagttagcagtcacacttgtgaagttgaaacagttccaaggtgctgttgatgcagcaaggaaagctaacagtgcaaagacgtggaaagaagtttgctttgcttgcgttgatgctgaagagttccgcttagcacagatatgcgggcttaacatcattatacaggttgatgatttggaagaggtcagcgagtattaccagaaccgtggatgcttcaatgaattaatatctctaatggagagtggtttaggattggaacgcgcacacatgggcatctttactgagttgggagttctctatgctagataccgtccagagaaattgatggagcatatcaagctcttttcaacaagacttaacattcccaagcttatccgagcttgtgatgagcaacaacactggaaggaacttgtctacttatacatccagtatgatgaatttgataatgctgcgaccactgtaatgaaccactccccggaagcttgggatcatatgcagttcaaagatattgttgccaaagttgccaatgtggagctatattacaaagcagtgcacttctacttgcaagaacacccagacatcattaacgacgttctcaatgtccttgcactaaggctggatcattcccgtgttgttgacattatgcgcaaggctggacaactgcttcttatcaagccctacatggtcgctgttcagagcaacaatgtttccgctgtaaatgaagcgttgaaccagatttatgtagaagaggaagattacgacaggttgcgtgaatccactgatttgcatgatagctttgaccaaataggtcttgctcagaagattgagaaacatgaactactcgagatgagacgtgtatcggcttacatctacaaaaaggctggaaggtggaagcaatccattgcattgtcgaaaaaagataagctatacaaggactgcatggaaacggcttcacagtctggagaccgtgaactagcagaggagttgcttgtttatttcatagaacagggaaagaaggaatgttttgcaacatgtctatttgtatgctacgacttaatccgaccagatgttgcccttgagttagcttggatcaacaaaatgatcgactttgccatgccctacctcttgcagtttatgcgcgaatacaccggaaaagtcgacgaactcataaaagacaagatagaagcacagaaagaagtgaaggctaaagagcaagaggacaaggaggttatgtcgcaacagaacatgtatgctcagttgctgccactggctttgcctgcaccgccagtgccgggagtgagcggaagctactctgcgccgccaccaccaggaatgagcggaggctactctgagccaccaccgggaatggtgggaatgcctccgatgccaccatatggcatgccaccaatgggaggaggctactgaccaacttaa

SEQ ID NO: 5218 - DNA, 5564 bp, Glycine max
ctctggttcatgcgcaatggctgcgaacgcccctatcaccatgaaagagaccttaacgctgggaagcgttggaatcaaccagcaattcattacatttactcatgtgacaatggaatcggataagtacatttgtgtcagggaaactggacctcagaacagtgttgtcatcattgacatgagcatgccaatgcagcctttgagacggcccataactgccgattcggctttgatgaaccccaattctagaattcttgctctcaaagcccaagtgccgggaaccactcaggatcatttgcaagtttttaacattgaaacgaaagcaaagatgaaatcgcatcagatgaaagaacaggttgtcttttggaagtggataactccaaatacactgggaattgtcactcagacgtctgtatatcattggtcagttgagggcgatggtgaaccaatgaagatgtttgatcgaacagctaatctggctaataaccaaataattaattatcgttgtgatcctaatgaaaagtggttggttttgattggaattgctcctggttcagcagagagaccacaactagtaaaaggaaacatgcaactcttctctgtggatcagcaacgtagtcaggctcttgaagcacatgctgcctcgtttgctacatttagagtggctgggaatgataaggaatctactcttatttgttttgcatcaaagagtttgaatgctggacaggttacatcaaagatgcatgtcattgaacttggtgcccagccaggcaaaccatcatttactaagaaacaagcagatctgttcttccctccagactttgctgatgactttcctgtgtcaatgcagatttcaaataaatatggattgatttatgtcatcacaaagcttgggctgttatttgtctatgatctggagacttcaactgcagtttatagaaaccgaatcagttccgatcctatatttttgaccacagaagcactttcagtagggggattttatgccatcaatagacgtggccaggtgttgcttgctactataaatgaggcagccattgtaccttttgttagtggccagctaaataatttggaacttgctgttaatctggctaaaagaggaaacctccctggtgcagaagaattggttgtcaagcggtttcaagaattattttctcagaccaagtataaggaggctgcggagctcgctgcagaatctccacgaggaattcttcgaactcctgacactgttgctaaatttcagagtgtacctgtgcaagctgggcagacgccaccactgttgcagtactttggtactctgttaaccaggggaaaactcaattcttatgagtcattggaactgtcacggcttgtggtaaatcaaaacaaaaagaatcttttggaaaattggctagcagaggacaaacttgaatgcagtgaggagcttggtgaccttgtgaagacagtggataatgacctcgcattgaaaatatttatcaaagccagagccacaccgaaagttgttgcagcatttgctgagaggagggaatttgacaagattctgatatactcaaagcaggttggatacacgcctgattacatgttccttctgcaaacaatattacgggcagatgcccagggtgctgtaaattttgctctgatgatgtctcaaatggaggggggttgccctgttgactacaacacaataactgatctctttcttcagaggaatttaatccgcgaggcaactgcctttttattggatgtgctgaagtcaaacctaccagaacatggatatcttcaaacaaaggtactggaaattaatcttgtgacctttccaaatgttgctgatgctatattggccaatggcatgtttagtcattatgaccgtccacggattgctcagctttgtgaaaaggctggccttttcattcgggctcttcagcattattccgaattgcctgacatcaaacgtgtcattgtgaatacacatgccatcgaaccacaggctctagttgagttctttggaactctttcaaaagaatgggcgctagagtgcatgaaagatcttttactggtcaaccttaggggcaaccttcaaataattgtgcagactgccaaggaatattgtgaacagctcggtgtagatgcatgcattaaactctttgagcaattcaagtcctatgaaggactatactttttcttgggtgcatatttgagctctagcgaggatcctgatattcacttcaagtatatcgaagcagctgctaaaactggacaaattaaggaggtggagcgtgttactcgggaatcaaacttttatgatgctgagaagacgaagaactttctaatggagaccaagcttccagatgcacggccattaataaacgtgtgtgatcgttttggttttgttccagatctcacccattatctctacaccagcaacatgctgcgttatattgagggatatgttcaaaaggtgaatccaggaaatgctcctctagttgtaggacagttgttagatgatgaatgccctgaggatttcattaaaggtcttattctttcagttcgttctcttcttccagttgagcctttagttgaagaatgtgagaagagaaatcgtctccgcttgcttactcagtttttggagcatcttgtaagtgagggaagccaggatgtgcatgtgcataatgctctgggtaaaattatcattgacagtaataacaatcctgagcattttcttacaaccaacccatattatgattctcgtgttgttggtaaatattgtgagaagcgggatcctacacttgctgttgttgcttaccgaagggggcaatgtgatgatgagcttgttaatgtttccaataaaaattccttgttcaaactccaagccagatatgttgtggaacgtatgaatgctgacctctgggagaaagttcttaatcccgagaatgagtttagaagacagttgattgatcaagtggtgtccactgctttgcctgaaagccagagtcctgatcaagtttccgctgcagtgaaagcttttatgactgctgatcttccccatgagttgattgagcttcttgaaaagattgtgctacaaaattctgctttcagcggaaactttaatctacaaaatttgttgatcctcactgcaatcaaggcagatccctcaagagtcatggattacattaataggctggacaactttgatggccctgctgttggggaggtggcagtagaagcaaacctatatgaagaagcttttgccattttcaaaaaatttaatttgaatgttcaagctgttaatgtcctactagataaccttcggaccattgatcgagctgtggagtttgcattccgggttgaagaagatgctgtctggagccaagtggctaaggcacaactaagagaaggcttagtaagtgatgcaattgagtcattcatccgtgcagatgattccactcacttcttagaggttataaaagcttctgaagatgcagaagtataccatgacctagtaaggtaccttcttatggttaggcagaataccaaagagcccaaggtggacagtgagctcatatatgcatatgcaaagattgacaggcttggagaaattgaagagtttatattgatgccaaatgttgctaatttaccaaatgttggagaccgtttgtatgatgaggctctctatgaggctgcaaaaattatatttgcttttatttcaaactgggctaagttagcagtgacattggtgaagcttaaacaattccaaggtgctgttgatgctgctaggaaagcaaacagttcaaaaacatggaaggaagtttgttttgcttgtgttgatgctgaggaattccgattggctcagatttgtggtctcaatgtcatcattcaggtggatgatttggaagaggttagtgagttttaccagaacagaggatgctttaatgaactgatatctctaatggagagtggacttggactggagcgtgcccatatgggtatctttactgagttgggagttctttatgcaagatatcgtcctgagaagttaatggagcacattaagttattctcaactcggcttaacattcccaagcttattcgagcctgtgatgagcagcagcattggatggaacttacatacttatacatccaatatgatgagtttgataatgctgcaaccactgtaatgaatcactctcctgaagcatgggaccacatgcaattcaaagatattatagttaaggttgcaagtgtggagctctactataaggctgttcacttctacttgcaagaacatcctgatattttaaatgatcttcttaatgtacttgccctacgtgtggaccacacccgtgttgtggatataatgcggaaggctggccacattcgattggttaagccgtacttgattgcagttcaaagcaataatgtgtctgctgttaatgaagctttgaatgaaatttatgttgaggaggaggactatgatagacttcatgaatcaatagatctgcatgacaacttcgatcagataggtcttgcacagaagattgagaagcatgagcttcttgagatgaggcgtgtcgctgcttatatttacaagaaagctggaagatggaagcagtccattgctttgtcaaaaaaagacaatctttacaaggactgtatggaaacttgctctcaatctggtgaccgtgaactctcagaggatttgcttgtttactttattgagcaggggaagaaggaatgttttgcatcttgcctcttcgtctgttatgatataatacggccagatgttgctcttgagctagcttggatgaacaatatgattgattttgctttcccatacctcttacagtttattcgagagtatactggtaaagttgatgagcttatcaaggacaaaattgaagcacagaaagaggagaaagctaaagagaaggaagagaaggatgttattgctcagcagaatatgtatgcccagttactaccacttgctttgcctgcaccaccaatgccaggtatgggtggaggaggctatgctccactgacaacaccccctatgggtggtatggggatgcctccgatgccaccttttggaatgcctccaatgggcggcagcagcggctcctactgatctctccattcaagacaggagaaaattttgctataaattttatcggagaagctaggtacattgttttgaatccacaagcattgaagatgagttcctcagctttaaggaatttaacatgatgaatgtaagcatctaccttagccttctgacgactgtggcttttttgcatggaaagtttttaggttcttatttcttttgtcaattgctgaatagattgggttgtctgatcaattctgtgagatgattgaatcttcagaggctttagttcggttgttgatgtatagttgattctttctctcctataattgttttcttagttatgtagtcatgtaaatgtattctgattaggatttaacacaaattttgttcggttaatttggtgtataaaaatattcatcaactattagaaatggtctctttatgtagc

SEQ ID NO: 5219 - DNA, 5758 bp, Podocarpus macrophillus
ggcagaagcggtgttctcctcttcagccctcgcgagggttgcaaagcataagttcacttcggcttagatctcagatttaattaccttgagttctaatcaagggtcgtgtttgtgttcctcgagtttttgcggtcatttatagctaagcattgccggagttcgtggagtatcaaggattatttaagggatcgagcagattgatgatttttgttgtgtgaataagtatttggtgcataattgtattgagtcgatcagagatagggttaggggttttgtgaatccagaaatttacttggcagtctaaggtttttttaagttctttcggggttaggcaccatggctgcagcaagtgcaccgatctctatgaaggagtctctcactctgacgagccttgggataaatccacaatttattacattcactcatgtcaccatggagtcggacaagtacatctgtgtgcgggaaactgcacctcaaaacagtgttgtaatcattgacgtgaataaccctgtgccagtgatgaggagacctataacagcagactcagctttaatgaatcccaacagtagaattcttgctttgaaagctcaaatcccggggaccactcaggaccacctgcaaatatttaatattgagatgaaagcaaaagttaagtcacatcaaatgccagaacaggttgtcttttggaagtggatcacaccaaaaatgttgggacttgtcacacagacttcggtgtatcattggtccttggaaggggattctgagcccatcaaaatgtttgagcgaactgccaacttaactggtaatcagataataaactatcgatgtgatcctactgagaagtggcttgttctgattggaattgctcctggagctcctgagaggccacaacttgtcaaagggaacatgcagttgtttcagtagatcagcagcgcagtcaagctctagaagcgcatgctgctgcatttgctacatttaaggttgcggggaatgaaaatccttctatcctaatctcttttgcttcaaaaacaatcactggagggcagcttacatcaaagctacatgtaattgagcttggtgcacagccaggcaaacctggattttcaaagaaacaagcagatctttttttcccaccagattttgcagacgatttccctgtttccatgcagatatcacacaagtatagtctgatatatgtcatcacaaagctgggacttctatttgtttatgatttagaaactgctacagcagtttacagaaatcgtatcagtcctgatccgattttcttaacatctgaagcaacatcagttggagggttttatgctgtgaatcggagagggcaagtcctgctggcaactgtcaatgaagcaactattgttccttttgttagtgggcagcttaataatcttgaacttgctgtgaatcttgctaaaagaggaaaccttcctggagctgaaaatctggttgtccagcgtttccaggagttgttttctcagatgaagtataaagaagctgcagagcttgctgcagagtctccccaaggaattcttcgtacaccagagactgtagtaaagtttcagagcgttcctgtacaacctggacaaacaccacctcttctccagtattttggtactttacttactaaaggaaagttgaatgcatttgaatctcttgaactttcaagattagttgttaatcagaacaagaaaaatcttttggagaactggcttgcggaggacaagctggagtgcagtgaggagttgggggatttggtgaagactgttgacaatgatctcgcattgaaaatttacataaaagcaagggctacccccaaagtggttgcagcttttgctgagagaagggagtttgacaaaatacttatatattcaaaacaggttgggtacacacctgattacctattccttcttcagacaatcttgcgctccgatcctcagggtgctgtaaactttgctttaatgatgtctcaaatggaaggtggttgtccagttgactacaatactattacagatctttttcttcagcgtaacatgatccgtgaagcgacctcatttttattggatgttttgaagcctaatttgccagaacatgcccatcttcaaactaaagttcttgagattaacctggtcactttcccgaatgtggctgatgcaattctggcaaatggaattttcagtcactatgatcgtcctcggattgcacaattatgtgaaaaagctggattatatatgcgtgcacttcagcattatacagagttacctgatatcaagcgagtcattgtcaatactcatgccattgagccacaggcactcgtggagttctttggcaccctttcaagagaatgggcactggagtgcatgaaagatttacttcttgtcaacctgagaggaaatcttcaaataattgtacagactgctaaagaatattctgatcaactgggtgcggattcatgcatcaaactctttgagcagttcaagtcttatgaagggctctatttcttcttgggttcatacttaagctccagtgaggatccagaaattcactttaaatacattgaggcagctgctaaaactggacaaatcaaggaggtggaacgtgtaactagagagtcaaacttctatgatcctgaaaagacaaaaaatttccttatggaagctagacttccagatgctcgtccccttataaatgtttgtgatcgatttggatttgttccagatcttactcattacttatattcaaacaatatgctgcgatacattgaaggttatgtccagaaggtaaatccaagcaatgctcctttagttgttggtcagctacttgatgatgattgtccagaggacttcattaaaggtcttattctatctgttcgttctctccttccggttgaaccacttgttgaagaatgcgagaaaaggaatcggcttcggttgctgacgcaattcttagagcatcttgtgagtgaaggaagtcaagatgtacatgtacacaatgcattgggtaaaatcattatcgatacaaataataatccagagcatttccttacaacaaatccatactatgactcccgtgtggtgggtaaatactgtgagaaaagggacccaacattggcagttgttgcatataggcggggacaatgtgacgatgaacttattaacgtcactaataaaaattctcttttcaaactccaagcgaggtatgtggttgagcggatggagcctgagctttgggaaaaggttctcaacccagaaaatcctttccgaaggcagctcattgatcaagttgtatcaactgccttaccggaaagcaagaacccagatcaggtgtcagcaacagttaaagcttttatgactgctgacctcccgcatgagttaattgaacttctggagaagatcgtccttcaaaattctgcattcagtggaaatcccaatttacaaaaccttctgattctgacagctatcaaggctgataagtcacgtgtaatggactatattaatagattggacaattttgatggccctgcagttggagagattgctgttggagctgagttatatgaagaggcttttgccatctttaagaagtttaacttaaatgtacaagctgtgaatgtactgttggataacatcagaagtattgagcgggctgttgagtttgcgtcacgtgttgaggaggatgcagtttggagtcaggtagctaaggcccaacttagagagggattggtcagtgatgctatcgaatcattcattcgtgctgatgatgctacacaattcttagatgtgatacgggcagctgaacaaatggaagtgtatcatgacttagtgaagtatttgctcatggtacggaggaaggttaaagagccaaaggtggacagtgagcttatctatgcatatgctaagattgacaggcttggtgaaatagaagaattcatacttacaccaaatgttgccaatctgcaaagtgttggagaccgcctatttgatgaagccctctatgaggctgcaaaaataattttcactttcatttcaaactgggcaaaacttgcaagtacacttgtcaagcttaaacagttccaaggtgcagttgatgctgctcgcaaggccaacagctcaagaacatggaaggaagtctgttttgcctgtgttgatgctgaagagtttaggctggcccaaatatgtggtctgaacatcattgtgcaggtggacgacttggaggaggtcagtgattactaccagaatagaggccgctttgatgaactcatttctctgatggaaagtggtttgggattggaacgtgcacatatgggcatctttacagagctgggtatcctatatgctagatatcgcccagagaaacttatggaacatattaaattgttttcaacacggctcaacattccaaaacttatccgtgtttgtgatgagcagcagcactggaaagaacttacgtatttgtatattcagtatgatgaatttgacaatgctgcgacaacaatcatgaaccactctcctgaagcatgggatcatatgcaatttaaagatgttgttgttaaagtggcgaatgtggaattatactacaaggctgtccacttttatttacaagaacatcctgaccttatcaatgatctcctcaatgtccttgctcttagggttgatcatgcacgagtggttgacattatgcgcaaggctgggcaccttctccttgtcaaaccatacatgattggagtacaaagtaataacgtcgcagctgtaaatgaagctttgaatgagatctatgtggaagaggaagattatgaaaggcttcgggaatcaatagatttgcatgataactttgatcagataggactcgcacagaaggttgagaagcatgaattacttgaacttcgccgtattgctgcatacatctacaagaaagcagggagatggaggcaatctgttgcattgtccaaaaaggataatctttacaaggatgcaatggagactgcttcgcaatctggtgatcgtgaacttgccgaggaattgcttgtatattttgtggaacagggcaagaaagaatgctttgcttcatgtttgttcacatgctatgatttgatcaggccagatgtggccttggaacttgcctggatgaataatatgattgactttgcatttccgtacatacttcagttcattagagagtacacaacaaaggtggatgaacttgtcaaggataagttagaagctcttcaagaagtgaaatccaaggagaaagaagagaaagatatggttgcccaacagaatatgtatgctcagcttctaccccttgctttgccagcacctccaatgcctggcatgggtgcaggaatgggaactggcttccaaccgacagctatgcctggaatgggaatgccgcccatggcaccttatggtatgccaccaatgggtggctattaattggtgctgagaccttggaaggcagtgcatttgcttctactagcccatgcattttacgaggcttgtattggatctttagctagagagtacttttggggatggtttgccatctcaaatgtcatagtttggcagataatattgccaatttgtaggactcatgttcagtatgattttgtagattgggctgattaggtgagcggattttttgctatgatctcgtatgggccattttctgaatgccatttttgtttcttgtctggttaatattctttaattgacattattctttaatgcgaaatgtggacttttgt

SEQ ID NO: 5220 - DNA, 5707 bp, Taxus baccata
gcgagggttgcaagatctgagaagactgcgattttagttcattaaaatcacttgtttttcattgaatttgcatgccggctttgggctcttcggattgttgcgattttttttgagctcggcattgcatgatttttgaggagtattcaggagtttttcgggctttatagaacagatcgattgttttgactgctttaatctgtaattagcttcgacggatcagaattagggttttgtagttcaataaattgtaaggctgcggtaaagcgggttttaatcgtttcggcagtcatggctgcagccagcgcaccgatcactatgaaggaggctctaacgttgccgagccttgggataaatccgcagttcattacattcactcatgtcactatggaatcagacaagtacatctgtgtacgtgaaactgctcctgcaaatagtgttgtgatcattgacacgaacaatcctgtgccggtgatgaggagacctattacagcagattcagctctaatgaatcccaacagtagaattcttgctttgaaagcccaaataccaggcaccactcaggatcatctgcaaatatttaacatagagatgaaagcgaaagtaaaatcataccagatgccagaacaggttgtcttttggaagtggatcacaccaaagatgttgggacttgttactcagagttcagtgtatcattggtccttggaaggggattctgagcctgtcagaatgtttgagcgaacgggcaatttaactggaaaccagataataaattatcgatgcgatcctactgagaagtggcttgttttgattggaattgctccaggagcaccggagaggccacaacttgttaaagggaacatgcagttgttttctgtagatcaacagcgcagtcaggctctagaagctcatgctgctgcttttgcatcatttaaggttgcaggcaatgaaatccttcgattcttatttccttcgcttcaaaaacaattaccggagggcagcttacttcaaagctacatgtgattgagcttggtgcacagccaggtaagcctgggttctcaaagaaacaagcagatctttttttcccgccagattttcaagatgattttccagtatccatgcagatatcacacaagtatagtctgatatatgtcatcacaaagctgggacttctttttgtttatgatttagaaacagccacagcagtttacagaaatcgtatcagtccagatccaatatttttaacttctgaagcgacagcagctggtgggttctatgctgttaatcggagagggcaagtgttgcttgcaactgtcaatgaagctactattgtgccgtttgttagtgggcagctcaataacttggagcttgctgtgaatctggctaaaagaggaaacctccctggagctgaaaatctagttgtccagcgtttccaagagttgttttcacagatgaagtataaagaagctgcagaacttgctgcagagtctcctcaaggcattctccgtacgccagatactgtagcaaagttccagagtgttccagtacagccaggtcaaacaccaccgcttctccagtattttggtactctattgacaaaaggaaagttgaatgcatttgagtctctagaactttcacgactagttgtgaatcagaataaaaagaatcttttggagaattggcttgccgaggacaagttggagtgtagtgaggaactgggagatcttgtgaagactgtggacaacgaccttgctttaaaaatttacataaaagcaagggctacgcccaaagttgttgctgcctttgccgagagaagggaatttgacaaaatacttatttactctaaacaggttgggtacactcctgattacttattcctccttcagacaattttgcgctctgatccccagggtgctgtaaactttgcactaatgatgtctcaaatggagggtggttgtccagttgactacaatgttatcacagatctctttcttcagcgtaacatgatccgtgaagctacctcctttttgttggatgttttgaagcctaatttgccagaacacgcccatcttcaaaccaaggttcttgagataaatctggtcactttcccaaatgtggctgatgctatcttggcaaatggaattttcagtcactatgatcgtccacgtattgcacaattgtgcgagaaagctggcttgtatatgcgtgcacttcagcactatacagagttgcctgatatcaagcgtgtcattgtcaacactcatgctattgagccacaggcacttgtggagttctttggtaccctttcaagagagtgggcattggagtgcatgaaagatctccttctcgtgaacctgaggggaaatctccaaataattgtacaggccgctaaggaatattctgaacaattaggcgcggattcgtgcattaaattgtttgagcagttcaagtcatatgaagggctttatttcttcttgggctcgtatttgagctccagtgaggatcctgacatccacttcaaatacattgaagcagcagccaaaactggacaaatcaaagaggtggaacgtgtaacgagagagtcaaatttctatgatgctgaaaagacaaagaactttctcatggaagcaaaacttccagatgctcgtccactgataaatgtttgtgatcgatttggattcgtaccagatcttacccattacttatatacaaacaatatgctgcgatacattgaaggttatgtgcaaaaggtaaatccaagcaatgctcctttagttgttggtcagctgcttgatgatgattgtccagaggacttcatcaaaggtcttatactgtctgttcgttctcttctacctgtcgaaccacttgttgaagaatgtgagaaaaggaatcggcttcgattgctgacgcaatttttagaacatcttgtgagtgaaggaagtcaagatgtacatgtacacaatgcactgggtaaaattattattgatacaaataataatccagagcattttctcactacaaatccctactatgactctcgtgtggtgggtaaatactgtgagaaaagggatccaactctggcagtcgttgcttacaggcggggacaatgtgatgaagaacttattaatgttaccaataaaaattctctgttcaagctccaagccagatatgttgttgagcggatggaacctgagctttgggaaatagttcttaatccagaaaatcctttccggagacaacttattgatcaagttgtatcaactgctttacctgaaagcaagaatccagatcaggtgtctgcaacagtgaaagcatttatgactgctgacctgccacatgagctgattgagcttctagagaagattgtactacaaaattctgcattcagtggaaatcctaatctgcaaaatcttctcattcttactgctatcaaggctgataaatcacgtgttatggactacattaatagattggacaactttgatggccctgcagttggggagattgctgttggagctgagttatacgaggaggcctttgccatctttaagaagttcaacttgaatgtacaagctgtaaatgtcctattagataacattcgaagcattgagcgggctgttgagtttgcctcacgtgttgacgaggatgcagtctggagtcaagtggcaaaggcacaacttagggagggactggtcagtgatgctattgaatcatttattcgtgctgatgatgctacacagttccttgatgtgataagggcagctgagctatcgagtgtgtatcatgacctagtcaagtacttgctgatggtaaggagtaagattaaagagccaaaggttgacagtgagcttatctatgcatatgctaagattgacaggcttggtgaaattgaagaatttatactgtcaccaaatgttgctaatcttcaaagtgtgggagaccgtctatttgatgaagctctttatgaggctgcaaagataatatttacttttatttccaactgggctaaacttgctagcacactcgtcaaacttggccagttccaaggagcagttgatgctgctcgcaaggcaaacagttcaaagacatggaaggaagtatgttttgcttgtgttgatgccgaggagtttaggctggctcaaatatgtggcttgaacattattgtacaggtggatgatttggaagaggtcagtgattactaccaaaacaggggtcgctttgatgaactgatatctttgatggaaagcggcttgggattagagcgtgcacatatgggcatctttacagagttgggcatcctctatgctagatatcgtccagacaagctcatggaacatataaaattattttcaacacgactcaacattcccaagcttatccgggtttgtgatgagcagcagcactggaaggagcttacatatttatacattcagtatgatgaatatgacaatgctgcaaccacaataatgaaccattctccggaagcatgggatcatatgcaattcaaagatgttgttgttaaagtggccaatgttgagttgtactacaaggcggttcacttttatctgcaagaacacccagaccttattaatgacctcctgaatgtccttgctcttagagtggatcacacacgtgtggttgacattatgcgtaaggccgggcatcttcatcttataaagccatacatgattgcagtacagagtaacaatgtggctgctgttaatgaggctttgaacggaatttacgtagaggaggaagattatgacaggcttcgagaatctatagatatgcacgataattttgatcagatagggcttgcccagaaagttgagaaacatgaacttcttgaattccgacgtattgctgctttcatttacaagaaagcagggagatggaggcagtctgttgcactgtctaaaaaggataatctatacaaggatgcaatggaaactagttctcaatcaggtgatcgtgaacttgcagaggaattgctcgtgtattttgtggaacagggcaagaaggaatgctttgcatcatgcttgttcacatgctatgacttaatcaggccagatgtggccttggaacttgcttggatgaataatatgattgactttgcattcccatacctacttcagttcattagagagtacactacaaaagtggacgaacttgtcaaggataagttagaggctcttcaagaagagaaatccaaggagcgagaagagaaagatcttgttgcccaacagaatatgtatgcccagcttcttcctcttgctctgccagcacctccaatgcctggcatgggaggtggctttcaaccaggtatgggtggaatgggaatgcctcccatgccagcttatggtatgccgcctatgggtggctattgattggttccgagaccttcacacggactgcgaaatccttcaagcatagacgtttatttgaggcttgtatttcatattagcaagagcaatgccgggtgggtgtacatcccagaagtgatagtttggcagagcaggttgtgaaattttaggaactgatgttcagtatgattttgtagattgggctgattagaagagggcaatttttttgtttttgctagacccaacatgggtcgttttctgaatggcatttttgtttttatttcatcgtccgtattaattctttaattgacattattcttttggtgcagatgtaaacttgggtgtgc

SEQ ID NO: 5221 - DNA, 5890 bp, Populus trichocarpa
atggaggagaaaaaaacaaaaatccattcatcacaaaatatctctgtttcggctttaactccatcgaaccgtcaaattccctccattctaggcccactgggcctcaatcttcccaagacagactggttttcgctactaactcaaggccgtcttaaaacagcccaagacaaatatctatctggtacagcggagatgaacacagacccattttctcttcctctactcgatctaccaacgaacaccctctctcgcctccccctcgggcttctgaaatcgaaacccctgatccagggcaccatggctgctgccaatgccccaatcaccatgaaagaggctttaacgttgccaagcctcgggatcaatccacagttcataaatttcacccatgtgacgatggaatcagagaagtacatctgcataagagaaacggcgccgcagaacagtgtggttattgtcgatatgagcatgcctgcgcagcctctgagaaggcctatcacggccgattccgccttgatgaatcctaattcccgaattctcgctctcaaagctcaactcccgggaactactcaggatcatttacagatatttaatatcgaaatgaaagcgaaagtgaaatcacatcaaatgcctgagcaggttgtgttttggaagtggagtagtgctaacatgctggccttggtaacacagacttctgtttatcactggtcaattgaaggcaagcattctgtatctttcatttttttaagatattgtgattcggagcctgtgaagatgtttgataggacagctaatctgcaaggtaatcagataatcaactatagatgtgatccttcagagaagtggttggtcctcattggaattgctcaaggtcctccagagaggccacaattggtcaaagggaatatgcagcttttctctgtggatcagcagcgtagtcaggctcttgaagcacatgcagcgtcatttgcggcatttaaagttgcaggaaatgataatgcttcaatccttatctcttttgcatcaaggtcatttaatgctggacaactaacatcaaagttgcatgttattgaacttggtgctgtgccaggcaaaccatcatttactaagaagcaagcagacctgttctttccaccagacttcgctgatgattttcctgtgtcaatgcagatatcccaaaagtatggcttaatatatgtgatcacaaagcaaggacttctatttgtttatgacctagagactgctagcgcggtttatagaaaccgaatcagtccagatcctatatttttgacgactgatgcttcttcagtaggtggcttctatgcagtcaataggagaggacaggttttgcttgccactgtaaatgaagcaacacttgtgcctttcgttagtggccagttaaacaatcttgaacttgctgttaatcttgcaaaaagaggaaatcttcctggtgctgaaaatctggttgtccagaggtttcaggagttattttctcaggcaaagtataaggaggctgcagaacttgcggcagaatctccacaaggaatcctgcgcactcctgacactgttgctaaatttcagagtgttccggtgcaagctgggcaaacaccaccattgctgcagtactttggaactctgttgactagaggaaaactcaatgctttcgagtcattggaattatcacgccttgttgtaaatcagaataagaaaaatcttctggagaattggttggcagaggacaagcttgaatgcactgaagagcttggagatcttgtgaagacagttgataatgaccttgcattgaagatatatatcaaagctagggcaactccaaaagttgttgcagcatttgctgagaggagggagtttgacaagattcttatatactcaaagcaggttggctataatcctgattatttgttccttctccaaacaatattgcggacagaccctcaggctgctgttaattttgctctaatgatgtctcaaatggagggaggttgcccagtcgattacaacacaataactgatctattccttcagaggaatttgatccgtgaggcaacagcatttttgttggatgttctgaagccaaatttgcctgagcatggattccttcaaactaaggttttggagatcaatcttgtgacatttccaaatgttgcagatgctatattagccaatggtatgtttagtcattatgatcgcccacggattggccaactctgtgaaaaagctgggttgtatattcgagcgcttcagcactataccgagttgcctgatataaaacgtgttattgtgaacacacatgttattgagcctcaggctcttgttgagttctttggcactctttctcgagaatgggctcttgaatgtatgaaagatcttcttctagtcaacctgaggggcaaccttcagattattgtgcagactgccaaagaatactgtgagcaattgggtgtggatgcatgcataaagctctttgagcagtttaagtcgtatgaaggactgtatttctttttgggttcatatttgagctccagtgaggatcctgaaatccacttcaagtacattgaagcggctgcgaaaactgggcagattaaggaggtagaacgtgtgacgcgtgaatctaacttctatgatcctgaaaagacaaagaactttttaatggaagccaaacttccagatgcacgtccattgatcaatgtttgtgatcgttttggatttgtcccggaccttacccattacctgtacgtaaacaatatgcttcgctatattgagggttatgttcaaaaggtcaatccaggaaatgctcctttagttgtaggacaacttcttgatgatgaatgtgctgaagatttcattaaaggccttattctttcagttcgttctcttctgccagttgagcccttagtggaggagtgtgagaaaaggaatcgtctccgcttgctcactcagttcttggagcatctagtcagtgagggaagccaggatgtgcatgttcacaatgctcttggtaaaatcattatcgacagtggcgacaatccagagcattttcttaccaccaacccatattacgattcacgtgttgttggtaaatattgtgagaagcgggatcccacccttgctgttgttgcctaccgaagaggacagtgtgatgatgaactaatcaatgtcacaaacaagaattcattgttcaaactgcaggccagatatgttgtagaacggatggatggtgatctctgggagaaagtccttagtcctgataatgagtatagacggcagctgattgatcaggttgtatcgactgctttgcctgaaagcaagagtcctgatcaagtttcagcaactgttaaagctttcatgacagctgatcttccacatgaactgatcgaacttcttgaaaagattgttctccaaaattctgctttcagtggaaatttcaatctgcaaaacctgctcatcttgactgccatcaaggctgatccatcaagagttatggattacattaataggctagacaactttgatggtcctgcaattggggaggttgctgtggaagctcaattgtatgaagaggcgtttgccattttcaagaagttcaatctgaatttttcagctgtcaatgtcctgctggataatattcgcagcattgatcgagctgtggagtttgcattccgggtggaagaagaagctgtctggagccaagtggccaaggcccaactgcgagagggactagtgagtgaagcaattgagtcatttatccgtgcagacgatgctactcaatttttggaagtcataaaggctgccgaggatgcagatgtatatcatgacttggtgaggtaccttctaatggtgaggcaaaagtccaaggagcccaaggtggatagtgaactcatttatgcatatgctaaaattgatcaactgggtgaaattgaagagttcattctcatgcctaatgtcgctaatctccaaaatgttggagatcgcttatatgatgaagccctgtacgaggcagcaaagattatatttagatttattagtaactgggcgaagttagctgttacacatgttaagctaaacgagttccaaagtgctgttgatgcagctcgaaaagcaaacagctcgaaaacatggaaagaagtctgctttgcttgtgttgatgctgaggaattccgcttggctcagatatgtggtctcaacatcatcatacaggttgatgatttggaagaggtcagtgagtattaccagaacagaggatgcttcagtgagctcatctctctaatggaaagtgggcttggtttggaacgtgcgcatatgggcatcttcactgagttgggagttttatatgcgagataccgccctgagaagcttatggagcacatcaaattgttctcaactcgtctcaacatccccaaggttatacgggcttgtgatgaacaacagcactggaaggaactgacttatttatacatccaatatgatgaatttgacaatgctgctaccactataatgaaccactctccagaagcttgggaccacatgcaattcaaagatgttgtagtaaaagttgcaaatgttgagctctactacaaggctgtgcacttttacttgcaagagcatccagacctaatcaatgatcttcttaatgtgattgctcttcgtgttgaccatactagagtggtggacataatgcgaaaggctggtcagctccgccttgttaagccatacatggttgcagttcagagcaacaatgtctctgctgtaaatgaagcactgaatggaatttacattgaggaggaggactatgacagacttcgtgaatctattgagttgcatgataattttgaccagataggtcttgcacagaagattgagaaacacgagcttctggagatgagacgtgttgctgcttacatatacaagaaagctggaaggtggaagcagtcaattgctttgtcaaagaaagacaatctttacaaagattgtatggaaacttgttcacagtctggtgaaagggaactttctgaggagttgcttgtctatttcattgagcagggaaagaaagagtgctttgcagcttgcctctttgtttgttatgatatgatccgaccagatgttgctcttgagctggcttggatgaacaacatgattgattttgcgttcccatatctcttgcagttcatccgtgagtacacaagcaaagtagatgaactcatcaaggaaaaacttgaggctcttagtgaggtgaaggctaaagagaaagaggagaaggacatggttgctcagcagaatatgtatgcacaattgctgccccttgctttgcctgcgccacctatgcctggaatgggtggaggttttgcaccacctccaatgggtggaatgggaatgcctccaatgccaccttatggcatgccgtccatggccccctactgatttggacatctacctctgaaattagattatctagaattgcttgtctgttattgaaggttaattcagttcttttgatggctatatacttccgggaggaattaaaccggtccctgccattgcattttctgtaactttttatctctcagaattggttgtcatgcagcaagttttccccagtgaagtctcggccatgaacatgttttctacagagattgggttatgaaatttgttgtggttgtggcacgtgtatagttttagttttattgtagtaataacattttggttttgttaattgtcgcctgcacggttcttggattcatattagggttttttaaattttgtaatcaccatatttcattcatgtacaacagttcaatttatactcttgaaaatattgttgggcttggatgcatgttgcaaagcaattttcttactcttgatatggcagtgctttgag

SEQ ID NO: 5222 - DNA, 5562 bp, Zostera marina
gctctctctctaccctcgcccgcactctcttttctctggtgagaatcgaagggcgtcgtcagatcagatcagatcggatctagcttcaccatggctgcggcgagtgctccgatcgccatgaaggaggcgataactctcacaagtctcggcataaacccacaatttgtgacgtttacgcatgtgacgatggaatcggagaagtatatatgtgtcagggagacatctccacagaatagtgttgttataattgatatgaacatgccaatgcaaccaatgaggaggcctatcactgccgactccgctttgatgaacccaaactctagaattcttgcactcaaagctcaactctctggaactacccaggaccaccttcaaatatttaacatcgagcagaagtccaaagtgaaatcccatcagatgccagagcagattatattttggaaatggattaccccaaagatgttaggtctggttacacatatctctgtatatcattggtctatagaaggtgattctgaacctgtaaagatgtttgacagaaccgcgaatctatcaaacaatcaaataatcaattatcgttgcgatcccaacgaaaaatggctagttttgattggaatagctcccggcgctcctgagagaccacaattggtgaaaggtaatatgcagctattttctgttgatcaacagaggagtcaggctcttgaagcacatgctgcatcatttgcttcatttaaggttacaggaaatgaaaacccatccacactaatatgttttgcttcaaagactaccaattctggccaagttacttcaaagatgcatgtgattgagcttggtgcacagccaggaaaatctggttatacaaagaaacaagctgatctttttttccctccagactttgctgatgatttcccagtagcaatgcagatttcaaataagtatagtttgatttatgtgataacaaagcttgggttgctatttgtttacgatcttcaaactgcaagcgctgtttatagaaataggatcagttcggatcctatctttttaacatctgaatcatcatcagatggaggtttctatgcagtaaataggagagggcaagtgctgcatgctactgttaatgaagcaacaattattccttttataagtggccagttaaacaatctagagctggctgtcaaccttgctaaaagaggaaatcttcccggagcagagaatttggtagtgcaacgttttcaagaattgttttctcaaacaaaatataaggaggcggcagagcttgctgcagaatccccacaaggtattttgaggactcgggagactgtagcaaaattccagagtgttccagttcaatcaggacaaacccctcctttattgcaatactttggaacattgcttactagaggaaaactgaatgcatttgagtctctggagctctctcgcttagttgtaaaccagaataagaagaacctactcgagaattggttagctgaagacaagcttgaatgtagtgaagaacttggggatcttgtcaagactgtggacaatgaccttgcacttaaaatatacattaaagcaagggccactcctaaggttgttgcagcttttgcagagcgaagagaatttgacaagattcttatctattcaaagcaggtggggtatgcacctgactatctcttccttctgcaaacaatattgcgttcagatcctcagggagcagtaaattttgctcttatgatgtcacaaatggaaggtggttgccctattgattacaatgtcatcaccgatctctttctccagaggaacttgattcgagaagctacagctttcctgttagatgttctgaaaccaaatttgccagaacatggttttcttcaatccaaggtgttggagatcaatttggttacatatccaaatgtggcagatgctatattggctaatggaatgttcagtcactatgaccgtcctcggatagctcaattgtgcgaaaaagctggactatatatgcgtgctcttcagcattactctgagttacctgatattaaacgagtcattgtgaacacacatgctattgaacctcagtcacttgtagagttctttgggacactttccaaggagtgggctttagaatgtatgaaggatctattacttgttaacttaagaggaaatcttcagataattgtccaggcagctaaagaatactctgaacaacttggtatggaagcatgcataaaactctttgagcaattcagatcttacgaaggtctatacttcttcttggggtcatatttgagctcaagtgaagatccagatattcatttcaaatatattgaggcagcagccaaaactgggcaaattaaggaagttgagcgtgtgactagagaatcaaatttctatgatgccgagaaaaccaaaaactttctgatggaagtcaaacttccagatgctcggcccttgataaatgtctgtgaccgttttggatttgttccagatctcactcactacttgtactcaaacaacatgcttcggtacattgaaggctatgttcaaaaggtaaacccaagcaatgctcctttggtgattggtcaattacttgatgatgaatgtcctggggatttcatcaaaggtcttattctgtcagttcgttctcttcttccagtggaacaacttgtagatgaatgtgaaaagaggaatcgtcttagtctgctcacgcagttcttggaacatcttgttagcgagggaagccaagatgtccatgttcataatgctttgggtaaaattatcatagaaagcaacaataatcctgagcattttcttaccacaaatccatactatgattcacgtgttgttggtaagtattgtgagaaacgagatcccacattggctgttattgcttatagacgagggcaatgtgacacagagcttattaatgtaaccaataagaattcgctattcaagctgcaagctaggtatgttgtggaaagaatggatgcagatctgtgggagaaggttcttgtccctgacaatgactacagacgacaatttattgatcaagttgtgtctactgccttgcctgaaagcaagagtccggagcaagtttcttcagcagttaaagctttcatggctgcagatcttccacaagaactcattgaactgcttgaaaagattgtgctccagaattctgcctttagtggcaatttcaatctacagaacctgttaattttaacagctatcaaagctgatccatcaagagtaatggactacgtaaacaggttagataattttgatggacatggagtgggtgaggtagccgttgaagcacaattatatgaagaagcatttgctatcttcaaaaagttcaacttgaatgtacaagctgtcaatgtattggttgaccacatccaaagcatagagagatctgttgaatttgcttttcgtgttgaagaggatgctgtttggagccaagttgctaaggctcaactccgggagggtctagtcagtgaagcaattgagtcatttattctagcagatgacacaactcaattcttagatgtcattcgagcttctgaggatgctaatgtataccctgacttggtcaagtatctgcttatggtgaggcaaaagactaaagaaccaaaagtggacagtgagcttatttatgcatatgcaaaaactgacaggataggtgatattgaagaattcatacttatgcctaatgttgccaatcttcaaaatgttggggaccgtctgtatgatgaagctttatacgaagccgccaagataatttttgcctttatttctaattgggccaggcttgcttgtactcttgttaaactcatgcagttccaaggagcagttgatgctgctcgtaaagcaaatagtgcaaggacatggaaggaagtctgttttgcctgtgttgatgcagaggaatttcgcttggctcagatatgcggccttaatattattgtgcaggtggatgatttggaagaagtaagtgattactatcagaacagaggatgcttcgctgaacttatctcccttatggagagtggacttggactggagagagcacatatgggcatttttacagagctgggtgtcttgtatgctagatatcgtcctgaaaagcttatggagcatataaaattgtttgcaaccagtctcaatattcccaaactaataagagcttgtaccgagcagcaacattggaaggaactcactcatctatacatccaatacgatgaatttgacaatgctgccgcaactataatgaaccattctccagatgcttgggatcacatgcaattcaaagatgttgctgtaaaagttgcaagtgtagagctttactacaaggcagtgcacttttatcttcaggaacatcctgatctcataaatgatcttctatatgtactctctcttcgtgtagatcatactcgtgtggtggacattgtgcggaaggctggtcacatctatcttgtgaagccatacatggtttctgttcagagcaacaatgtggcagctgtgaatgaagcattaaatgcaatatacgttgacgaagaagactatgacagactacgggaatcaactgatatgcatgacaactttgatcaaataggccttgcacagaaggttgagaaacatgaacttcttgagatgcggcgcatttctgcatatatttataagaaagcaggaagatggaagcaatccattgcattgtctaagaaagacaatctttacagggatgccatggaaaccgcctcacaatctggtcagcgtgaacttgctgaggagttgctagtgtattttattgaaaaggagaagaaggaatgctttgcttcctgtctcttcatctgttacgatcaaatccgaccagattttgcacttgagcttgcctggatgaataacatgatcgatttttcagtcccttatcttttgcagtatattcgtgagttaacaagcaaagtggatgagctcatgaaagataagattgaagcacagatcgaagttaaatctaaagagacggaagagaagaatatggtagcccaacagaacatgtatgctcaattgctaccacttgcattgcctgctccaccaggcatgggtggagctggactttccggatcttttggatcaacacctccgatgtctggaatgatgggcatgccaggcggaatgggaatgcctcctatgccagcatatggaatgcccccaatgggttcctactgattcttccatccatatatgtctattaatcatggtaactcccagtatcattagattatctatggtattcacagtaataagctttagatatgttattagtatatattgtgactttgtgattgaccattcctcatttttattctttaagctaagattagtgtttttgtctccgtggatatatttcttcccttggtttctcatggttgaacttttgttagctttgtatgtataattcaacctttctcaatgtccaaacaactttcttgtaatgtattaattatttttggttcatctcattttgaatattttatttaggtttgatgataaatttttccaaaaaaa

SEQ ID NO: 5223 - DNA, 5509 bp, Valeriana officinalis
agatctcgcactcatcgatttcttccgtcttctcctctctctctacaaaccctcactcactgctcttcaacgaacctgctgctccctcgtgctccgtcttccgatctggtgtattaggtcaacatggcggctgcaaatgccccaatcactatgaaggaggtcctcacgttgcccggtattggagtgaatcctcagtttatcacgttcacacatgttaccatggaatcagataagtacatctgtgttcgagaaacttcacctcaaaatagtgtagttattgtcgatatgaacatgccaaatcagcctttgagaaggccaatcacagctgactcggctttaatgaatccaaattccaagattcttgccctcaaagctcaagttccgggaacaactcaagatcatctgcaaatattcaacatagaattaaaaacacgagtgaaatcacatcaaatgtctgagcagattgtattttggaagtggattacccacaaaatgttgggtctggtcacgcaaacttcggtttaccattggtcactcgaagatgattctgagcctcagaggatgtttgagcgaacagctaatttggcaaataatcaaataatcaactatcgttgtgacccttctgagaaatggttggttctgattggaatcgcccccggtccacaagagaggccacaactagtgaaaggtagtatgcagcttttttctgtagatcagcaacgtagtcaagctcttgaagcacatgccgcatcatttgcttcatttaaagttactggaaatgagaacccctcgattctcatttgtttcgcttcaaagactattaatgctggacaaatcagttcaaagttgcatgtcattgagcttggcgctcagccaggaaagcctgcatttacaaagaaacaagcagacctattctttccccccgacttcgccgatgactttccagtggcaatgcagatatcacacaagtacagtttgatatacgtgattacaaagctagggcttctatttgtttatgacctagaaacggcgactgccgtgtacagaaacagaatcagtccagatcctatatttctgacgagtgaggcttcatcagttggtggattctacgctgttaatagacgtggtcaggttttgcttgctactgtaaacgaagcaactattgtgcccttcgttagtggccagttgaataatttggagcttgctgtcagtcttgcaaagagaggaaaccttcctggtgcagaaaacctggttgttcaacgtttccaagaattatttgctcagaccaagtataaagaggcagctgaacttgctgcagattctcctcagggtatcctccgtacttctgacactgtggctaaatttcagagtgttccagtccaagctggtcaaacaccaccattgctacagtactttgggacattgttaacaaaaggaaaactgaatgcgtttgaatctttggagttgtcacgactggttgttaatcagaacaaaaagaatctcctggagaattggttggcagaagataagcttgaatgcagtgaggagctaggagatcttgtgaagacagtggataatgacctggcactaaaggtttatattaaagcgagagcaactcctaaagtcgttgcagcgtttgcggagagaagggagtttgacaaaattctcatatactcaaaacaggttggatatactccagattatttgagtcttcttcaaacaattttgcgggtcgatgcccagggagctgtaaattttgctttaatgatgtcccaaatggagggaggtagcccagttgattataacacaataactgacctattccttcagcgaaatctgattcgcgaggcaacagcttttcttttggatgttctgaagccggatttgcccgagcatgggtttcttcaaacaaaggttttgtaaataaatctggttacttttcctaatgtcgccgatgctatattagcaaatgggatgtttagtcactatgaccgccctcgtattgcacaactatgtgaaaaagctggtctattcgtgcgagcccttcagcattacaccgagttgcaagatataaaacgtgtcattgtgaacacgcatgccattgagccacagtcgcttgtcgaattctttggcaccctttcccaagaatgggcccttgagtgcatgaaagatcttctggtggtcaaccttaggggcaatcttcagttaattgtgcaggttgctaaagaatactctgagcaattaggcgtcagcgcctgcatcaaattgtttgagcagttcaaatcatacgagggtttatactttttccttggttcttatctgagctcaagcgaggatccggatatccactttaagtacattgaggcggctgctaaaaccgggcaaatcaaggaagtggaaagagttactagggaatcaaatttctatgatccggaaaaagcaaaaaactttctgatggaagcaaaactaccagatgctcgtcctctcattaatgtttgtgatcgttttggctttgttcctgacctaacccactatctctacacaagtaacatgctgcggtatattgaaggatatgttcaaaaggttaatccaggaaatgcacctctagttgtgggtcagcttctagatgatgagtgccctgaagatttcattaaaggccttatactttcagttcggtcacttctcccagttgagccactcgttgacgaatgcgagaagaggaaccgtctgcgactgttgaccgatttcctagagcatcttgtaagtgaaggaagccaagacgtacacgttcacaatgctcttggtaaaattatcatcgacagtaataacaaccctgaacacttcctcacaactaatccttactacgattcgcgcgttgtgggcaagtattgcgagaagcgggacccaactcttgcagttgttgcttatcaaagaggacaatgtgatgaagagcttatcaatgtgaccaataagaactccttgttcaaattacaggctagatatgtagtggatagaatggatggtgacctatgggaaaaagttctcagtccagataacgagtacaaaagacagttaatcgaccaagtagtctcgacagctttaccagaaagcaaaagccccgaacaagtctcggcagcggtcaaggccttcatgacagctgaccttccacacgaactaatcgaactcctagaaaaaatcgtactccaaaactcggcatttagtggaaatttgaacttacaaaatctcctaatcctaactgcaatcaaagctgatccatcaagagtcatggactacatcaaccgccttgaaaattttgatgggccagcagttggtgaggtggcagttgaagcagagctctacgaagaagcagttgcaatatttaaaaagtttaatctgaatgtacaagccgttaacgttttactagataatattcgaagcattgatagagctgtcgaatttgcgtaccgggtcgaagaagacgaggtttggagccaggtggcaatagctcaattgagagatgggttagttagcgacgcaatcgagtcgttcatccgtgctgatgatgcgacccggttcttggatgtcattcgcgcatcagaaaatgctaacgtgtaccacgacttggtgaaatatcttgttatggttagacaaaaagtgaaagagccaagagtggatagcgaacttatatacgcgtatgcgaagattgataggttaggtgacgttgaagaatttattttgatgccgaatgttgcgaatttgcaaagtgttggggatcgattgtacgatgaggaattgtacgaggcagcgaaaataatatttgcttttatttctaactgggccaagcttgctagtactcttgtgaaacttggtcagtttcaaggcgctgttgatgctgctcgtaaagcaaatagttcaaagacttggaaacaagtttgttttgcttgtgttgatgctgaagagtttcgtctcgctcagatttgtgggctcaatatcatcatacaggttgatgatttagaagaagtgagcgaatattatcaaaacagaggctgctttaatgaactaatctctctaatggaaagtggtctagggctagaacgggcccacatgggaatcttcacagaactcggagttttatacgctagataccgtcacgaaaaactaatggaacacatcaaattattctcgacgcgtctcaacattcccaaactcatacgagcttgtgacgagcagcaacactggaccgaactgacatacctctatattcaatacgatgaatttgataatgcagccacaactgtcatgaatcattcgcctgttgcatgggaccacatgcagtttaaggatgtggtggcgaaagttgcaaatgtagagctttattacaaggctgtgcatttttatttggaagagcatccggatcttttgaatgaccttcttaatgtgctcgcacttcgcgtggatcatgcacgtgttgtcgatataatgcgcaaggccggccaccttctacttgtgaagccgtatatggttgcagtacagagtacaaatgtttctgctcttaatgaagcactaaatcaaatctatgtggaggaagaagattatgacagacttcgtgaatctatagatctgcacgataactttgaccaaatcggccttgcacagaaaattgaaaaacacgagcttcttgaaatgaggagagtggcagcatatatatacaagaaagctggcaggtggaagcaatctattgcgttatccaaaaaagacaatctttacaaagatgccatggaaacatgttcgcaatcgggcgatagagaattgtccgaagaattgctcgtatatttcatcgaacaaggaaagaaagagtgtttcgcgtcttgtctttttgtgtgctacgatttaatccgtccagatgttgttcttgaacttgcctggatgaataatatgctcgatttctctttcccatatcttttgcagtttattcgtgagtacactgggaaagtagacgaacttatcaagagtaaacttgaggctcaaagtgaggttaaagagaaagaaaaggaggagaaagatatggttgcacaacagaacatgtatgcacaactgctaccacttgctttaccggcaccaccgatgacggggatgagcggaggatatggcccaccaccaccaatgggtatgcccggttatggtatgcctccaatgggttcgtattgattttctatatcttttactcgttaaacgtgctaaatctgatcatagctagtatttttaaaatattatattacaatcttgtttcatgaggagagattttgtcgtcgttcatagtttatgagaatgttggattcttgtatattttcttatagtgtaatctatgtagaaaatgattcatattttgtttgcacgctttttggagttctgtttgcttgctattttattctgacattctacggcttacattgctaattgagcttgtccaataaatgtttaccccgtgtaagtttcataaaaaaaaaaa

SEQ ID NO: 5224 - DNA, 5595 bp, Cajanus cajan
tggcccaattgtgaagtttccacatttttggatttctatattttgatttgtgatttggtgttctttttgcagctgggaagcgttggaatcaacccgcaattcattacatttactcatgtgacaatggaatcagataagtacatatgtgtcagggaaacttcacctcagaacagtgttgttatcattgacatgagcatgccaatgcagcctttgagacggcccataaccgctgattctgctttgatgaaccccaattctagaattcttgctcttaaagcccaagttccggggaccactcaggaccatttgcaagtttttaacattgaaatgaaagcaaagatgaaatcgtatcagatgaaagaacaggttgtcttttggaagtggataactccaaatacactgggaattgtcactcagacgtctgtatatcattggtcagttgaaggtgatagtgagccaacaaagatgtttgaccgaacagctaatctgtcaaataaccaaattatcaattatcgttgtgatcctaatgaaaaatggttggttttgattggaattgctcctggttcaccagagagaccacaactagtaaaaggaaacatgcaactcttctctatggatcagcaacgtagtcaggctcttgaagcacatgctgcctgttttgctacgtttagagtggctgggaatgataaggattctactcttatttgttttgcatcaaagagtatgaatgctggacaagttacatcaaagatgcatgtcattgaacttggtgcccagccaggcaaaccatcatttactaaaaaacaagcagatctgttcttccctccggactttgctgacgactttcctgtgtcaatgcagatttcaaataaatatggatttatttatgttatcacaaagcttggacttttgtttgtctatgacctggaaactgcaactgcagtttatagaaaccgaatcagtcccgatcctatatttttgaccacagaagcaccatcagtagggggtttttatgccatcaatagacgtggtcaagtgttgcttgctacaataaatgaagcatccattgtaccttttgttagtggccagctaaacaatttggaacttgctgttaatctggctaaaagaggaaacctccctggtgcagaagaattggttgtcaagcggtttcaagaattatttgctcagaccaagtataaggaagctgcagagcttgctgcagaatctccacaaggaattcttcgaactcctgagactgttgctaaatttcagactgtacctgtgcaagctgggcaaacaccaccactgttacagtactttggtactctgttaaccaggggaaaactcaatgcttttgagtcattggaactatcacggcttgtggtaaatcaaaacaaaaagaaccttttggaaaattggctagcagaggacaaacttgaatgcagcgaggagcttggtgatcttgtgaagacagtggataatgaccttgcattgaaaatatatattaaagccagagccacaccgaaagttgttgcagcatttgctgagaggagggagtttgacaagattctgatatactcaaagcaggtcggatacacgcctgattatttgttccttctgcaaacaatattgcgggcagatgctcagggtgctgtaaattttgctctgatgatgtcccaaatggaggggggttgccctcttgactacaacacaataactgatctctttcttcagaggaatttaatccgcgaggcaactgcctttttattggatgtgctgaaaccaaaccttctggaacatggatatcttcaaacgaaggtgctggaaattaatcttgtgacctttccaaatgttgctgatgctatattggccaatggcatgtttagtcattatgatcgtccacggattgctcagctttgtgaaaaggctggccttttcatacgggctcttcagcattatactgagttgcctgacatcaaacgagtcattgtgaacacacatgctattgaaccacaggctctagttgagttctttggaactctttcgaaagaatgggcgctagagtgcatgaaagatcttttactggttaaccttaggggaaatcttcaaataattgtgcagactgctaaggaatattgtgaacagctcggtgttgatgcatgcattaaactctttgagcaattcaagtcctatgaaggactatactttttcttgggtgcatatttgagctctagtgaggatcctgatattcacttcaagtatattgaagcagctgctaaaactggacaaattaaggaggtagagcgtgttactcgggaatcaaacttttatgatgctgagaagaccaagaactttctaatggaagccaagcttccagatgcacgacctttgattaatgtgtgtgatcgttttggttttgttccggatctcacccattatctctacaccagcaacatgcttcgttatatcgagggatatgttcaaaaggtaaatccaggaaatgctcctctagttgtaggacagttgttggatgatgaatgccctgaagatttcattaaaggtcttatactttcagttaggtctcttcttccggttgagcctttagtcgaagaatgtgagaagaggaatcgtctccgcttgcttactcagttcttggagcatcttgtaagtgagggaagccaggatgtgcatgtgcataatgctctgggtaaaattatcattgacagcaataacaatcctgagcattttcttacaaccaacccatattatgattcccgtgttgttggtaaatattgtgagaaacgggatcctacacttgctgttgttgcttaccgaagggggcaatgtgatgatgagcttgttaatgttaccaataaaaattccttgttcaaactccaagccagatatgttgtggaacgtatggattctgacctttgggagaaagttcttaatcctgagaatgagtttagaaggcagttgattgatcaagtggtgtccactgctttgcctgaaagccagagtcctgagcaagtttcagctgcagtgaaagcttttatgaccgctgatcttccccatgagttgattgagcttctcgaaaagattgtcttacaaaattctgctttcagtggaaactttaatctgcaaaatttgctggtccttactgcaatcaaggcagatcctacaagagtcatggattacattaataggttggacaacttcgatggccctgctgttggggaggtggcagtagaggcacaattatatgaagaagcttttgccattttcaaaaaatttaatttgaatgttcaggctgtaaatgtcctactagataatcttcggaccattgatcgagctgtggagtttgcattccgggttgaagaagatgctgtatggagccaagtagctaaggcacagctaagagaaggcttagtaagtgacgcaattgaatcattcatccgtgcagaagattccactcaattcttagaggttataaaagctgctgaagatgcagaagtataccatgatctagtaaggtaccttctcatggttaggcagaacaacaaagagcccaaggtggacagtgagcttatttatgcatatgcaaagattgatcggcttggagaaattgaagagtttatattaatgccaaatgttgctaatttgccaaatgttggagaccgtttgtatgatgatgctctctatgaggctgcaaaaattatatttgcttttatttctaactgggctaagttagcagtgacattggtgaagcttaaacaattccaaggtgctgttgatgctgctaggaaagcaaacagttcaaaaacatggaaggaagtttgttttgcatgtgttgaggctgaggaattccgcttggctcagatttgtggtctcaatgtcattattcaggtggatgatttggaagaggttagtgagttttatcagaacagaggatgctttaatgaactcatatctctaatggagagtggactaggactggagcgcgcccatatgggtatctttactgagttgggagttctttatgcaagatatcgttatgagaagttaatggagcacattaagttgttctcaactcggcttaacattcccaagcttattcgtgcctgtgatgagcagcagcactggaaggaacttacatacctatatatccaatatgatgagtttgataatgctgcaaccactataatgaatcactctccagaagcatgggaccacatgcaattcaaagatgttatagttaaggttgcaagtgtggagctctactataaggctgttcacttttacttgcaagaacaccctgatatgataaatgatgttcttaatgtgcttgcccttcgtgtggaccatacccgtgttgtggatataatgcggaaggcaggccacatccgactggttaagccatacatggttgcagttcaaagcaataatgtgtctgctgttaatgaagctttgaatgaaatttatgttgaggaggaggactatgatagacttcatgaatcaatagatctgcatgacaacttcgatcagataggtcttgcacagaagattgagaagcatgagcttctcgagatgaggcgtgttgctgcttatatttataagaaagctggaagatggaagcagtccattgctttgtcgaaaaaagacaatctttataaggactgtatggaaacgtgctctcaatctggtgaccgtgagctctccgaggatttgcttgttttctttattgagcagggaaagaaagagtgctttgcgtcatgcctctttgtgtgttatgatattatacggccagatgtggctcttgagctagcttggatgaacaatatgattgattttgctttcccatacctcctacagtttattcgagagtatactggtaaagttgatgagcttataaagcacaagattgaaacacaaaatgaggagaaagctaaagagaaggaagagaaggaagttattgctcagcagaatatgtatgcccagttactaccacttgctttgcctgcaccaccaatgccaggtatgggtggaggagggtatgctcccccaacaacacctcctatgggtggtatggggatgccaccaatgccccctttcggcatgcctccaatgggcggcagcggctcctactgatctcttgattcaagacggggaaaattttgctagaaattttactggagaaactagatacattgttttgaatccacatgcattgaggacgagttgcttagggctaaggaatttaacatggagaatgtaagcatctaccataccttccaaccactgatgcttttttccattgaaagttttaggttcttatttcttaagtcaatggctgaatagattgggttgttcgatcaattctgtgagagatgattgaatctttgaggctttagtttggttgctgtatgtacagttgattctttttcacttataattcttttcttagttgtgtagtcatgtaaatgtattctgattaggatttcatacaaattttattcatttaatttggtatatccttttccctttcatagatttggtttacattcaccaattattcgaaaaggtctttttgtgcag

SEQ ID NO: 5225 - DNA, 5711 bp, Triticum aestivum
ctctcgccaccgccgcctgccgccatggcggcggccaacgcccccatcgccatgcgtgaggcgctcacgctgacgagcctggggatcgcgccacagttcgtcaccttcacccatgtcaccatggagtcggacaggtacatctgcgtcagggagacctcgccgcagaacagcgtcgttatcatcgacatggccatgcccagccagcccctccgcaggcctatcaccgccgattccgcgctcatgaaccccaacaccaggatcctcgcgctcaaagcccaaatagctggaacgacgcaggatcacctgcagatcttcaatattgaagctaaaacaaagtaaaagtcgcaccagatgcctgagcaggttgtgttctggaaatggatcacccccaagttgttgggcttggtaacacagacatctgtttatcactggtcaattgaaggagattctgaacccaccaagatgtttgataggacagctaatctggccaataatcagatcattaactaccgttgtgacccggcagagaagtggcttgtgcttattggaattgcacctggtgctcctgagaggccgcagttggtgaagggaaatatgcaacttttctctgttgatcagcagcgtagccaggcacttgaagcccatgcagcatcttttgcaacttttaaggttcctggcaacgagaatccatcaacactcatctgttttgcctcgaaggcaactaatgctggacagattacttctaagttacatgttattgaactgggggctcagccagggaaacctggtttttccaagaagcaagccgatctcttcttcccaccagattttcaggatgattttcctgtagccatgcagatctctcaaaagtatggacttgtctatgtaattacgaagcttggccttttgtttgtgtatgacttggaaactgccgcagcagtttatagaaatagaatcagtccagatcctatattcttgacagcagagtcttctacaaccggtggattttatgccatcaacagaagaggacaggtcttacatgccacagttaatgatgcgactgttgtgccttttgtcagcggccaattaaataaccttgagctagctgtgaatcttgccaaaagagctaaccttcctggggcggagaacttggttgtgcaaagatttcaggaactgttttcgcaaacaaaatacaaggaagcggcggagctcgctgcagaatcccctcagggtcttctgcgaacccctgagactgttgcaaaatttcagagtgttcctgttcaagctgggcaaacgcctccactgttgcagtactttggcacattgctaactcgagggaagctcaatgcttacgagtcccttgagttatctcgacttgttgtcaatcagaacaaaaagaaccttctggaaaattggttggcagaagataagttggaatgcagtgaagagctaggagatcttgttaagacggtagacaatgaccttgcattgaaaatatacataaaggctagggcaacacctaaagtcgttgctgcttttgccgaaaggagggagtttgacaagatccttatatattcaaagcaggttgggtacactcccgattaccttttcctcctccagaccatcctacgtacagatccacagggagctgtaaatttcgctctcatgatgtcacaaatggagggtggttgtccattagattataataccataaccgatctcttccttcagagaaatatgatacgggaggcaacagcttttctgctggatgttctgaaaccaaacttggaagaacatgcttttctgcaaaccaaggttttggagatcaacttggtgacttaccctaatgttgctgatgccatccttgctaacggtatgttcagtcattacgaccgcccacgcattgctcaactgtgtgaaaaggctggtttgtacttgcgagccctccagcactatgcagagttgcctgatatcaaacgtgtcattgtaaatacccacgccattgaaccacaggcactcgttgagttctttggaaccctttcaaaagaatgggcactagagtgcatgaaagaccttctactggtcaatctgagaggaaaccttcaaatagttgtgcaggccgccaaagaatactctgagcagctaggtgtcgatggttgcataaaactatttgagcaatttaaatcttatgagggcctgtactttttcttgggatcctatttgagctccagtgaggatccagatatccacttcaagtacatagaatcagctgcaaggactggacaaatcaaagaagttgagcgtgtaaccagagagtctaatttctatgatgctgagaagacaaagaactttctgatggaagcaaaactacctgatgcccgcccactgattaatgtttgtgaccgctttggttttgttccagatctgactcactatctgtacacaaataacatgctcaggtatattgaaggctatgtacagaaggttaaccctgggaatgctccattggtagtggggcagctacttgatgatgagtgccctgaagatttcattaagggtttgattctatctgtccgctctctccttcccgttgaaccactagttgacgagtgcgagaagaggaaccgcttacgtctgcttacacaattcttggagcacttagtgagcgagggtagccaagatgtgcatgtccataatgctcttgggaaaattatcatcgatagcaacaacaacccagagcatttccttactaccaatccattttatgactctcgtgtggttggtaaatactgtgaaaagcgggatcctacacttgctgttgttgcttacaggcgtggacaatgtgatgatgaacttattagcgttactaacaaaaactcacttttcaagctgcaagctaggtatgtagttgaaagaatggatggtgatctttgggataaagttctactgcctgaaaatgaatacagaaggcagttcattgaccaagttgtttctacggccctgcctgaaagcaagagccctgagcaagtttctgctgctgttaaggctttcatggaagctgacctcccgcatgagctgattgaacttcttgaaaagattgtcctccagaattctgcattcagtggaaactttaatcttcagaacctgctcatcttgacagccattaaggcagacccatccagggtcatggactatgttaacagactggacaactttgatggccctgctgtcggagaagtagctgtcgaggcacaactgtatgaggaggcttttgccatatttaagaagttcaacttaaatgttcaggccgtcgatgttctgttagataacatccgaagcatagaaagagctgaagagtttgcattccgtgttgaagaagatgctgtttggagccaggttgccaaggcccagttgcgtgaaggtctagtcagtgaagcaattgagtcattcatccgtgcagatgacgcaacacatttccttgatgtcatccgtgctgctgaggaagctgatgtataccatgatcttgtcaagtacttgctgatggtaaggcaaaaggcaagggagcccaaagtcgatggagagctcatctttgcatatgcgaagattgataggcttagcgacattgaagagtttattcttatgccaaatgttgctaatctccaaaatgttggtgaccggctttacgatgaagaactttatgaagctgcaaagatcatctatgccttcatctctaactgggctaagttggctgtcaccttggtcaagctgaagcagttccaaggagctgtagatgctgctcgcaaggctaacagcgctaaaacatggaaggaggtctgctttgcctgtgttgatgctgaggagttccgtctagcgcaaatatgcggtctcaatatcatcattcaggttgatgacttggaagaagtgagtgaatactatcagaacagaggatgcttcaatgaacttatttctctcatggagagtggtcttggacttgagcgtgcgcacatgggcatctttacagaacttggagtcctttatgctagataccgccctgagaagctcatggaacacatcaagcttttctccacccggctgaatattcctaagcttatccgtgcttgtgatgaacaacaacactggaaagagcttacgtacctatacatccaatatgatgaatttgacaatgctgctaccactattatgaaccattctccagatgcatgggatcatatgcaatttaaggatgttgccgttaaggttgcaaatgttgagatatattacaaggctgtgcacttctatttgcaagaacaccctgatctcatcaatgatcttctcaatgtgcttgcgcttcgcttggatcacacaagagttgtagacataatgcgcaaggctggtcagttgcatcttgtgaaaccatacatggttgctgttcagagcaacaatgtctctgctgtcaatgaagcattgaatgagctttatgttgaggaggaggactatgagaggctccgtgagtcggttgacatgcatgataactttgatcagataggtcttgcccagaagcttgagaaacatgaattgcttgagatgaggaggattgctgcttacatttacaagaaagctggcagatggaagcaatctattgccctatcgaaaaaagacaacatgtacaaggattgcatggaaacatgctcacagtctggtgaccgtgagctgtcggaggatttacttgtctatttcatcgagcagggaaagaaagaatgttttgcttcttgcctcttcatttgttacgacttgattcgtgcggatgttgctctcgagcttgcatggacaaacaacatgctggactttgctttcccctacctattacagttcatccgtgagtacacaagcaaggtagatgacctggtgaaggacaggattgaatcgcagaaagaagaaaaagccaaagagcaggaagagaaggacgttgttgctcagcagaacatgtacgctcaattgctccctctcgccttgcctgctccgcctggtatggggggtccacctcctatgggcggcatgggtatgcctcctatgggcgggatgggtatgcctccgatgggtgggatgggtatgcctccgatgggtcctggtccgatgccggcatatgggatgcctccaatgggaaactactgagttggcttttgaagaacatagatgatgtcgattgtttcagtctttttttacagagggagcatgaggatcccaaaggtatctttcaagttgtagattgatttgggctattggttgtttcagttaatattcttttggtaccagggcaattttggcgagcaatatttctagccgaggtagagtaaatttactggttgctatatattatgatcgggtaggatgaggatgagattaggttccagctgaagaatgagaggtggaagactggtaccatttgtatagcttgtgtgataaaaagactaagacattttgggtgtacactcctccgtgttggtgttgccacccgtgaacataaacactgcctgtatgttatatgttacactttgtgttcagaggtttgggttttgtacctggaagaatgcttttgttgaacgacacggtgtatttgtatctgtattttggtagtggtcagcagttctcctgagcaaacttggatcttttgctccatttggacgttggatgaaaattatttgacggtggcg

SEQ ID NO: 5226 - DNA, 5431 bp, Chelidonium majus
gcatgcctaatcagccattgagaaagcctattacagctgattcagctttaatgaaccccaattctagaattcttgctctcaaagctaagttccgggaacctcccaggatcacctacaaatatttaacattgaaataaaagcaaaaatgaaatcgcatcaaatgcctgagcagatcgtcttttggaagtggataactccaaaaatgttgggactggtcacacaaactacagtttatcattggtcaattgaaggtgactcgcagcctgtaaaggtgtttgagagaacagctaacttagcaaataatcaaataataaactaccggtgtgatccttcagtaaagtggttggtcctaattggtattgctcctgggtcgcctgagaggcctcaactggtcaaagggaatatgcagctcttttctgtggaccagcaacgtagtcaagcccttgaagcacacgctgcatcatttgccacatttaaagttcctgggaatgaaaacccgtctaccctcatcagttttgcctcaaagaccaccaatgccggacaaattacatctaagttgcatgtcattgaacttggtgcccagccaggcaagccagcttttacaaagaaacaagcggatctattcttccctccagattttgccgatgacttcccagtggcaatgcagatatcccacaaatacagtttgatatacgtgatcacaaagcttggacttctatttgtttatgacctggaaacagctacagcagtttacagaaaccgaattagtccagatcctatattttttgacaacagaagctacatcagttggaggattctatgctgtcaataggcgaggacaggtgttacttgccactgtaaatgaagcaaccatagtgccttttgtcagcggccaattgaacaatctggagcttgctgtaaatcttgccaaaagaggaaaccttcccggagcagagaatttggttgtccagcggttccaagaattattctctcagacaaaatataaagaggctgcagagcttgctgcagaatctccccaggggatcctccgaactcccgatactgttgcgaagtttcagagtgtacctgtgcaagctggccaaactccaccattgttgcaatactttggaacactgttaactagaggcaagctcaatgcttttgagtctttggaattatcgcgccttgttgtgaatcagaacaaaaagaatcttttggagaattggttggctgaggacaagcttgagtgtagcgaggaacttggagatcttgtgaagaccgtggataatgaccttgcactgaaaatatatatcaaggcaagggctactccaaaagtcgttgcagcttttgctgaacgcagggaatttgacaagattcttatctactcgaagcaggttggctattctcctgattatctgttccttctccaaacaattctgcgatcagatccccagggagctgttaattttgctctaatgatgtcacaaatggagggaggctgtccggtggattacaacacaattacagatctcttccttcagaggaacatgatccgtgaggccaccgcttttctgttggatgttctgaagccaaatttaccagaacatgctcaccttcaaaccaaggtcttggagatcaacttggtaacatttccaaatgtagcagatgccatcttggctaatggtatgttcagtcactatgaccgtcctcgaattgcacagctctgtgaaaaagctggactgtatgtgcgagcccttcagcactacgctgagctcccagatattaagcgtgtaattgtgaatacacatgctattgagcctcagtcacttgtagagttctttggaaccctttcaaaagaatgggctttggagtgcatgaaggaccttttactggttaatttgagaggaaatcttcagataattgtgcagactgccaaagaatactctgagcagttgggtgtagaggcatgcataaaactttttgagcaattcaagtcttacgagggtttatactttttcttgggatcatatttgagctccagtgaggatcctgacattcacttcaagtatatcgaggctgctgcaaaaactggacaaattaaagaggttgaacgcgtgacgagagaatctaacttctatgacgcggagaaaacaaagaacttcctaatggaagccaagcttcctgatgcaagacctctgatcaatgtatgtgatcgttttggatttgttccggatctgacccactatctctacacaaacaacatgcttcggtatattgaaggttatgttcagaaggtgaatccaggaaatgctcctttagttgtaggccagctccttgatgatgaatgtcctgaagatttcatcaaaggtctgattctctcagttcgatctctccttccagtggagcctctagtagatgagtgtgagaaaagaaatcgcctccgtttactaacccaattcttggagcatcttgtgagtgagggaagccaagatgtacatgttcacaacgctttaggtaaaattatcatagacagcaataacaatcctgagcattttctcactaccaatccatactatgattcacgcgtggtgggtaaatactgtgagaaacgcgaccccactttggctgttgtggcttatcggagagggcagtgtgacgatgaacttgtcaatgttacaaataagaattccttgttcaaactacaggccagatatgtggttgaaagaatggattccgacctttgggagaaagttctcaaccctgagaatgagtatagaagacagcttattgatcaagttgtatctactgccttgcctgaaagcaagagccctgaacaagtttctgcaactgttaaagcttttatgactgctgatcttccacatgaactaatagagcttcttgaaaagatagtacttcaaaactctgccttcagtgggaacttcaatttgcaaaatttgctgatcttgacagccatcaaggcagacgcgtcaagagtgatggattacattggtagattagacaatttcgatggacctgcagtcggggaggtggctgtggaggcacaactttttgaagaagcatttgccattttcaagaagttcaacttgaatgtgcaggctgtcaatgttcttttggataacattcaaagcattgaacgagctgtggagtttgcattccgtgttgaagaagatgctgtttggagccaggtagcaaaggctcaactgagagaggggcaggtgagcgaggcaattgagtcattcatccgtgcagatgatgcctctcaatttttagatgtcattcgagctgctggggatgccaatgtctaccatgacttggtgaggtatctgctgatggttaggcagaagtctaaggagcccaaagtggacagtgagcttatttatgcatatgccaagattgacaggctaggtgacattgaagaattcatcctcatgcctaatgttgctaatctcccaaatgtcggggaccgtttgtttgatgaagccctatacgaagctgcaaagatcatatttgcttttatttctaactgggccaagctggcttgcacccttgtgaagttgggacaattccaaggtgcagttgatgcagctcgaaaagccaacagctcaaagacgtggaaggaggtttgctttgcctgcgttgatgctgaggagttccgtttggcacagatatgtgggctcaacatcattgttcaggtggatgacttggcagatgtcagcaactattaccagaacagaggttgctttaatgagctaatatctctcatggagagtggtcttggcctggaacgtgcacatatgggaatctttacggagttgggagtcctatatgctagataccgtccagagaagcttatggagcacatcaaactgttttcgacccgtctcaacattccccagcttatacgagcttgtgatgaacagcagcactggaaggaactcacttatctgtacatccaatatgacgagtttgacaatgcagccactactattatgaatcattctcctgaagcatgggatcacatgcaattcaaggatgttgcagtcaaggttgcaagtgtcgagctttattacaaggctgtgcacttctacctgcaggaacatcctgatcttattaatgatcttctgaatgtgcttgcccttcgtgtggaccatacacgtgttgtagacataatgcggaaggctggtcacttgcgtcttgtgaagccatatatggttgcagttcaaagcaacaatgtatctgctgtgaatgaggcattgaatgagatctacgttgaggaggaggactatgataggctgcgggagtcgattgatatgcatgataactttgatcaaataggccttgcacagaagattgagaaacacgagcttcttgaaatgaggcgtgttgctgcttacatttataaaaaggcaggtcggtggaagcaatctattgcattatcgaagaaggataatcactacaaagatgcaatggagacttgttcacagtctggtgagcgtgaacttgcagaagagttgcttgtttatttcatcgaacagggaaagaaggagtgcttcacctcttgcctatttgtttgctatgatgtgatccggccggatgtcgcacttgaacttgcgtggatgaacaacatgctagactttgccttcccatatctcttacagtttatccgcgagtacacgggcaaagttgatgagcttgtaaaggatagaattgaagctcagagtgaagtgaaagccaaagaaaaggaggagaaggacatggttgctcagcagaacatgtacgctcagttgctgcctctggccttgcctgcaccaccgatgccaggcatgggaggaagcatgggaggaggcatggcgggaggttatggtcctccaccaccaatggggggaatgggtatgcctccaatgccaccttttggtatgccccaaatgggtagctattgatttcccagaggtgaaagacttcagcagacttagtagttgagttgtagtagagcaagcaccggcaaaagaaagcgttgagcttttaacagtaccaggggtggtgttctggcagacgacaaaggcacttgatttatgacgaggagggtattttgtggcattaggtctcaaataatattcctcgtggagtttctttttggtcggaaggtggggtttgtggtggttgtgttatatttccatagtattctactattctttgggtagcagcagagaaggcatttttttcttttcttttgagcagagctgaacagaatttttctgtgttggagttgagatattacacgcagtgtgtgccggctgcagtgaaactataactgagattagtgtcatggttgtggcttggttgccacatgtataaattcatatttgcatgtgtttataattttgtttttgtcgtcttttaccttaaaacc

SEQ ID NO: 5227 - DNA, 5247 bp, Musa acuminata
cccgacccgatcaccatggcttcggccaacgctcccatcgccatgcgggaagtcctcacgctccccagtctcggaatcaaccctcagttcgtcacctttacgcatgtgaccatggaatcggacaagtacatatgcgtcagagagacggctccgcagaacagcttggttatcatcgacatgagcatgcccatgcagccgttgaggaggccgatcacggcagactcggctttgatgaatcccaatgccaagatcctcgctctgaaagcacaattacagggatccacacaggatcatcttcagattttcaatattgatcagaagactaaaataaaatctcaccagatgcctgagcagcacctgcaggttgtcttctggaaatggattaacccgaaaatgttgggaatagttacacaaacttcggtctatcattggtcaatagaaggtgaaggtgagcctgtcaagatgttcgatagggcagctaatttaacaaacaatcaaatcatcaattatcgttgtgacccttcagaaaaatggcttgttctcattggaattgcacctggagctcctgagagaccccaactggtgaaaggacatatgcagcttttttcagtggaacagcagcgcagccaggcacttgaagcacatgctgcatcttttgcatcatttaaggctgctggaaaagaaaacccctctactcttgtttgttttgcctcgaagaccactaatgctggacagattgcctctaagttgcatgtgattgaactcggagcccaaccaggtaaaccaggcttcactaagaaacaagcagatttattttttccaccagattttgctgatgacttcccagtggcaatgcagatctcacaaaagtacagtttaatatatgtgatcacgaagctcggtctgttgtttgtttacgatcttgaaacagcaacagcagtttacagaaatcgaattagtccagatcctatattcttgacctcagaggcttcaacagttggtggattttatgctatcaataggagagggcaggttttgttggctactgttaatgaagcaaccattgtgccatttgtcagtggtcaattgaacaatctggagcttgctgttagccttgctaaaagaggaaatcttccaggggcagaaaatttggttgtgcaaaggttccatgaattgttttctcagacaaaatacaaggaagctgctgaattggctgctgaatctccaaaaggcatcctgagaactccagagactgtggcgaagtttcaaagtgttcctgtgcaatctggacagacaccacctcttttacaatactttggaacattgttaacaagaggaaaacttaatgcttttgagtctttggagttatctcgccttgttgtaaatcagaacaaaaagaatctattggaaaattggttggctgaagacaagcttgagtgtagtgaagaacttggggatcttgtgaagactgtggacaatgatctagcattgaaaatctatataaaagccaggtgtactccaaaagttgttgctgcttttgctgaacgaagagagtttgacaagatacttatttattcgaagcaggtgggatacacaccagattaccttttccttctgcaaacaattttaagatcagatcctcagggagcagttaattttgctctcatgatgtcccaaatggagggtggctgtccggtggattacaatacaattactgatctttttctccagagaaatatgatccgggaggcgacagcttttctgttagatgttttgaagcccaatttacctgagcatgcctttcttcaaactaaggttctggagatcaatttggtgacatatcctaatgttgcagatgctatattggctaatggaatgtttagtcattatgatcgtcctcggatagctcagctgtgtgaaaaggctggcctttatatacgagcccttcagcattacacagagttgcctgatattaagcgtgtgatagtgaacacacatgccattgaaccacaggcacttgtggagttctttggtactctttctagtgagtgggctttagaatgcatgaaggaccttttgcttgtgaatctgagaggcaatcttcaaataattgtacagactgccaaagaatattctgagcagttaggtgtggatgcttgtatacagctatttgagcaattcaagtcttatgaaggtctttacttcttcttgggatcatacttgagttccagtgaagatccagatatacactttaaatatattgaggcagcagccaaaactggtcaaattaaagaagttgaacgtgtaacaagagaatccaacttctatgatccagagaaaacaaagaatttcctgatggaagccaaacttcctgatgcaaggcctttgataaatgtttgcgaccgttttggttttgttcctgatttaactcactttttgtacacaaacaatatgctccgatatattgaaggttatgtccagaaagtgaacccaggcaatgcacctatggtagtaggacagctgctagatgatgagtgtccggaagattttataaagggtctgattctttccgttcgttctctccttccagtcgagcctcttgtggctgaatgtgagaagaggaaccgtctgcgactactcacacaatttctggagcatctcgtgagtgaagggagccaagatgtgcatgttcacaatgctttaggaatgatcatcattgacagcaataacaatccggagcattttctgacaacaaatccatactatgattcacgtgttgtgggcaaatattgtgaaaaacgggatcccacacttgcagttgtcgcatatagacgaggtcaatgtgatgatgaacttataaatgtcactaataaaaattcgctgttcaagttgcaagccagatatgtcgtcgaaagaatggatgctgatctgtgggagaaagttcttgttcctgaaaatgattacagaaggcaactcattgatcaggttgtttctactgcattgcccgaaagtaagagcccagagcaagtctctgcagctgttaaagctttcatgactgctgatcttccacatgaactgattgaattacttgaaaagattgtgctccagaattcagcctttagtgggaattttaatctgcaaaaccttctgattttaactgccatcaaagcagatccatctagggttatggattatgtgaatagattggacaactttgatggccctgcagtgggtgaggtggctgttgaagctcaactgtatgaggaagcttttgccatctttaagaaattcaacttaaatgtgcaggcagtcaatgtcctcctggacaacattcaaagcatagagcgagctgtagaatttgcattccgtgtagaagaagatgatgtgtggagtcaggtagccaaagctcagttacgtgaaggtttagtgagtgatgcagtagagtcattcattcgtgcagatgatgctacccaattcctagatgttattcgggctgctgaggatgcaaacatttaccatgacttggtgaagtacttactgatggtgaggcaaaagatcaaagaaccaaaggtggatagcgaactcatatatgcatatgcaaagattgataggctgggtgaaattgaggaattcattcttatgcccaatgttgctaatctccaaaatgttggtgatcgcttgtttgatgatgccctgtatgaagctgcgaagatcatatttactttcatttctaactgggcaaagctggctagtacactggtcaagctcaggcagttccagggtgcagtggatgcagctcgaaaagcaaatagctcaaagacatggaaggaagtttgttttgcttgtgttgatgctgaggaattccgcttagcacaaatttgtggtctaaatatcattatccaggttgatgacttggaagaggtcagtgattattatcagaacaggggttgctttaatgagttaatctccctcatggaaagtggccttggattggaacgtgttcacatgggtatttttacagagttgggagtcctgtatgccagatatcgaccagataaacttatggaacacattaaacttttctcaactcagcttaacattcccaaacttatccgtgtgtgtgatgagcaacaacattggaaggagctaacctatctgtatattcagtatgatgagtttgacaatgctgccacgactataatgaaccattctccggatgcatgggatcacatgcagtttaaagatgttgtcgtcaaagtagcaaatgttgagctttattacaaagcagtgcatttctacctgcaagaacatcctgatctaattaatgatcttttgcatgtcctcgcccttcgtgtggaccacactcgtgtagtagatataatgcggaaggctggtcatttgcatcttgtgaagccgtacatggttgcagttcagagtaacaatgtagctgctgttaatgaggcactaaacaaaatttatgtcgaggaggaggattatgacaggttacgggaatcagttgatatgcatgataactttgatcagataggccttgcacagaggattgaaaagcatgagcttctcgaaatgaggcgtattgctgcatatatctacaagaaagcaggaagatggaagcaatccattgcactgtctaagaaggacaacctatacaaagatgcaatggagacatgttcacagtctggtgaccgtgaactttctgaagagctgcttgtttattttattgagcagggaaagaaagaatgttttgcttcatgtctcttcatttgttatgacctgattcgtcctgatgttgctgttgaactcgcctggacgaacaatatgctggactttgctttcccatacctcttgcagtttattcgggagtatacgagcaaagttgatgaacttattaaagacaagattgaagcacaaaatgaagtaaaagtaaaagaaaatgaggagaaggatttggttgctcagcaggcatgttggacgcattcattcttaacaatccttttttttttattttttcaagtgtccttctgttgcctaacaatgacattgatttccttttgcagaatatgtatgctcagttgctacccttggcgttgccagctccaccagtgcctggtatgggaggtccaggcatgggtggaccttttccacctccgccacccatggctggtatggggatgcccccgatgccgccatttggaatgcctcctatggcaacgtactgagatgatatag

SEQ ID NO: 5228 - DNA, 5400 bp, Glycine max
tttccacattttttgtgtttctattttttgatttgcgattcggcgttcttttgcagctgggaagcgttggaatcaaccagcagttcattacatttactcatgtgacaatggaatcggataaatacatttgtgtcagggaaactggacctcagaacagtgttgttatcattgacatgagcatgccaatgcagcctttgagacggcccataaccgctgattcggctttgatgaaccccaattccagaattcttgctctcaaagttaatgatttggataactgtagcttgtgtaaatatgtgttttgtatgtctcatgaatacgaggttctatatgcagcccaagttccaggaaccactcaggatcatttgcaagtttttaacattgaaacgaaagcaaagatgaactcgcatcagatgaaagaacaggttgtcttttggaagtggataactccaaatacactgggaattgtcactcagatgtctgtatatcattggtcagttgaaggcaatggtgagccaatgaagatgtttgaccgaacagctaatctggctaataaccaaattattagttatcgttgtgatcctaatgaaaagtggttggttttgattggaatagctcctggttcagcagagagaccacaactagtaaaaggaaacatgcaactcttctctgtggatcagcaacgtagtcaggctcttgaagcacatgctgcctcatttgcttcgtttagagtggctgggaatgataaggattctactcttatttgttttgcatcaaagagtatgaatgctggacaggttacatcaaagatgcatgtcattgaacttggtgcccagccaggcaaaccatcatttactaagaaacaagcagatctgttcttccctccagactttgctgatgactttcctgtgtcaatgcagatttcaaataaatatggactgatttacgttatcacaaagcttgggctgttatttgtctatgatctggagacttccaccgcagtttatagaaaccgaatcagtcccgatcctatatttttgaccacagaagcaccttcagtaggggggttttatgccatcaatagacgtggccaggtgttgcttgctactataaatgaggcagccattgtaccttttgttagtggccagctaaataatttggaacttgcagttaatctggctaaaagaggaaacctccctggtgcagaagaattggttgtcaagcggtttcaagaattatttgctcagaccaagtataaggaagctgcagaacttgctgcagaatctccacaaggaattcttcgaactcctgacactgttgctaaatttcagagtgtacctgtgcaagctgggcagacaccaccactgttacagtactttggtactctgttaaccaggggaaaactcaattcttatgagtcattggaattgtcacggcttgtggtaaatcaaaacaaaaagaatcttctggaaaattggctagcagaggacaaacttgaatgcagcgaagagcttggtgaccttgtgaagacagtggataatgaccttgcattgaaaatatttatcaaagccagagccacaccgaaagttgtggcagcatttgctgagaggagggaatttgacaagattctgatatactcaaagcaggttggatacactcctgattacatgttccttctgcaaacaatattaagggcagatgcccagggtgctgtaaattttgctctgatgatgtctcaaatggaggggggttgccctgttgactataacacaataaccgatctctttcttcagaggaatttaatccgcgaggcaactgcctttttattggatgtgctgaagccaaacctaccagaacatggatatcttcaaacgaaggtactggaaattaatcttgtgacctttccaaatgttgctgatgctatattggccaatggcatgtttagtcattatgaccgtccacggattgctcagctttgtgaaaaggccggccttttcattcgggctcttcagcattattccgagttgcctgacatcaaacgtgtcattgtgaatacacatgccatcgaaccgcaggctctagttgagttctttggaaccctttcaaaagaatgggcgctagagtgcatgaaagatcttttactggtcaaccttaggggcaaccttcaaataattgtgcagactgctaaggaatattgtgaacagctgggtgttgatgcatgcattaaactctttgagcaattcaagtcctatgaaggactatactttttcttgggtgcatatttgagctctagtgaggatcctgatattcacttcaagtatattgaagcagctgctaaaactggacaaattaaggaggtggagcgtgttactcgggaatcaaacttttatgatgctgagaagaccaagaactttctaatggagaccaagcttccagatgcacgaccattgataaacgtgtgtgatcgttttggttttgttccggatctcacccattatctctataccagcaacatgcttcgttatattgaaggatatgttcagaaggtgaatccaggaaatgctcctctagttgttggacaattattagatgatgaatgccctgaagatttcattaaaggtcttatactttcagttcgttctcttcttccagttgagcctttagttgaagaatgtgagaagagaaatcgtcttcgcttgcttactcagtttttggagcatcttgtaagtgagggaagccaggatgtgcatgtacataatgctctgggtaaaattatcattgacagcaataacaatcctgagcattttcttacaaccaacccatattatgattctcgtgttgttggtaaatattgtgagaagcgggatcctacacttgctgttgttgcttaccgaagggggcaatgtgatgatgagcttgttaatgttaccaataaaaattccttgttcaaactccaagccagatatgtcgtggagcgtatggatgctgacctctgggagaaagttcttaatcctgagaatgagttcagaaggcagttgattgatcaagtggtgtccactgctttgcctgaaagccagagtcctgatcaagtttcagctgcagtgaaagcttttatgactgctgatcttccccatgagttgattgagcttcttgaaaagattgtcttacaaaattctgctttcagtggaaactttaatctgcaaaatttgctgatcctcactgcaatcaaggcagacccctcaagagtcatggattacattaataggctggacaactttgatggccctgctgttggggaggtggcagtagaagcaaacctatatgaagaagcttttgccattttcaaaaaatttaatttgaatgttcaagctgttaatgtcctactagataaccttcggaccattgatcgagctgtggagtttgcattccgggttgaagaagaggctgtatggagccaagtggctaaggcacaactaagagaaggcttagtaagtgatgcaattgagtcattcatccgtgcagatgattccactcacttcttagaggttataaaagcttccgaagatgcagaagtataccatgacctagtaaggtaccttctcatggttaggcagaataccaaagagcccaaggtggacagtgagctcatatatgcatatgcaaagattgaccaacttggagaaattgaagagtttatattgatgccaaatgttgctaatttaccaaatgttggagaccgtttgtatgatgaggctctctatgaggctgcaaaaattatatttgcttttatttcaaactgggctaagttagcagtgacattggtgaagcttaaacaattccaaggtgctgttgatgctgctaggaaagcaaacagttcaaaaacatggaaggaagtttgttttgcctgtgttgatgctgaggaattccgattggctcagatttgtggtcttaatgtcatcattcaggtggatgatttggaagaggttagtgagttttatcagaacagaggatgctttaatgaactcatatctctaatggagagtggacttggactggagcgtgcccatatgggtatctttactgagttgggagttctttatgcaagatatcgtcctgagaagttaatggagcacattaagctgttctcaactcggcttaacattcccaagcttattcgagcctgtgatgagcagcagcattggatggaacttacatacttatacatccaatatgatgagtttgataatgctgcaactactgtaatgaatcactctcctgaagcatgggaccacatgcaattcaaagatattatagttaaggttgcaagtgtggagctctactataaggctgttcacttctacttgcaagaacatcctgatattataaatgatcttcttaatgtacttgcccttcgtgtggaccacacccgtgttgtggatataatgcggaaggctggccacatccgattggttaagccgtacttggttgcagttcaaagcaataatgtgtctgctgttaatgaagctttgaatgaaatttatgttgaggaggaggactatgatagacttcatgaatcaatagatctgcatgacaacttcgatcagataggtcttgcacagaagattgagaagcatgagcttcttgagatgaggcgtgttgctgcttacatttataagaaagctggaagatggaagcagtccattgctttgtcaaaaaaagacaatctttacaaggactgtatggaaacttgctctcaatctggtgaccgtgaactctcggaggatttgcttgtttactttattgagcaggagaagaaagaatgttttgcatcttgcctctttgtctgttatgatataatacggccagatgttgctcttgagctagcttggatgaacaatatgattgattttgctttcccatacctcttacagtttattcgagagtatactggtaaagttgatgagcttatcaaggacaaaattgaagcacaaaaagtggagaaagctaaagagaaggaagagaaggaagttcttgcacagcagaatatgtatgcccagttactaccacttgctttgcctgcaccaccaagtatgggtggaggagggtatgcaccaccaacaccccctattggtggtatggggatgcctccgatgcccccttttggcatgcctccaatgggcggtggcagcggctcctactgatctctctattcaagacaggagaaatttttgctataaattttattggagaagctaggtacattaacacgatgaatgaaagcatctaccttagcccttctgacgactgtggcttttttgcatggaaagttagtcaattgctgaatagattgggttgtctgatcaatcctgtgagatgattgaatcttctgaggctttagtt

SEQ ID NO: 5229 - DNA, 4979 bp, Papaver somniferum
tagaaggcctctctccttctttctcagctaaatcgagaaaaaccatttttcgctgttcatcacttcaccattacattccatttcatttctcccccctccactgtaaaagcgaaaccctaactctggtaaagttccgttctagcaatcatggctgctgctagcgccccgatcgccatgaaagaaacactaactttgccaagtattggaataaatccacagcatataacattcacgcatgtaaccatggaatcggataagtacatttgtgtaagagaaacatcaccacagaatagtgttgtcattattgatatgagtatgccgaatcaaccattgagaagacctattactgctgattctgctttgatgaaccctaattccagaattcttgctctcaaagctcaactgccgggaaccactcaggatcacctacaaatatttaacattgaaatgaaagcaaaaatgaaatcacatcaaatgcctgagcagattgtcttttggaaatggatcacaccaaaaatgttgggtctagtcacccaaacctcggtgtatcattgggcaattgaaggtgagtcacagcctgtaaagatgtttgaaagaaccgctaatttagcaaacaatcaaataataaactaccgaagcgatccttctgaaaagtggttggtcttaattggtattgctcctgggtcacctgagaggcctcaactggtcaaagggaatatgcagctgtattctgtagatcagcagcgcagtcaagcgcttgaagcacatgcagcatcgtttgccacatttaaagttcccgggaatgaaactccttcaacgcttattagttttgcctcaaaaactaccaatgctggacaagttacctcgaagctgcatgttattgaacttggtgcccagccagggaaaccagcttttacgaagaaacaagcagatcttttcttccccccagattttgctgatgacttccctgtggcgatgcagatttcacataagtatgggttgatatacgtgattacaaagcttgacttctatttgtttatgatttggagacagctaccgcggtttatagaaaccgaattagtccagatcctatattttgacggcagaagctacatcagtaggagggttttatgctgttaataggagaggtcaggtgctacttgcgactgtcaatgaagcaaccatagtgccttttgtcagcggccaattaaacaatctggaacttgctgttaatctgcaaaagagggaaccttcccggggcagagaatttggttgtccagcggtttcaagaattgttctcacaaacaaaatataaggaggctgcagagcttgctgcagaatctccccaggggatcctccgaactcctgatactgttgcaaagtttcagagtgtacctgtgcaagctggccaaactccaccgttattgcaatacttcggaacactattaactagaggaaagctcaatgcatttgagtctctggaattatcacgtcttgtagtgaatcagaataagaagaatcttttggaaaattggttggctgaggacaagcttgagtgcagcgaggaacttggagatcttgtgaagactgtggataatgaccttgccctgaaaatatatatcaaggctagggctacaccaaaagttgttgcagcttttgctgaacgaagggaatttgacaagattcttatttactcgaagcaggttgggtacacacctgattatctcttccttttgcaaacaattctgcgatcagatccccagggagctgtcaattttgctctaatgatgtcacaaatggagggaggttgtcctgtagattacaacacaatcactgatctcttccttcagaggaacatgatccgtgaggccactgcctttttgttagatgtgttgaagccaaatctaccagaacatgctcacctccagacaaaggtcttggagatcaatttggtaacatttccaaatgtggctgatgccatcttggctaatggaatgttcagtcactatgatcgtcctcgaattgcacagctctgtgaaaaagctggtctatatgtgcgagcccttcagcactatgcggagttgccagatattaaacgtgtcattgtgaatacacatgccattgagccacagtcacttgtggagttctttggaaccctctcgaaagagtgggcgttggagtgcatgaaggaccttttacttgttaatctgaggggaaatctccagataattgtgcagaccgccaaagaatattccgagcaattgggtgttgaggcatgcataaaactttttgagcaatttaagtcttatgagggtttatattttttcttgggatcgtatttgagctccagtgaggatcctgacattcactttaaatatatcgaggccgcagctaaaactggtcaaattaaagaggttgaacgcgtgactagagaatcaaacttctatgacgcggagaaaaccaagaattttcttatggaggccaagcttcctgatgcaagacccctgatcaatgtatgtgatcgttttggttttgttccagatctcacccactatctctacacgaacaacatgctccgatatattgaaggttatgttcagaaggtcaatccaggaaacgctccattagttgtcggtcagctacttgatgatgaatgccctgaagatttcattaaaggacttattctttctgtccgctctcttcttccagtggagccccttgttgatgagtgtgaaaagagaaatcgcctccgcttactaacccaattcttggagcatcttgtgagtgaaggaagccaagatgtacatgttcacaatgctttaggtaaaataatcatagacagcaataacaatcctgagcattttctcacaaccaacccatattatgatccacgggtggtgggtaaatattgtgagaaacgtgaccctactttggctgttgttgcttaccgaagagggcagtgtgatgatgaacttatcaatgttacaaataagaactccttgttcaaattacaggccaggtatgtggtggagaggatggattctgacctctgggaaaaggttctcaaccctgagaatgagtccagaagacagcttattgatcaagtcgtatcaactgccttgcctgaaagcaagagcccggagcaagtttctgcaactgttaaagcttttatgactgctgatcttccacatgagctaatagagcttctcgaaaagatcgtacttcaaaactccgctttcagtgggaactttaatttgcagaatctgctgatcctcacagccattaaggcagacacgtcaagagtgatggattacataaacagattagacaatttcgatggacctgcagttggagaggttgctgtggaggcgcaactctatgaagaagcttttgccattttcaagaagttcaacttgaatgtacaagccgtgaatgttcttttggataacatccagaacatcgaacgagctgtggagtttgcgttccgtgttgaagaggatgctgtttggagccaggtagcgaaggcccagctcagagagggactagtgagtgatgcaattgagtcattcatccgtgcagatgatgcttctcaatttttagatgtcattaaagctgccgaggatggtaatgtttaccatgatttggttaagtacctccagatggtaaggcagaagtctaaggagcctaaagtagacagtgagcttatttatgcatatgccaagatcgacaggcttagtgacatcgaagaatttattctcatgcctaatgttgctaatctaccacttgttggcgaccgtttatatgatgaagcgctatacgaggctgcaaagattatatttgcttttacttctaactgggccaagctggctgtcaccctcgtcaagttgcagcaattccaaggtgcggttgatgcagctagaaaagccaacagcgcgaagacatggaaacaagtctgctttgcctgtgttgatgctgaggagttccgtttggcacagatatgtgggctcaacatcattgtacaggtggacgatctagaggaagtcagtatttattaccagaatagaggctgctttgatcagcttatatctctcatggagagtggtctaggcctggaacgtgcgcacatgggtatctttactgagctaggtgtcctttatgcgagataccgttatgagaagcttatggagcacattaaattgttctcgacacgtcttaacattcccaagcttattcgagcttgtgatgaacaacagcactggaaggaacttgtttatctgtacatccagtatgacgagtttgacaatgcagcaaccaccattatgaatcattctccggacgcgtgggaccacatgcagttcaaagacgttgcagttaaagtatcgaatgttgagctttattataaagctgtacatttctacctgcaggaacatcctgaccttattaatgatatgctcaatgtactcgcccttcgcgtggatcatactcgtgtcgtggacattatgcgaaaggctggtcatctgcgtcttgtgaagccttacatggttgcagttcaaagtaacaatgtatctgctgtgaatgaggcattgaatgagatctatattgaggaggaggactatgataggttgcgtgagtccatagatatgcatgataacttcgaccagattggtcttgcacagaagattgagaaacacgagcttcttgagatgcggcgagttgctgcttacatctataagaaagcaggtcgatggaggcaatcaattacgttatcgaagaaagacaatcactacaaagatgcaatggagacttgttcacagtctggggaacgcgaacttgcagaagaattgcttgtttatttcattgagcagggaaagaaggagtgttttgcctcatgcttatttgtttgttatgatgtgatacgaccggatgttgcacttgaacttgcatggatgaacaacatgatagactttgctttcccctat

SEQ ID NO: 5230 - DNA, 4899 bp, Musa acuminata
ctttggggatatgcagcacaaatacagggaaccatgcaggatcatctacagattttcaatattgaacagaagactaaaataaaatctcatcagatgcctgagcaggttgtcttttggaagtggattaacccaaaaatgttggggctagttacacaagcttcagtctatcactggtcaattgaaggtgacagtgagcctgttaaggtgtttgatagggcagctaacttaacaaacaatcaaatcatcaactatcggtgcgatccctcagaaaaatggcttgttctcattggaattgcacctggagctcctgagagaccccaactggtgaaaggaaatatgcagcttttttcagtggaacagcagcgcagtcaggcacttgaagcacatgctgcatcttttgcaacatttaaggttgttggaaaagaaaacccctccactctcatttgttttgcctcaaagaccactaacgctggacagattacctctaagttgcatgtgattgaactgggagcccaaccaggtaaaccaggcttcaccaagaaacaggcagatttattttttccaccagattttgctgatgatttcccagtggcaatgcagatctcacataagtatagtttgatatatgtgatcacgaagcttggtctgttatttgtatatgatcttgaaacagcaacagcagtgtacagaaatagaattagtccagatcctatattcttgaccgcggaggcttcaacaattggtggattttatgctattaataggagaggacaggttttattggctgctgttaatgaagcaaccattgtgccgtttgtcagcagtcaattgaataatctggagcttgctgttagccttgctaaaagaggaaatcttccaggggcagaaaatttggttgtgcagaggttccaagaattgttttcccagacaaaatacaaggaggctgccgaactagctgctgaatctccacaagacatcctgagaactccggagactgtggcaaaatttcaaagtgttcctgtgcaagctggacagacacctcctcttctacagtactttggaacattgttaaccagaggaaaactaaatgcctttgagtctttggagttatctcgccttgttgtaaatcagaacaaaaagaatctattggaaaattggttggctgaagacaagcttgagtgcagtgaagaactgggggatcttgtcaagactgtcgacaatgatctagcactaaaaatctatataaaagcaagggctaccccaaaagttgttgctgcttttgctgaacgaagagagtttgacaagatacttatctattcaaagcaggtgggatacgtgccagattaccttttccttctgcaaacaattttaaggtcagatcctcagggagcagttaattttgctcttatgatgtctcaaatggagggtggctgtccagtggattataatacaattactgatatctttcttcagagaaatatgatccgagaggcaactgcctttttgttagatgtcttaaagccaaatctacctgagcatgcctttcttcaaactaaggttctggagatcaatttggtgacatatcctaatgttgcagatgctatattagctaatggaatgtttactcattatgatcgtcctcaaatagctcagctatgtgaaaaggctggcctatatatgcgagcccttcagcattacacagagctgattgatattaagcgtgtcatcgtgaatacccatgccattgagccacaggcacttgtggagttctttgggaccctttccagagagtgggctttagaatgcatgaaggaccttttgcttgtgaatttgagagcaaaccttcagataattgttcagactgccaaagaatattctgagcagttaggtgtggatgcttgtattaaactatttgagcaatttaagtcctatgaaggcctttacttcttcttaggatcatacttgagttccagtgaagatccagatatacactttaagtatattgaggcagcagccaaaactggtcaaatcaaagaagttgaacgtgtaacaagagaatccaacttctataatccagagaaaacaaagaatttcctgatggaagccaaacttcctgatgcaaggcctttgataaatgtttgcgaccgttttggttttgttcctgatttaactcactttttgtacacaaacaatatgcttcgatatattgaaggttacgtccagaaagtgaacccaggtaatgcacctttagtggtgggacagctgctagatgatgagtgtcctgaagattttataaaaggtctgattctttctgtccgttctctccttccagttgagtctcttgtggttgaatgtgagaagaggaaccgtctgcggctactcacacaatttctggaacatcttgtgagtgaaggaagccaagatgcacatgttcacaatgctctaggaatgatcatcatagacagcaataataacccagagcattttctgactacaaatccgtattatgattcacgtgtagtgggtaaatattgtgaaaagcgggaccccacgcttgcagttgttgcatacagacgaggtcaatgtgatgatgaactaataaatgtcactaataaaaattcattgttcaagttacaggctagatatgttgttgaaagaatggatgctgatctatgggagaaagttcttgttcctgaaaatgaatacagaaggcagtttattgatcaggttgtttctactgcattgcctgaaagcaagaacccggagcaagtctctgcagctgttaaggctttcatgactgctgatcttcctcatgaactgatcgaattacttgaaaagattgtgctccagaattcagcctttagtgggaatttcaatctgcaaaaccttttgatcttaacttccatcaaagcagatccatctagggtcatggattacataaatagattggacaactttgatggccctgcagtgggtgaggtggcaattgaagctcaactgttcgaggaagcctttgccatttttaaaaaattcaacttaaatgtgcaggctgttaatgtcctcctggacaacatccaaagcatagagcgggctgtagaatttgcattccatgtagaagaagattctgtatggagtcaggtgggcaaagctcaattacgggaagggttagtaagtgaagcaattgagtcatttattcgagcggatgatgctactcagttcctagatgttattcgggctgcagaagattcaaacatttaccatgacttggtgaaatacttattgatggtaaggcaaacggtcaaggaaccaaaagtggatagtgaactcatatatgcttatgcaaagattgataggctgggtgaaattgaggaattcattctgatgcccaacgttgctaatctccaaaatgttggagatcgcttgtttgatgatgccctttatgaagctgccaagatcatatttactttcatttccaactgggcaaagctagctagtacgttggtcaagctcagacagttccagggtgcagtggatgctgctcgaaaagcaaatagctcaaagacatggaaggaagtctgttttgcttgtgttgatgctgaggaattccgcttggcacaaatttgtggtttaaatatcatcatccaggtggatgacttggaagaggtcagtgattattatcagaacagaggctgctttaatgagttaatttctctcatggaaagtggccttggattggaacgcgcacacatgggtattttcacggagttaggagtcttgtatgctagatatcgaccagagaaacttatggagcacattaaacttttttcgactcgccttaatattcccaagcttatccgtgtttgtgatgagcaacagcattggcaggagcttacctatctgtatattcagtatgatgagtttgacaatgccgccacaactattatgaaccattctccagatgcatgggatcacatgcaatttaaagatgtagttattaaagttgcaaatgttgagctctattacaaggcagtgcatttctacctgcaagaacatccagacctgattaatgatcttttgcatgtacttgctcttcgtgtggaccacactcgtgttgtagatattatgcggaaggctggtcacttgcatcttgtcaagccatacatggttgcagttcaaagtaacaatgtagctgcagttaacgaggcactaaatgaaatttatgtcgaggaggaggactatgacaggctacgggaatcagttgatacgcatgacaactttgatcagataggcctcgcccagaggattgaaaagcatgagcttcttgagatgagacgtatcgctgcatatatctacaagaaagcaggaagatggaagcaatccattgcactatcgaagaaggacaacctatacaaagatgcaatggagacatgttcacagtctggtgatcgtgaactttctgaagagctgcttgtttattttatcgaaaagggaaagaaggaatgcttttcttcatgtctttttatttgttatgacttgatccgtcctgatgttgcccttgagcttgcctggatgaacaatatgctggattttgcttttccatacctcttgcagtttattcgtgagtatactagcaaggttgatgaacttattaaagataagattgaagcacagaatgaagtgaaagttaaagaaaaagaggaaaaggatttggttactcagcaggcatgtttgaatatgtatgcacagttgctaccccttgcactgccagctccaccaatacctggtgtgggtgctactggcatgggtggaccttatccagctccaccacctatggctggtatggggatgcccccggtgccgccatttggtatgcccccaatgggaacgtactgaaagaac

SEQ ID NO: 5231 - DNA, 4996 bp, Lotus japonicus
gtttcactcgtgtcaaaagtcagcacacaccagcccatttccacgtctctctctctttctccccctcttcgctttgaagagggtccaagtcttctcagatctccactggtcgcagatcggagtcttcgatctaagccaccatggcggccgccgcgaacgctccgatcgccatgaaagaagtcctcaccttgccgaccctcggcatcaatacacaattcatcaatttcacgcatgtgacgatggaatcggacaagtatatctgtgttcgagaaacggcgccgcagagcagcgtggttatcgttgatatgagcatgccaaatcaacctttaaggaggcctattactgcggattcggctcttatgaatccgaattcgagaatccttgctttgaaagcgcaactccaagggactactcaggatcacctgcagatatttaatattgaattgaaagctaagatgaaatcatatcagatgcctgagcaggtagtcttctggaagtggattagccccaagacattgggccttgtaacactgacctctgtataccattggtcaattgaaggtgactctgaacctattaagatgtttgagagaactgcgaatttggcgaacaaccagataattaattatcgatctgaccctacagaaaaatggttggtcttgattggtattgctcctggttcccctgagaggccgcaattggttaaaggaaacatgcaacttttctctgtggatcagcagcgcagtcaggctcttgaagctcatgctgcatcatttgcccaatataaagttcctgggaatgaaaatccttctactttgatttctttttccacaaagacacttaatgctggtcaaattgtatctaagttgcatgttattgagctgggtgcgcagccagggaagccatcattcacgaagaaacaagcagatcttttctttccaccagattttgctgatgactttccagttgcgatgcagatatcccacaaatacagtttgatttatgtgattaccaaacttggcctactttttgtctacgatttggagacagctactgctgtatataggaacagaattagtccagatcctatatttttgacatcagaagctacaacagtgggaggcttttatgccataaacaggagaggccaggttttattggctactgttaatgaacaaaccattgtgaattttgtcagcggtcaattaaacaatttggagctagcagttagtcttgccaaaagaggaaatcttcctggtgctgagaagctggtagtggaacgtttccatgaactgtttgcccaaacaaagtacaaagaagcagctgagcttgctgctgaatctccacaaggaatccttcgtacgccagacacagttgccaaatttcagagtgttcctgtgcaatctgggcaaactcccccactgttgcagtattttggaacacttttaacgaggggaaagttgaatgccttcgagtcattagaattatctcgattggttgtgaaccagaacaagaaaaatctgttggaaaattggttggcagaggacaagcttgaatgcagcgaggagctaggagatctcgttaagactgtggataacgatcttgctttaaaaatttatatcaaagccagagctactccaaaagttgttgcagcttttgctgagaggagggagtttgacaaaattctgatatactctaagcaggttgggtacacacctgactacctcttcctcttgcaaacaattctccggacagatcctcagggtgctgttaattttgcgttaatgatgtctcaaatggagggaggtagcccagttgattacaataccataactgatctgtttcttcagagaaacctgatccgtgaggcaacagcttttcttctggatgttttaaagccaaatctaccagaacacgggttcctgcagacaaaggtcttggagataaatctggtgacattccccaatgttgctgatgctattttggctaatggcatgttcagccattatgaccgtcctcgtattgcccaactctgtgaaaaagctggtctttacgtgcgagctttgcaacattacacagagctaccagatataaaacgtgtgattgttaatacacatgcaattgagcctcagtcacttgtagagttttttggcactctatctcaagaatgggctttagagtgcatgaaagacctattgctggccaaccttaggggaaacctgcagattattgtgcaggttgctaaagaatactgtgaacaattgggcgttgatgcctgcataaaactttttgagcagtttaggtcatatgaaggactgtactttttccttggctcatatttgagctccagtgaggatcctgatattcactttaagtacattgaagcagcagcaaagactggtcaaatcaaggaggtcgagcgtgtgacaagagaatccaatttctatgatgccgagaaagcgaagaactttctaatggaggctaagcttccagatgcacggcctttaattaatgtttgtgatcgttttggatttgttccagatctaacacactatctatacacaaacaacatgcttcgctatattgaaggttacgttcagaaggtaaaccctgggaatgctcctttagttgttgggcagctgctagatgatgagtgtccagaagattttatcaaaggtttgattctttctgtccgttcattactgccagtggagccccttgtggaggaatgtgagaagaggaatcggcttcgtttgctaactcagttcttggaacatctcgtaagtgagggaagccaggatgtacatgttcacaatgcactgggtaaaattatcattgagagcaacaacaacccagagcattttctcacaaccaatccatactatgattctcgagttgtgggcaagtattgtgaaaaacgtgatcccaccttggcagtcgtagcttaccggcgaggacaatgtgatgatgaacttatcaatgtcaccagcaaaaattctttgttcaaattgcaagcaagatatgttgttgagagaatggatggtgatttgtgggctaaagttcttactcctgataatgagtatagaaggcaacttattgatcaggttgtatctacggctttgcctgaaagctcaagcccagaacaagtttctgcagctgttaaggctttcatgacagctgatctgcctcatgaattgattgaacttctcgagaagattgtgcttcagaattctgcattcagtgggaactttaatttgcagaatcttcttattttgaccgcaataaaggctgatccatccagagttatggattatatcaatagactggataattttgatgggcccgcagttggagaaatggctgtagaaggtcaactgtatgaggaagcatttgcaatttttaagaagttcaacttgaatgttcaagcagttgatgtcttgcttgaaaatatacatagcattgatagagctgtggagtttgcttttagagttgaagaagatgctgtttggagtcaagtggccaaggctcaacttagggaagggcttgtaagtgatgccattgagtcgtttatacgggcagaagatgctacgcaatttttggatgtcatcagtgctgctggaaatgctaatgtttaccatgacctggtgaaatacttattaatggtaagacagaaggcaaaagaacccaaggttgacagtgagctcatttatgcgtatgcaaagattgataggctcagtgacattgaggagtttattcttatgccgaatgttgctaatctacaaaatgttggtgatcggttgtatgatgaagcattatatgaggctgcaaaaatcatatttgcttttatatcgaactgggctaagttggccatcacactggtcaagttaaaacagttccaaggtgctgttgatgcggcaaggaaagccaacagctcaaaaacatggaaggaagtttgctttgcttgtgttgatgaagaagagtttcgtttggcccagatatgtggacttaacattattattcaggtggatgacttggaagaagtcagtgaatattaccaaaatagaggccacttcaatgagttaatatctctcatggagagtggtttagggttagagcgggctcatatgggcatcttcaccgagttaggagttttgtttgctagataccgccctgagaaacttatggagcatatcaaactattctccacccgcctcaatattccaaaactcataagagcttgtgatgaacaacaacattggacagaattgacgtatttgtatatccaatatgatgagtttgataatgctgcaaccaccatcatgaaccattcaccagaagcatgggatcacatgcaattcaaagatgttattgtcaaagttggaaatgttgagttgtattataaggctgttcacttctatttggaagagcatccagatcttatcaatgatgttctgaatgtccttgcccttcgtgtggaccatgcacgtgttgttgacatcatgcgaaaggctggtcacctccgccttgtaaagccatacatggttgcagttcagagcaacaatgtatctgctgttaatgaagccttgaacgagatatatgttgaggaggaagattatgatagattgcgtgagtcaattgatttgcatgataactttgatcaaataggcctcgcacaaaagattgaaaagcatgagcttcttgagatgaggcgtgttgctgcttatatttacaagaaggctggtaggtggaagcaatccattgctctgtcaaagaaggataatctttacaaagatgcaatggagacagcctcacaatctggcgagcgtgaacttgctgaggaattgcttgtttatttcattgatcagggaaagaaggaatgctttgcctcgtgtctatttgtttgctatgatttaataagggcggacattgctcttgaactagcttggatgcacaatatgatcgactttgccttcccatatcttttacaggtttgcat

SEQ ID NO: 5232 - DNA, 5237 bp, Catharanthus roseus
ggccaaaatgaagtcacatcaatgctgacaggtgtttttggtaagtggattaccctaaggtgttgggtttggttcgactcagtcctccgtttatcattggtctattgaaggagaatctgaacctgtaaaaatgtttgacagaacagctaatttagcaaacaaccaaataatcaattataggtgtgatccatctgaaaaatggttggttttgattggaattgcacctggttctcccgagagacctcaactggttaaaggaaacatgcaactgttttctgtggatcagcaacgtagtcaagcccttgaagctcatgcagcgtcatttgcttccctgagagtacccggaaatgataaggattctattcttattgcatttgctacaaaatcctcaaatgctggacaggtcgtctcaaagttgcatgttattgagcttggagctgtgccaggaaagccatcttttacaaagaagcaagctgatcttttcttccctcctgatttcgctgatgacttccctgtagctatgcagatttctcacaagtatagtttgctatatgtcatcacaaagcttggacttctctttgtatatgacctggaaacagccactgcagtttataggaataggatcagcccagatcctatctttttgacctcagaggcttcatctgtgggtggcttctatgcaattaatcggcgaggacaggtattgctggctacagtgaatgaagcgacaattgtaccgtttgtcagtggccagttaaacaatctggagcttgcagtaaatctcgccaaaagaggaaaccttcctggtgcagagaatttggttgtccagcgtttccaggagttatttgctcagacaaaatataaggaagctgcagagcttgcagctgagtctccacaaggcatcctacgaacacctgacactgttgccaagtttcagagtgtacctgtccaagctggacaaacaccacctctcttgcagtactttggaacacttttaacccgtggaaagcttaatgcctttgagtcactagaattatcccgccttgtcgtgaatcagaataagaagaatcttttggagaactggttggctgaggataaactggaatgtagtgaggaacttggtgaccttgtgaagactgtggacaatgatcttgcactgaaaatatacataaaagcaagggcaacgcctaaggttgttgcagcttttgctgagcggagggaatttgacaaaatactgatttactccaagcaggttggctatacaccagattatttgttccttctgcaaacgattctacgttcagatcctcagggggctgttaattttgcccttatgatgtcccaaatggagggaggctgccctgtcgattacaacactataactgatctctttcttcagaggaacatgatccgtgaggcgacagcatttttgttggatgttctgaagcccaatttaccagaacatgcttaccttcaaactaaggttcttgaaatcaatcttgtcacattccctaatgtagctgatgctattttagcaaatgggatgtttagccactatgaccgtccacgtatcgcacagctttgtgaaaaagctggtctatatatgcgagctcttcagcactacgctgaacttccagatatcaaacgtgttattgtgaatactcatgcaattgagccacaggctcttgtagaattttttggtacgctttcacgagaatgggcattggagtgcatgaaggatctgctactcgtcaacctaaggggcaaccttcagatcattgttcaagttgctaaagaatattgtgagcagttgggtgttgatgcttgtgtcaagctctttgaacagttcaagtcctatgaaggattgtacttcttcttgggctcatacctgagctcaagtgaggaccctgatatacatttcaagtacattgaagctgccgcaaagactggacaaattaaggaagtcgagcgcgtaacgagggagtcaaatttttatgatgctgaaaagacaaagaacttcttgatggaagccaagcttccagatgctaggccactgatcaacgtgtgtgatcggtttggttttgttccagatttgactcactacttgtacacaaacaacatgttgcggtatattgaaggatatgtacagaaggtcaatcccggaaatgctcctttggttgttgggcagctgctagatgatgaatgccctgaggattttatcaaaggactgatcctttctgtgcggtctctgcttccagttgagccccttgtggaagagtgtgagaaaaggaatcgactccggttgttaactcaatttctggagcatcttgtgagtgaaggaagtcaagatgtacatgttcacaatgctttggggaaaatcattatagacagtaataacaaccctgagcacttcctcacaaccaacccatattatgattcacgtgttgttggcaaatattgtgagaagcgtgatcctacccttgctgttgtggcttaccggagagggcaatgtgatgatgagctcatcaatgtaacaaataagaattctctatttaagctgcaagccaggtatgtggttgaaagaatggatgctgatctctgggagaaggttctgaaccctgagaatgaatttagacggcagcttatcgatcaagttgtatctactgcacttcctgaaagcaagagccctgaacaagtttctgcagctgtgaaagcctttatgacagctgatcttcctcatgaacttattgagcttcttgagaagattgtgcttacaaaactctgcattcagtggaaacttcaatttgcagaacttactgatattgactgctatcaaagcagatcctactagagttatggactatgtcaatagactggataactttgacggacctgcagttggtgaagtggctgttgaggcccaattatatgaagaagcttttgcaattttcaagaagtttaatttgaatgttcaagctgtcaatgtcttattggataatattcgtgacatcaaccgtgcagtggagtttgcattccgtgttgaggaagatgcagtttggagccaggtagctaaggctcaattgagggagggattggtgagtgatgccattgagtcctttatccgggcagatgatgccactgagttcttggaggtcataaaagctgctgaggatgctgaagtgtaccatgacctggtgaaatacctccttatggttaggcagaagacaaaggaacccaaggttgacagtgagattatttatgcatatgctaaaattgatagactgggtgacattgaagagtttattctcatgccaaatgttgcaaatcttcctaatgtgggtgaccgcttatatgatgaggctttatatgaggctgcaaaaatcatttttgcttttacttctaactgggctaagctagctgtcacattagtcaagttgaagcaatttcaaggtgctgttgatgctgcaaggaaggctaacagctcaaagacatggaaagaagtatgctttgcttgtgtcgatgctgaggagttccgtttggctcaaatttgtgggcttaacattattgtgcaggtggatgacttggaagaagtcagtgaatattatcagaacaggggatgctttaatgaactaatttctctcatggaaagtggactagggttggagcgtgcccatatgggcatatttacagagctaggtgtgctttatgctagatatcgccatgagaagctcatggagcatatcaagttattttctactcgactgaacattcctaagctaatccgagcttgtgatgagcagcagcactggaaagaactcacatatctatatattcagtatgatgagtttgacaatgctgccactactgtgatgaatcattccccagatgcttgggatcatatgcagttcaaggatattattgtcaaagttgctaatgtggagctttattacaaggctgtacatttctatttgcaagagcatcctgatctcatcaatgatgttctcaatgtccttgcacttcgcgttgaccatactcgtgttgtggacataatgaggaaggctggccatctacgtctcgtgaaaccatacatggttgcagttcagagtaacaatgtttctgctgtgaatgaggctctgaatgagatctacgttgaggaggaagactatgacagattaagggaatcaattgatttacatgataactttgatcagattggccttgcacaaaagattgagaaacacgagctgcttgagatgaggcgtgtagctgcttatatttacaagaaggcaggtaggtggaagcaatccattgctctgtcaaagaaagacaatctttacaaggatgcaatggagacagcttcccagtctggggatcgtgaactggctgaggagctgcttgtttattttatcgaacaaggaaagaaagaatgctttgcatcatgcctgtttgtttgttatgatctaattcgtgctgatgttgctcttgagcttgcttggatgaacaatatgatcgactttgccttcccttatcttttacagtttatccgtgaatacacgggcaaagttgatgaattgatcaaggacaaaattgaagctttgaaagaagtgaaggccaaggaaaatgaagagaaggatgtcattaagcagcagaatatgtatgcacaattgcttcctcttgctctgcctgccccaccaatgcccggtatggggggtggtatgggaggaggttttgttccacctccacctccacccatgggtggaatgggaatgccgccgatgtcacaatttggcatgccaccaatgggctcctattaatcttggcaaatatatttgtagcagtggatagttcgcatggttgccgctttaggtggaaatggaaagcagaccagtttgggctcttcacagttgatgtttcttggttcaaccgcatcttacagctgatattttctggtaatagttattgatggatggggctcggggtgcaggtttagggtaaagaataatgtttttcgcggtgttgtttgtgatagggtgtggatatgtttctttgtaatattcttttagtgaggcaattttttgcagctgggtaggcggcaagctgaggatattttgtattttattatgaacacagtgttctatatgaatattttgtcacattttgtactgatttgccatttacaaccaataccattttgtgggttctatttaaatctctcgactctgagtcccaatttaacg

SEQ ID NO: 5233 - DNA, 5083 bp, Gossypium hirsutum
tgcttggcctagtcacgcaaacttctgtgtatcattggtcaattgaaggcgactccgtaccagttaaaatgtttgagagaacagcaaatttagtgaacaatcagataataaactataaatgtgacccttctgagaagtggttggttttgattggaattgcccctggtgcacctgagaggccgcaattggttaaggggaacatgcaacttttctctgttgatcagcaacgtagtcaagctcttgaagcacatgctgcttcatttgcacaatttaaggttccaggaaatgagaatccttctattctaatttcctttgcaacgaagacttttaatgccggtcagattacatcaaaattgcatgtaattgagcttggtgcgcagccaggtaagccatcgttttcaaagaaacaggcagatctgttctttccaccagattttcaagatgattttccagttgcaatgcagatatcccacaaatatagtttgatctatgttatcaccaagctaggactgctttttgttatgatctagagactgcaagtgctgtatacagaaatcggatcagtccagatccaatatttttaacctctgaagctacatcagcgggagggttttatgccatcaacaggcgagggcaggtgttgctggctactgtaaatgaagcaacaatagtgccatttgttagcggtcaattgaacaatttggagcttgctgtcaatctagctaaaagaggaaaccttcctggtgcagagaacctggttgttcaacgttttcaagaattgtttgctcaaacgaagtataaagaagctgctgagcttgctgcagagtctccacaagggatccttcgtacacctgatacagttgccaagtttcagagtgttcctgtgcaagctgggcagactccaccgctgttgcagtactttggtacgcttttaactagagggaagctcaatgcattcgagtcattggaattatctcggcttgtggtaaaccaaacaagaaaaaacttctggaaattggttggctgaagataagttggaatgtagtgaggaacttggagaccttgtgaagactgtagataatgatcttgctctaaaatatatattaaagctagggcaactccaaaaagttgttgcagcttttgcagaacggagggagtttgataaaatcttgatttactcgaagcaggttgggtacactcctgattacttattccttctgcaaacaattcttcgtacagatccacagggagccgtaaattttgcattgatgatgtctcaaatggagggaggttgcccagttgattacaacaccattactgatctttttcttcagaggaacttgatacgggaggctacagcatttctattagacgttttgaagcctaatctgcctgagcatgcttttctacaaactaaggtcttggaaatcaatctagttacttttccaaatgttgctgatgccattttagcaaatggcatgttcagtcactatgaccgtcctcgcattgcacaactctgtgagaaagctggtctctatgtccgagctctgcagcattacactgagttaccagatattaaacgtgtcattgtgaatacacatgctattgagccacagtcacttgttgagttttttggtactctttcacgagaatgggctttggagtgcatgaaagatcttttgctggttaatctaaggggcaacctccaaataattgttcaggttgccaaggagtattgtgagcagctgggtgttgatgcttgcataaagctttttgagcagtttaaatcttatgaaggattgtacttctttctgggctcttatttgagctcaagtgaggaccctgatatacactttaagtacatcgaggcagctgctaaaactggacaaataaaggaggttgagcgtgtgaccagggaatccaacttttacgatgctgagaagacaaagaacttcctgatggaagccaagcttcctgatgctaggccgttgattaatgtttgtgatcggtttgggtttgttcctgatctcactcactatctctacacaaataacatgttacgttacattgaaggttatgttcagaaggtgaacccagggaatgctcctttagtggtggggcagttgctagatgatgaatgccctgaagattttatcaagggcctcattctctcagtccgttctttgcttccagtcgagccccttgtggaggaatgtgagaagagaaatcgtcttcgtttacttacacagttcttggagcatcttgtaagtgagggaagccaagatacacatgtccacaatgctttgggtaaaatcatcattgacagcaataacaatccagagcatttcctcacaaccaacccttactatgactcccgggttgttggcaagtactgtgagaagcgtgatcccaccctagcagttgtggcttaccgaagaggacaatgtgatgatcaacttatcaatgtcacaaataaaaactcattgttcaaattgcaagccaggtatgttgttgagaggatggatggtgatctttgggagaaggtgctaaatcctgaaaatgaatacagaagacagctaattgatcaggttgtgtcgacagctttgccagaaagcaagagtccagaacaagtctctgccgctgttaaagctttcatgactgctgacctgccccatgaactgattgagcttcttgagaagattgttctccaaaactctgcattcagtgggaacttcaatctgcaaaatcttcttattctgacagctattaaggcagatccatctagagttatggattatatcaataggctagataattttgatggacctgcagttggagaagtggccgtcgaagctcaactgtatgaagaagcatttgcaattttcaaaaagttcaaccttaatgttcaggctgtcaatgttttattggataacataagaagcatcgatcgggctgtggaatttgcattccgagttgaagaagatgctgtttggagtcaggtggcaaaggcacaactgagggaggggctagtaagcgatgcaattgaatcgtttattcgtgcagatgatgctactcagttccttgatgtaatccgagcatctgaggatgctgatgtgtaccctgatttggtgaggtaccttctgatggttagacagaaggtcaaggagcccaaggtggatggtgaactcatttatgcatatgcaaagactgatagactgggtgaaattgaagaattcattctcatgccaaatgttgctaatcttcaaaatgttggtgatcgtttgtttgatgaagccttgtatgaagctgctaaaataatatttgcatttatatcaaactgggccaagttggctgttacactggtgaggcttaaacaattccagggtgccgttgatgcagcccgaaaagcaaatagtgccaagacatggaaggaggtttgctttgcttgtgttgatgcagaggaattccgattggcacagatatgtggtcttaacattattatacaggtggatgacttggaagaagttagtgaatactatcaaaataggggatgtttcaatgagttgatctctctcatggagagtggtttaggattggaacgtgtacacatggggatctttactgagttgggagttctttatgccagatatcgttatgagaagcttatggagcacattaaattgttctctactcgtctcaatatccccaagctgataagagcctgtgatgagcagcagcattggaaggaacttacgtacttgtatatccagtatgatgagtttgataatgctgctactactgtgatgaaccactctcctgaagcatgggatcacatgcaattcaaagatattatagtcaaagttgcaagtgttgagctttattacaaggctgtccacttctacttgcaagaacatcctgatctcatcaatgatatgcttaacgtgcttgcacttcgagtggatcacacccgtgtcgttgacattatgagaaaggctggtcatctgcgtcttgtgaagccatacatggttgctgttcagagcaacaacgtgtcagcagtaaatgaggcattgaatgagatttatgtggaggaagaagattatgatagattgagagaatctattgacttgcacgataactttgatcagattggccttgcactaaagattgagaaacatgaactgcttgaaatgaggcgtgttgctgcatacatttacaaaaaggcaggtagatggaagcagtcaattgccttgtcaaagaaggacaaccattacagagatgcaatggaaacagcttcacagtctggtgaacgtgaacttgccgaggagttgcttgtttacttcattgagcagggcaagaaagaatgctttgcatcatgcctctttgtctgttatgacctagttcgaccagatgttgctcttgagctagcctggataaacaatatgattgactttgcattcccgtatctattacagtttatccgtgaatacactggcaaagttgatgaacttatcaaggacaagattgaggctcaaaaggaagtaaaggctaaagagcaggaagagaaggacgtgatcgcacaacagaacatgtatgcacagttgctacctcttgccttgcccgcaccgccaatgccaggcatgggaggttttgctccatcaccaccaccaccacccatgggaggaatgggaatgcctccaatgccagctttcggcatgccaccaatgggcagctattaagtcataacaggtctgttcaattgaaacattttaggttacggatcaatggggctctatatagctgcaatttcgaggctttcattctttttcccctctttctttttcatttgtctgatgagtgaagatcaaaatttggaataatgccatttttgtgtttcaagtgtgtgatatatggccttgtaatattcttttatttagaagaggaattttttgaggtggtgatagagagcaaaccgaggatttcatgaatttgtaatttgtagtattatttcctgtcggtcattggaacgaccgagcatgtaccaaaaaaacttacacaccaatcatatttttggattttaatgttc

SEQ ID NO: 5234 - DNA, 6365 bp, Sequoia sempervirens
gattataacaaatattttaatcatatgtcatgagacaactaactcaactaatattaaatgacctaagactcaagtattaaatgcgaaaaagataagataaaatctgagtgacaactaagacttatagaaagattcataagtagactaaacatgtaaatatgatctattagttgacttaataggtaaaatacctatttacaccaactatcaatgtatcccttacaccttgtgagggtgaaagtactagtttatttaattataatattgtgtctagtaaaataaggaaggattcatgctgtaatagcaaagcttttggcaaagaacttgggatcttctttcatcaacttgagcaaaaattcctgaaatactgctcgagctgattctgtgtccattggagaccctgatgaaacaggctttgtctccaccttgaacacatcgtttaaggccgtagtggaaaccatggccgctttaagcaaccccaacacctcagctgcaccaacagtagcatttttctcttccaattcggtaggctctttcacttgaagtttgttccacagattaacaatggtagcggtggaatcaacaggaagcacacttaagtcatcggtgatgacaaaattagcacgcttcttaacatagccctgagtagttgcaggtacaacaggttgcggggttgaatcagcgggacgatcgacaaaatagacctcccggttaacatagtacccgcaggggcatttgacagctccagaaagggggctaaggtagtgcttgtagcttgacgaaccggcgttgctgcagacataatatttgggaggctcggcaggcttagcagcagcaggaggagagggcgcctcaatattgagtgtctcgttggtatagatggtggagaataatttttggccgaggagggccgatttatcggctttcatgagagaatctggcaaggcctcgacgctgttatagagattagtaatacagcagggtttggtagtggtgtcaccgcgcagggccagcttcgcaacgagacccgttggaagtgttagaaagctacataacatatccacaaagtcttttccggcttctgcatacattacgcgccggtttttcttattcaccatcagtttgatggtgagggaggaagtgggtttagtaggcgtgggcttgctctcattgtcagttgccattgcaaaactatcttttctctttttctgtgtgattggaaggctcaaataccaggcagcactcaggatcatctacagatatttaacattgagatgaaggcaaaagtaaaatcgtatcagatgcctgaacaggttgtgttttggaagtggatcacaccaaagatgttgggacttgttacacagagttcagtgtatcattggtcattggaaggggattctgaacctgcccgaatgtttgagcgaacggccaatttaacaggcaaccagataataaattatcgatgtgatcctactgaaaagtggcttgttttgattggaattgctccaggagcacctgagaggccacaacttgtcaaggggaacatgcagttgttttctgtagagcagcagcgaagtcaagctctagaagcccatgcagctgcatttgcatcatttaaggttgcaggcaatgaaaatccttccatccttatttcgtttgcttcaaaaacaatcactggagggcagctcacttcaaagttacacgtgattgagctgggtgcacaaccaggtaagccagggttcacaaagaaacaggcggatctgtttttcccaccagattttgcagatgattttccagtatccatgcagatatcacacaagtatagtctgatatatgtcattacaaagctgggacttctgtttgtttatgatttagaaacagcaacagccgtttacaggaatcggatcagtcctgatccaatctttttaacatctgaagcaacttctgttggtgggttctttgccgtcaatcggagggggcaagtgttgcttgcaactgtcaatgaagctacaattgtgccttttgttagtggacagctcaacaaccttgagcctgctgtgaatcttgctaaaagaggaaaccttcctggggcggaaaatctggttgtccagcgattccaagagttgttttctcagatgaagtataaagaagcggcagaacttgctgctgaatctcctcaaggcattcttcgtacgccagacactgtagcaaagttccagagtgttccagtacaaccagggcaaacaccacctcttctccagtattttggtactctattgacgaaaggaaagttgaatgcatttgagtctcttgaactttcacgattagttgtaaatcagaataaaaaaaccttttggagaattggcttgctgaggacaagttggagtgtagcgaggaattgggggatcttgtgaagactgtggacaatgaccttgcattaaaaatttacattaaagcaagggctaccccaaaagttgttgcagcttttgctgagagaagggaattcgacaaaatacttatttactctaaacaggttgggtacactcctgattacttgttcctcctccagacaattttgcgctctgatccccagggcgctgtaaactttgcattgatgatgtctcaaatggagggtggttgtccagttgattacaatgtcatcacggatctctttcttcagcgtaacatgatccgtgaagcaacatcctttttgttggatgttttgaagcctaatttgccagaacatgcgcatcttcaaactaaggttctcgagattaatttggtcactttccccaatgttgctgatgctatcttggcaaatggaatttttagtcattatgatcgtcctcgtattgcacaattgtgtgagaaagctggtttatatatgcgtgcgcttcagcactatacagagttgccagatattaaacgtgtcattgtcaacacccatgctatcgagccacaggcccttgttgagttctttgggaccctttctagagagtgggcattggagtgcatgaaagatctccttcttgtcaacctgaggggaaatctccaaataattgtccaggctgccaaggaatattctgaacaattgggtgcagattcatgcatcaagttgtttgaacagttcaagtcttatgaagggctttatttcttcttgggtgcatatttgagctccagtgaggatcccgacattcacttcaagtacattgaagcggcagccaaaactggacaaatcaaggaggtggaacgtgtaactagagagtcaaacttctatgatgctgaaaagacaaagaactttcttatggaagcaagacttccagatgctcgtccactgataaatgtttgtgatcggtttggatttgtaccggatcttacccattacttatattcaaacaatatgttgcgatacattgaaggctatgtccaaaaggtaaatccaagcaatgctcctttagttgttggtcagctgcttgatgatgattgtcccgaggacttcatcaaaggtcttattctgtctgttcgttctctccttcctgttgaaccacttgttgaagaatgcgagaaaaggaaccggcttcgattgttgacacaatttttagagcatcttgtgagtgaaggaagtcaggatgtacatgtacacaatgcgttgggtaaaatcattattgatacaaataataatccagagcacttcctcactacaaatccctactatgattctcgggtggtgggtaaatactgtgagaaaagggatccaactctggcagttgttgcatataggcggggacaatgtgacgaagagcttattaatgtcaccaataaaaattctctatttaagctccaagcaaggtatgttgttgagcggatggaacctgacctttgggaaaaagttcttaacccagataatcctttccggaggcaacttattgatcaagttgtatcaactgctttacctgaaagcaaaaatccagatcaggtatctgcgacagtgaaagcatttatgactgctgatctgccgcatgagttgattgaacttctagagaagattgttctacaaaattctgctttcagtggaaatcctaatctgcaaaatcttctcatcctgacagccattaaggctgataagtcgcgtgtaatggactacattaataggttggacaactttgatggccctgcagttggggaaattgctgttggagctgagttatatgaggaggcctttgccatttttaagagtttaatctaaatgtacaagctgtaaatgttcttttagacaacattcgaagcattgagcgggctgtggagtttgcctcacgtgttgaggaggatgcggtatggagtcaagtggcaaaggcacaacttagggagggaatggtcagcgatgctattgaatcattcattcgtgctgatgatgctacagagttccttgatgtgatcagggcagcagagctagcaagtgtgtatcatgacctagttaagtatttgctgatggtgaggaaaagattaaagagccaaaggttgacagtgagcttatctatgcatatgctaagattgacaaacttggtgaaattgaagaatttatactaacaccaaatgttgctaatcttcaaagtgtgggagatcgtctatttgatgaagctctttatgaggctgctaagataattttcacttttatttccaactgggcaaaactcgccagcactcttgtcaaacttggtcagttccaaggagcagttgatgctgctcggaaggcaaacagttcaaagacatggaaggaagtatgttttgcctgtgttgatgctgaggagtttagattggctcaaatctgtggattgaacatcattatacaggtggatgacttggaagaggtcagtgattactatcaaaacaggggtcgctttgatgaactcatatctctgatggaaagtggcttggggttggagcgtgcacatatgggcatctttacggagctgggtatcctctatgctagatatcgcccagacaagcttatggaacatatcaaattattttcaacacggctcaatatacccagggttatccgtgtttgtgatgagcagcagcactggaaggaacttacatatttatatattcaagatgatgagtatgacaatgctgctactactatcatgaaccattctccagaagcatgggatcatatgcaattcaaagatgttgtagttaaagtggccaatgttgaattgtactacaaggctgtccacttttatttgcaagaacacccagaccttattaatgacctcttgaatgtccttgcccttagggtagaccacacacgagtggtcgacatcatgcgtaaggctggacatctccgtcttgtgaagccatacatggttgcagtacagagcaacaatgttgctgctgttaatgaggctttgaatgaaatctatgtagaagaggaagattatgacaggcttcgagaatctatagatatgcacgataactttgatcagatagggcttgctcagagggttgagaaacatgaacttcttgaattccgccgtattgctgctttcatttacaagaaagcaggaagatggaggcagtctgttgcgctgtccaaaaaggataatctttacaaggatgcaatggaaactagttcccaatcgggtgatcgtgaacttgcagaggaattgctggtgtattttgtggaacagggaaagaaagaatgctttgcttcatgcttgttcatatgctatgacttgatcagaccagatgtggccttagaacttgcctggatgaataatatgattgattttgtgtttccatacctacttcagttcattcgagaatacacaacaaaagttgatgagcttgttaaggacaagttagaggctgctcaagaagagaaatccaaggagaaagaagagaaagagcttgttgcccaacagaatatgtatgctcagcttcttcccttgctttgccagcacctccaatgcctggcatgggaatgggaggtggatttcaaccaggtatgggcggaatgggaatgcctcccatgccagcttatggtatgccacctatgggtggctattgatgagactggagaactaacgtgggatgcataattcttcaagcatacatgtttttttgaggcttgtattcgatattagtaagagcaatgccggctggttgttcatcccggatgcaatagtttggcagagcattttgtgaaattgtaggaactcgtgttcagtatgattttgtagattgggctgattaggagagggcaaatttttgctatggcctgatatgggtcattttctgaatagcatttttgttcttattttattgtcggtattaattctttaattgacattattctttgg

SEQ ID NO: 5235 - DNA, 4872 bp, Fagus grandifolia
ctgggcctggtgacacagacctcagtatatcattggtcgattgaaggtgattctgaacctttaaagatgtttgatagaacggcaaatttggcaaacaatcagattataaactatcgatgtgacccttctgaaaagtggttggttttgattggaattgctcctggtgcacccgagaggccacaattggtcaaagggaatatgcaacttttctcaattgatcagcagcgcagtcaagctcttgaagcacatgctgcatcatttgctcaatttaaggttccaggaaatgaaaatccttctgttcttatttcttttgccacaaagaccctgaatgctggacagatcacatcaaagttacatattattgagcttggtgcccagccagggaagccgtcttttacaaagaaacaagcagatcttttcttcccgccagattttgccgatgactttccagttgcaatgcagatatcccagaaatacaatttgatctatgtgatcaccaagcttgggctattatttgtttatgacatggagaccgctactgcggtatacagaaatagaatcagtccagatccaatatttttgacagcagaagcttcgtcattgggagggttctacgccgtcaataggcgtggacaggtgctactggctactgtcaacgaacaaacaattgtgccatttgtcagtggccagttgaacaatttggaactagctgtcaatcttgccaaaagagggaatcttcctggtgctgagcagctggttgtcaacgtttccaagaattgtttgcccaaacgaagtacaaagaagctgcggagcttgctgctgagtctccacaaggaatcctccgtacacctgacacagttgcaaaatttcagagtgttcctgttcaagctgggcaaacaccacctctgttgcagtattttgggacactattgacgagaggaaagcttaatgcatttgagtcgttggaattatcacgtctagttgtgaaccagaacaaaaagaatcttttggaaaattggttggcagaggataagctggaatgcagcgaggaactaggggatcttgtgaagactgtggataatgatctagcattgaaaatatatattaaagccagagcaactccgaaagtcgtcgctgcttttgctgagcggagggagtttgacaaaattctgatctactcaaagcaggttgggtacactccagactatctattccttttgcaaaccattcttcgttcagatcctcagggagctgtgaattttgcattaatgatgtctcaaatggaggggggttgtccagttgattacaataccataacagatctctttcttcagaggaacttgatccgtgaggcaacggctttcctattagatgtttgaagccaaatcttcctgaacatggtttccttcaaacaaaggtcctggaatcaatctggtaacttttccaaatgtagctgatgctatattagccaatggaatgttcagccactatgatcgtcctcgaattggccaactatgtgaaaaagccggtctttatattcgtgctctgcaacactatacagagttgccagatattaaacgtgtcattgtgaatacacatgcaattgagccacagtcacttgtagagtttttcggcactctgtcacgagaatgggctttggagtgtatgaaggaccttttattggtcaatctaagaggcaatcttcagataattgtgcaggctgccaaggaatattgtgaacagttgggtgttgatgcatgcattaaaactttttgagcaatttaagtcatatgaagggttgtactttttccttgggtcatatttgagctccagtgaggaccctgacattcactttaagtacattgaggcagctgctaaaactggacaaatcaaagaggtggagcgtgtgaccagagagtcgaatttctacgaccctgagaaaacaaagaactttttaatggaagcgaagcttccagatgcacgtccactaattaatgtttgcgaccgttttggatttgttccagatctcacacactatctgtactcaaacaacatgcttcgttacattgaaggttatgttcaaaaggtgaacccaggaaatgctcctttagtgtggggcagctgctagatgacgagtgtcctgaagattttatcaaaggcttgattctttctgtccgttctttgcttccagtggagccccttgtggaggaatgtgagaagaggaatcgacttcgtttgctcactcagttcttggagcatcttgtgagtgagggaagccaagatgtacatgttcacaatgctttgggtaaaatcatcattgatagcaacaacaatccagagcacttcctcaccaccaacccctattatgattcccgtgttgtgggtaaatattgcgagaaacgtgatcctaccctggcagttgtggcctatcggcgaggtcaatgtgatgaagagctcatcaatgtcacaaataaaaattctttgttcaaactgcaagcaagatatgtggtagaaaggatggacactgatctttgggagaaagttcttaaccctgataatgtctatagaagacagctcattgatcaagttgtgtctactgctttgcctgaaagcaagagtccagaacaagtttctgcagctgtaaaggctttcatgactgctgatctgcctcacgaattaattgagctccttgaaaagattgtgctgcagaactccgcattcagtgggaactttaatctgcaaaacctgcttattttgacagcgattaaagcagatccatctagagttatggattacattaatagactagacaactttgatggacctgcagttggggaagtggctgtggaagcccaactgtatgaggaagcatttgcaattttcaagaagtttaacttaaatgttcaggctgtcaatgtcttattggacaatatccaaagcattgaacgggctgtggagtttgcattccgtgttgaagaagatgctgtttggagccaggtgggcaaggctcaactcagggagggcctggtgagcgatgccattgagtcatttattcgtgcagatgatgcaactcaatttttggatgttattcgtgcttctgaggatgcaaacgtttaccatgacttggtgaggtaccttctgatggttaggcagaaggtgaaagagcccaaggtggacagtgagctcatctatgcatatgccaagattgataggctgagtgacattgaagagttcattctcatgccaaatgtggctaatctccaaaacgttggtgatcgcttatatgatgaagccctttatgaggctgcaaaaataatatttgcatttatatctaattgggccaagttggctgtcacacttgtgaaactaaaacaattccaaggtgcagttgatgcagcaaggaaagctaacagttcaaaaacatggaaggagatttgctttgcttgtgttgatgcagaggagttccgcttagctcagatatgtgggctcaacattattatacaggtggatgacttggaagaggtcagtgaatattaccagaatagaggatgcttcaatgagctaatctctcttatggagagtggtttaggtttggaacgtgcacatatgggcatctttacagagttgggagttctgtatgctagataccgtcctgaaaagcttatggagcacatcaagttgttctcaacccgtctcaatattccaaagcttataagagcctgtgatgaacaacagcattggaaggaactcacctatttgtatatccaatatgatgaatttgacaatgctgcaactactataatgaaccattcccctgaggcatgggatcacatgcagtttaaagatgttgcagttaaagttgctaatgtggagctgtattacaaggctgtgcacttctacttgcaagaacatccagatcttattaatgatcttctcaatgtgcttgcacttcgtgtggaccatacacgtgttgttgacattatgcggaaggctggtcacctgcatcttgtgaagccatatatggttgcagttcagagtaacaatgtagctgctgtgaacgaggcgttgaatggaatatatgttgaggaggaagactatgataggttgcgtgaatcaattgatctgcatgataactttgatcaaattggccttgcacagaagatcgagaaacatgagcttcttgaaatgagacgcgttgctgcttatatttacaagaaagctggcaggtggaagcagtccattgcattgtcaaagaaagacaacctttacaaagatgccatggagacagcctcacaatctggtgagcgtgaacttgcagaggaattgctggtttacttcattgaaaagggaaagaaggaatgctttgcttcatgcctctttgtttgttatgatttaattcgggcggacattgctcttgaacttgcctggatgaacaatatgatcgactttgctttcccgtatctgttgcagttcatccgtgagtacacgggcaaagttgatgaacttgttaaggacaaaattgaggctctgaatgaggttaaggctaaagagaaggaagagaaggatgtgatggcacaacagaacatgtatgcgcagctgctgcctcttgctttgcctgcacctccaatgccaggtatgggaggtggaccgggaatgggagggtttgttccaccgccacctatgggtggaatggggatgcctcctatgccaccttatggtatgcctccaatgggtactggctactgatacgcggacatattgttcaagctgaagttaatgatggaaattgagagtgtaggggcaaggacaacctagcggttatggcatttttgtcttgtgttagtgcgtggggtgttggtgcctcattttttc

SEQ ID NO: 5236 - DNA, 6978 bp, Vitis vinifera
acagaaaccaaacaaacggaatcagaaaatagaaagacgaaagcaaaaaaaaaatcatcgcaagcaaagacagaaaccaaagagaaaacgttccagaaatcaatcaatggcgtgctcggttgcagtgaacaactcccctgtcttctctccctcttcctctctcttctgcaaaacctcagtctcttctcctgaaaccctgacgcgtcaccaccatgtctcttcgccctcctcgccatcttctccctttaggcttaggcttcccaagtccttgactgggctgaggccctgcaaggaggggcctgcttcttcttcttcttcttctgctgctgctgctgctgcttcggcttcggcgtcttcgcccacggttttgaagcgaaagaggcccgcgaggttggatattccgattgcgtcgttgagttttccggcgccggttccggtgggtgaggggtgtagggaggcggtggaggatgagagagacgggtattattccgtgtattgcaagagggggaggagagaagctatggaggatcgctactcggctgtggttgaccttcaaggagaccacaaacaggctttctttggtatttttgatgggcatggtggtgcaaaagctgctgaatttgcagcacaaaatttgaaaaacaacatcttagatgaagtggtgagaagaggtgacgatgaaattgaagagtcagtaaaacacggttacttgaacacggattctgattttctaaaggaggatctccgcggtggatcatgctgtgtgacagctttgatccggaatggcaaacttgctgtgtcaaatgctggtgactgtcgcgctgttatgagcagagggggaattgccaaggccctcacttctgatcatcggccttcgagagaggatgaaaagagcagaattgaaaagctggatggctatgttgattgctaccatggtgtttggagaattcagggatctttggctgtatcccgaggaattggcgatcgtcatcttaagcagtgggtaactgcagagccagagacaaaaatccttgcaattcaacctgactatgagttcttaatccttgcttctgatggattgtgggataaggttactaaccaagaagcagtggacatttctcgtcctttttgcatcggtgttgataagccagatcctttgtttgcctgtaaaaagctcgtagacctctctgtttcacgaggctcaactgatgatatcagtgtgatgctaattcggttgggccagtatatctgaagatccccattaaccctaaggggaaggaattcacctaacaaataggcaacttattttttcagaggaaactcagttctctcaagggcagggctctccgggtataattatgttttgcgggtagtgcctgtgactatgatagatatgatgaagaggatccatagttatactggaagagcctttatctagctgactatgtaacttcgacacaccattttttattgatagatctacaaataactttgatatgtaaatcagttgattctctgtaaaacattctgttgtatagggtgttcctttttctttgtttctcatcatcccttcaagcctctctgcctttctccaggcactggaagtctcgtttctctaagttgcttgtgcccacttcatcattctgcattttgaagcagagaagtcggtttcagctgctgagagaaggcaagtcatgaacggctagtgttagaaatttctcatacaagaaggttgtcttttggaagtggattacccctaagatgctgggcctggttacacaaacatcagtatttcattggtccattgaaggtgattctgagcctgtgaagatgtttgagcgaactgcaaatctggtaaataatcaaataatcaactatcgttgcgatccttctgaaaagtggttggttttgattgggattgcacctggttcacctgagaggccacaactcgtcaaagggaatatgcaacttttctcagtggatcagcaacgtagtcaggcccttgaagcacatgctgcatcatttgcctcatttaaagtattggggaatgagaatccctcaacgctaatatgttttgcctcaaagaccaccaatgctggacaaattacatcaaagctacatgttattgaacttggggcccagccaggcaaacctggattcactaagaaacaagcagatctgttctttcctccggattttgcagatgactttcctgtgtcaatgcaggtatcccaaaagtatggtttgatatatgtgataacaaagcttggacttctattcgtgtatgacctagagacggctagtgcagtttacagaaaccgaattagtccagacccgatatttttgacagcagaagcttcctcaattggaggtttttatgccattaataggcgagggcaggttttgcttgctactgtaaatgaagcaacaattgtgccttttgttagtggccagttgaataacttggagcttgccgttaatcttgccaaaagaggaaaccttcctggtgcagaaaacctggttgtccagcggttccaagaactgtttgctcagacaaagtataaggaagctgcggagcttgctgcagaatctccacagggactcctgcgtactcctgatactgttgccaaatttcagagtgtccctgtgcaatctggacagacaccacctctgttgcagtactttggtactctgttaaccagaggaaaactcaatgctttcgaatcactggaattgtcacgccttgttgtaaatcagaataaaaagaatctcttagagaattggttggcagaggacaagcttgaatgcagtgaggagcttggagatcttgttaagacggtggataatgaccttgcactgaaaatatatatcaaagctagggccactccaaaagttgttgcagcatttgctgagaggagggagttcgataaaattctaatatactccaagcaggttggctatacgcctgattatttgttcctactccaaacaattttgcggtcagatccccagggggcagttaattttgctttaatgatgtctcaaatggaaggaggttgcccagttgattacaacacaataacagatctattccttcagaggaatctgattcgtgaagcaacagcctttttgttggacgtactgaagccaaatttacctgagcatgggttccttcaatctaaggttttggaaatcaatctggttacatttccaaatgtcgcagatgctatattagctaatggtatgtttagtcactatgatcgcccacgtattgcacagctctgtgaaaaagctggtctttatgtgcgagcccttcagcattatactgaattgcccgatatcaaacgtgtcattgtgaacacacatgccattgagccacaggctcttgttgagttctttggaactctttcaagagaatgggctcttgagtgtatgaaagaccttctacttgtcaatcttcgtgccaatcttcagataattgtgcagactgccaaggagtattctgaacagttgggtgttgaggcatgtataaaactgtttgagcagttcaagtcttatgaaggattatactttttcttggggtcatatttgagctccagcgaggaccctgatatccacttcaaatacattgaggcagctgctaaaactggacaaattaaggaggtcgaacgtgtgactcgggaatcaaacttttatgatgccgagaagacaaagaattttctgatggaaaccaagcttcctgatgcacgcccactgattaatgtctgtgatcgttttggttttgttccagatctcacccattacttatatactaataatatgctccggtatattgaaggttatgttcaaaaggtaaatccgggaaatgctcctctagttgttgggcaacttctagatgatgaatgccctgaagatttcattaaaggtctcattctttcagttcggtctcttcttcctgttgagcccctcgtggaggaatgtgagaaaagaaatcgtctccgtttactcactcagttcttggagcatcttgtgagtgagggtagccaggatgtgcatgttcataatgctctgggtaaaatcatcatagacagcaacaacaatccagaacattttctcactactaacccatattatgattcacgtgttgtgggaaaatattgtgagaaaagggatcccactcttgcagttgttgcttaccgcagaggacagtgtgatgatgaacttatcaatgttacaaataaaaactctttgttcaaactgcaggccagatatgtggtggaaaggatggatgctgacctctgggagaaagttcttagtcccgataacgagtatagaaggcaactaattgatcaagttgtatctactgctttgcctgaaagcaagagtccagagcaagtttcagcagctgttaaagcttttatgactgctgatcttccgcatgagcttattgagcttcttgagaagattgtgcttcagaattctgcatttagtggaaacttcaatcttcaaaatctgcttatccttacagctatcaaggctgatccatcacgagttatggattatattaatagactagacaactttgatggacctgctgttggggatgtggctgttgaagcacaattgtatgaggaagcatttgccattttcaaaaagttcaacttgaatgttcaggctgtgaatgttctattggataacattcagagcattgaacgagctgtagagtttgcattccgtgtcgaagaagatgctgtctggagccaggtagctaaggcccagctaaaagaggggctagtgagtgatgcaattgaatcctttattcgtgcggacgatgccacccaattcttagatgtcatacgggctgctgagaatgcaaatgtataccatgacttggtgaggtatctcctgatggttaggcagaaaaccaaagagcccaaggtcgacagtgaactcatttatgcatatgctaagattgataggctgggtgacattgaggagttcattcttatgcctaatgttgctaatctccaaaatgttggtgatcgcttgtatgatgaagccttatatgaggcagcaaagatcatatttgcatttatttctaactgggctaaactggcttgtacgcttgtgaagctaagacaattccaaggtgcagttgatgcagctcggaaagccaacagctcaaaaacatggaaggaagtttgctttgcctgtgttgatgctgaggaatttcgcttggctcagatatgtgggctcaacatcatcatacaggtggatgatttggaagaagtcagtgactattaccagaacaggggatgctttaatgagctcatatctctcatggagagtggattgggattggaacgtgcacatatgggcatctttactgagttgggtgtcctttatgccagatatcgtcctgagaagcttatggagcacattaaactattctcaacccgcctaaacattcccaaactcatacgagcgtgtgatgagcagcagcactggaaggagcttacttatctgtatattcaatatgatgagtttgacaatgctgcaaccaccataatgaaccactccccagaagcatgggatcacatgcaattcaaagatgttgcagtcaaagttgcaaatgtggagctctactataaggccgtgcacttctacctgcaggaacatcctgatcttattaatgatctccttaatgtgcttgctcttcgtgtggaccacactcgggttgttgacataatgcgaaaggctggtcaccttcatcttgtgaagccctatatggttgctgttcagagtactaatgtggctgcggtaaatgaagcattaaatggtattcatgtagaggaggaggactatgatagacttcgggaatcaatagatatgcatgataactttgaccagataggccttgcacagaaggttgagaaacatgagcttctggagatgaggcgtattgctgcttatatttataagaaagcaggtagatggaaacaatccattgcattgtcaaagaaagacaacctatacaaagatgcgatggagacatgctctcagtctggggatcgtgaacttgcagaggagttgcttgtttatttcattgagcagaaaaagaaagagtgttttgcatcatgcctctttgtctgttacgatttaattcggccagacgttgtccttgagcttgcatggatgaacaatatgatcgactttgccttcccatatctcttacagtttattcgtgagtacacgggcaaagtagatgaccttgtcaaggacagaattgaggctcttaaagagacaaaagctaaagaggaggaggagaaggatgttgtgaaacaacagaatatgtatgcacagttactgcctcttgctttgcccgctccaccaatgccaggaatgggtggtgcagggatgggcggtggttttgctgctccaccaccaatgggcgggatgggaatgcctccaatgccaccattcggcatgccaccaatgggctcctattgatctatggttgtcatgaatcggtgattgtgggaaaccctctaatggagctggaaattttttggaatttcctcgtcgtgctgagggcgaagttaaacttctgtggtgacccggggaatggaatccagcggaattttcttgtaggattgtggacaaattgtcttaatattcctttcataggaggctttttgttttcttaccccttcttttgtagttggcgccgagcagattagactgctccaactgatctccatttgatctgggggtgatataatccaatagtgctggttaactgaaaagagatcatcgtggtaattttgctcctggtagtggcgaggttgccacgtgtataggttattgtagtttgttgattaaactctttgtttgttttccctttttaaactcatttggtggtctccccttcgttctgggaggttataaaatttcagttctcataacctttgccttttg

SEQ ID NO: 5237 - DNA, 5118 bp, Musa acuminata
atgattcatattggttcttgttttcatgagaatatataccattatgtaatttctttaatattgatgatgctgatattaggtgtgttgtatatcttcatatatacatctgttgaaattcaacttcttctgttttctttgttgtattatgctggtagtttgatattacttgtcctaagggaaaaattccatgtagccgaccccaaggttcaaataccaataggatcagtatgtactgagaaggtttttttgtctcaaatacctggaaccactcaggatcacttgcaggtattcaatattgaggcaaagactaaaattaaatctcatcagatgcctgagcaggtggtcttttggaagtggatcaccccaaagatgttgggtctggttacgcaaacttcagtctatcattggtcaatagaaggtgaatcagagcctgttaaaatgtttgatagggctgctaatttgacaaacaatcaaatcattaactacaagtgtgatcccactgagaaatggctggttcttattggaattgcaccaggtgttccagagagaccacaactggttaaaggcaatatgcagcttttttctgtggagcagcagcgcagtcaggcacttgaggcacatgcagcatccttcgcatcatttaaggtggttgggaatgagaaaccatccattcttatttgttttgcctcaaagacaagtaatgctggacaaattagttcaaagttgcatattattgaactaggagcccaaccaggaaaaccaggtttcacaaagaaacaagcagatctgttcttcccaccagattttgcagatgactttcctgtggcaatgcagatctcccaaaagtacagtttgatatacgtcatcacaaagcttggcctgttgtttgtgtatgatctggacacagcaacagcagtttacagaaatcgaattagtccagatcctatatttcttacaacagaggcttcaaatgtgggtggcttttatgcagtcaataggaggggccaggttcttctggctactgtcaatgaagcaaccattgtgccatttgttagtggccaattgaacaatcttgagcttgctgttaaccttgccaaacgagggaaccttcctggagcagagaatttggttgtgcaaagattccaagaactattttcccagacaaagtataaggaagctgctgagcttgctgcagaatctccgcaaggcattcttcgaactccagagactgttgcaaagtttcagagtgttccagttcaagctgggcaaacaccaccactgttgcagtattttggaacattattaacaaaaggaaagcttaatgcttttgagtctttggagctatctcgccttgttgtgaaccagaacaaaaagaatctactggaaaattggttggctgaagacaagcttgagtgcagtgaagaacttggggatcttgtgaagaccgtggacaatgatcttgcactgaaaatctatataaaagcaagggctactcctaaagttgttgctgcttttgcggaaagaagggagtttgataagattcttatttactcaaatcaggttggctacacgccagattatctcttccttctgcagaccattctgaggtcagatcctcaggcagcagttaattttgctctaatgatgtcacaaatggagggaggctgcccagtggattacaatacaattactgatctttttcttcagagaaatatgattcgagaggcaacaaggttcctgttagatgtcctgaagcccaatcttcctgagcatgcttttctccaaaccaaggttttagagatcaatttggtgacatatccaaatgttgcagatgcgatattggctaatggaatgttcagtcactatgatcgccctaggattgctcagttatgtgaaaaggctggtttatatgtgcgagctcttcagcattacacagagttgcctgatataaaacgtgtcatcgtgaacactcaagccattgagccacaggcacttgtcgagttctttgggacactttccaaggaatgggcactggagtgtatgaaggatcttttgcttgttaatttgagaggcaaccttcagataattgtgcagactgccaaagaatattctgagcagttaggtgtggatgcctgcataaaactatttgagcaatttaagtcttatgaaggcctttacttctttttgggatcttatttaagctccagtgaggattctgatatacacttcaagtatatcgaggctgcagcaaaaactggacagttaaaagaagttgaacgtgtaacaagggaatctaacttctatgatcccgaaaaaacaaagaatttcctgatggaagccaaacttccagatgcaagacccctgatcaatgtttgtgaccgttttggttttgttccagacttgactcactatttatatacgaacaacatgcttcgatatattgaaggctatgtacaaaaggtaaatccaggaaatgctccgttggttgtcgggcagttgctagatgatgaatgtcctgaagattttattaaaggtctgattctttccgtccgttctctcctgccagttgaacctcttgtggctgagtgtgagaaaaggaatcgtctgcggttgctcacacaatttctggaacatcttgtcagcgaagggagccaggatgtgcatgtccataatgcactgggaaagattatcatagacagcaataataatccagagcattttctaactactaatccatactatgattcacgtgttgttggtaaatattgtgaaaagcgggaccctactcttgcagttgttgcatacagacgaggtcaatgtgatgatgaactaataaatgtcactaacaaaaattcactgttcaaattgcaagccagatatgttgtcgagaggatggatgccgatttatgggagaaagtcctccaaccagaaaatgaatacagaagacaactcattgatcaagttgtttcgactgctttgcctgagagcaagagccctgagcaagtctctgctgctgttaaagctttcatgaccgctgatcttccacatgaacttattgaactacttgagaagattgtgctacagaattctgccttcagtgggaatttcaatctgcaaaacctgctgatattaacagctattaaagcagatccacctagggtcatggattacattaatagattagacaattttgatggcccagcagttggtgaggtagcagttgaagcacaattatatgaagaagcctttgccatcttcaagaaattcaacttaaatgtgcaggctgtcaatgtccttctggacaacatccaaagcatagagcgggctgtagaatttgctttccgtgttgaggaagatgctgtatggagccaggttgcaaaagctcagttacgggaagggttagtaagtgatgcaattgagtcattcattcgtgcagatgatgaaacacagttccatgatgttattcgggctgctgaagatgctaatgtttaccatgacttggtgaagtacttgttgatggtgaggcaaaaggttaaagagccgaaagtggatggtgaactgatatttgcatatgctaagattgataggctaggtgaaattgaggagttcattctaatgccaaatgttgctaatcttcaaaacgtcggcgaccgcttatttgatgatgctctttatgaagctgctaagatcatatttgctttcatttctaactgggcaaaattggcttgtaccctcgttaaactaaagcagtttcagggtgccgttgatgcagctcgtaaggcaaatagctcaaagacatggaaggaagtttgttttgcttgtgtggatgctgaggagttccgcttggcacaaatatgtggtctgaatataattatccaggtggatgacctggaagaggtcagtgactattatcagaacagaggctgctttaatgagttaatttctctcatggaaagtggccttggtttagaacgtgcgcatatgggcatctttacagagctgggagtcttatatgctagatataggccagagaaacttatggagcacattaaacttttctcaactcgattgaacattcccaagcttatccgtgtttgcgatgagcaacatcattggaaagagcttacatatttgtatattcagtatgatgaatttgataatgcagcaacaactataatgaaccattctccagatgcctgggatcatatgcagttcaaagatgttattgttaaagttgcaaatgttgagctatattacaaggctgtgcatttctacctgcaagaacatcccgacctcattaatgatgttctccatgtgcttgcacttcgggtggaccacacacgtgtcgtggatattatgcgaaaggctggttacttgcatatagtgaagccatatatggttgcagttcaaagtaacaatgtagctgctgttaatgaagcactgaatgaaatctatgttgaggaggaagactatgatagattacgtgaatcagttgacttgcatgataactttgatcagataggacttgcacagaggattgaaaagcatgagcttcttgagatgaggaggattgcagcatacatttacaagaaagctgggagatggaagcagtcaattgcattgtccaagaaggacaacctttacaaggatgccatggagacatgttcacaatctggtgaccgtgaactttctgaagaattgcttgtttattttattgaacagggaaagaaggaatgctttgcctcgtgtctcttcatttgttatgacttgatccgtcctgatgttgcccttgaactggcctggatgaacaacatgattgattttgcctttccataccttttacagtttattcgcgagtacactagtaaagttgatgatcttgtgaaggataagattgaggcacaaaatgaagttaaatctaaagaaaaggaagagaaggatttggttgcacagcagaatatgtatgcacagttgctgcctcttgctctaccagcaccacctatgcccggtatgggagcaccgagcatgggtggatcttatccagttccaccaccaatgcccggtatgggaatgcctccaatgccaccatttggcatgcctcctatggggagctactga

SEQ ID NO: 5238 - DNA, 6001 bp, Ceratodon purpureus
ccgctccgcacttcaccgcaaacagagcctcccagtctgtgttaactccactcatgccccgtatctacgcatcataaaaatttcacgtagagtacgcagatgagtgagttacgtagattgtgcgtatgaacgtatccggcgtcgtcgtcgtcgtggttgatgaggactcgaaccgagtgatgggagcctttgatgcttgctaaccttgtaggtagagaagacagacagagagtgagagagagagagagagagagcgtgctcgctgcttcggagcttccccgatcttcctctcgatctgcggcatcattgagaggggcagcggcccgtggagcgcgcgcatcgtccgccatggcggccgccaacgcccccatcgccatgaaggaggcgcttacgctgacgagcttggggataaaccaacaattcgtgacgttcacgcatgtgacgatggagtcggacaagttcatttgcgttcgggagacttcgcctcagaacagcgtggtgatcatcgacatgtcgatgcccaaccagcctctccgccggcccatcactgcggactccgcgctcatgaatcccaccagccgagttcttgccctaaaagcactaatcccggggacaacacaagatcatttgcaaatttttaacatcgagttaaaagcgaaaatgaaatcttatcagatgccggaacaggtggtattttggaagtggatcactccaaagttacttgggttagttacacagacatcagtctatcactggtctatagaaggtgaaacggaaccagtgaagatgttcgacagaactgcaaatttgactggcaaccagatcattaattatcgatgtgatccctctgaaaagtggctcgttttgattggaattgcgcctggtgcaccagagcgtccgcagcttgtgaaaggaaacatgcagctgttttctgtggatcagcagagaagtcaagcattagaagcgcatgcggcatcatttgcatctttcaaggtgccaggaaacgactcaccaagtctcctgattgccttttcaacaaaaaccattactgctggacagcttacatccaagctgcatgtcattgagcttggtgctcagccagggagacctggctttgcaaagaaggcggcagatttgttttttcctccagattttgcggatgattttccagttgcaatgcagatttcatcgaaatacaatcttatttacgtcattacaaagctgggtctactttttgtctacgatctcgaaaccgctacagctgtctacaggaatcgtatcagcccagatccaatttttttgacagctgatgcaccaacagttggtgggttttatgcggtcaatcgtcgtggacaagttcttctggctactgttaatgaggcaacaattgttccattcgtcagcaatcagctaaataatttggagcttgcggtgaaccttgcgaggcgaggaaatttgcctggagcagagggcctggttgttcaacgtttccacgagttgttctcccagatgaaatacaaggaagcagctgaccttgcagctgaatcaccacagggaattcttcgaactccagatactgtggctaaattccagagtgttccagtgcagccaggacagacttcgccccttctgcagtactttggtacattgctgacaaaggggaaattgaatttgttcgagtctttggagctttctcgcttggttgtaaaccaaaacaagaagaatttgcttgaaaactggttagcggaagacaagctcgagtgcagtgaagaactgggcgatcttgtaaagaccgtggacaacgatatggctctgaaaatctatattaaggccagagctactcccaaggtggttgcagcttttgctgagcggggtgagtttgacaagattctgatatactccaagcaggtcggatatactccagattatctgttcctgctgcagacaatcttgcgatcagatcctcaggctgctgtgaactttgctctgatgatgtctcagctggaaggagggtgtccagtagactacaatgtcattacagatttgttccttcagcgcaacatgatcagagaggcaacagcgtttcttttggatgttcttaagcctaatctgccggagcatgcgttgcttcaaactaaggtgctggagatcaatctggtcacatttcctaatgtggctgatgcaattcttgccaacggcatgttcagccattatgatcgtcctcgcattgctcagctgtgtgagaaagcgggtctttacatgcgcgctcttcagcactacacagagttgaatgatattaagcgtgttgtggtcaacactcatgctattgagcctcagagtcttgtcgaattctttggaacgttgtcaaaggagtgggctttagactgcatgaaggagctgctccaagtcaacatgcgaggcaatctacaaattattgttcaggtcgcgaaggagtacggggaacagctcggtgtcgatcaatgtgttaagttgtttgagagcttcaagtcatacgaaggactttactttttccttggtgcatttctgagtacgagtgaggaccctgagatccactataagtacattgaagccgcagccaagactggccaaatcaaagaagtggaacgtgtcacaagagagtcgaacttctatcctccggagagaactaaaaatttcttgatggaagcaaagttgccagatgcaagacctctgattaatgtttgtgatcgacatggctatgttcctgatcttactcattatctctatgtcaacaacatgcttcgatatattgagggatatgtgcaaaaggtcaatcctcaaaacgcacctttggtggtcgggcaattgctggatgatgattgccctgaggactttatcaagggcttaatcttgtctgtccgctcattgcttccagtggagcctctagtcgacgagtgtgagaagagaaaccgcctccgactattgacacaattcttagagcatttggtgagtgaaggaagtcaagatgtgcatgtgcacaacgctcttgggaagatcattatcgataccaataataatcctgagcatttccttaccacaaatccttactatgactctaaagttgttggtaagtattgcgagaagcgcgaccccacgcttgcagttgttgcgtacagacgaggcctatgtgacgatgagcttgtcaacgttaccaacaagaactctctgtttaagcttcaggccaggtatgtcgtcgagcgaatggagcctgacttatggttgaaggttctcgacccagaaaatccttgcagacgacagctcattgatcaagtcgtgtctactgctctgccagagagtaagaacccagagcaggtgtcagccactgttaaggcattcatgaccgcagacttgccccacgagttgattgagcttctagagaaaattgttctgcagaactctgccttcagtggcaacccgaatctccagaacctgctcattcttacagcaatcaaggcggacacatcaagggttatggattatatccacagattggataatttcgatggtccagcagtaggagaaattgcagttggtgccgaactttatgaggaagcgttcgctatcttcaagaagttcgatctgaatgtccaagccgtcaatgtcctgctggataatatgcgcagcattgaccgtgctgtggagttcgcagcacgagtggaagaagatgaagtctggagccaagtgggtaaggcacagttgagagaaggcttggtcagcgatgccattgagtctttcatcaaggcaaatgatgcatctcaatacaatgaagttatcgacgtggcctctggtgtaagggcatacgaggatctagtaagatacttgaacatggtacgcaagaaggtgaaggaggcgaaggtggattctgagttgatcttcgcatatgccaagcttaaccgattggatgacattgaggagttcattgttactcccaatcttgcaaacttgcaaactgttggagaccggctgtttgatgaggaattgtatgaagctgctaaaatcattttcacgcacatttccaactgggccagacttgccagcactcttgttaaacttcatcaattccaagcagccgtggatgcagctaggaaggccaacagcgcaaggacatggaaggaagtctgttttgcttgcgtggatgctgaggagttccgtctggctcaaatttgtggtctcaacgtcattgtccaggttgatgatttggaagaggtcagtgaatactatcaaaacaggggtcgtttcgatgagctcatctcactcatggaaagcggtctcggtttggagcgtgctcatatgggtatcttcacagaacttggcactctgtatgccaaatatcgcccggagaagcttatggagcatctcaagctttttgtcactcgcatcaacattccaagacttatccgtgtttgcgacgagcaacaacattggaaggaacttacatacttgtatgttcagtatgatgagttcgataatgctgctgctactatgatgagccattctccagaagcctgggatcatatgcagttcaaggacgtggctgtcaaggttgccaatgtggaattgtactacaaggctgcacatttctatctgcaagagcatccagaactcatcaatgacttccttaatgttcttgctgctcgtgtcgatcatacaagggtggtggatatcatgaagaaggctggacaattaccacttgtgaagccatacatggtggctgtacagagcgctaataatgctgcagttaatgaggctctgaacgggctatacatcgaggatgaagattatgaccggctcagggagtccattgatatgtatgataactttgaccagatttcaatggcacaacggattgagaagcacgagcttctggaaatgcgacgagtggcagcttacatctacaagagggctgggagatggaaacaatctgtggctctttccaagaaggataacttgtacaaggatgccatggagacttgctcacagtcaggcgatcgtgacctcgctgaggagttgcttactttctttgtggacaagggcaaaaaagaatgcttcgctgcatgtttgtatacctgctacgacctcatccgtgcggacgttgccgtggaactggcctggatgcatggcatgatggattttgttgtaccctacatgttacagttcatgcgtgagtacacaacaaaggttgatgaccttgtcaaggataaaattgaagcaactgaagaaaagaggtccaaggaatccgaggataaggacgttgtagctcaacagaacatgtatgcccagcttttgcctttggctctacctgccccacctgttgccggtatgggcagtatgcctggcatgggcggcatgcctgctatgggcgcgggtatgccttacgggggaatgccgggagggtacggcatgccctctatgagtacattctaaatcagctctgaggaaggcttaatatttacgtatttccctcagccgacaaggttgatgtgaacaagtgtacgaacattggcggttcaagacctcctacttccaattgttcgagaacggctttttgttccctgtttgcatccaactggaaattggattttagtgaggggttaagtggcggtgctgttttatgtaggttgaggggttagctaagttggcactacgatgtcaatcgatgtatatgagggtggtgctgagggcttgtgttatcaggatacccatgtgagttgctgctgcagacttgtaggttaaagagaagtgcagcagatatcaccacatgtagagaaagccttttaattgtagcagtttctgcgtttttatctcaattccttgtccttgcgtttctgttcaggacttgtttcaatgtcatgaactctttgttcaagcctttgagacacaatttgctttcattacaagattatcaagcaagagagacctgttttgtcatgatagatggattccacgagattgaagcgagcac

SEQ ID NO: 5239 - DNA, 5695 bp, Physcomitrella patens
tctgtcgccatggcggccgctagcgcgcccatcaccatgaaggaggctctcacgctgacgagcctcgggattaaccagcaattcgtcacatttacacatgtgacgatggagtccgataaatacatttgcgtgcgggagacgtcgccgcaaaacagtgtggtgatcattgacatgtcgatgcctaaccaacctctccgtcgccctatcaccgccgactccgccttgatgaatccttctagcagagtgctggccttgaaagccctgatacctggttcaacacaagatcatctccaaattttcaacatcgaattgaaagccaagatgaaatcgtatcaaatgccagaacaggtagttttttggaagtggattacaccgaggttgctaggactcgtgacacaaacttcagtttatcactggactattgaaggtgaatctgaacctgtaaagatgtttgagaggacagcaaatttgagtggcaaccagatcatcaattatagatgcgacccgtcagagaagtggcttgtgctgattggtatagctcctggagcacctgagcggccccaacttgtgaaaggaaacatgcagttgttttcagtggaccagcagaggagtcaggcgcttgaagctcatgctgcgtcatttgcttcccaccaggtggctggaaacgattctccatctctactgattgctttcacaacaaaaactatctcagctgggcagctaacatccaagctgcatattattgagctgggtgctacgtcaggtagacctggtttctccaagaaggcagcagatctattttttcctccagattttgccgatgactttcccgtttcgatgcagatctctgccaagtacggccttatttatgtaattacgaagctcggtcttctttttgtatacgacctggaaacggcaacagctgtttatagaaaccgaattagtccagaccctatttttttgactgccgatgctcccacagttggtgggttttatgctgtaaatcgccgaggccaagtcctccttgctacagtgaatgaggcaacaatcattccttttgtcagtaaccagctaagcaacttggagcttgcagtgaatcttgcgagacgaggaaatctgcctggagcggagggactggttgtacaacgttttcaagaattgttctcccagatgaagtacaaggaggcagcagatcttgctgcagagtcgcctcagggcattcttcgaactcctgatacagttgccaagtttcagagtgttccagtgcagcctggacaaacttcaccactcttgcagtactttgggactttattgacaaaggggaagttgaacgtgttcgaatctctggagctttcgcgactagtggttaaccagaacaagaagaatctgctggaaaactggttggcagaggacaagctggaatgcagtgaagagctgggtgatcttgtcaagactgtggacaatgatatggcactcaagatatacattaaggctagggctacaccaaaggtagttgcggcctttgcagagcgtcgtgaatttgacaagattttgatctactccaagcaggttgggtacactccagattacctatttctgctgcagacaatcctacgagctgaccctcaaggtgctgtgaactttgctctgatgatgtctcaacttgaaggtggctgcccagttgactacaacaccatcactgacttatttcttcagcgcaacatgattagggaggctactgctttcctcctggacgttttgaagccaaatcttccagagcatgccttacttcagactaaggttctagaaattaatctggtcacattccctaacgtggctgacgcaattttggcgaatggtatgttcagtcattatgaccgtcctcgtgttgcccaattgtgtgagaaagctggtctctacatgcgcgcccttcagcattacacggagctaaatgatatcaagcgcgttgttattaacacccatgccattgagccacagggtcttgttgagttttttggcacgctttccaaagaatgggccttggactgcatgaaagagttgctccaggtgaatatgcgtggaaatctgcaaattatagtccaggtggccaaggaatacggtgagcagctgggtgtcgacgcgtgtgtgaagttgtttgagagtttcaagtcatttgagggcttatactttttcctcggagcgtacttgagtacgagcgaggagcctgaaattcactacaagtacattgaggctgcggcaaagactggccaaattaaagaagtagagcgtgttacgagggagtccaatttctaccctgcagagagaaccaagaatttcctgatggagtccaagctcccagatgcaaggcctcttatcaatgtttgcgaccgtcatggttttgtgccagatcttactcattacctgtatgtcaataacatgcttcgttatattgaaggttacgtacagaaggttaaccctcaaaatgcacctttagtggtcgggcaattgttggatgatgactgtcccgaggacttcattaaaggtttgattctttctgtccgctctctacttccggtggaaccattggttgacgagtgcgaaaagaggaaccgtctgaggttgctgacacagtttctggagcaccttgtgagcgaagggagtcaagatgtgcatgttcataatgctttggggaaaatcattattgacacaaacaataatcctgagcacttcctcaccacaaatccctattatgattccaaagttgttggcaagtactgcgagaagcgcgatccaacgcttgctgtggttgcatacaaacgtggcctgtgtgacgatgaacttgtcaatgtcaccaacaagaattctctctttaagcttcaggccagatatgtggtggagcgcatggagcccgacctgtggttgaaggtcttaaatcctgagaattcttgtaggaggcagctcattgatcaggtggtatctactgctcttccagagagcaagaatccagagcaggtgtcggccactgtcaaagctttcatgactgcagatttgccacatgagctgattgagcttctggagaagatcgttcttcagaattcagctttcagtggcaaccccaaccttcagaatctgctcattcttactgctatcaaggccgatacgactcgggtcatggactacattaaccgtttggataacttcgatggtcctgccgtgggtgagattgcagtgggtgcggaactttttgaggaagcgtttgcaattttcaaaaagttcaacctcaacgtccaagcagtgaatgttctcttggacaacattcgcaacatagatcgtgctgtcgagtttgctgctcgtgttgaagaggacgatgtttggagccaggttggtaaggcgcagttgagggaaggattggttagcgatgccattgagtctttcatcaaggcaaacgatgcctctcagtacaatgaagttatcgatgttgcatctggtgtaagagcatatgacgacttagtgaagtacttgaacatggtacgcaagaaagtaaaggaggcgaaggtagactccgagttaatttttgcttacgctaagctcaatcgtctcgacgacattgaggagttcattgttactcctaatcttgcaaatcttcaaactgttggagaccgcttgtttgatgaagaactgtatgaggccgccaaaatcatttttacccacatttccaactgggcaaggcttgccagtacccttgtcaaactgcaccagttccaagcagccgtggatgcagccaggaaggccaacagtgcacggacgtggaaggaagtctgctttgcttgtgtggatgccgaagagtttcgtctggctcaaatttgtggtctcaatgttattgtccaggttgatgatctggaagaggtcagcgaatattaccagaacaggggtcgctttgacgagctcatttcacttatggaaagtgggcttggtttggagcgtgcccacatgggcatcttcacagagttgggcactttgtatgccagataccgtccagataagctcatggagcatctcaagctattcgtcactcgtatcaatattccgaaacttattcgtgtgtgcgatgagcagcagcactggaaggagcttacttacttgtacattcaatatgatgagtacgataatgctgctgcaaccatgatgagtcattctccagaagcttgggaacacatgcagttcaaggatgttgccgttaaggttgcaaatgtagaactttactataaggctgtgtacttttacctcgaggaatatcccgagctcatcaacgacttactcaatgtgttggctgcacgtgttgaccacacacgggttgtggatatcatgcgaaaggccgggcatcttcctttggtgaagccatacatggtagcagtacagagtgccaataacgctgcagtcaatgaggctctgaacaacttgtacattgaggaggaagattatgagcgattgagagagtccatcgatatgtatgataacttcgatcagatttcaatggctcagaggattgagaagcacgagctcctggaaatgcgccgtgttggagcgtacatctacaagagagctggtagatggaaacaatctgttgccctgtccaagaaggacaatttatacaaggatgccatggagacttgctcacagtcaggggatcgtgaacttgctgaggagcttctcacgttcttcgtggacaagggcaagaaggaatgctttgctgcttgtttgtacacttgttacgacctcattcgtgccgatgttgcggttgagttggcatggatgcatggcatgatggacttcgctgtaccatacctgttgcagttcttgcgtgaatattcttcgaaggtggatgatttgattaaagacaaattggaagccactgaggagaagaagtctaaagagcagcaggaaaaggacgtagttgctgagtcgaacatgtacgctcagctcttgcctctggctctaccagctccccctgttgccggtatgcctggtttgggtggaggtatgcctgtgccgggtatgggtggaggtatgccaatgccaggaatgccgggcatgccaggtatgccgggtatgtcaggctacggcatgccctcaatgagcgctttttaaacttcgctgaagctttgtacatgcacaagcgaagacatttgtgcgagcgggtagcccaaagaatgccaagtgggccatttggcttgaaagagctgagacatttgttgcacatcctttgatagttggagcatgccttctagtcactgcgtgtcttacaataagtatgtcggatgcatcaattcttctgttgactctagtcgggttagtcatgtacaagtgaacaagagagatcctcgaaagtgtctacattcgtatcatcctgccacaaggtctccaagacggtgatgccaggggctatggtagacagtattcgtttttctgatacaccaggaaaggtcagatcattttcgtatccttgtccatttccttgtggatcttactgcacgtacatagattagtgaacgttgcagcagtcttttttcttggagtagagagatttggccttcttgtagcagtatctgcagttggacctcagccctcttgggcttggtatcttcttgtgcagagggctctgcagtaaaattgttttggttggtataaattatgc

SEQ ID NO: 5240 - DNA, 5669 bp, Physcomitrella patens
cccgtcgccatggcggccgctagcgcgcccatcactatgaaggaggctctcacgctgacgagtcttgggattaaccagcaattcgttacgttcacacatgtgacgatggagtctgataaatacatttgcgtacgggagacgtcgcctcaaaacagtgtggtgattattgatatgtcgatgcctaaccagcctctgcgtcgcccgatcactgcggactctgccttgatgaatccgaacagcagagtcctggctctgaaagccttgatacctggttcgacacaagaccatctccaaatctttaacatcgaattaaaagctaagatgaaatcgtatcaaatgccagagcaggtggttttctggaagtggatttcgccaagattacttggactcgtgacacaaacttcagtgtatcattggactatagaaggtgaatctgaacctgtaaagatgtttgagaggacagcaaacctgagtggcaaccagatcattaactacagatgcgaccccgctgagaaatggcttgtattgattggtatcgcccctggagcaccggagcggccccaattagtgaagggaaatatgcagttgttttcagtcgaccagcagaggagtcaagcactagaagctcatgctgcatcatttgcttctcatcaggtggccggaaacgattctccatctctactgattgcattcactacaaaaactcttacagctgggcagctcacatccaagctgcatattattgagctgggtgctacaccaggtaaacctggtttctcaaagaaggcagcggatctgttttttcctccagattttgccgacgactttccagtttcaatgcagatctcatctaaatatggcctcatttatgtgattacaaaacttggtcttctttttgtctatgatctggaaactgcaactgctgtgtatagaaaccgaattagtccagatcctattttcttgacagcggatgctcctacagttggtggtttttatgccgtcaatcgtcgaggccaagtcctccttgctacagtcaatgaggctacaattatcccatttgttagtaaccagttgagcaacttggagctggcagtgaatcttgcaagacgaggaaacctgcctggagcagagggactggttgtacaacgttttcaagagttattctctcagatgaagtataaggaagcagcagaccttgcagcggagtcgcctcaaggcatccttcgaactccagatactgttgccaagtttcagagtgttccggtacagccaggacaaacttcaccattattgcagtactttgggactttattgacgaaggggaagttgaacgtatttgaatcccttgagctttcgcggctagtggttaaccaaaacaagaagaatctactggagaactggttggcagaagacaagctggaatgtagtgaagagttaggagatcttgtcaagactgtggacaatgacatggcactcaagatatacatcaaggccagggccacaccaaaggttgttgcagcttttgctgaacgtcgtgaattcgacaagattctgatctactccaagcaggtcggatatactccggattatcttttcctactgcaaactattttgcgagctgaccctcaaggtgccgtgaactttgctcttatgatgtctcaactagaaggtggttgccccgttgactataacaccgtcaccgacttatttcttcagcgcaacatgattagggaggccaccgctttcctcttggacgttttgaagccaaatcttccagagcacgccttgctccagaccaaggttctggaaattaatttggtcacgtttcctaatgtcgctgatgcaatactggcaaatggaatgtttagccattatgaccgtcctcgtgttgctcaactttgcgagaaagctggtctgtacatgcgagcccttcagcattacacggaattaaatgatatcaagcgcgttgttatcaacacccatgccatagagccacagggtctagttgaattttttggcactctgtcaaaagaatgggccttagattgcatgaaagagttactccaagtgaatatgcgtggaaacctgcaaattatagtccaggtagccaaggaatacggggagcagctgggtgtcgatgcgtgtgtgaagttgtttgagagtttcaagtcttttgagggattgtactttttcctcggagcatacttgagcacaagcgaggaacctgaaattcactacaagtacatcgaggctgcggcaaagactggccaaattaaagaagtcgagcgtgttacaagggagtccaatttctaccctccagagagaaccaagaatttcttgatggaatccaaactcccagatgcaaggcctctcatcaatgtttgcgaccgtcatggttttgtcccagatctcactcactacctttatgtcaacaacatgcttcgttacattgaaggttatgtacagaaggttaaccctcaaaatgcaccattagtggtcgggcaattactggatgatgattgtcctgaggacttcattaagggtttgatcctatctgtacgctccctccttccggtggagccattggttgacgagtgtgaaaagaggaaccgattgaggttgttgactcagttcttggagcaccttgtgagcgaaggtagtcaagatgtgcatgtccacaatgctttggggaaaatcattattgatacaaacaacaatcctgaacatttcctcactacaaacccttactacgactccaaggttgtcggcaagtactgcgagaagcgcgacccaactcttgctgtggtagcatacaaacgtggcaattgtgatgatgagcttgtcaatgtcaccaacaagaattctctcttcaaactccaggccaggtatgtggtcgagcggatggagcctgacttgtggttgaaggttctgaatccggagaacccctgtaggaggcaactcattgatcaggtggtgtctactgctcttccagagagcaaaaatccagagcaggtgtcagccactgttaaggccttcatgactgcagatttgccacatgagctgatcgagctcttggagaagattgtgctccagaattcggctttcagtggcaaccccaaccttcagaaccttctcatcctcacagcaatcaaggccgacacaactcgggtcatggactacatcaatcgtttggataatttcgatggtcctgcagtgggtgagattgcagtaggtgctgaactttatgaagaggcatttgcaattttcaagaagttcaacctcaatgtccaggcagtgaatgttcttctggacaacattcgcaacatagaccgtgctgtggagtttgcagcccgtgtcgaagaggatgatgtttggagccaggttggtaaggcacagttaagagagggactggttagcgatgccattgagtctttcatcaaggcaaatgatgcttctcaatataatgaagttatcgatgtggcatctggtgtaagagcatacgaggacctagtgagatacttgaacatggtacgcaagaaggtgaaggaagctaaggtggactctgaattaatttttgcctatgccaagcttaatcggttggacgacattgaggaatttatcgtcaatcccaaccttgcaaatctgcaaactgttggagatcgcctgtttgatggagaattgtatgaagctgccaaaattattttcacgcacatctccaactgggcaagacttgccagtactcttgtcaagcttcatcagttccaagcagccgtggatgcagcgaggaaggccaatagcgcacggacatggaaggaagtctgctttgcttgtgtggacgccgaagagttccgcctggctcaaatttgtggtctcaatgttattgtccaggtggacgatttggaagaggtcagtgaatattaccagaatagaggtcgctttgatgagctcatctcacttatggaaagtgggcttggtttggagcgcgctcacatgggtatctttacagaactgggcactctgtacgccagataccgtccggataagcttatggagcatcttaagctgtttatcacccggattaatattccaaagcttattcgtgtatgcgacgagcagcagcactggaaggaacttacgtacttgtacattgcatatgacgagtatgataatgctgcggctaccatgatgagccattctccagaggcctgggaacacatgcagtttaaggatgttgctgttaaggttgcaaacgtggaactttactacaaagcagtgtacttttatctcgaggagtatcccgagcttatcaatgacttactcaatgtgttatctgcacgggttgaccacacacgagttgtggatatcatgaaaaaggctggatacctaccgttggtgaagccatacatggttgccgtccaaagtgccaacaacgctgcagtcaatgaggctctgaacaacttatatattgaggaggaagattatgagcggctcagagagtctattgatatgtatgataactttgatcagatttcaatggcacagaggattgagaagcacgaacttctggaaatgcgtcgcgttggtgcgtacatctataagagagctggcagatggaaacaatctgtggctttgtccaagaaagacaacttatacaaggatgcaatggagacttgctcacagtctggagatcgtgagcttgctgaggagctgcttacattcttcgtggacaagggcaaaaaagagtgcttcgctgcttgtctatacacttgttacgaccttatccgtgctgatgttgcggtggagctggcatggatgcatggcatgatggacttcgccgtaccttacttgctgcagttcttgcgtgagtactccacgaaggtggatgatttgattaaagacaaattggaagctactgaggagaagaagtccaaagagcaacaggaaaaggacgtagttgctgaatcgaacatgtacgctcaactcttgcctctggctctaccagctcctcctgttgctggtatgactggtatgcctggtatgggcggaggtatgccaatgccgggtatgtcgggaatgccaggaatgcccggtatgtcagggtacggcatgccctctatgagtgctttttaaacagccctgaaactgtgtacatgcacaaacgaagacttctttgtgagcctgggtggcggacgaagaatgtgaccacagggtggagaactgagatatttgttgcctcccagtcattgcgtgtcttttaataaggatgttgaatgcatcaattcttttgtaggctctagtttggttagatacatacagttgaacaaggacaggcgccgggagtgattacgttctcatcatcctgccacaaggtgtacatgagggtgatgctaaggtgtacatgagggcttgtggaaaatattcctgtttggctgatagacaagcataggtcagatcatattcatatccatgtccatttccttgggtggatcttactgcacttaaataggttagcgaatgttgcagcagccttctccttcaagtacagagatttaccactttttcctgaagtggtatctgcagtagaacccgtccttttgggctgtgttcctttttatggcgagagctctgcagtaaaattgctgtgtttagtgctaatttcgcacattatc

SEQ ID NO: 5241 - DNA, 5730 bp, Ceratodon purpureus
cggagctcagagtgaagggagtttgtttttcgcagcgttgttgcagatccaagggtttgcttgctccgtagctctgtgcttgcttgctcgccaccgtgaccgcgcctgcgcctggggaggctcggccttggcctcccgcacttcgtcgccatggcggccgctagtgcgcctatcgccatgaaggaggctctcacgctgacgagcctcgggatcaatcagcaatttgtgacgttcacgcatgtgacgatggagtccgataagtatatttgcgtgcgggagacttcacctcagaatagcgtggtgattgttgatatggcgatgccgaatcagccgctgcggcgcccgatcactgcggattctgcgttgatgaatccttccagtcgagtgctggctttgaaagctcttatacctggtactacgcaagatcatcttcaaatttttaacatcgaattaaaagccaagatgaaatcatatcaaatgccagagcaagtggttttctggaagtggattagtccaaggttactaggacttgtgacacaaacctcagtttatcattggagtatagaaggtgaatccgaacctatgaagatgtttgacaggacagcaaatttgagtggtaatcaaatcatcaactatagatgtgatccttctgagaagtggctggtgttgatcggtatagcccctggagcacctgagcggccccaacttgtgaagggaaacatgcagttattttcagtggaccagcagaggagtcaagcacttgaagctcatgctgcgtcatttgcttctcaccaggtggctggaaacgattctccatctctattgattgcattctcaacaaaatctattacagctgggcagcttacatccaagctgcatgttattgagctgggtgctcagccaggtaaacctggcttctccaagaagtcagcagatctttttttccctccagattttgccgacgactttcccgttgcgatgcagatctcagccaagtacggcctcatttatgtaattacaaagcttggtctattattcgtctacgacctggaaagtgcaacggctgtgtacagaaatcgaattagtccagaccccattttcttgacagccgatgccccaacagttggtgggttctatgccgtcaatcgcagagggcaagtgctccttgctacagtcaatgaggctactattgttccttttgttagcaaccagctgaataacttggagcttgctgtgaatctcgcaagacgaggaaacttgcctggagcagaggggctggttgtacaacgttttcaagagttgttctctcaaatgaagtacaaggaagcagcagaccttgcagcagagtcacctcaaggcattcttcgaacccctgatacaattgcaaagttccagagcgtcccagtccagccagggcaaacatcaccactattgcagtacttcggaactttattaactaaggggaaattgaatgcatttgaatctttggagctttcacggcttgtggtcaaccaaaacaagaaaaatctgttggagaattggctggcagaagacaagctggaatgcagtgaggagttgggagatcttgtcaagactgtggacaatgacatggcactaaagatatacattaaagccagggctacaccgaaggtggtggcagctttcgctgagcgtggtgagtttgataagattttaatctactccaagcaagttggatacaccccggattacctcttcctgctgcagtcgatccttcgagcagaccctcaaggagctgtgaactttgctctcatgatgtctcaattggaaggtggctgccctgttgactataataccattactgatttgtttcttcagcgcaacatgattagggaagcaactgctttccttttggatgttctgaagccaaatcttccagagcacgccttactccagactaaggtcctagaaattaacttagtcacgttcccaaatgtggctgatgcaattttggcaaatggcatgttcagccactatgaccgtcctcgtgttgctcaactctgtgaaaaagctggactttacatgcgagctcttcagcattacacggagttgaatgatatcaagcgcattgttgtcaacacccatgccattgagccacagagcctggttgagttttttggcactctgtcaaaggaatgggccttggactgcatgaaagagttgcttcaagtgaatatgcgtgggaacttacagatcatagttcaagtggccaaggaatacgcagagcagttgggagttgattcatgtgttaagttgttcgagactttcaagactttcgagggtttatactttttcctcggggcgtacttgagttcaagtgaggatcctgaaattcattacaagtacatcgaggccgccgcaaagaccggccaaatcaaagaagttgagcgtgttacgagggaatcaaatttctatcctcccgagaggacaaagaatttcctgatggaatcgaagctcccagatgcgaggcctcttatcaatgtctgcgaccgtcatggttttgtgccagaccttactcattacctctatgtcaacaatatgcttcgttacattgaaggttatgtgcagaaggttaatcctcaaaatgcacccgccgtggtcgggcaattgctggatgatgactgtcctgaggacttcattaagggtttgatcctctctgtacgctcgcttcttccagtagaacctttggttgacgagtgtgagaagaggaaccgtttgaggctgctgacacagttcttggagcacctcgtaagcgaagggagtcaggatgtacatgtgcacaatgctttggggaaaatcatcatcgataccaacaacaatcctgaacatttcctcactacaaatccctactatgactccaaggttgttggcaagtactgtgagaagcgcgacccaacacttgctgtggttgcgtatagacgtggtctgtgcgatgacgagcttgttgaggtcactaacaagaattctcttttcaagcttcaggccaggtatgtcgtggaacgcatggagcctgacctatggttgaaggttctggatccggagaatccctgtagaaggcagctcattgaccaggtggtgtctactgctctgccagagagcaaaaatccagagcaggtgtcagccaccgtcaaggcttttatgactgcagatttgccacatgaactgattgagcttctagagaagattgttcttcagaactcggccttcagtggcaaccctaaccttcagaacctgctcattcttacagcaatcaaggctgatacaactcgggttatggattacatccaccgtttggataactttgatggtcctgcagtgggtgaaattgcagtaggtgcagagctttttgaggaagcatttgcaattttcaagaagttcgaccttaatgtccaagcagtaaatgtccttctggacaacatacgcaacatagaccgtgctgtggagtttgcagcccgtgttgaagaagatgacgtttggagtcaggttggtaaggcgcagttgagagatggcctaatcagcgatgccattgagtctttcatcaaggcaaacgatgccactcaatacaatgaagttatcgacgtggcatctggtgtaagggcatacgaagatctggtgagatacttgaacatggtacgcaagaaggttaaggaggcgaaggtggattctgagctgatctttgcatatgccaagcttaaccgtttggatgacattgaggagtttattgtcactcccaatcttgcgaacttgcaaattgttggagaccgtctgtttgatgaagctttgtatgaagctgccaaaatcatcttcacacacatttccaactgggccagacttgctagcactcttgtcaagcttcagcagttccaagcagctgtggatgcagccaggaaggcgaacagctcacggacatggaaggaagtatgctttgcttgcgtggacgctgaggagttccgcctggctcaaatttgtggtcttaacgtcatcgtccaggttgacgatttggaagaggtcagcgaatactaccagaaccggggccgctttgatgagcttatctcacttatggaaagtgggctcggtttagagcgagctcatatgggtatcttcacagaactcggcactttgtatgccagataccgttcagagaagctaatggagcatctcaagctgttcgttacccgcatcaacattccaaaacttattcgtgtatgcgatgagcaacaacactggaaggagcttacttacttgtacattgcatatgacgagtatgataacgccgcatcaaccatgatgagtcactctccagaagcgtgggaccacatgcagtttaaggatgtcgcagttaaggttgcaaacgtggaactatactacaaggctgtgtatttctacctcgaggagtatcctgagctcatcaacgacttactgaatgtgttgtctgcgcgcgttgaccacactcgagttgtggatattatgcgaaaggctggacatctcccactggtgaagccttatatggtcgccgtacaaagtgccaacaatgctgcagttaatgaggctttgaacaatttatacattgaggaggaagattatgaacggctcagggaatctattgatatgtatgataacttcgaccagatcgcaatggcacaaaggattgagaagcacgagcttctggaaatgcgccgagttggagcttacatctacaagagggccggcagatggaagcaatctgtggcactgtccaagaaggacaacctatacaaggatgcaatggagacctgctcgcagtcaggcgatcgtgagcttgctgaggaacttctcacattctttgtggacaagggcaagaaagaatgttttgctgcttgcttgtacacttgctatgacctcattcgtgccgatgttgcggttgagttggcatggatgcatggcatgatggacttcgctgtaccgtacttgcttcagttcttgcgtgagtattccacaaaggtggacgatttgattaaagacaaattggaagcaactgaggagaagaagtcaaaggagcaagaggagaaggaagtagttgcgaactcgaacatgtatgctcagctccttcctctcgcactacctgctcccccagttgcgggtatgtcagggttgggtggaggtatgccagatatgggtggaggtatgccaatgccaggtatggcaggttatggtggtatgccaaatatgtctggttatggcatgccttccatgagctactaatcaccgagaacctgtacatgcgcaaacgaagacttctgtgagcgtgggtgggggacgagaatacatagagagttagttagccgttcggttgagagaacctagacatttgttgcactctgattgctggagcaggcctcccagtcactgcatgtcttctaataaggatgcgaaatccatcgattcttttgtaggctttagtttggttagtagcatccagatgaatacgatggaagccgactttggcgaccttgggatcatcctgccactagaatgtacatgagggtgacactaagggcttttgtggaaagtgtcattgtttggctgataggcaagggtaggttagattgtatcgatatccatgttagttttcttgcgtggatgttcctgcacataagtaaattaccggtagtgaatgttgcagccgcctcacctaaagtagagggatttagt

SEQ ID NO: 5242 - DNA, 4924 bp, Arnica chamissonis
gaagatatttgataggacagccaatttatcaaacaatcagataattaattacaaatgtgatccatctgagaaatggttggtattgattgggattgcccctgggtcacctgagagacctcagctagtcaaagggaatatgcaactgttttctgttgatcagcagcgaagtcaagctctggaagcacatgcagcatcatttgctagcttgaaagttccaggcaatgagaatccttcaattctcatttcttttgcaacaaaaagccataatgctggacaggttacttcaaagctgcatgttattgagcttggtgcccaaccagggaagccctcgttcaccaagaaacaagcggatctttttttccctcctgactttgcagatgattttcctgtggccatgcagatatccaacaaatatggtttgatctatgtcatcaccaagctgggtctcttatttgtgtacgatcttgaaaccgctactgcggtttacagaaacagaataagccctgatcctattttcctaacatctgaagcttcgtcagttggaggcttctatgcagtaaatagacgtggacaagtgttacttgctactgtgaatgaagctacaattgtcccttttgttagtggacagttgaacaacctggaacttgctgtcagtcttgccaaaagaggaaacctacctggtgcagagaatttggttgttcaacgtttccaagaattgtttgctcaaaccaaatacaaagaagctgctgagctggctgctgaatctcctcaaggcattctccgtacacccgatacagttgcaaaatttcagagtgtacctgtgcaagctggacagacaccaccattactgcagtactttgggacccttctgacaaaaggaaaactgaatgcttttgaatccttggaactatctcgcttagttgtcaatcaaaacaaaaagaatcttctagagaattggttagctgaagacaagctggaatgtagtgaagaacttggagaccttgtgaagacggtggataatgatcttgctttgaaaatttacatcaaagcgagagcaaccccgaaagttgttgcagcttttgctgagcgaagggagtttgacaaaatactcatttactccaagcaggttggatattcacctgattatctcttccttctgcaaacaattcttcgtacagacccgcagggagctgttaattttgctttaatgatgtcccaaatggaaggaggctgtcctgttgattacaacaccattacggatcttttccttcagaggaacttgatacgagaagcgacggctttccttttggatgttttgaagcccaacttaccagaacatgctcagcttcaaactaaggtccttgaaattaaccttgtaacattccctaatgttgcggatgcgatattagctaatggtatgttcagtcactatgatcgtcctcgaattgctcaactttgtgagaaagcgggtctttatgtccgagcgcttcagcattacagtgaattaccagatatcaaacgtgtcattgtgaatactcatgcaatagagccacagtctcttgtagaattttttggaactctgtcaaaggaatgggcacttgagtgcatgaaggatcttttactggtcaatttgagaggaaaccttcaaataattgttcaggttgcaaaggaatattgtgagcagcttggtgttgaatcatgtattaaactttttgagcagtttaaatcatatgaaggtctctacttctttttggggtcatatttgagttctagtgaggatccagacatacacttcaagtacattgaggcggctgcaaagactggtcaaattaaagaggttgaacgtgtaacaagggaatcaaatttctatgatgctgaaaagaccaagaactttctaatggaagccaagcttcctgatgcaagaccgttgatcaatgtttgtgatcgctttggctttgttccggatctcactcactacctctataccaacaacatgcttcggtatattgaaggttatgttcaaaaggtcaaccctgggaatgctccacaagttgtaggacagctcctagatgacgagtgccctgaagattttatcaaaggtttgattttatcagttcgttctctgcttccagttgagcctcttgtagacgagtgtgaaaagaggaaccgacttagattattaactcaatttttggagcacttggtgagtgaaggaagccaagatgtacatgttcataatgctttgggtaagattatcattgatagcaataataacccggagcacttccttaccacaaacccatattatgattctcgtgtcgtggggaaatactgtgagaagcgtgatcctacactcgctgtcgttgcttatcgcagaggccaatgcgatgatgaactcattaatgtcacaaacaaaaactctttattcaaacttcaagcaaggtatgttgtggagaggatggatggcgatctttgggagaaggctcttaacccagagaatgaatatagaaggcaactaattgatcaggttgtttctactgctttgccagagagcaagagccccgagcaggtttctgctgctgttaaagctttcatgactgctgatcttcctcatgaattaatcgagctccttgagaaaatcgtcctccaaaactctgctttcagtgggaatttcaatctacaaaacctgcttatcttgaccgccattaaagcagacccatcaagagttatggactacatcaatagactggataactttgatggacctgctgttggtgaggtggctgtagaagcacagctttatgaagaagcatttgcaatattcaagaaattcaacttaaatgttcaagcagtcgatgttttgttggataatattcaaagtattccacgggctgttgagtttgcataccgtgttgaagaagatgctgtttggagccaggtggcaaaagctcaactcagggagggattagttagtgatgcgattgagtctttcattcgtgctgatgacgctactcaattcttggatgttattcgcgcttctgaagatacggaatgttaccatgatttggttaagtatcttttgatggttagagacaagatcaaggagccgaaggtggatagtgagctcatttatgcatatgcaaagattgacaggttgagtgatattgaggaatttatccttctgccaaatgttgcgaatctccataatgttggtgatcgtttgtttgatgaagcattgtacgaagctgctaagataatatatgcttttatctccaactgggctaagcttgctgttacacttgtgaggctgcagcagtttcaaggtgctgttgacgctgctcgtaaagcaaatagtgcaaagacatggaaagaagtttgctttgcttgtgttgatgctgaggagttccgcttggctcagatatgtgggctcaatattattgtgcaggtggatgacctggaagaggtgagtgaatactaccaaagcagaggatgcttcaatgagcttatatctcttatggagagtggtttagggctggaacgggctcacatgggcatctttactgagttgggcgtcttatatgcccgataccgtcacgacaaattaatggagcatataaaactcttttcaacccgtctcaacattcccaagttaattcgtgcttgtgatgagcaacaacactggaaagaacttacttacctatacattcaatatgacgagtttgacaacgctgctacaaccgtcatgaatcattctccagatgcatgggaccatatgcagttcaaggatattgcagttaaagtctcaaatgttgagctttattacaaggcagttcacttctatttagaagaacatcccgaccttattaatgatgttcttaatgtcctcgcactccgtgttgaccatacacgtgttgtagacattatgcgcaaggctggtcaacttcctttagtcaaaccatacatggttgcagttcagagcaacaatgtatctgctgtgaatgaggcgttgaatgaaatatacgttgaagaggaagattatgatagactgcgtgaatctattgatttgcatgataattttgaccagattggcctcgcacagaagattgagaaacacgagcttcttgaaatgaggcgtgtggctgcatatatttacaaaaaagccggtagatggaagcagtctattgcactgtctaaaaaagacaaggtttacaaagatgcaatggagaccgcatcgcaatctggggaccgtgaactggcagaagagttgcttgtttatttcatcgagcagggaaagaaggaatgctttgcgtcatgtctatttgtttgttatgacctgatccgtccagatgttgctcttgagctagcctggttaaacaacatgatcgattttgctttcccgtatctgcttcagtttattcgggaatataccggtaaggtcgatgaactcatcaaagacaagatcgaagcagttaaagaaaataaggcgaaggagaacgaggagcaggatatcgttaaacaacagaatatgtatgctcaactactccctcttgcactacctgctccaccaggtatgggtggaggatttgctccaccaccacccatgggtggaatggggatgccgccaatgcctccatttgggatgccgccaatgggttcttattgattgatgcgtcgtgactttagtgagtggtggtggttacttgggtctctttttgaggaaactatgggcgtaaatttgcttgttttggagggagatggattgaagttattatagtcgagtctaacggtgtttttcttgtattgtgtggatatgttctcattgttatattctttttggtagactcggcaaatttttgcagcttagggcagcaaaatgagcataatgttgaatcctatcatgtgtataaaaaacaaggggtcaggt

SEQ ID NO: 5243 - DNA, 6047 bp, Ceratodon purpureus
cttcttcgacgtcgccccgagggaggcctttgtttgatgagctgagggagagagaaaccgaaggaagcgagagagagcgactctcgacgtcgcggctggcttgcagatcgaccgcggggacagccaagggtttgctcgctctcgtccgctctcacaccaggggaggcgcggcctccgtcgcagcagctcgcagccatggcggccgctaacgcgcctatcaccatgaaggaggctctcacgctgacgagcctcgggattaaccagcaattcgtcacgtttacgcacgtgacgatggaatcggataagtacatttgcgtgcgggagacttcgccgcagaacagtgtggtgattattgatatgtctatgccgaaccagccgctgcggcgcccgatcacggcggattctgcgttgatgaatccgaacagcaaggtcctggcgctgaaagctcttattcctggcacgacacaagaccatctccaaatttttaacatcgaattgaaggccaagatgaaatcttaccaaatgccagagcaggttgtcttctggaagtggattacaccaagattactcggactcgtgacacaaacttcagtttatcactggacaatagaaggtgattccgaacctgtgaagatgttcgagaggacagcaaatctgagtggcaaccaaatcatcaactatagatgtgatcctgcagagaagtggcttgtgttgattggtatcgcccccggagcacctgagaggccccaacttgtgaagggaaacatgcagttgttttcagtggaccagcagaggagtcaagcactagaagcacatgctgcgtcatttgcttctcaccaggtggccggaaacgattctccatctctactgattgcattctcaaccaaaactattacagccggacagcttacatccaagctgcatgttattgagcttggtgctcagccaggcaaacccggtttctcgaagaaggcagcagatctttttttccctccagattttgccgacgattttcccgttgcaatgcagatctcagccaagtacggtctcatttatgtaattacgaagcttggtcttctgttcgtctacgacttggaaacagcaacggcggtgtatagaaaccgaattagtcctgatccaattttcttgacagctgatgcccccactgttggcgggttttatgctgtcaatcggcgaggtcaagtcctccttgctacggttaacgaatccactattgtcccttttgtcagtaaccagctgaataacttggagcttgcagtgaatcttgcaagacgaggaaatttgcctggagcagagggcctggtggtacaacgtttccatgaattattctcccagatgaagtacaaagaagctgcagatcttgcagcagagtcacctcaaggaatccttcgtacccctgatacaatcgcgaagtttcagagtgttccagtgcaacctggacaaacctcaccactcttgcagtactttggaactttgttgaccaagggaaagttaaatgtatttgaatctttggagctttcacggttagtggttaaccagaacaaaaagaatctacttgagaactggttagcagaggacaagctggaatgcagtgaagagttgggagatcttgttaagactgtggacaatgacatggcacttaagatatatattaaggccagagctacaccaaaggttgtggcagctttcgctgagcgtggtgagttcgacaagattttgatatactccaagcaagttggatacactccggattatctttttctgctgcaatcgatcctgcgagcagaccctcaaggtgctgtgaacttcgctctcatgatgtcacaattggaaggtggctgcccggttgactacaataccatcactgacttgtttcttcagaggaacatgattagggaagcaactgctttccttctggatgtgttgaaacctaatctcccagagcatgcgctactccagacgaaggtcttggaaatcaatttggtaacgtttccaaatgtggctgatgcaattctggcgaatggcatgtttagccattatgaccgtcctcgtgttgctcagctttgtgagaaagctggtctgtatatgcgtgcccttcagcactacacggagctaaatgatatcaagcgcgttgttgtcaatacccatgcgattgagccacagtctctggtcgaattttttggccaactgtcgaaggaatgggcattagactgcatgaaagagctgcttcaagtgaacatgcgtgggaaccttcaaattatagtacaggtggctaaggaatatgcagagcagttgggtgttgattcatgtgtgaagctgtttgagacttttaagtctttcgagggcctgtactttttccttggggcttacttgacgtcaactgaggaacctgaaattcactacaaatacatcgaggctgcagcaaagaccggccaaattaaagaagttgagcgggttacaagggagtctaatttctaccctccggagagaaccaaaaatttcttgatggaatctaagcttccagatgcaaggcctcttataaatgtttgtgatcgtcatggtttcgtgcccgatctcactcattatctctacgtcaacaacatgcttcgttacattgaaggttatgtgcagaaggtgaatcctcaaaatgcacccttggtggtcggacagttgctggatgatgactgtccagaagatttcatcaagggtttgatcctttctgtacgctccctacttccagtagaaccattggttgatgagtgcgaaaagaggaaccgtctgagactgctgacacagttcttagagcaccttgtgagcgaagggagtcaagacgtgcatgtgcacaacgcgctggggaaaatcatcatcgacacaaacaacaatccggaacatttcctcaccacaaatccctactatgactccaaggttgttggcaagtactgtgagaagcgcgatccaacactcgctgtggttgcgtatcggcgtggcctgtgtgatgaggagcttgttaatgtcaccaacaagaactctcttttcaaacttcaagccaggtatgtggtggagcggatggagcctgatctgtggttgaaggttcttgatccggagaacccctgtcgaaggcagctcatcgatcaggtggtgtctactgccttgccagagagcaaaaacccagagcaggtgtcagccactgtcaaggccttcatgactgcagatttgccacatgagttgattgaacttttggagaagatcgttcttcagaactcagccttcagtggcaatcccaaccttcagaatctcctcattcttacagcaatcaaggctgacacaactcgggtcatggactacattaatcgtttggataacttcgatggtcctgcagtaggagagattgcagttggtgcagagctttttgaggaggcatttgcaattttcaagaaattcaatctcaatgtccaagcagtaaatgttcttttggacaacattcgcgacatagaccgtgctgtggagtttgcagcccgtgttgaggaagatgaggtttggagtcaggtcggtaaggcgcagttgagagacggactggtgagcgatgctattgagtcctttatcaaggctaatgacgccactcaatacaatgaagttatcgacgtggcatctggtgtgagggcatacgaggatctagtgagatacttgaacatggtacgcaagaaagtcaaggaggcgaaggtggactccgagttgatctttgcttatgccaagcttaaccgattggatgacattgaagagtttattgttactcccaaccttgccaacttgcaaactgttggagatcgcctgtttgacgaggagttatatgaagctgccaaaatcattttcacgcacatttccaactgggctagacttgccagtactcttgtcaagcttcaacagttccaagcagccgtggatgcagccaggaaggccaacagcgcacggacatggaaggaagtctgttttgcttgcgtggatgccgaggaattccgtttggctcaaatttgcggtctcaatgttattgtccaggttgacgatctggaagaggtcagtgaatactaccagaacaggggccgcttcgatgagctcatctcactcatggaaagcgggcttggtttggagcgtgctcatatgggtatctttacggaacttggcactttgtatgccagataccgcccagacaagcttatggagcatctcaagctttttgtcacccgcatcaacattccaaagcttattcgtgtatgcgacgagcaacaacactggaaggaacttacttacttgtacattgcatatgacgagtatgataacgctgcatcaaccatgatgagccattctccggaagcatgggaacatatgcagtttaaggacgttgctgttaaggttgcaaatgtggaactttattacaaggcagtttacttttaccttgaggagtatcctgagctgatcaacgacttactcaatgttttggcttcacgtgttgatcacacacgtgttgtggacatcatgcgaaaggctggacaccttccgttggtgaaaccatatatggtcgcagtacagagtgccaacaatgctgcagttaatgaagctctgaacaatctctacattgaagaggaagattatgagaggctcagagagtctattgatatgtatgataactttgatcagatttcaatggctcaaaggattgagaagcatgagcttttggaaatgcgccgtgttggagcttacatctacaagagagctggcagatggaaacaatctgtggctttgtctaagaaagacaatctatacaaggatgcaatggagacttgctcgcagtcaggggatcgtgaccttgctgaggagctgcttactttctttgtggacaagggcaagaaagagtgcttcgctgcatgcctatacacttgctacgacctcattcgtgctgatgttgcggttgagttggcatggatgcatggcatgatggactttgctgtaccatacttgttgcagttcttgcgtgagtactccaccaaggttgatgacttgattaaggacaaattggaagccaacgaagagaagaagtcgaaggagcaagaagagaaggacgttgtttcgaattcgaacatgtatgctcagcttttgcctctggctctacctgctcctcctgttgctggtatgccaggcatgggaggcggtatgccaggtatgggcggaggcatgccaatgccgggcatggcaggttatggtggtatgccaggtatgtcgaacggtggtatgccaggtatgtcgaacggtggtatgccaggtatgtcgggctatggcatgccttctatgagtgggttttaaaaatgctgagaagctgtgcatatgcacgtactcagacttttgtgtgggccttggaggtggacaaagaatactgaggagccgattggtttgagagaactgagacatttgttgcacatcctttgattgctggagcatgcctcccggtcactgcatgtcttaataaggatgttgaatgcatcaattcttttgtagactctagccgggttagtaccgtaatatacagctgaacaagaggagggcccatcggtggctacattggtatcatcctgtctcaagatgtacatgagggtggtgctcagggcttttgtggaaattatcattgtttggttgataggcaagggtaggtcagatcttattcatatccatgttcattttcttgcgtggatcttactgcacatagatagactagtgaatgttgcagcagcttttcctttttagtagagttattcagccttcattctgcagtggtatccgcagttggaatcagcctttttaggttaggtttcctcctgtgctgaaggctccgcagtaaaattgtctggttacatttgatttaacatatgattgatgtttctttaaggagtgcaatggacaaatatggtgcagtgttcactatatgcaaggttgtccgttttattctaccaattgctttcgccttgattcgctccact

SEQ ID NO: 5244 - DNA, 5564 bp, Brassica napus
gtgcaggccatttaggccgtgcagcccccccccccccacctttctcgttcactcgccgctcagatctgtcagcgattccaattccttctacactctctcgtctcccatctcttccttctcgtccctgccacatagctgtctcttccccagattctctcgcctcgcgaaactctggtaaaaaatggcggcagcaaacgccccatcacgatgaaggaggtcctcacgcttccgagcgttgggatcaatcagcagttcatcacgtttacgaatgttactatggagtctgacaagtatatatgcgttcgagagacggctcctcaaaacagcgttgtaattatcgatatgagtatgccgatgcagcctctgaggaggcctattactgctgattctgctcttatgaacccagactccaggatccttgccttaaaagctcaagttccaggaactactcaggatcatctacagatatttaacatcgaagcaaaagcaaagcttaaatcacatcagatgcctgagcaggttgcgttttggaagtggattacactcaagatgttggggctggtcacacaaaactccgtgtatcattggtctattgaaggtgattctgaacctgttaagatgtttgatagaacggccaatttagcaaacaatcaaattattaactacaagtgctctcctaacgagaagtggttggttctaattggaattgctcctggccctcctgagagagcacaattggtaaaaggaaatatgcagcttttttctgtggatcaacagcggagccaggcccttgaagcacacgctgcctcatttgctcagtttaaggtccctggaaacgaaaatccttctatccttatatcctttgcaagcaagagctttaatgctgggcagataacatcaaagttgcacgtcattgagcttggtgcccaacccggaaaaccatcatttacaaaaaaacaggcggatctctttttccccccagattttgctgatgatttccctgttgccatgcaggtctctcacaaatttagcttgatatatgtcatcaccaagcttggattgttgtttgtatacgatctagaaactgcttctgctatctacagaaatcgaataagtccagacccaattttcttgacttctgaagcctcttcagttgggggtttctatgccattaataggcgaggacaagttcttttggccacagtaaacgaggctactataataccttttattagtggtcaattgaacaatttggagcttgctgtcaatcttgctaaaagaggaaacctccctggtgcagaagagctggttgtggagcggttcaaagagctttttgctcagacgaagtacaaggaggctgctgagcttgctgctgaatctcctcagggaattctaaggacacctgatacagtggccaaattccagagtgttcctgtacaagctgggcaaactcctccgttgttacaatattttgggactctcttaactaaaggaaagctcaattcatatgagtcattggaactatctcggcttgttgtgaatcaaaacaagaagaacctcctggaaaactggttagcagaggataaattagaatgcagtgaagaactgggagaccttgtcaagactgtggataatgaccttgctctgaaaatatatatcaaagcccgggcaactccaaaagttgtagcggcttttgcagaaagaaaggagtttgacaaaatcctgatttactcaaagcaggttgggtacacacctgattacatgtttcttctgcaaacaatactccgtacagatccccagggagcagtcaattttgcattaatgatgtctcaaatggaaggaggttgtccagttgacttcaacaccatcactgacctttttcttcagagaaatctgatccgagaagctactgcattccttttggatgtgcttaagccaaatttacctgagcatgcgtttcttcaaactaaggttctggagatcaatttggtaacctttcctaatgtggctgatgcgattttagcaaatgggatgttcagccactatgaccggcctcgtgttgctcaactttgtgagaaggctggactttttatccaatccttaaagcattactcagagttacctgatataaaacgtgtaattgtgaacacacatgctattgagccacaggctcttgttgagttttttggtactctttctagcgattgggctatggagtgcatgaaggatcttttgctggtcaaccttagaggcaacctgcagataattgttcaggcttgcaaggagtactgtgaacaacttggtgttgatgcatgtattaagctctttgagcagtttaaatcatacgaaggcctctactttttcctaggctcatatttgagtatgagtgaggatcctgagattcacttcaagtacattgaagcagctgccaagactggtcaaataaaggaggttgagcgtgtgactagagagtctaacttctatgatgctgaaaagacgaagaactttttgatggaagctaagcttcctgatgcccgacctttgataaatgtctgcgaccgtttcggctttgtacctgatctaactcattacctctacacaaacaacatgcttcgttatattgaaggttacgttcagaaggtgaaccctgggaatgctcccttagttgtgggtcagttgcttgatgatgaatgccctgaagattttataaaaggcctcattctctctgttcgctcattgctacctgttgaaccccttgtcgatgaatgcgagaagagaaatcgactccgtctcctcactcagttcttggagcatctagttagcgagggaagccaagatgttcatgtccataacgccttgggtaaaattatcatcgacagtaacaacaaccccgagcatttcctgaccaccaacccgtactatgactctcgggttgttggcaagtactgcgagaagcgtgatcctaccctggctgttgtggcatacagaagaggacaatgcgatgaggaactcgtcaatgtcaccaacaaaaattctttgttcaagttacaagccaggtatgtagtggagaggatggatggtgatctttgggataaggttcttatggaagaaaatgaatatagaagacaacttattgaccaagttgtgtctactgctttacccgaaagccagagcccagagcaggtatccgctgctgtgaaagcattcatgaccgctgatttgccgcacgagcttattgagcttcttgaaaaaatagtgcttcaaaactctgccttcagtggaaacttcaatctgcaaaatctgcttatattgacagctattaaagcagatccatctagagtgatggattacattaataggctggacaattttgatggacctgctgttggagaagtggctgttgaagcccaactgtacgaggaggcatttgctattttcaagaaatttaacttaaatgttcaggctgtcgacgtattactggataacgtcaaaagcattgagcgtgctgttgagtttgctttccgggttgaagaagattctgtttggagccaagttgcaaaggctcaactcagggaaggactagtcagtgatgcaattgagtcctttatccgtgctgaggatgccacgcatttcttggaggtcatacgtgctactgaagatgctaatgtctatgatgacttggtcagataccttctgatggttagacagaaggtgaaggagcccaaggttgatagtgagctcatctatgcatatgcaaagattgataggttaggtgagatcgaagaattcattctgatgccaaacgttgctatcctaccaaatgttggtgatcgcctgtatgacgaagctctgtatgaagctgcaaaaataatctatgcgttcatatcgaactggggcaagttagctgtcacgcttgtgaagttgcaacagttccaaggtgctgttgatgctgcaaggaaagcaaacagtgcaaagacatggaaggaagtctgctttgcttgtgttgatgcagaggaattccggttggcacagatctgtggccttaacgttatcattcaggtggatgatctggaagaagtaagcgagttctaccagaacagagggtgcttcaatgaattaatctcacttatggagagtggacttgggctggagcgtgctcacatgggtatcttcactgagttgggtgtactctatgctagatatcgatatgagaaacttatggaacacattaagctattctccactcgcctcaatatccccaagctcatacgggcctgtgatgaacaacagcactggcaggaacttacttatctctacattcaatatgatgagtttgataatactgcgaccactgtgatgaaccattctcctgaagcgtgggagcacatgcaattcaaagacattgttgccaaggttgcaaatgtcgagctgtactacaaggctgtgcatttctacctacaggagcatcctgatctgatcaacgatcttctcaacgtgcttgctttgcggttagatcacacccgtgttgtcgatattttgcggaaggctggccagttgcgtcttatcaagccatacatggttgcagttcagagcaacaatgtctctgctgtcaatgaagctctgaatgagatatatgtggaagaagaagactatgacaggttgcgcgagtctattgatttacatgacagctttgaccagataggcctcgcgcagaagattgagaaacacgagcttgttgaaatgagacgtgtggctgcttatatctacaagaaagcgggtagatggaagcaatcgattgctttgtcaaagaaagacaacatgtacaaagactgtatggaaactgcttcacaatccggtgaacatgaccttgcagaacaactgttggtttacttcattgaacagggcaaaaggaatgctttgctacatgtctctttgtatgttatgatttaatccgaccagacgttgctctagaacttgcctggatcaataacatgctcgactttgccttcccgtatctcctccagtttatccgagagtactcgggcaaagtggatgagctaatcaaagacaagctggaggcacaaaaagaggtgaaggccaaagagcaggaagataaggatgttatgtcccaacagaacatgtacgctcaactgttgccacttgctttgcccgcaccaccaatgccaggaatgggaggtggtggtgggtatggtccgccaccaccaatgggcggaggaatgccaggaatgcctccgatgccaccatatggaatgccaccaatgggtggctactaagtggaaagttatcagaaacccataggccgtgttcgcttattacatgtctctcttgctagaatttgactgggttagtgaaaggtttagtggaaataatgttctccgtttagtttataagttgcggggatgctttcgttgtagtatataatatactcttgggaattagttgagtctttttttggttggaagccatttttctttcgaggatatttagactcatttagacatctttactcatgagtttgtagtttctcttttccaccttatttt

SEQ ID NO: 5245 - DNA, 6336 bp, Theobroma cacao
atttaatttcgtaaattaaaaataaaaaaaacattgttaaactcaaaaaaattaatttgggcctaattaatagagattcattaattatcgggccatctacacagcttatagactcatctgtttcagaggagcctttttttttacgagcccatattcggactcttgattgttttcctaagcccaaagtcctaagtttgtacaacaaggtacaagcctgctgctaattcttacaaatcaaaaatagctcgtcgactagaagagaagaccctttggttcttctcccttttagttctagatctacactctttccctcttttgatttcatttctcagatttacctccactgatcggagtttcgaatatcgagaacgctaatctaagccgcagccatggctgctgccaacgctcccctctccatgaaagaaaccttgacgttgccgagcatcggcataaatccgcagttcataagcttcactcatgtgactatggagtcggataagtatatttgcgttagggaaacggcgccgcaaaacagcgtcgttataatcgacatgagcatgcctatgcagcctctcaggcgtccgatcactgccgattccgctctgatgaatccgaacactagaattctcgctttgaaagctcaacttccgggaacaactcaggatcatttacagatatttaacattgaaatgaaagcgaaagtgaaatcatatcagatgcctgagcaggtggtgttttggaagtggatttctccacagaagcttgccctggtcacacaaactgcagcatatcattggtcaatcgaaggcgagtgaatctgagcctgtgaagatgtttgagcgaactgctaatcttgcaaataatcaaatcattaactataaatgtgattccaatgagaagtggttagtcttgattggaattgcccctggttcatctgagaggccacaattggtcaaaggtaatatgcagcttttctctgtggatcagcagcgtagtcaagctcttgaagcacatgctgcatcatttgccacatttaaagtacctggaaatgaaaatccttcaactcttatttcttttgccacaaagacattcaatgctggacaaataacgtctaagttacatgtcattgaactcggtgctcagccaggcaaaccttcattcacaaagaaacaagcagatttattctttcctccagattttgctgatgactttcctgtgtcaatgcagatatctcagaagtatggtctaatatatgtgatcacaaagcaaggacttctttttgtatatgacctggagacagctactgcagtttacagaaatcggatcagtccagatcctatattcctgacaacagaggcttcatccattggtggcttttatgctataaacagacgaggccaggttctgcttgccactgtaaatgaagctacaattataccatttattagtggtcagttgaacaatcttgaacttgccgtaaatcttgccaaaagggggaatcttcctggtgctgaaaatctggtggtgcagcggttccaggaattgttttcacagacaaagtacaaagaggctgccgaacttgctgctgaatcacctcagggaattctccgtactccagacactgttgccaaattccagagtgtccctgttcaagctggacaaactcctccattattgcagtattttggaaccttgttgactagaggaaaactcaatgcttttgagtcattggaattatcacgccttgttgtaaaccagaataaaaagaatcttctagagaattggttggcagaggacaagcttgagtgcagtgaggagcttggagatcttgttaagacagtagataatgatcttgcactgaaaatatacatcaaagcaagagcaactcctaaagttgttgccgcttttgctgagaggaaggaatttgacaagattctaatttactcaaagcaggttggatacactcctgattatttattccttctgcaaacaattttgaggacagatccacagggtgctgttaattttgctttgatgatgtctcaaatggagggtggttgcccagttgattataacacaataacagatctatttcttcagaggaacttgattcgtgaggcaactgcctttttgttggatgtgctaaagccaaatgtaccagaacatgggtaccttcaaacgaaggttttggaaatcaatctagtgacctttccaaatgttgctgatgcaatattagcaaatggtatgtttagtcattatgatcgtccacgtattggccaactctgtgaaaaagctggtctgtacatacgagctcttcagcattatacggagttgccggatatcaaacgtgtcattgtgaatacacatgccatcgagccccagtcccttgttgagttctttggaaccctttccagagaatgggctcttgagtgtatgaaagatcttctaatggtcaatcttagggcaaatcttcagattattgtacagactgcaaaggaatactgtgagcagcttggtgttgatgcatgtataaaactctttgagcagttcaagtcctatgaaggattatactttttcttgggttcatacttgagctccagtgaggatccggatatccacttcaaatacattgaagcagcagcaaaaactggacaaataaaggaagtagaacgtgtgactcgtgaatcaaacttttacgatgctgaaaagaccaagaattttctgatggaagctaagcttccagatgcacgtcccttgattaatgtttgtgatcgttttggttttgttccggatctcactcattatctatatacaaacaacatgctccgatatattgagggttatgttcaaaaggtaaatccagggaatgctccattagttgttgggcagctgttagatgatgaatgccctgaggatttcatcaagggtcttattctttcagttcgttctcttcttccagttgagccccttgtggatgaatgtgagaagaggaattgtctccggttgctgactcagtttttagagcatctagtgagtgagggcagtcaagatgtgcatgttcataatgctttgggtaaaattatcatagagagcaataacaacccagagcattttctcactaccaacccgtattatgattcacgtgtcgtgggtaaatattgtgaaaaacgagatccaacacttgctgttgttgcttaccgtagaggacagtgtgatgatgaactggtcaatgtcacaaacaagaattccttattcaagttgcaagctagatatgtggtggagaggatggatgcagatctttgggagaaagttcttaatcctgataatgagtatagaagacagcttattgatcaggttgtgtcaactgctttgcctgaaagcaagagtccggagcaagtctcagcagctgttaaagcatttatgactgctgatctcccacatgaactgattgagcttcttgagaagatagtgctgcaaaattctgccttcagtggaaacttcaatttgcaaaatctgctgatattgacagctatcaaagcggatccatcaagagttatggattacattaatagattggacaactttgatggacctgcagttggagaggtagctgtggaagcccaattgtatgaagaagcatttgccattttcaagaagtttaatttgaatgttcaggctgtaaatgtgttgttggataaccttaatagtatcgatcgagctgtggagtttgcattccgtgttgaagaagatgctgtctggagtcaagtggctaaggcacaacttcgtgtaggggatgtgagtgaagctattgagtcatttattcgtgctgatgacgctactcagttcttggatgtcataaaggctgctgaggatgcaaatgtataccaagacctggtgaggtacctactaatggttcggcagaaaaccaaggaacccaaagtggacagtgaacttatctatgcttatgccaagattggtgggctgggtgagatagaagagttcattcttatgccaaatgttgctaatctgcaaaatgtgggagaccgcttgtatgatgaagccctttatgaggcagcgaaaatcatatttgcatttatttctaactgggctaagctggccatcacacttgttaagctacaacagttccaaggtgctgtcgacgctgctcggaaagccaacagttcaaaaacatggaaggaggtttgcttcgcttgtgttgatgctgaagagttccgcttggctcagatatgtggcctcaatatcatcatacaggttgatgacctagaggaggttagcgagtactatcagaaccggggatgcttcagtgagctcatatctctaatggagagtggattaggtttggaacgtgcacatatgggcatctttacggaattgggagttctgtatgcaagataccgtccagagaagcttatggagcacataaaacttttctcaactcgtctaaacattccaaagcttattcgagcttgtgatgaacagcagcactggaaggaactaacttatctatatgttcagtatgatgagtttgacaatgcagctaccaccataatgaaccactctccagaagcatgggatcacatgcaatttaaagatattgtagtcaaagttgcaaatgttgaactctattacaaggctgtgcatttttacttggaagaacatcctgatcttatcaatgatgttcttaacgtgcttgccctccgtgttgaccatgcacgtgttgtggatataatgaggaaggctggtcacttgcgtcttgttaagccatacatggttgccgttcagagcaacaatgtggctgctgttaatgaagctctgaatgagatttatgtagaggaggaggactatgacaggcttcgtgaatctatagatctccatgataactttgatcagataggctttgcacagaagattgagaagcatgaactacttgagatgaggcgtgttgccgcttatatatataagaaggcagggagatggaagcagtctattgccttgtcaaagaaggacaatcattacagagatgccatggaaacatgttcacagtctggtgatcgggaacttgcagaggaattactcgtctattttattgagcagcgaaagaaagagtgttttgctgcatgcctctttgtttgttatgatgtaatcaggccagatgttgctcttgagcttgcctggataaataatatgattgattttgccttcccatatctcttgcagtttatacgggagtacacaggcaaagtggatgaactcgtgaaggataaaatcgaagctatgaatcagctgaaggccaaggaggaggaggagaaagacgtggttgctcagcagaatatgtatgctcagttgctgcctcttgctttacctgcacctccaatgcctggaatgggtggaagttttgctccaccaccaccaccacctccaatgagtgggatggggatgcctccaatggcaccctatggcatgccaccaatgggttcctattgatctctgattaaacaaggataggtaagcaagaaatatgttgacttatacaaggatgaatcgaatctctaattgcccatgatatcatgtttacgtttgaaggtgaatttgatctttttcatggttgtgaaatattgaggtagtagccttgctttctttggtaatgcatctgttattgggttgtggttatttgtgcccaacagatgcagctttaccctgtagtcgaggacgttagcaactagggttttgacaaaattttatgcagcttagtgatgactgaacgaatttcgtgcaaaccttgccaagtctgccatatgtataggttattctagctcagtcatatacatttttctgttctcctaagtgctcggacatgtagttgcttcgttttaggaatccaaaattttgtacttgctaatctttcctcccccagtgtataacagagtattctttatagtttaaatttcacaatctctctctctctctctctcttgttgcagataagttttattaatctttatccttggctggactcctcaactcttattttgaattcaatgagactccattgtttggttgatacgccttctgaattttgtacattcttttttacttgctcaacctctaatttaaagttggagaaatgaaattctgattgagagttgatgtagagttggtaacactctctctgcctctgtgattatatatgccaaatgatacaaggaaaattctggatctcaactcgtcaagttagcttctgattgtatgtagaggtcaccagtttgatccttcgctcaatctctagtcctcaaagattaaagccgttaaattgaa

SEQ ID NO: 5246 - DNA, 4469 bp, Triticum aestivum
tttctctgttgatcagcagcgtagccaggcacttgaagcccatgcagcatcttttgcaacttttaaggttcctggcaacgagaatccatcaacactcatctgttttgcctcgaaggcaactaatgctggacagattacttctaagttacatgttattgaactgggggctcagccagggaaacctggtttttccaagaagcaagccgatctcttcttcccaccagattttcaggatgattttcctgtagccatgcagatctctcaaaagtatggacttgtctatgtaattacgaagcttggccttttgtttgtgtatgacttggaaactgctgcagcagtttatagaaatagaatcagtccagatcctatattcttgacagcagagtcttctacaaccggtggattttatgccatcaacagaagagggcaggtcttacatgccacagttaatgatgcgactgttgttccttttgtcagtggtcaattaaacaaccttgaacttgccgtgaatcttgccaaaagagccaatccgtccccggggcggagaacttggttgtgcaaagattccaggaactgttcgcacagaacaaaatacaaggaagcagcagagttggctgcagagtccccgcagggtcttctacgaactcccgagacagttgcaaaatttcagagtgttcctgttcaagctggacaaacgcctccactgttgcagtactttggcacattgctaactcgagggaagctcaatgcttacgagtcccttgagttatctcgacttgttgtcaatcagaacaaaaagaaccttctggaaaattggttggcagaagataagttggaatgcagtgaagagctaggagatcttgttaagacggtagacaatgaccttgcattgaaaatatacataaaggctagggcaacacctaaagtcgttgctgcttttgccgaaaggagggagtttgacaagatccttatatattcaaagcaggttgggtacactcccgattaccttttcctcctccagaccatcctacgtacagatccacagggagctgtaaatttcgctctcatgatgtcacaaatggagggtggttgtccattagattataataccataaccgatctcttccttcagagaaatatgatacgggaggcaacagcttttctgctggatgttctgaaaccaaacttggaagaacatgcttttctgcaaaccaaggttttggagatcaacttggtgacttaccctaatgttgctgatgccatccttgctaacggtatgttcagtcattacgaccgcccacgcattgctcaactgtgtgaaaaggctggtttgtacttgcgagccctccagcactatgcagagttgcctgatatcaaacgtgtcattgtaaatacccacgccattgaaccacaggcactcgttgagttctttggaaccctttcaaaagaatgggcactagagtgcatgaaagaccttctactggtcaatctgagaggaaaccttcaaatagttgtgcaggccgccaaagaatactctgagcagctaggtgtcgatggttgcataaaactatttgagcaatttaaatcttatgagggcctgtactttttcttgggatcctatttgagctccagtgaggatccagatatccacttcaagtacatagaatcagctgcaaggactggacaaatcaaagaagttgagcgtgtaaccagagagtctaatttctatgatgctgagaagacaaagaactttctgatggaagcaaaactacctgatgcccgaccactgattaatgtttgtgaccgctttggttttgttccagatctaactcactatctgtacacgaataacatgctcaggtatattgaaggctatgtacagaaggttaaccctgggaatgctccattggtagtggggcagctacttgatgatgagtgccctgaagatttcattaagggtttgattctatctgtccgctctctccttcctgttgagccactagttgacgagtgcgagaagaggaaccgcttacgtctgcttacacaattcttggagcacttagtgagcgagggtagccaagatgtgcatgtccataatgctcttgggaaaattatcatcgacagcaacaacaacccagagcatttccttactaccaatccattttatgactctcgtgtggttggtaaatactgtgaaaagcgggatcctacacttgctgttgttgcttacaggcgtggacaatgtgatgatgaacttattaacgtcactaacaaaaactcacttttcaagctgcaagctaggtatgtggttgaaagaatggatggtgatctttgggataaagttctactgcctgaaaatgaatacagaaggcagttcattgaccaagttgtttctaccgcactgcctgaaagcaagagccctgagcaagtttctgctgctgttaaggctttcatggaagctgacctcccgcatgagctgattgaacttcttgaaaagattgtcctccagaattctgcattcagtggaaactttaatcttcagaacctgctcatcttgacagccattaaggcagacccatccagggtcatggactatgttaacagactggacaactttgatggccctgctgtcggagaagtagctgtcgaggcacaactgtatgaggaggcttttgccatatttaagaagttcaacttaaatgttcaggctgtcgatgttctgttagataacatccaaagcatagaaagagctgaagagtttgcattccgtgttgaagaagatgctgtttggagccacgttgccaaggcccagttgcgtgaaggtctagtcagtgaagcaattgagtcattcatccgtgcagatgacgcaacacatttccttgatgtcatccgtgctgctgaggaagctgatgtataccatgatcttgtcaagtacttgcttatggtaaggcaaaaggcaagggagcccaaagtcgatggagagctcatctttgcatatgcgaagattgataggctcagcgacattgaagagtttattcttatgccaaatgttgctaatctccaaaatgttggtgaccggctttacgatgaagaactttgtgaagctgcaaagatcatctatgccttcatctcaaactgggctaagttggctgtcaccctggtcaagctgaagcagttccaaggcgctgtagatgctgctcgcaaggctaacagcgctaaaacatggaaggaggtctgctttgcttgtgttgatgctgaggagttccgtctagcacaaatatgcggtctcaatatcatcattcaggttgatgacttggaagaagtgagtgaatactatcagaacagaggatgcttcaatgaacttatttctctcatggagagtggtcttggacttgagcgcgcgcacatgggcatctttacagaacttggagtcctttatgccagataccgccctgagaagctcatggaacacatcaagcttttctccactcggctgaatattcctaagcttatccgtgcttgtgatgaacaacaacactggaaagagcttacgtacctatacatccaatatgatgaatttgacaatgctgctaccactattatgaaccattctccagatgcatgggatcatatgcaatttaaggatgttgctgttaaggttgcaaatgttgagatatattacaaggctgtgcacttctatttgcaagaacaccctgatctcatcaatgatcttctcaatgtgcttgcgcttcgcttggatcacacaagagttgtagacataatgcgcaaggctggtcagttgcatcttgtgaaaccatacatggttgctgttcagagcaacaatgtctctgctgtcaatgaagcattgaatgagctttatgttgaggaggaggactatgagaggctccgtgagtcggttgacatgcatgataactttgatcagataggtcttgcccagaagcttgagaaacatgaattgcttgagatgaggaggattgctgcttacatttacaagaaagctggcagatggaagcaatctattgccctatcgaagaaagacaacatgtacaaggattgcatggaaacatgctcacagtctggtgaccgtgagctgtcggaggatttacttgtctatttcatcgagcagggaaagaaagaatgttttgcttcttgcctcttcatttgttacgacttgattcgtgcggatgttgctctcgagcttgcatggacaaacaacatgctggactttgctttcccctacctattacagttcatccgtgagtacacaagcaaggtagatgacctggtgaaggacaggattgaattgcagaaagaagaaaaagccaaagagcaggaagagaaggacgtcgttgctcagcagaacatgtacgctcaattgctccctctcgccttgcctgctcgcctggtatggggggtccacctccgatgggcgggatgggtatgcctcc

SEQ ID NO: 5247 - DNA, 5626 bp, Physcomitrella patens
aacgacctcaatcggtcaccatggcggcagccaacgcccccatcgccatgagggaggcgttaacgcttacaagtctgggcataaaccaacaattcgtgacatttacacatgtgacgatggaatccgacaagtacatttgcgtgcgggagacttctcctcagaacagtgtagtgattatcgacatgtcgatgcccaatcagcctctgaggcggcctattactgccgattctgcactcatgaatccaaccagtagagttcttgcgctgaaagctctaattcctgggtcaacgcaagatcacttgcaaatttttaacattgagttaaaggcgaaaatgaaatcgcatcagatgccagaacaggtagtgttttggaagtggatttcttcaaaattactagggcttgttacacaaacctcagtatatcattggtccatagaaggtgaaagtacaccacagaagatgtttgacagaactgcaaatttgactggtaaccaaatcatcaactatcggtgtgatccctctgaaaagtggctagtattgattggtattgcccctggtgcacctgagcgcccacagcttgtgaagggaaacatgcaattattttctgtggatcaacagaggagtcaagcattagaagcgcatgcagcatcattcgcaacttttaaggtggcaggaaacgactcaccaagtcttcttattgcattctcaacaaaaactataactgctggacagcttacatccaagctgcatatcattgagcttggtcctcaaccaagtagacccgggtttgccaagaaggcggcggacttgttttttcctccggattttgcagacgattttccagttgcaatgcagatctcatcgaagtacaatcttatctacgttatcacaaagctgggccttctttttgtctacgatctagaaaccgctacagctgtgtacagaaaccgtatcagtccagatcctatctttttgacagttgatgcaccaacaactggtggattttatgctgtcaatcgccgcggacaagttctactggcgactgtaaatgagtcaacaattgttccattcgtcagcaatcagctgaacaatttggagcttgcggtgaatctggccagacgagggaatttgcctggagccgagggcttggttgtgcaacgtttccacgagttgttttctcaaatgaaatacaaggaagcagctgaccttgcagctgaatcaccaaaaggaatacttcgaactccagatacggtggccaaatttcaggcaagtcacccaagtgttccagtgcagcccggacaaacgtcgccacttttgcagtacttcggaactttgctgacaaagggcaaattgaatgtgtttgagtccttagagctttcccggttggttgttaatcaaaacaagaagaacctacttgagaactggttggcggaagacaaactcgagtgcagtgaagaactcggagatcttgtcaagaccgtagacagtgatatggctttgaaaatttacataaaggccagggctacacccaaggtggttgcagcttttgctgagcggcgagagtttgataagattctgatttactccaagcaggttgggtatacaccagattatctgttcctgctgcagacaatactgctatcagatcctcagggtgctgtaaactttgctctgatgatgtctcagttggaaagaggatgtccagtagactataatgttatcactgacttgttccttcagcgcaacatgatcagggaggcaaccgcgtttcttttggatattctgaagcctaatttaccggagcatgccctacttcaaaccaaggtactggagatcaatttggtcacatttcccaatgtggctgatgcaattctggcgaatggcatgttctcccattatgatcgtcctcgcattgctcaactctgtgagaaagctggtctctacatgcgtgcccttcagcattacacagagttgaatgatatcaagcgtgttgtgatcaacactcatgctattgaacctcaggcgctagtggagttttttggaactttgtctagggagtgggccttagactgcatgaaggagcttctccaagtgaatatgcgagggaatcttcaaattatcgtgcaggtttcgaaggagtatggggaacagctgggtgttgattcttgtgtaaagttgtttgagagcttcaaatcatacgaaggcctttacttcttccttggcgcatacttaagtacaagcgaggaccctgagatccactacaagtacattgaggctgcagcaaagactggccaaatcaaggaagtggaacgtgtcacaagagagtccaacttctatcctcctgagaggaccaaaaactttttgatggaagcaaagttaccagatgcaaggcctctcatcaatgtttgcgatcgacatggctttgtgccagatcttactcatttcctttatgtcaacaatatgcttcgatatattgaaggatatgtgcagaaggtcaatccacaaaacgcacctcaggtggttgggcaattgcttgatgatgattgccctgaggacttcattaagggtttgatcttatccgtccgctcactgcttgctgttgagcctctggtcaccgagtgtgagaagaggaatcgtctgcgactgttgacacaattcttagagcatttggtaagtgaaggtagccaagatgtgcatgtgcacaatgctcttgggaagatcatcatagatacaaacaataatcctgagcattttctcactacaaatccttactacgactcaaaagttgttggtaagtactgtgagaagcgcgaccccacactcgcagtggttgcatacaaacgaggtctgtgtgatgatgagcttatcaatgtaacgaacaagaactctatgttcaagcctcaggccaggtatgtggttgagcgtatggatcctgagctatggttgaaggttctcgacccagaaaatcccttcaggagacagctcattgatcaagtcgtttctactgcactgccagagagcaagaatccagaacaggtgtcagccactgttaaggcattcatgactgcagatttgccccatgagttgatcgaacttctagagaaaattgttctacagaactctgccttcagtggcaacccgaatctccagaacctgctcattctcacagcaatcaaggctgataaatcaagggttatggactatatcaaccgattggataattttgatggtccagcagtgggggaaattgctgttggtgctgagctttatgaggaagcatttgctatatttaagaagttcaacttgaacgtgcaagctgtcaatgtcctcttggaccacctccgcgacattgaccgtgctgtggaatttgcagcacgagtggaagaggatgaggtctggagccaggtgggtatggcacagttgagagaagggctggtaagtgatgccattcaatctttcatcaaggctaacgatgctacccagtacaatgaagttataaatgtggcatccaatgtcaaagcttacgaggatcttgtcaaatacttgcatatggttcggaagaaggtgaaggaacagagggtggactcggaattgatttattcctatgctagacttgatcgattgggtgatattgaggatttcattatttctcctaaccttgcgaatctgcaaaccgttggagaccgactctttgatgactccttgtacgaagctgccaaaatcatatttactcacatctccaactgggctagactggcgagcactcttgtcaaaattcatcagtatcaagcagctgtggatgcggctcggaaggccaataactcacggacttggaaggaagtgtgtttcgcttgtgttgatgctgaggaatttcgattagcgcaaatctgcggtcttaatgtcattgtccaggtggacgacttggaagaagtcagtcagtactatcagaacaggggttgttttgtggagcttatctctcttatggagagtgggcttgggctggagcgtgcacacatgggaatattcacagaacttggaacgctttatgcgaaataccggccagagaagcttatggagcatctcaagctttttgttacccgtattaatattccaaaacttatccgcgtttgcgacgagcaacagcactggcaggaacttacattcttgtatattcagtatgatgagtatgacaatgccgctgctactatgatgagccattctcctgaggcttgggatcacatgcagttcaaggacgtggctgtgaaggtagccaatgtggaattgtactacaaggctactcacttctatctgcaggagcatccagagtacatcagcgatcttcttaatgtcctagctactcgaatagatcatacaagggtggtagacatcatgcggaaggctggacaattatcactggtgaaaccatacatggtggctgtacagagtgctaacaatgctgcagtgaatgaggctctcaatggcttatacattgaagatgaggattacgaacgactcagagagtccattgatatgtatgataactttgatcagatgtcaatggcacagcggattgagaagcacgaacttctggaaatgcgacgagttgcagcttacgtctacaagagggctgggagatggaaacagtcggtcgctctttctaagaaggataacttgtacaaggatgccatggaaaccgcctcacaatcaggcgatcgtgatcttgctgaggaattgcttaccttctttgtggacaagggcaagaaagaatgctttgctgcatgcctatacacctgttacgatctcattcgtgctgatgttgcggtggagctcgcctggatgcatggcatgatggatttttgtgttccttatttattaccagttttcattcgtgagtatacaacaaaggttgatgaccttgtcaaggataaaattgaagcaactgaagaaaagcggtcgaaggagtccgaagagaaggaggttgtggcgcaacagaatatgtatgcccagcttttgcctttagctctacctcctcctcctgttcctggtgtgaatggctttgcgcctggcatgggcatgcctaccatgagtggtatgccacctatgggtggaggttacggcatgccccccttaagcggagggtacggtatgcctagtatgagttcaatctaacaatatcttcaaaggaatttattattcaatctctatcaagcttctcatctgggttgaattacgtccaacaaagcttaatgtgaacaatttgtggttcaacgaatgcattttcacgcgttcgagaacggctttttggtgtgtctgcatcgaactgaaattgaattgtagttggtagtgctgctagtttgtagattagttgtagcgctggtttgtgcaggtagtaggatggatactaaattaccagtgatgatcaggacggccgcgtagtcacctatgttgggaccatgatatatatatgagggtgttgtcgatggattatattgttgagggatatgtggtggttccgttcatcggctgctattgcagatttgtagggtagagagaagtgcagcgggcaactcatgtacagtaagccatttgatctgatacattgtagcattatcaacatttgaacttct

SEQ ID NO: 5248 - DNA, 5781 bp, Citrus sinensis
attttaacacgtcccctcctctcctctctccctcggcccgatttttttcttttttaaaaattcatttcactttcttttcctcttcgcttcttcttcttcttcgtgctgcgaagtgccttaagataagatctcattctattttatctctctagatctctcgtctaggttttaattgctgccgtagatctcgcagcgatttgaatctctcttgtaataggattgaattgaattgaatctccaccgtagatctctcccgatctgatcccaaatcatggctgctgccaacgcgccgatctccatgaaggaggtcttaaccttgccaagtgtcgggattaatccgcaatttattactttcacgaatgttacgatggaatctgataagtacatatgtgttcgagaaactgctccacagaatagtgttgtgattattgatatgaatcagccgatgcagccgttgaggcggcctatcacggctgactcagcacttatgaatcccaattcaagaattcttgctttgaaagcacaactccctggaaccactcaggatcacttgcaaatatttaacattgagctgaaagcaaaaatcaaatcgcatcagatgtctgagcaggtggtcttttggaagtggattagcccaaagatgttgggagttgtcactcaaacttcagtgtatcattggtcaattgaaggtgattctgaaccagtcaagatgtttgatagaactgctaatttgacaaataatcagataattaactacaaatgtgaccctactgaaaaatggttggttttgattggaattgctcctggttcagctgagaggccacaattggttaaagggaacatgcaacttttttcagtggatcaacagcgtagtcaagctcttgaagcccatgctgcatcatttgcccaattcaaggttcctgggaatgagaatccttctgttcttatttcctttgcgacaaagtctttcaatgctgggcaggttacatcaaagctgcatgttatcgagcttggtgcgcagccaggaaagccatcttttacaaagaagcaagcagatcttttctttcctcctgattttgctgatgattttccagtggcaatgcagatatcgcacaaatatggtttgatttatgttatcaccaagcttggattgctatttgtttacgatttggagacggctgcggcagtgtaccgaaacagaattagtccagatccaatatttttgacatctgaagcttcttcgctgggaggtttttatgccatcaacaggcgaggccaggtgttactggcaacagttaatgaagcaacaatagtgccttttgttagtggccaattgaacaatcttgaactagcagtcaatctggccaaaagaggaaaccttcctggtgcagagaatctggttgtccagcggttccaagaactgtttgctcagacaaagtataaagaggcagctgagcttgctgcagaatctccacaaggactcctccgcacaccagatacagttgccaaatttcagagtgttcctgtgcaagctgggcagactccacctttgttgcagtactttgggacacttttgacaaggggaaagctcaatgcttttgagtcattggaattatctcgcctagttgtgaaccagaacaaaaagaatcttttggaaaactggctagcagaggacaagttggaatgtagtgaggaacttggagaccttgtgaagactgtggataatgatcttgcactgaaaatatatattaaagctagggcaaccccaaaagttgttgcagcttttgcagagaggagggagtttgacaaaattttgatttactcaaagcaggttgggtatacacctgattatttattccttctgcaaacaattctccgaacagatcctcagggagctgttaactttgcattaatgatgtcccaaatggagggaggttgtccagttgattacaatacgattactgatctgtttcttcagaggaacttgatccgcgaagcaacagcctttctgttggatgttttaaagccaaatctaccagaacatggttttcttcagacaaaggtgctggagatcaatctcgtaacttttccaaatgtagctgatgctattttggccaatggaatgttcagccactatgatcgtcctcgaattgcccaactttgtgaaaaagctggtctttatatgagagctctgcaacattacacagaattaccagatattaagcgtgtcattgtgaatacacatgcaattgagccacagtcactggttgagtttttcggtactctttcaagagaatgggctttggagtgcatgaaggaccttttacttgttaacctaaggggcaaccttcagataattgtgcagactgccaaggaatactgcgagcagttgggcgttgaggcttgcattaaactttttgagcaattcaagtcatatgaagggctgtactttttcctgggttcatacttgagttccagtgaggatcctgacatacacttcaaatacatagaggcagctgctaaaaccggacaaataaaagaggtggaacgagtgacaagagaatcaaatttttacgaccctgaaaagaccaagaactttttgatggaagccaagcttcctgatgccaggcctctgattaatgtctgtgaccgatttggttttgttccagatctcacacattacctctacacgaacaacatgcttcgctacattgaaggttatgttcagaaggtgaacccagggaatgctcccttagttgtaggacagctgttagatgatgaatgccctgaagattttattaagggcctcattctttctgtccgttctttgcttccggttgagcccctggttgaagaatgtgagaagaggaatcggcttcgtttgctcactcagttcttggagcatcttgttagtgaaggaagccaagatgttcatgtccacaatgctctgggtaaaattattattgacagcaataacaatccagagcacttccttaccactaatccttactatgattcccgagtggtgggtaaatattgtgagaaacgtgatccaaccctggctgttgtggcttaccgtaggggacaatgtgatgatgaactcatcaatgtcaccaataagaactcactgttcaaactacaagccagatatgtggttgagagaatggatgcggatctatgggagaaggttcttacccctgaaaatgagtatagaagacagctcattgatcaagttgtatctactgctttgccagaaagcaagagtccagaacaagtttctgcagctgttaaagctttcatgactgctgatctgccccatgaactaattgaacttcttgaaaaaattgtgctgcaaaactctgccttcagtgggaacttcaacttgcaaaacctgcttatcttgacagctattaaggctgatccatctagagtcatggattatgttaatagactagataactttgatggacctgctgttggggaagtggctgttgaagctcaactatatgaggaagcatttgctattttcaagaagttcaacttgaatgttcaggctgtcaatgtcttgttggataacatccgaagtattgaacgggctgtggagtttgcattccgtgttgaagaagatgcagtttggagccaggtagcaaaggctcaactgagggaggggctggtgagcgatgcaattgagtcatttatccgtgctgatgatgctactcaattcctggatgttattcgtgctgccgaggatgcagatgtctaccatgacttagtgagataccttcttatggtcaggcaaaaggtaaaagagccgaaggtggatagtgagctcatttatgcatatgcaaagattgataggctgggtgatattgaggaatttattctcatgccgaatgttgctaatctccaaaatgttggtgatcgcttgtatgatgacaccctctacgaggctgcaaaaataatatacgcatttatatctaactgggcaaagttggccgtcacacttgtgaagctgaaacagtttcaaggtgctgtcgatgcggcacggaaagccaacagtgcaaagacatggaaagaagtttgctttgcatgtgttgatgctgaggagttccgtttggctcagatatgtggtctcaacattattgtacaggtggatgacctggaagaagtcagtgaatattaccagaacagaggatacttcaatgaattaatctctctcatggagagtggtttgggattagaacgtgcacatatgggtattttcaccgagttgggagttctgtatgccagatatcgttatgagaagcttatggagcacatcaaattgttttccacccgccttaatatccccaagcttattcgtgcttgtgatgagcagcagcactggaaggaactcacctatttgtatatccagtatgatgagtttgataatgcagcaactaccattatgaaccattctcccgaagcatgggatcacatgcagttcaaagacgttgctgtcaaagttgctaatgttgagctatattataaggccgttcacttctacttgcaagaacatcctgaccttatcaacgatctacttaatgtgcttgcacttcgtgtggaccatacacgtgttgttgacattatgcgaaaggctggtcaccttctccttgtgaagccctacatggttgcagttcagagcaacaatgtttctgctgtgaacgaggctttgaatgagatttacgttgaggaggaggactacgagagattgcgtgaatctattgatatgcatgataactttgatcagattggccttgccagaagattgagaaacatgagcttttggaaatgagacgagtcgctgcatatatttacaaaaaggctggcagatggaagcaatctattgcactgtcaaagaaagacaaggtttacaaagatgcgatggagactgcctcacaatctggtgatcgtgaacttgcagaggagttgctggtttatttcatagaacaggggaagaaggaatgctttgcgtcatgcctgttcgtttgttatgatttgatcagacctgatgttgctcttgaactttcttggatgaacaacatgatcgactttgccttcccatatctcttgcagtttatccgtgaatacacaggcaaagttgatgaacttgtgaaggacaaaattgaggctcaaattgaagtcaagtctaaagagaaagaagaaaaggatgtaattgcacaacagaatatgtatgctcaattgctgcctcttgctttgcctgcgccacctatgcctggtatgggaggtggttttgcttcaacagcaccacctatgggtggaatgggaatgcctccgatgcctcctttcggcatgcctccaatgggtagctactgattttgttgatcagatcgggaaataggtgtagttgcttgttggttggagcacaagaacttagcagttgtttcaggcttgcttttgcgtggtgttcctcaggattcgtcgcctcccattgtttttttggtgttccttttgtctcatggtgaaagtctaatcagaaataacatggcatttttttgtactagttgtgtggatatgtgttgtagtatttttttttcccgggtagcagaggcattttttggctgctggtacagagcacgccgagagtttcctgctttgtactatttttcttgtggtccaaaattgaccaggattatcattaccaaacacttctacagatttaagttccaattacaatatgttctgtattatcattttcattcttaatttcctttattttca

SEQ ID NO: 5249 - DNA, 5104 bp, Brassica rapa
atggcggtagcaaacgcccccatcacgctgaaggaggtcctgacgcttcctagcgttgggataaatcagcaattcatcacgtttacaaatgttactatggaatctgacaagtatatatgcgtgcgagagacgtcaccacaaaacagtgttgtgattattgatatgaatatgcccatgcagcctcttaggaggcctatcactgcagattctgctcttatgaacccaaactcaagaatccttgcattaaaagctcaagttccaggaactactcaggattatctacagatgtttaacattgaagcaaaagcaaagctgaaatcacatcagatgcctgaccaggttgagttttggaagtggattacacccaagatgttggggctggtcacacaatactcagtgtatcactggtccattgaaggtgattctgagccagttaagatgtttgatagagcgaccaagctggaaaacaatcaaattattaactacaagtgctctcctaatgagaagtggttggtgttaattggaatcactcctggtcctcctgagagaccacaattggtaaaaggaaacatgcagctattttctgtggatcaacagcagacccagtcccttgacgcacacgctgcatcatttgctcagtttaaggtccctgggaatgagaatccttctacccttatatcctttgcaaccaagagctttaatgctgggcagataacatcaaatgtgcatgtcattgagcttggtgccctacccggaaaggcatcatttgcaaaaaagaaggcagatctctcttttctcccagattttgctgatgattttcctgttgccatgcagatctctaacaagtttagcttgatatatgtcatcaccaagcttggcttgttgtttgtatacgatctagagactgcttctcctatctacagaaaccggataagtacagacccaattttcttgacttctgaagcctcttctgttgggggtttctatgccattaataggcgtggacaagttcttttggctactgttaacgaggctactataataccttttattagtggtccattgaagaatttggagcttgctgtcaatcttgctaaaagaggaaacctccctggtgcagatgatctggttgtaaagcgtttcaaagagctgttcgatcaaacaaagtacaaagaggctgctgagcttgctgctgaatctcctcaggggattctaaggacacctgatacagtgtccaagttccagagtgttcctgtacaagctgggcaaactcctccattgttacagtattttgggacgcttttaactaaaggaaagctcaactcatatgagtcattagaactgtctcgccttgttgtgaatcaaaacaagaagaacctcctgaaaaattggttagaatatatatatattatactgttaagtgtgtgatatgtctcattttactttggataatgaccttgctctggaaatatacatcaaagcccagacctctccaaaagttgtagtagcacttgttgaaaaaagggagtttgacaacatactaatttactcagagaaggttaagtacacacctgattacctgtttcttctgcaaaccatactccgtacagatcctcagggagcaggagaatttgcagtaaagatgtctcaaatgaaaggaggttgtccacttgacatcaacaccatcactgacctttttcttcagagaaatttagtcagagaagctactgctttccttttggatgtgctgaagccaaatttacctgaacatgcttttctgcagactaaggttctggagatcaatttggtaaccttccctaacgtggctgaggccattttagctgggagtatgttcagccactatgacaggcctcgtgttgctcagctttgtgaaaaggctggactttatatccaatccttaaagcattactcagacttaaatgatataaaacgtgtgattgtcaacacgcatgctattgagccacaggctcttgttgattttctaggcactctttctagcgattgggctatggagtgcatgaaggaacttttgatagttaacccgagaggcaacctacagataatcgttcaggcttgcaaggagtactgtgagcaacttggtgttgatgcatgtattaaactctttgagcagtttaaatcatatgaagggctatactttttcctaggctcatatgttagaatgagtgaggatcctgaggttcatttcaagtacattgaagcatctgcaaagactggtcaactaaaagaggttgagcgtgtgactagagagtctaacttctacgatgctgaaaagactaagaactttttaatggaagctaagcttcctgatgcaaggcctttgataaatgtctgtgaccgtttcggctttgtacctgatcttactcattacctttacataaacaacatgctgcgttacattgaaggttacgttcaaaaggtgaaccctgggagtgctcccttagttgtgggacagttacttgatgatgagtgccctgaagattttatcaaaggtcttatcatctctgtgcgttcattgctgcctgttgaaactcttgtggaggaatgcgagaagaggaaccggctacgtctcctcacacagttcttggagcatctagtaaccgagggaagccaagatgtgcatgtccataacgccttgggtaaaatcatcatcgacagtaacaacaaccctgagcgtttcctaaccaccaacacctactacgactctcgagttgtcggtaagtactgcgagaaacgtgatcctacgctggctgttgtgtcctacagaagaggacaatgtgatgaggagctaatcaacgtcaccaacaaaaactctttattcaagttacaagcgaggtatgtagtggagaggatggatggtgatctctgggagatggttcttgatgaaaacaatgagtacagaagacaagttattgaccaagttgtgtccactgcattacctgaaagcaagagcccagagcaagtttcatctgccgttaaagcctttatgactgctgatttgcctcatgagcttattgagcttcttgagaagattgtgcttcagaactctgacttcagtgggaacgtcaaccttcagaatcttctgatactgacagctgtcaaggcggattcatctagagttatggattatgttaacaggctggagaactttgatggacctgtcgttggagaaatggcggtagaagctcaactctttgaggaagcgtttgctattttcaagaagtttaacttaaacgttgaggctgtcaacgtgttgctggataacgttaaaagcattgagcgtgctgctgagtttgctttgagggttgaagaagattctgtgtggagccaagttgcaaaggctcagctcagggaaggactagtcagtgaggcaattgagtccttcatccgtgctgaggacgcaactcatttcttggaggtgatacgcgttgctgaggatgctaatgtctatgatgacatggtcagttaccttctgatggttagaaacaaggtgaaggaagttaaagttgatagtgagctcctctacgcatatgcaaagatcggtaggttaggcgaggttgaagacttcattctgatgccaaacgttgctaacttacaaaacgttggtgaccgcatgtatgatgaagctatgtatgaagctgctaaaatagtctatgcgtttgtatcaaactgggggaagctagctgtcacgcttgtgaaattgcaacagttccaaggtgctgttgatgctgcaaggaaagcaagcaatgcaaagacatggaaggaagtgtgttttgcttgtgttgatgcagaggagttcagattggctcagatctgtggtcttaacattatcattcaggtggatgacctggaagaagtcagcgagttctaccaaaacaaaggcttcttcaatgaactaatctcactcatggagagtggacttgggctggaacgtgctcacatgggtatcttcactgagttgggtgtgctctacgctagataccgttatgagaagcttatcgaacacatcaagctgttctccactcgcctcaacattcccaagcttatacgagcttgtgatgagcagcagcactggcaggagcttacctatctctacattcagtatgctgagtttgataacgctgcgaccaccgtcatgaaccactctcctgaagcgtgggagcacgtgcagtttaaagacattgttggcaaggttgcgaatgttgaggtgtactacaaggctgtgcacttttacttactggagcatccggatattatcaatgatcttctcaacgtgcttgctttgcggttggatcatacgcgtgttgttgatatcatgcggaaggctggtcacttgcgtcttatcaagccatacatggttgcagttcagagcaacaatgtcactgctgttaatgaagctttgaatgagatatacgtggaggaagaagactatgaaaggttgcgtgagtctattgatttacatgacagctttgaccagataggccttgctcagaagatagagaaacacgagcttgttgaaatgagacgcgtggctgcttatatctacaagaaagctggtaaatggaagcaatcaattgctttgtcaaagaaggataacttgtacaaagactgtatggaaactgcttcacaatctggcgaccatgaccttgcggaacagctactggtttacttcattgaacaggggaagaaggaaagctttgctacatgtctctttgtgtgttatgatttaatcagaccagacgttgctctagagcttgcatggatcaacaatataatagacttagcctttccttaccttctccaggtaatgcgagagtacacaggcaaagtggatgaaataatcaaggacaagctggaggcacaaaaagaagcgaaagccaaagagcaggaagagaaggaagtcatgtcccaacagaatatgtacgcacaattgttgccaaatgctttaccggcaccatcgatgctacttgctttaccggcaccaccgatgcaaatgggagggatgccaccgatgccaatgggagggatgccaccatttggaatgccaccaatgggtggctactaa

SEQ ID NO: 5250 - DNA, 5293 bp, Papaver somniferum
atgtgatccttctgcgaaataggtgttttgattggaattgcaccggttcacctgagaggcgcaactagtcaaggaacatgcagctttctctgtggaacagcaacgaagtcagtcgcttgaagcgcatgctgcatcttttgcttcacataagattccagggaatgaaaacccatctactctcatttgttttgccacgaagaccaccaatgctgggcaaattacgtcaaaattgcatgtgattgagcttggtgcccagccaggcaaaccagctttttcaaagaaacaagcagatcttttctttcctccagatttcgctgatgactttccggtgtcaatgcagatatcacacaagtacagcttgatctatgtgattacaaagcttgggcttttatttgtgtatgatctcgagacagctacagcagtttacagaaaccgaattagtccggatcctatatttttgacggcggaagcttcatctgtaggaggcttttatgctgtgaatcggcgtggacaagttctgcttgctactgttaatgaggcaactattgtgcctttcgtcagcggccagttaaacaatcttgaacttgctgtaaatcttgccaaaaggggaaaccttcctggggcagaaaacttggttgtccagcgcttccaagaattgttctctcagacaaaatacaaggaggctgcagagcttgctgcagaatccccacagggcatcctgcgtactccagacactgttgccaagtttcagagtgttcctgttcaagctgggcaaactcccccacttctgcagtactttgggacattgttaaccagaggaaagctcaatgcatttgaatcactggagttatcgcgacttgttgtgaatcagaacaaaaagaatcttttggagaattggttggctgaggataaacttgaatgcagtgaggaacttggagaccttgtgaagactgtggataatgaccttgcactgaaaatatacatcaaggctagagctactcctaaagttgttgcggcctttgctgaacgaagggaatttgataaaattctcatctactcgaagcaggttggatacacacctgattatctatttctcctgcaaacaattctgcgatcagacccccagggagctgtcaattttgctctgatgatgtcacaaatggaaggtggatgtccagttgattataacacaatcaccgatcttttcctacagcggaacttgattcgtgaggcaacagcttttctattggatgttctgaagccgaatttgccagagcatggttttctacaaacaaaggtcctggagatcaatctagttacttttccaaatgtagcagatgcgatcttggccaatggcatgttcagtcactacgaccgtcctcgcgttgctcagctttgtgaaaaagctggactgtatgtccgtgctctccagcattatgccgagttgcctgacatcaaacgagttattgtgaatacacatgcgattgagccacagtcacttgtagagttctttgggactctttctaaggagtgggctctggagtgcatgaaggaccttttacttgttaatttgagaggaaatcttcagataattgttcagactgccaaggaatattcagagcagttgggtgttgaggcgtgcattaagctctttgagcaatttaagtcttacgaaggtttatacttcttcttggggtcgtacttgagttccagcgaggatcccgaaattcactttaagtacattgaagctgctgctaagactggacaaattaaggaggttgaacgtgtgacacgagaatcaaacttctatgatgctgagaagaccaaaaatttccttatggaggccaaacttccacgatgcgcgtccattaattaatgtctgtgatcgttttggtttcgttactgtacctcacccactacctctacactaacaacatgctgcgatacatcgagggttatgtacaaaaggtcaatccagggaatgctcctctagttgtagggcagcttttggatgatgaatgcccagaagatttcatcaaaggacttattctttctgttcgttcacttctcccagtggagccccttgtagatgaatgtgagaagaggaatcgtcttcgtttactgacccaattcctggagcatcttgtaagtgaagggagtcaagatgtgcatgttcataatgccctgggtaaaattatcattgatagcaacaacaatcctgaacatttcctcaccaccaatccatactatgattcacgcgtagttggtaaatattgtgaaaaaagggacccaaccttggcagttgttgcttaccgtagaggacagtgtgacagtgaacttatcaatgtcacaaacaagaattccttgttcaaattgcaagccaggtatgtggtggagaggatggattcagacctctgggatttggttcttaaccctgaaaatgagtatagaagacagctaattgatcaagtagtttccactgccttgcctgaaagcaagagcccagagcaagtttctgcggcagtcaaagctttcatgacagctgatcttccacacgagctaattgagctgcttgaaaaaatcgtacttcaaaactctgctttcagtggaaactttaatctgcaaaatcttttgattctgacagccattaaagcagatgcgtctagagttatggattacatcaataggctggacaatttcgatggacctgctgttggggaggtggctgtggaagctcaactgtttgaagaagcatttgccattttcaagaagttcaacttgaatgtccaggctgtgaacgttcttttggataatattcaaagcattgaacgagctgaggagtttgcattccgtgttgaagaagatgctgtttggagtcaggtggccaaggcccagctcagggagggtttagtgagcgaggctattgagtcattcatccgtgctgatgatgccactcatttcttagatgttattaaggcttccgaggatgcaaatgtgtatcatgatctagtgaagtacctcttgatggttagacaaaagtccaaggagcctaaggtggacagtgagcttatttatgcatatgctaagattgataggttgggtgatattgaagagtttattctaatgccgaatgttgctaatctccaaagtgttggtgatcggttatatgatgaagaactctatgaggctgccaagatcatatttgctttcatttccaactgggccaagctggcagtttgtcttgttaagcttagacagttccaaggtgctgttgatgcagctcgtaaggccaacagtgcaaagacatggaaggaaatttgctttgcctgtgttgatgccgaggaattccgtttggctcagatatgtgggctcaacatcatcatacaggtggatgacttggaggaggtcagtcaattctatcagaacagaggctgcttcaacgaattaatttctctaatggagagcggtctaggtttggagcgtgcacatatgggtatctttaccgagttaggagtcctatatgccaggtatcgtccagagaagctcatggaacatatcaagctgttctcaacccgtctcaatattcccaagcttattagagcatgcgatgagcaacaacactggaaggaattagtatatttatacatacagtatgatgaattcgacaatgctgcaaccaccatcatgaatcattctccagaagcatgggatcacatgcaatttaaagatgtggcagttaaagttgcaaatgtggaactatactacaaggcggtccacttttacttgcaagaacaccctgatcttattaatgatatgctcaatgtgctcgctcttcgtgtggaccatactcgtgttgtagacataatgcgcaaggctggtcacctgctccttgtgaaaccatacatggttgccgttcagagcaacaatgtctctgctgtgaacgaggcgttgaatcaaatctacgtcgaggaagaagactatgataggctgcgcgaatcaattgacatgcatgataattttgatcagataggccttgcacaaaaggttgagaaacacgagcttcttgaaatgagaagaatagctgcctatatttacaagaaagcaggtaggtggaggcagtccattgcattgtcaaagaaggacaacctttacaaagatgccatggagacatgttctcaatctggtgatcgtgagctttcagaggagttgctcgtgtatttcattgagcagggtaaaaaggagtgctttgcatcatgcctctttgtttgttatgatttaatccggcctgatgttgcccttgagcttgcctggatgaacaatatgatcgattttgccttcccgtatctattgcaatttatccgtgagtacactggtaaagttgatgagctggttaaggatagaattgcggcccaaagtgaagttaaggtcaaagagcaggaggagaaagatatggtagcacaacagaacatgtatgctcaattgctaccacttgcattgcctgcaccaccaatgcccggcatgggaggtggcgggggaatgggaggaggttatggtcctccaccccccatgggaggtatgggaatgcctccgatgccagcctatggaatgcccccgatgggttaccagtgatccaacttaaagcaagaaaattgtattgaacagtggtcatttgtaagcaccagcagacagagcatcggagaagtctgtggcatcaggttgatgggatgaatgatgtgtaattctaatttaggggatgtgaagggagtcagagaaataagatataatgatccatattctttgttttttatccggcatatagatgttattagtttgtaaaagatattcttttggtagcagagaaagggggcatatgtattttcttttcttacctctattggaaggctgagctgactgtcttatcatctcttagtttattgtatttcgagaatcatcgagagttctgatgctagcaaaagaaggaaggaaaagatcgtggagtggtggtgtacttgtgttgtatcatctcttaacttcacagatgattgtggtttatcggctgaagctgcttcgtgtataggtggtttaatccttcttgttgagcagcaggacttggctctccagtattttgtactttttagatgtgtatgtgattgtttttattctgttggttgtgtttttttcgtgttcattctcacatgtcataaaaacttagattactcttcggaatattattaatgaatccagtctgcggatggaaccacgagtcatttcccctttggaagtgttccgcccc

SEQ ID NO: 5251 - DNA, 5528 bp, Vinca minor
tcagactctcacaccggtcggaattgcccgatttattcacctgttttcagataccagttttttgattctcgaagtccttcgatcttgccgccatggcggccgctaacgctccgatcaccatgaaagaggctctcacgttgactagcatagggatcaatccgcagtttatcacctttacaaatgttaccatggaatccgataagtatatatgtgtgcgtgagacatcaccacaaaatagcgttgtaattattgacatgagtatgccaatgcaacctctgaggaggccgatcactgcggattctgctcttatgaaccccaacaccagaatcttagctttgaaagcccaacttcctggaactactcaagatcacttgcaaatatttaacattgaggcaaaggctaaaatgaagtcacatcaaatgcctgagcaggttgtcttttggaagtggattaccccaaaaatgttgggattagtcacacagacctctgtgtatcattggactattgaaggtgaatctgaacctttaaaaatgtttgatagaacggctaatttggcaaacaaccaaataatcaattataggtgtgatccatctgaaaaatggttggtttggttggaattgcacctggttctcccgagagacctcaactggtgaaaggaagtatgcaactatattctgtggaacagcagcgtagccaagcccttgaagctcatgctgcatcatttgcttccttcagagtaccaggaaatgataaggattctattcttatatcatttgcaacaaaatccacaaatgctgggcaggtcacctcaaaattgcatgttattgagcttggagcccagccaggaaagccatcttttacaaagaagcaagccgatcttttcttccctcctgattttgctgatgactttcctgtagcaatgcagatttctcacaagtatagtttgatatatgtgatcacgaagcttgggcttctctttgtatatgacctggatacagccactgcggtttatagaaataggatcagtccagatcctatatttttgacctcagaggcttcatctgtggggggcttctatgcaatcaacaggcgaggacaggtattgcttgcgacagtgaatgaagcgacaattgtgccatttgtcagtggccagttgaacaatctggagcttgcagtaaatctcgctaagagaggaaaccttcctggtgcagagaatttggttgtgcaacgcttccaagagttgtttgctcaaacaaaatataaggaagctgcggagcttgcagctgaatctccacaaggcattctacgaacgcctgacactgttgccaaatttcagagtgtacctgtccaagctggacaaacaccacctctcttgcagtactttggaacacttttaacccgaggaaagcttaatgcctttgagtcattggaattatcccgccttgtggtgaatcagaataagaaaaatcttttggagaactggttggctgaggataaactggaatgtagtgaggaacttggtgaccttgtgaagactgtggacaatgatcttgccctgaaaatatatataaaagcgagggcaactcctaaggttgttgcagcttttgctgagcggagggaatttgataaaattctgatatactccaagcaggttggctatacaccagattatttgtttcttctgcaaacaattctgcgttctgatcctcagggagctgttaattttgcccttatgatgtctcaaatggagggaggttgccccgtcgattacaacactgtaactgatctctttcttcagaggaacttgatacgtgaggccacagcatttttgttggatgttctgaagcccaatttaccagaacatgcgttccttcaaaccaaggtccttgaaatcaatctggtcacattccctaatgtggctgatgctattttagcaaatggaatgtttagccactatgaccgccctcgtattgctcaactgtgtgaaaaagccggtttatatatgcgagctcttcagcactactctgaactgccagatatcaagcgtgtcattgtgaacactcatgcaattgagccgcagtctcttgtagaatttttcggcactctttcacgagaatgggcattggaatgcatgaaggatctgctgctcgtcaacctaaggggcaaccttcagatcattgttcaagttgctaaagaatactgtgagcagatgggtgttgatgcttgtatcaagatttttgagcagttcaagtcctatgaaggattgtacttcttcttgggctcgtatctgagctcaagtgaggactctgatatacatttcaagtatattgaagccgccgcaaaaactggacaaattaaggaggttgagcgtgtgaccagggagtctaatttttatgatgctgaaaagactaagaacttcttgatggaagccaagcttccagatgctaggcctctgatcaatgtgtgtgatcggtttggttttgttccggatttgactcactacctgtacacgaacaacatgctccggtatattgaaggatatgtacagaaggtcaatccaggaaatgcccctttagttgttgggcagctgctagatgacgagtgccctgaagattttatcaaaggactcattctttccgtgcggtctctgcttccagttgagcctcttgtggacgagtgtgagaaaaggaatcgactccggttgctaactcaatttttggagcatctcgtgagtgaaggaagtcaagatgtacatgttcacaatgctttggggaagatcattatagacagtaataacaaccctgagcacttcctcactactaacccatattacgattcacgtgttgttggaaaatattgtgagaagcgtgatcctacccttgctgttgtggcctaccggagagggcaatgtgatgaggagcttatcaatgtaacaaataagaattctctatttaagctgcaggccaggtatgtagttgaaagaatggatggggatctctgggagaaggttctgaaccctgaaaatgagtccaggaggcagcttatagatcaagttgtatctactgctcttcctgagagcaagagccccgaacaagtttctgcagctgtcaaagcctttatgaccgctgatctccctcatgaacttattgagcttcttgaaaagattgtgcttcaaaactctgcattcagtggaaacttcaatttgcagaacttactgatactgactgctatcaaagcagatccctctagagttatggactatgttaatagactggataactttgatggacctgcagttggtgaagtggctgtggaagcccaattatatgaagaagcttttgcaattttcaagaagttcaatttaaatgtccaagctgtcaatgtcttattggataatattcgtgacatcaaccgtgcagtggagtttgcgttccgagttgaagaagacgctgtctggagtcaggttgctaaagctcaattaagggagggattggtaagtgatgcaatcgagtcctttatccgtgcagatgatgccactcaatttttagaggtcataaaagctgctgaggatgctgaagtgtaccatgacctggtgaagtacctgctaatggttaggcagaaaaacaaggaacctaaggttgatagtgagattatctatgcgtatgctaaaattgataggctgagtgacatcgaagaatttattctcatgccgaatgttgctaatcttcctaatgtgggtgaccgcttgtacgacgaggctttgtatgaggctgcaaaaattatttatgcctttatttctaactgggccaagttggctgttacgttagtcaagttgaagcaatttcaaggtgctgttgatgctgcaaggaaggcaaacagctcaaagacatggaaagaagtatgttttgcttgtgttgacgctgaggagttccgtttggctcagatttgtgggcttaacattattgtacaggtggatgacttggaagaagtcagtgaatactatcaaaataggggatgcttcaatgaactaatttctctcatggaaagcggattaggtttggagcgtgcacatatgggcatatttactgaattaggcgtgctttatgcaagataccgctatgagaagctcatggagcatatcaagttattttctacccgacttaacattcccaagctaatccgagcttgtgatgagcagcaacactggaaggaacttacatatttgtatattcaatacgatgagtttgacaatgctgccactaccgtcatgaatcattccccagatgcctgggatcatatgcagttcaaggatattattgtcaaagttgctaatgttgagctttactacaaggccgtacatttctatttgcaagagcatcctgatctcattaatgatgttctcaatgtcctcgcacttcgtgttgaccatactcgtgttgtggacataatgaggaaggctggtcatctacgtcttgtgaaaccatacatggttgcagttcagaacaacaatgtttctgctgtgaatgaggctctgaatgagatctatgttgaggaggaagactatgacagattacgggaatcaattgatttgcatgatagctttgatcaaattggccttgcacaaaagattgagaaacatgagctgcttgagatgaggcgtgtagctgcttatatttataagaaggcaggtaggtggaagcaatctattgctctgtcaaagaaagacaatctgtacaaagatgcaatggagacggcttcacagtctggggatcgtgaactggctgaggagctgcttgtttatttcatcgaacaaggaaagaaagaatgctttgcatcatgcctctttgtttgttatgatttaattcgtgccgatgttgctcttgagctggcttggatgaacaatatgatcgactttgccttcccttatctgttacagttcatccgtgaatacactggcaaagttgatgaattaatcaaggacaaacttgaagctatgaaagaagtgaaggccaaggagaatgaagagaaggacgtcattatgcagcagaatatgtatgctcaattgctgcctcttgctctgcccgcaccaccaggtatgggaggaggtttctctcaacctccacctcctcccatgggtggaatgggaatgccaccacaggggatgggaatgggaatgccaccaatgccgcaatatggcatgccaccaatggggtattaatcttggcaaatatacatatagaagtggatagtgcacatggttgtcccaggtggaagatgaaaaccggaccagttcgggctcttcatagttgatgtttctcggttcacctcaatctttatatcattttgtgcaagttgacgacgggtgtcagttcaggttttagagttaaaagaataattttctaagtgttgtttgtcataggatgtggatatctttctttgtaatattctttggtagcgaggcaatttttttgcagctggtaggtggcaagatggggatattttgtattttattatgataacacagtggt

SEQ ID NO: 5252 - DNA, 5301 bp, Brassica napus
ctgcaccgcagaacagcgttgtgattattgatatgaatatgcctatgcagcctctgaggaggcctatcactgcagattctgctcttatgaacccaaactctaggatccttgccttgaaagctcaagttccaggaactactcaggatcatctacagatatttaacatcgaagcgaaagcaaagttgaagtctcatcagatgcctgagcaggttgctttttggaaatggattacaccaaagatgttgggcctggtcacacaaacttctgtgtatcattggtcgattgaaggtgattctgagccagttaagatgtttgatagaacggccaatttggcaaacaatcaaattattaactacaagtgctctcctaatgagaagtggttggtgttgattggaattgctcctggctctcctgagagaccacagttggtaaaagggaatatgcagcttttctctgtggatcaacagcggagccaggcccttgaagcacatggtgcttcatttgcccagtttaaggtccctgggaatgagaatccttctattcttatatcctttgcaagcaaaagctttaatgctggacagataacatcaaaattgcatgtcattgagcttggtgcccaaccaggaaaaccatcatttacaaagaagcaggcagatctctttttccccccagattttgctgatgattttcctgtagccatgcaggtctctcacaaatttaacttgatatatgtcatcaccaagcttggcctgttgtttgtatacgatttggagacggcttctgctatctacagaaataggataagtccagacccaattttcttaacttccgaagcttcctcagttggggggttctatgccattaataggcgaggacaagttcttttggctacagtgaacgaggctacgataatacctttcattagcggtcaattgaataatttggaacttgctgtcaatctggctaaaagaggaaatctccctggtgcagaaaacctggttgtccaacggttccaagagttatttgctcaaacaaagtacaaggaggctgctgagcttgctgctgaatctcctcaggggattctacggacacctgatacggtggctaaattccagagtgttcctgtacaagcagggcaaactcctccattgttacagtattttgggacccttttgactagagggaagctcaattcatatgagtctttagaactatctcggcttgttgtgaatcaaaacaagaagaacctcttggaaaactggttggcagaggataagttagaatgcagtgaagaacttggagaccttgtcaagactgtggataatgaccttgctctgaaaatatatatcaaagctcgagctactccaaaagttgttgctgcttttgcagagcgaagggagtttgacaaaatactgatttactcaaagcaggttggatacacacctgattacatgtttcttctgcaaaccatactccgttcggatccccagggggcagtaaattttgctttaatgatgtcgcaaatggaagggggttgtccagttgactacaacaccatcactgatcttttccttcagagaaatctgatccgtgaagcaactgctttccttctcgatgttctgaagccaaatttacctgagcatgcttttctgcaaactaaggttctggagatcaatttggtaacctttccaaatgtggctgatgcaattttagcaaatgggatgttcagccactatgaccgccctcgtgttgctcagctttgtgaaaaggctggactttatatccaatctttaaagcattactcagagttacctgatataaaacgtgtgattgtgaacacacatgctattgagccacaggctcttgttgagtttttcggtactctttccagcgaatgggctatggagtgcatgaaggatcttctgctggtcaacctgagaggcaaccttcagataatcgttcaggcttgcaaggagtattgtgagcaacttggtgtcgatcaatgcattaaactctttgagcagttcaagtcgtacgaagggctatactttttcctaggttcatatttgagtatgagtgaggatcctgagattcacttcaagtacattgaagcagctgcgaagactggtcagataaaagaggttgagcgtgtgactagagagtctaacttttatgatgctgaaaagacgaagaactttttgatggaagctaagcttcctgatgcccgacctttgataaatgtctgcgaccgtttcggctttgtgcctgatcttactcattacctgtacacaaacaacatgcttcgttacattgaaggttacgttcagaaggtgaatcctgggaatgctcccttagttgtggggcagttgcttgatgacgaatgccctgaagattttataaaaggcctcattctttctgttcgttctttgcttcctgttgaacccctcgttgaggaatgcgagaagagaaatcgactccgtctcctcactcagttcttggagcatctagttagtgagggaagccaagatgtgcatgttcataatgctttgggtaaaattatcatagacagtaacaacaaccctgaacatttcctgaccaccaacccttactacgactccaaggttgtgggtaagtactgtgagaaacgtgatcctaccctggctgttgtggcatacagaaggggacaatgtgatgaggaactcatcaatgtcaccaacaagaactctttgttcaagttacaagccaggtatgtagtggagaggatggatggtgacctttgggataaggttcttgtggaagaaaacgaatatagaagacaacttattgaccaagttgtgtctactgctttacccgaaagcaagagcccggagcaagtttctgcagctgttaaagcattcatgactgctgatctgccgcatgagcttatcgagcttcttgaaaagattgtgcttcaaaattctgcctttagtggaaacttcaatctgcaaaatctgttaatattgacagctatcaaggcggatccgtctagagttatggattacatcaacaggctagataattttgatggtccggctgttggagaagtggcggttgatgcccaattgtatgaggaagcatttgccattttcaagaagtttaacctaaatgtccaggctgtcaacgtattgttggatcacgtcggaagcattgagcgtgccgttgagtttgctttccgggtcgaagaagattctgtttggactcaagtcgccaaggctcaactcagggatggactagtcagtgacgcaatcgagtccttcatccgagctgatgatgccactcatttcctggaggtcatccgcgcctgtgaagatactgatgtttatgatgacttggtccgataccttcttatggttagacagaaggtgaaggaacccaaggttgatagtgagctcatctatgcttatgcaaagatcgaaaggttgggtgagatcgaagaatttattctgatgccgaacgttgctaacctaccaaatgtgggtgatcgcctgtatgacgaagctctgtacgaggctgcaaaaatcatttatgcgttcacatcgaactgggccaagttagccgtcacacttgtgaagttgcagcagttccaaagtgctgttgatgctgcaaggaaagcaaacagtgcaaaaacatggaaggaagtttgcttcgcttgtgttgatgctgaagaattccgcctggctcaaatatgtggacttaacgttatcatacaggtggacgacctggaagaagtcagcgagtactaccagaacagaggatgcttcagtgaattaatctcactgatggagagtggacttggtctggaacgggctcacatgggaatcttcaccgagttgggtgtactgtacgccagatatcgttacgagaagcttatggaacacatcaagttgttctcgactcgcctcaatattcccaagcttatacgggcctgtgatgagcaacagcattggcaagaacttacctatctttacattcaatacgatgagtttgataacgctgcaaccactgtcatgaaccattctcctgaagcatgggagcacatgcaattcaaagacattgtcgccaaggttgcgaatgtggagctttactacaaggccgttcacttctacttgcaagagcaccctgatataatcaacgatcttctcaatgtgcttgctctgcggttagaccacacacgtgtcgttgatattatgcgcaaggctggtcagttgcgacttattaagccctacatggttgcagttcagagcaacaatgtgtctgctgtaaatgaagctctgaatgagatatacgtagaagaagaagactatgacaggttgcgcgagtctactgatttgcatgacagttttgaccagataggcctcgctcagaagattgagaaacacgagcttgtggaaatgagacgtgtggctgcgtatatctacaagaaggctggtagatggaagcaatcaattgctttgtcgaagaaagataacatgtacaaggactgtatggaaactgcttcacaatccggcgaccacgaccttgccgaacaacttctagtatacttcattgaacagggaaaaaggaatgctttgctacatgtctctttgtgtgttatgacttaatccggccagatgttgctctagaacttgcttggatcaacaacatgattgactttgccttcccgtatctcctccagtttatccgagaatactctggcaaagtggatgaactgatcaaggacaagctagaggctcagaaagaagtgaaggccaaagagcaggaagagaaggatgtcatgtcccaacagaacatgtacgctcaattattgccactggctctacctgcaccaccgatgccgggaatgggaggaggtccagggatgggaggcggttatggtccgccaccaccaatgggaggaatgccgggaatgcctccgatgccaccgtatggaatgccaccgatgggcggctactaagactatcagaaacaaaagctaaacgttcaagtaatcagttgcgcaatctctaccacggtggtattcgtcagaatgtttccttctttgtttgattttataggtatgtgtggataataatctcgtacttttgtttgtattattctttggggggggagtcgtagatgagtcatttttggttaaaaaacattttactacatttctttggaggggagagaggtgactcctatagtctttatcattttactttgaccttctcgcatgttggttgttctttctttcagcttattatttccacttataaattcctg

SEQ ID NO: 5253 - DNA, 5455 bp, Manihot esculenta
ccatggcggccgctaacgcaccgatcgctatgaaggaagtcttaactttgccaagcattgggatcaatccccagttcatcacttttactaatgtcacaatggaatcggacaagtatatatgtgtaagagaaacggctccacagaatagtgttgtgattgtggatatgaatatgccaatgcagccattgaggcggcctattactgcagactcggcacttatgaatccgaattctagaattcttgccttgaaagcccaactcccaggaactactcaggaccacctacagatatttaacattgaaatgaaagcaaaaataaagtcacaccagatgcctgagcaggttgtcttttggaagtggataactgcaaagatgttaggcttggtcacacagacatcagtttaccattggtcaattgaaggcaagattccttttgtgaatctgaacctgtcaagatgtttgacagaacagctaatttggtgaacaatcagataattaactacagatgtgacccttcagagaaatggttggttctgattggtattgctcctggttcacctgagagacaacaactggttaaagggaacatgcaactttactctgtggatcagcagcgtagtcaagctcttgaagctcatgctgctgcatttgcccaatttaaggttcctggaaatgagaatccttccattctcatttcttttgccacaaaatcttttaatgctgggcagattacatcaaagttgcatgtcattgagcttggtgctcaaccagggaagccatcatttacaaagaaacaggctgatctcttctttcctccagactttgctgatgactttcctgttgcaatgcagatatcccacaaatacagtttgatttatgtgatcaccaagcttggactgttatttgtttatgacttggatacagcttctgctgtatacagaaatagaatcagtccagatccaatatttttgactgctgaagcttcatcagttggaggtttttatgccattaataggcggggccaggtgttgctagctactgtgaatgaagcaacaattgtgccatttgttagcagccaattgaataatttggagcttgctgtaaatcttgccaaaagaggaaacctccctggtgcagagaatttggttgtccagcgtttccaggagctgtttgctcaaacaaagtataaagaggcagctgagcttgctgcagagtccccacaaggacttcttcgaacacctgacacagttgccaagtttcagagtgttcctgtgcaagctgggcaaacacctcctttactgcagtactttgggacacttctaactagaggaaagcttaatgcatttgaatcattggaattatcacgccttgttgtcaatcaaaacaagaagaatcttttagagaattggttggcagaggacaagctggagtgcagtgaggaacttggagaccttgtgaagactgtggacaatgacctcgcactaaaaatatatatcaaagctagagctactccaaaggttgttgcggcttttgctgaaaggagggagtttgacaaaattttgatttactcaaagcaggttgggtatactcctgattatttgttcctcctgcaaacgattctccgttcagatccgcagggagctgtaaattttgctttgatgatgtctcaaatggagggaggttgtcctgttgattacaataccatcactgatctgtttcttcagagaaacttgatacgtgaggcaactgcttttcttttggatgttctgaagccgaatttaccagaacatggttttctgcaaacaaaggtcctagaaatcaatttggtaacatttcccaatgtagctgatgctattctagctaatggaatgttcagccactatgatcgccctcgaattgctcaattatgtgaaaaagctggtctatacatcagagccctgcaacattatgcggagttgccagatattaaacgtgtcattgttaatacacatgcaatagagccacaggcacttgtagagttttttggtactctttcacgagaatgggctttggagtgcatgaaggatctgttactggtgaatctaagaggcaaccttcagataattgtgcagactgccaaggaatattgtgagcagttgggtattgatgcatgcataaaactttttgagcaattcaagtcctatgaagggctttactttttcctcgggtcatatttgagttcaagtgaggatcctgatatacacttcaagtacattgaggctgctgctaaaacgggacaaataaaggaggttgagcgtgttactagagaatcaaatttttatgatgctgaaaagacaaagaactttttgatggaggccaaacttcctgatgctaggccgctgattaatgtttgtgatcgttttggttttgtggctgatcttacacactacctctacactaacaatatgcttcgttacattgaaggttatgttcagaaggtgaaccctggtaatgcacctttagttgtgggacagttgctggatgatgagtgtcctgaggactttattaagggtctgattctttctgtgcgttctttgcttcctgttgagccccttgtggaggaatgtgagaagagaaaccgacttaggttgctcactcagttcttggagcatcttgtcagtgagggcagccaagatgtacatgtccacaatgctctgggtaaaatcattattgatagcaataacaatccagagcacttcctcacaaccaacccttactatgattcccgagttgttggcaagtactgtgagaaacgtgatcccacactggctgttgtggcttaccgtaggggacaatgtgatgatgaactgataaatgtaacaaataagaactctttgttcaaattgcaagccagatatgtggttgaaaggatggatgctgatctctgggagaaggttcttaatcctgagaatgaatatagaaggcagctcattgatcaggttgtatcaactgctttgcctgaaagcaagagtcctgaacaagtttctgctgcagttaaggctttcatgactgctgatctaccccatgaactaattgagcttcttgaaaagattgtacttcaaaactctgccttcagtgggaatttcaatctgcagaatctacttatcttaactgccattaaggcggatccatctagagttatggattacattaacagattagacaattttgatggacctgctgttggcgaagtggctgtagaagcccaactgtacgaggaagcatttgcaattttcaagaagttcaacctaaatgttcaggctgtaaatgtcttattggacaatattcaaagcattgatcgtgcagtagaatttgcattccgtgttgaagaagatgcagtttggagccaggtggcaaaagctcaactcagagtggggctggtgagcgatgcaattgagtcatttattcgtgcagatgatgctactcaatttctggatgtcattcatgctgctgaggacgcaaatgtctatcatgacttggtgaggtacctcctgatggttaggcaaaagacaaaggagccaaaggtggacagtgagcttatttttgcatatgcaaagattgataggctaagtgacattgaggaatttattctcatgccaaatgtggctaatctccaaaatgtgggtgatcgtttgtttgatggagcactatatgaggctgcaaaaattatatttgcatttatatcaaactgggccaagttggcttgcacacttgtgaagctgaaacagttccaaggtgctgttgatgcagcacgaaaagccaacagtgcaaagacatggaaggaggtttgctttgcttgtgttgatgctgaggagttccgtttggctcagatctgtggtctgaacatcatcattcaggtggatgatttggaagaagttagtgaatattaccagaacagaggatactttaatgaattgatctctcttatggagagtggtctaggattagaacgtgcacatatgggcattttcactgagttgggagtattgtatgcaagatatcgtcctgagaagcttatggaacacattaaattgttctcaacccgcctcaatattcccaagctcatacgagcttgtgatgaacaacagcattggaaggaacttacctatttgtatatccagtatgatgaatttgataatgctgcaaccaccataatgaaccattcccctgaggcatgggatcatatgcaatttaaagatgtttctgtcaaggttgcaaatgtggagttatattataaggcggtccatttctacttgcaagagcacccggatcttatcaatgatcttctcaatgtgctggcactacgcgtggatcatacccgtgttgttgacattatgcggaaggctggtcaccttcttctagtgaagccatatatgattgctgttcagagcaataatgtttctgcggtgaatgaggctttgaatcaaatatatgtagaggaggaagactatgaaagattgcgtgaatcaattgatatgcatgacaattttgatcaaattggccttgcacagaagattgagaaacatgaactgcttgaaatgagacgtgttgctgcatacatctacaagaaggcaggaagatggaagcaatccattgcattgtcaaagaaagacaaccactacaaagatgctatggagacggcatcacaatctggagaacgcgaacttgcagaggagttgcttgtttatttcattgaacagggtaagaaagaatgttttgcatcatgccttttcgtttgttatgatttgatacgggcagatgttgctcttgagctggcctggatacataatatggttgactttgctttcccatacctgctgcagtttatccgggaatatgtaggcaaagttgatgaacttgttaaggacaaacttgaggctcagaaagaggtcaaggctaaagagcaagaagaaaaggacgttattgctcagcagaacatgtatgcccagttgcttcctcttgctttgcctgctcctccaatgccgggcatgggtggaccaactatgggtggaggcttttcagcaccaccaccaatggctggaatgggaatgcctccgatgccaccttttggcatgccgcctatgggtagctattaaacatgcaggtgacgttattgttgggtagaatttagcagtgaatccaagttgagttgcttatggaggacatgcaaatggggcttactctttggtggtagtttggtgccttcattcctttttgtgtgggatggatgaaggtctagttggaataatgccatttttttttaatgtttaggggtgtggatatgtattgtaatattctttttataggggaggcattttttggctgctctcagtgggctagccgaggatttcttgtatttgtattattattaaaaaaaattttatccttgcagcctacgaactggccgagcatagtac

SEQ ID NO: 5254 - DNA, 4792 bp, Avena sativa
ctcttcttcccaccagatttccaggatgattttccttgtagccatgcagatctctcaaaagtatggccttgtctatgtaattacgaagcttgggcttctgtttgtatatgacttggaaactgctgctgcagtttatagaaatagaatcagtccagatcccatattcttgactgcagagtcttcaactactggtggattttatgctattaacagaagagggcaggttttgcatgccacagttaatgatgcaaccgttgtgccttttgtcagtggtcaattaaacaaccttgaactagccgttaatcttgccaaaagagccaatctccctggggcagagaacttggttgttcaaagattccaggaactgtttgcacagacaaaatacaaggaagcagcagagctggctgcagaatctcctcagggtcttctgaggactcccgagaccgttgccaaattccagagtgttcctgttcaagctgggcaaacgcctccactcttgcagtactttggcacattgcttactcgagggaagctcaacgcatatgaatctctcgagttatctcgccttgttgtaaatcagaacaagaagaaccttttggaaaattggttggcagaagacaagttggagtgcagcgaagaacttggagatcttgttaagacggtagacaatgatcttgcgcttaaaatatacataaaggctagggcaacccctaaagtcgttgccgctttgctgagaggagggagtttgacaagatccttatatactcaaagcaggtcggatacactcctgactacctctttctcctccagaccatcttacgtacagatccacagggagctgtcaactttgctctcatgatgtcacaaatggagggtggttgtccactggattataataccataactgatctcttccttcagagaaatatgatacgcgaagcaacagcttttctgttggatgtactgaaaccaaatttggaagagcatgctttccttcaaaccaaggttttggagataaacttggtgacataccccaatgttgctgatgccattcttgctaatggtatgttcactcattacgatcggcctcgtattgctcagctgtgtgaaaaggctggtttgtacttgcgggccctccagcactatgcagagttacctgatatcaagcgtgttatcgtgaatacccatgctattgagccacaggcactcgttgagttcttcggaaccctttctaaagaatgggcattagaatgcatgaaggaccttctactggtcaaccttagaggaaatcttcaaattgttgtgcaggctgccaaagaatacgctgagcagcttggagttgacgcttgcataaaattatttgaacaatttaaatcatacgaaggcctctactttttcctgggatcctatttgagctcaagtgaggatccagatatccatttcaaatacatagaatcagctgcaaggactggacagattaaagaagttgagcgagtcaccagagagtctaatttttatgatgctgagaagacaaagaacttcttgatggaacaaaaactacctgatgcccgtccactcataaatgtttgcgaccgctttggttttgttccagatcttactcactatctctatacaaataatatgctccgatatatcgaaggctatgtacagaaagtcaaccctggaaatgctcctttggtagtggggcagctacttgatgatgagtgcccagaagatttcattaagggtttgattttgtctgttcgctctctccttcctgtcgagccactggttgatgaatgcgagaagaggaaccgtctacggttacttacacaattcctggagcacttagtgagcgagggtagccaagatgtacatgtccacaatgctcttggaaaaataatcattgacagcaacaacaatcctgagcatttccttactaccaacccgttctatgactcccgtgtggtgggtaaatactgtgagaagagggatcctacgcttgccgttgttgcttataggcgtggacagtgcgatgaagaacttatcaatgttaccaacaaaactcgttgttcaagctgcaagctaggtatgtggttgaaagaatggatggtgatctgtgggataaagttctacagcctgaaaatgaatatagaaggcagttcattgaccaagttgtttctaccgcattgccagaaagcaagagtcctgagcaagtttcagctgctgttaaggctttcatgacagctgacctcccccatgaactgatagagctacttgaaaagattgtccttcagaattctgcattcagtggaaactttaaccttcagaatcttctcatcttgacagccatcaaggcggattcatctagggtcatggactatgttaacagactagacaactttgacggtcctgccgtcggagaagtggctgttgaagcacaactctatgaggaggcttttgctatattcaagaagttcaacttgaatgtgcaggctgtcaatgttctgttggataacatccaaagcatagagagagcagaagagtttgcattccgtgttgaagaagatgctgtttggagccaggttgccaaggcccagttgcgtgaaggtctagttagcgaagcaatcgaatctttcattcgtgcagatgatgtgacacatttccttgatgtcatccgtgctgctgaggaagcaaatgtataccatgatttagttaagtacttgctgatggtgaggcaaaaggcaagggaacccaaagttgatggtgaactcatctttgcatatgctaagattgataggctcagtgacattgaagaatttatcctgatgccaaatgttgcgaatctccaaaacgttggtgaccgtttgtatgatgaagagctttacgaagctgcaaagatcatctatgccttcatctcaaactgggccaagctggctgtcaccctggtcaagttgaaacagttccaaggtgctgtagatgctgctcgcaaagctaacagcgctaaaacatggaaggaggtctgctttgcttgtgttgacgctgaggaattccgtctagcacaaatctgtggcctcaatattatcgttcaggttgatgacttggaggaagtaagcgaatactaccagaacagagggtgctttggtgagcttatttccctcatggagagtggtcttggacttgaacgggcacacatgggcatctttacagaattgggagttctctacgctagataccgccccgagaagctcatggaacacatcaaactcttctccacccgtctcaacattcctaagcttatccgtgcttgtgatgaacaacagcactggaaagagcttacatacctatacatacaatatgatgaatttgacaacgctgccaccactatcatgaaccattctccagatgcatgggaacatatgcaatttaaggatgtttgtgttaagattgcaaatgttgagatatattacaaggcagtgcacttttatttgcaagaacaccctgatctcatcaatgatcttctcaatgtgcttgcgcttcgtttggatcatacaagagttgttgatataatgcgcaaggctggccagttgcatcttgtgaaaccgtacatggttgcagttcagagtaacaatgtctctgccgtcaatgaggctttgaatgagctttatgttgaagaggaggactacgagaggctccgtgaatctgttgacatgcatgataactttgatcagatcggtcttgcccagaagctcgagaagcatgaattgcttgagatgaggaggattgctgcctacatttacaagaaggctggcaggtggaagcaatctattgccttgtcgaagaaagataacatgtacaaggattgcatggaaacatgctcacagtctggtgatcgtgagctctcagaagacttgcttgtttatttcattgaacagggaaagaaagaatgttttgcttcctgcctcttcatttgctacgacttgattcgtgcggatgttgctcttgagcttgcatggacgaacaacatgcttgactttgctttcccctatctgttacagttcatccgtgagtacacaagcaaggtagacgatttagtaaaggacaggattgaatcacagaaggaagaaaaggccaaggagagcgaagagaaggagctagttgctcagcagaacatgtacgcccaattgcttcctctcgccttgcctgctccgcctggtatgatgggcggtccacctccgatgggtggaatgggcatgcctccgatgggcggaatgggtatgccaccgatgggtcctggtccgatgccagcatacgggatgcctccgatgggaagctactgagttatcctctctcatgcttttgaagagtgtagatgatgtcaaacgtttcagttcacccagagagaaacatgagtaccgaccccaaggtatctttgaaagtgttagatctgcgttattggttgttccagttaatattctttccggtaccaggacaattttggagagcggaatctctagccgagtttgagttaattacaggtcgctatatatatattacgatcggataggataagcagcatgactatgattagactcagttgaggtgggaattgcaagactggtaccatttgtataggtgttgtgtgtaatgaaagtttgtagatctgcatgtacacttgccggtgttggtgtttccagccagccataaacacaagaaatactgtgtatgttacctgttacgctttacgatctcatgtccagtggtttgatttcttaaccaaaaaaaaaaaaaa

SEQ ID NO: 5255 - DNA, 4821 bp, Triticum aestivum
caccagattttcaggatgattttcctgtagccatgcagatctctcaaaagtatggacttgtctatgtaattacgaagcttggccttttgtttgtgtatgacttggaaactgccgcagcagtttatagaaatagaatcagtccagatcctatattcttgacagcagagtcttctacaactggtggattttatgccatcaacagaagagggcaggtcttacatgccacagttaatgatgcgactgttgtgccttttgtcagcggccaattaaataaccttgagctagctgtgaatcttgccagaagagctaaccttcctggggcggagaacttggttgtgcaaagatttcaggaactgttttcgcaaacaaaatacaaggaagcggcggagctcgctgcagaatcccctcagggtcttctgcgaacccctgagactgttgcaaaatttcagagtgttcctgttcaagctgggcaaacgcctccactgttgcagtactttggcacattgctaactcgagggaagctcaatgcttacgagtcccttgagttatctcgacttgttgtcaatcagaacaaaaagaaccttctagaaaattggttggcagaagacaagttggaatgcagtgaagagctaggagatcttgttaagacggtagacaatgaccttgcattgaaaatatacataaaggctagggcaacgcctaaagtcgttgctgcttttgccgaaaggagggagtttgacaagatccttatatattcaaagcaggttggatacactcccgattaccttttcctcctccagaccatcctacgtacagatccacagggagctgtaaattttgctctcatgatgtcacaaatggagggtggttgtccattagattataataccataaccgatctcttccttcagagaaatatgatacgagaggcaacagcttttctgctggatgttctgaaaccaaacttggaagaacatgcttttctgcaaaccaaggttttggagatcaacttggtgacttaccctaacgttgctgatgccatccttgctaacggtatgttcagtcattacgaccgcccacgcattgctcaactgtgtgaaaaggctggtttgtacttgcgagccctccagcactatgcagagttgcatgatatcaaacgtgtcattgtaaatacccacgccattgaaccacaggcactcgttgagttctttggaaccctttcaaaagaatgggcactagagtgcatgaaagaccttctactggtcaatctgagaggaaaccttcaaatagttgtgcaggccgccaaagaatactctgagcagctaggtgtcgatggttgcataaaactatttgagcaatttaaatcttacgagggcctgtacttcttcttgggatcctatttgagctccagtgaggatccagatatccacttcaagtacatagaatcagctgcaaggactggacaaatcaaagaagttgagcgtgtaaccagagagtctaatttctatgatgctgagaagacaaagaactttctgatggaagcaaaactacctgatgcccgcccactgattaatgtttgtgaccgctttggttttgttccagatctgactcactatctgtacacaaataacatgctcaggtatattgaaggctatgtacagaaggttaaccctgggaatgctccattggtagtggggcagctacttgatgatgaatgccctgaagatttcattaagggtttgattctatctgtccgctctctccttcctgttgagccactagtagacgagtgcgagaagaggaaccgcttacgtctgcttacacaattcttggagcacttagtgagcgagggtagccaagatgtgcatgtccataatgctcttgggaaaattatcatcgatagcaacaacaacccagagcatttccttactaccaatccattttatgactctcgtgtggttggtaaatactgtgaaaagcgggatcctacacttgccgttgttgcttacaggcgtggacaatgtgatgatgaacttattaacgtcactaacaaaaactcacttttcaagctgcaagctaggtatgtggttgaaagaatggatggtgatctttgggataaagttctactgcctgaaaatgaatacagaaggcagttcattgaccaagttgtttctaccgcactgcctgaaagcaagagccctgagcaagtttctgctgctgttaaggctttcatggaagctgacctcccgcatgagctgattgaacttcttgaaaagattgtcctccagaattctgcattcagtggaaactttaatcttcagaacctgctcatcttgacagccattaaggcagacccatccagggtcatggactatgttaacagactggacaactttgatggccctgctgtcggagaagtagctgtcgaggcacaactgtatgaggaggcttttgccatatttaagaagttcaacttaaatgttcaggctgtcgatgttctgttagataacatccaaagcatagaaagagctgaagagtttgcattccgtgttgaagaagatgctgtttggagccacgttgccaaggcccagttgcgtgaaggtctagtcagtgaagcaattgagtcattcatccgtgcagatgacgcaacacatttccttgatgtcatccgtgctgctgaggaagctgatgtataccatgatcttgtcaagtacttgctgatggtaaggcaaaaggcaagggagcccaaagtcgatggagaactcatctttgcatatgcgaagattgataggctcagcgacattgaagagtttattcttatgccaaatgttgctaatctccaaaatgttggtgaccggctttacgatgaagaactttatgaagctgcaaagatcatctatgccttcatctctaactgggctaagttggctgtcaccctggtcaagctgaagcagttccaaggagctgtagatgctgctcgcaaggctaacagcgctaaaacatggaaggaggtctgctttgcttgtgttgatgctgaggagttccgtctagcacaaatatgcggtctcaatatcatcattcaggttgatgacttggaagaagtgagtgaatactatcagaacagaggatgcttcaatgaacttatttctctcatggagagtggtcttggacttgagcgtgcgcacatgggcatctttacagaacttggagtcctttatgctagataccgccctgagaagctcatggaacacatcaagcttttctccacccggctgaatattcctaagcttatccgtgcttgtgatgaacaacaacactggaaagagcttacgtacctatacatccaatatgatgaatttgacaatgctgctaccactattatgaaccattctccagatgcatgggatcatatgcaatttaaggatgttgctgttaaggtcgcaaatgttgagatatattacaaggctgtgcacttctatttgcaagaacaccctgatctcatcaatgatcttctcaatgtgcttgcgcttcgcttggatcacacaagagttgtagacataatgcgcaaggctggtcagttgcatcttgtgaaaccatacatggttgctgttcagagcaacaatgtctctgctgtcaatgaagcattgaatgagctttatgttgaggaggaggactatgagaggctccgtgagtcggttgacatgcatgataactttgatcagataggtcttgcccagaagcttgagaaacatgaattgcttgagatgaggaggattgctgcctacatttacaagaaagctggcagatggaagcaatctattgccctatcgaagaaagacaacatgtacaaggattgcatggaaacatgctcacagtctggtgaccgtgagctgtcggaggatttacttgtctattttatcgagcagggaaagaaagaatgttttgcttcttgcctcttcatttgttacgacttgattcgtgcggatgttgctctcgagcttgcatggacaaacaacatgctggactttgctttcccctacctattacagttcatccgtgagtacacaagcaaggtagatgacctggtgaaggacaggattgaatcgcagaaagaagaaaaagccaaagagcaggaagagaaggacgtcgttgctcagcagaacatgtacgctcaattgctccctctcgccttgcctgctccgcctggtatggggggtccacctccgatgggcgggatgggtatgcctccaatgggcgggatgggtatgcctccgatgggtgggatgggtatgcctccgatgggtcctggtccgatgccggcatatgggatgcctccaatgggaaactactgagtcggcttttgaagaacatagatgatgtcgattgtttcagtctttttttacacagagggagcatgaggatcccaaaggtatctttcaagttgtagattgatttgggctattggttgtttcagttaatattcttttggtaccggggcaattttggcgagcaatatctctagccgaggtagagtaaatttactggttgctatatattatgatcgggtaggatgaggatgagattaggttccagctgaagaatgagaggtggaagactggtaccatttgtatagcttgtgtgataaaaagactagacattttgggtgtacactcctccgtgttggtgttgccacccgtgaacataaacactgcctgtatgttatatgttacactttgtgttcagaggtttgggttttgtacctggaagaatgcttttgttgaacgacacggtgtatttgtatttgtattttgttgatggtca

SEQ ID NO: 5256 - DNA, 4704 bp, Triticum aestivum
gatctctcaaaagtatggccttgtctatgtaattacgaagcttgggctgctgtttgtatatgacttggaaactgccgcggcagtttatagaaatagaatcagtccagaccccatattcttgactgcagagtcttcaacaaccggtggattctatgccattaacagaagagggcaggttttgcatgccacagttaacgatgcaactgttgttccttttgtcagtggtcaattaaacaaccttgaacttgccgtgaatcttgccaaaagagccaatctccctggggcggagaacttggttgtgcaaagattccaggaactgttcgcacagacaaaatataaggaagcagcagagttggctgcagaatccccgcagggtcttctacgaactcccgagactgttgccaaattccagagtgttcctgttcaagctggacaaacacctccactgttgcagtactttggcacattgcttactcgagggaagctcaatgcttacgaatctcttgagttatctcgacttgttgtcaatcagaacaagaagaaccttttggaaaattggttggcggaagacaagttggagtgcagtgaagagcttggagatcttgtaaagacggtagacaatgatcttgcgctaaaaatatacataaaggctagggcaaccccgaaagtcgttgccgcttttgctgagaggagggagtttgacaagatccttatatactcaaagcaggttggatacactccggactacctcttcctcctccagaccatcttacgtacggatccacagggagctgtcaactttgctctcatgatgtcacaaatggagggaggttgcccgctggattataataccataactgatctcttccttcagagaaatatgatacgagaagcaacagcttttctgttggatgttctaaaaccaaatttggaagagcatgcttttcttcaaaccaaggttttggagatcaacttggtaacttacccaaatgtcgccgatgccatccttgctaatggtatgttcagtcactacgatcgccctcgtattgctcagctgtgtgaaaaggctggcctgtacttgcgggctctccagcactatgcagagttacctgatatcaaacgtgttatcgtgaatacccatgctattgagccgcaggcactcgttgagttctttggaaccctttctaaagaatgggcactggaatgcatgaaggaccttctactggtcaacctgagaggaaatcttcaaattgttgtgcaggccgccaaggaatactgtgagcagcttggagttgacgcctgtattaaactgttcgaacaatttaaatcatacgaggggctctacttcttcctagggtcctatttgagctcaagtgaggatccagatatccatttcaaatatatagaatcagctgcaaggactggacagattaaagaagttgagcgagtcacaagagagtctaacttttacgacgctgagaagacaaagaactttctgatggaagcgaaactacctgatgcccgtccactcataaatgtctgcgatcgcttcggttttgttccagatcttactcactatctgtacacaaacaatatgctccggtacatcgaaggctatgtacagaaggtgaaccctggaaatgctccgttggtagtggggcagttacttgatgacgagtgcccggaagatttcattaagggtttgattttgtctgttcgatctcttcttcctgtcgagccactggttgatgaatgcgagaagaggaaccgtctacgtttactgacacaattcctggagcacttagtgagcgagggtagccaagatgtgcatgtccacaatgctcttgggaaaattatcattgacagcaacaacaatcctgagcatttccttactaccaacccgttctatgactcacgtgtggtgggtaaatactgtgaaaagagggatcctactcttgctgttgttgcgtacagacgtggacagtgtgatgaagaacttatcaatgttaccaacaaaaactcgctgttcaagctgcaagctaggtatgtggttgaaagaatggacggtgatctgtgggataaagttctacagcctgataacgaatatagaaggcagttcattgaccaagtggtttctactgcattgcccgaaagcaagagtcctgagcaagtttctgctgctgttaaggctttcatgacagctgacctccctcatgaactgattgaacttcttgagaagattgtccttcagaattccgcgttcagtggaaacttcaatcttcagaatctgctcatcttgacagccatcaaggcggactcatctagggtcatggactatgttaacagactagacaactttgatggtcctgccgtcggagaagtagcagttgaagcacaactttatgaggaggcttttgccatattcaagaagttcaacttaaatgtgcaggctgtcgatgttctgttggataacatccgaagcatagaaagggcggaagagtttgcattccgtgtcgaagaagatgctgtctggagccaggttgccaaggcccagttgcgtgaaggtctagtcagcgaagcaatcgagtccttcattcgtgcagatgatgtgacacatttccttgatgtcatccgcgctgcggaggaagccaatgtataccatgatttggtcaagtacttgttgatggtaaggcaaaaggcaagggagcccaaagtcgacagcgaactcatctttgcatatgctaagattgataggctcagtgacattgaagagtttattctgatgccgaatgttgccaatctccaaaatgttggcgaccgtctgtatgatgaagagctctatgaagctgcaaagatcatctatgccttcatctcaaactgggctaagctggctgtcactttggtcaagctaaagcagttccaaggtgctgtagatgctgctcgcaaggctaacagcgctaaaacatggaaggaggtctgctttgcttgtgttgacgccgaggagttccgtctagcacaaatctgtggtctcaacattatcgttcaggttgatgacttggaggaagtgagtgaatactaccagaacagaggatgtttcagtgaacttatttccctcatggagagtggtcttggacttgagcgggcacacatgggcatctttactgaattgggagttctctatgccagataccgccctgagaagctcatggaacacatcaaactcttctccacccgtctcaacattcctaagcttatccgtgcttgtgatgaacaacagcactggaaagagcttacatacctatacattcaatatgatgaatttgacaatgctgctaccactatcatgaaccattctccagatgcatgggatcacatgcaatttaaggatgtttgcgttaaagttgcaaatgttgagatttattacaaggcagtgcatttctatttgcaagagcaccctgatctcatcaatgatcttctcaatgtgcttgcacttcgtttggatcataccagagttgtagatataatgcgcaaggctggtcagttgcatcttgtgaaaccgtacatggttgcagttcagagcaacaatgtctctgctgtcaatgaagctttgaatgagctttatgtcgaagaggaggactacgagaggctccgtgaatctgttgacatgcatgataactttgatcagataggtcttgcccagaaacttgagaagcatgagttgcttgagatgagaaggattgctgcctacatttacaagaaggctggcagatggaagcaatctattgccctatcgaagaaagacaacatgtacaaggattgcatggagacatgctcacagtctggtgaccgtgagctgtcagaggacttgcttgtctatttcatcgaacagggaaagaaagaatgttttgcttcttgcctcttcatttgctacgacttgattcgtgcggatgttgctcttgagcttgcatggacgaataacatgctggatttcgcatttccctatctattacagttcatccgtgagtacacaaacaaggtagatgatttggtgaaggacaggatagaatcgcagaaggaagaaaaagctaaagagaacgaagagaaagaactagttgcgcagcagaacatgtacgctcaattgcttcctctggccttgcctgctccgcccggcatgatgggcggtccacctccgatgggcggaatgggcatgccgccgatgggcgggatgggtatgcctccgatgggtcctggtccaatgccagcatacgggatgcctccaatgggaagctactgagtcaaccaacctctgttgtatgaatttgaagagtacagatgatgtgaagtatttcagttgacgcagagggagggagacaatcatgaatatctatcccggagaggtatcctccaaggtgtatatctgcgtcattggttgttccagttgatattcttttggtaccaggacaattttggcaagcgaaatctctagccgagtttgagttaattacaggattgctatattatatatattatattacggtcggataggatgagcagcagcatgactggttaggcccctggtaccatttgtataggtgttatattgaaagtctgtagacattctgcatgtacactcgtcggtgttggtgttgctgccagccataaacacatcaaatactgtctgtatgttgttaattaccggtttcg

SEQ ID NO: 5257 - DNA, 5772 bp, Secale cereale
ccccatcgccatgcgtgaggccctcacgctgacgagcctggggatcgcgccacagttcgtcaccttcacccatgtcaccatggagtcggacaggtacatctgcgtccgggagacctcgccgcagaacagcgtcgttatcatcgacatggccatgcccagccagcccctccgcaggcctatcaccgccgattccgcgctcatgaaccccaacaccaggatcctcgcgctcaaagcccaaatagctggaacgacacaggatcacctgcagatcttcaatattgaagctaaaacaaaagtaaagtcgcaccagatgcctgagcaggttgtgttctggaaatggatcacccccaagttgttgggtttggtaacacagacatctgtttatcactggtcaattgaaggagattctgaacccaccaagatgtttgataggacagctaatctggccaataatcagattattaactaccgttgtgacccggcagagaagtggctcgtgcttattggaattgcacctggtgctcctgagaggccgcagttggtgaagggaaatatgcaacttttctctgttgatcagcagcgtagccaggcacttgaagcccatgcagcatcttttgcaactttaaggttcctggcaacgagaatccatcaacactcatctgttttgcctccaaggcaactaatgctggacagattacttctaagttacatgttattgaactgggggcccagccagggaaacctggtttttccaagaagcaagccgatctcttcttcccaccagactttcaggatgattttcctgtagccatgcagatctctcaaaagtatggacttgtctatgtaattacgaagcttggccttttgtttgtgtatgacttggaaactgccgcagcagtttatagaaatagaatcagtccagatcctatattcttgacagcagagtcttctacaactggtggattttatgccatcaacagaagagggcaggtcttacatgccacagttaatgatgcgactgttgtgccttttgtcagcggccaattaaataaccttgagctagctgtgaatcttgccaaaagagctaaccttcctggggcagagaacttggttgtgcaaagatttcaggaactattttcgcaaacaaaatacaaggaagcggcggagctcgctgcagaatcccctcagggtcttctgcgaacccctgagactgtcgcaaaatttcagagcgttcctgttcaagctgggcaaactcctccactgttgcagtacttcggcacattgctaactcgagggaagctcaatgcttatgagtcccttgagctatctcgacttgttgtcaatcagaacaaaaagaaccttctagaaaattggttggcagaagacaagttggaatgcagtgaagagctaggagatcttgttaagacggtagacaatgaccttgcattgaaaatatacataaaggctagggcaacgcctaaagtcgttgcggcttttgccgaaaggagggagtttgacaagatccttatatattcaaagcaggttggatacactcccgattaccttttcctcctccagaccatcctacgcacagaccctcagggagctgtaaatttcgctctcatgatgtcacaaatggagggtggttgtccattagattataatactataaccgatctcttccttcagagaaatatgatacgagaggcaacagcttttctgctggatgttctgaaaccaaacttggaagagcatgcttttctgcaaaccaaggttttggagatcaacttggtgacttaccctaatgttgctgatgccatccttgctaatggtatgttcagtcattacgaccgcccacgcattgcccaactgtgtgaaaaggctggtttgtacttgcgagccctccagcactatgcagagttgcctgatatcaaacgtgtcattgtaaatacccacgccattgaaccacaggcactcgttgagttctttggaaccctttcaaaagaatgggcactagagtgcatgaaagatcttctactggtcaatctgagaggaaaccttcaaatagttgtgcaggccgcaaaagaatactctgagcagctaggtgtcgatggttgcataaaactatttgagcaatttaaatcttatgagggcctgtactttttcctgggatcctatttgagctccagtgaggatccagatatccacttcaagtacatagaatcagctgcaaggactggacagatcaaagaagttgagcgtgtaaccagagagtctaatttctacgatgctgagaagacaaagaactttctgatggaagcaaaactacctgatgcgcgcccactgattaatgtttgcgaccgctttggttttgttccggatctgactcactatctgtacacaaataacatgctcaggtatattgaaggctatgtacagaaggttaaccctgggaatgctccattggtagtggggcagctacttgatgatgagtgccctgaagatttcattaagggtttgattctatctgtccgctctctccttcctgttgagccactagttgacgagtgcgagaagaggaaccgcttacgtctgcttacacaattcttggagcacttagtgagcgagggtagccaagatgtgcatgtccataatgctcttgggaaaattatcatcgatagcaacaacaacccagagcatttccttactaccaatccattttatgactctcgtgtggttggtaaatactgtgaaaagcgggatcctacacttgctgttgttgcttacaggcgtggacaatgtgatgatgaacttattagcgtcactaacaaaaactcacttttcaagctgcaagctaggtatgtggttgaaagaatggatggtgatctttgggataaagttctactgcctgaaaatgaatacagaaggcagttcattgaccaagttgtttctactgcactgcctgaaagcaagagccccgagcaagtttctgctgctgttaaggctttcatggaagctgacctcccgcatgagctgattgaacttcttgaaaagattgtcctccagaattctgcattcagtggaaacttcaatcttcagaacctgctcatcttgacagccattaaggcagacccatccagggtcatggactatgttaacagactggacaactttgatggccctgctgtcggagaagtagctgttgaagcacaactgtatgaggaggcttttgccatatttaagaagttcaacttaaatgttcaagctgttgatgttctgttagataacatccgaagcatagaaagagctgaagagtttgcattccgtgttgaagaagatgctgtttggagccaggttgccaaggcccagttgcgtgaaggcctagtcagtgaagcaattgagtcattcatccgtgcagatgacgcaacacatttccttgatgtcatccgtgctgctgaggaagctgatgtatatcatgatcttgtcaagtacttgctgatggtaaggcaaaaggcaagggagcccaaagtcgatggagaactcatctttgcatatgcaaagattgataggctcagcgacattgaagagtttattcttatgccaaatgttgctaatctccaaaatgttggtgaccggctttacgatgaagaactttatgaagccgcaaagatcatctatgccttcatctctaactgggctaagttggctgtcaccctggtcaagctgaaacagttccaaggagctgtagatgctgctcgcaaggctaacagcgctaaaacatggaaggaggtctgctttgcttgtgttgatgctgaggagttccgtctagcacaaatatgcggtctaaatatcatcattcaggttgatgacttggaagaagtgagtgaatactatcagaacagaggatgcttcaatgaacttatttctctcatggagagtggtcttggacttgagcgtgcgcacatgggcatctttacagaacttggagtcctttatgctagataccgccctgagaagctcatggaacacatcaagcttttctccacccggcttaatattcctaagcttattcgtgcttgtgatgaacaacaacactggaaagagcttacttacctatacatccaatatgatgaatttgacaatgctgctaccactattatgaaccattctccagatgcatgggatcatatgcaatttaaggatgttgctgttaaggttgcaaatgttgagatatattacaaggctgtgcacttctatttgcaagaacaccctgatctcatcaatgatcttctcaatgtgcttgcgcttcgcttggatcacacaagagttgtagatataatgcgcaaggctggtcagttgcatcttgtgaaaccatacatggttgctgttcagagcaacaatgtctctgctgtcaatgaagcactgaatgagctttatgttgaggaggaggactatgagaggctccgtgagtcagttgacatgcatgataactttgatcagataggtcttgcccagaagcttgagaaacatgaattgcttgagatgaggaggattgctgcttacatttacaagaaggctggcagatggaagcaatctattgccctatcgaagaaagacaacatgtacaaggattgcatggagacatgctcacagtctggtgaccgtgagctgtcggaggacttacttgtctattttatcgagcagggaaagaaagaatgtttcgcttcttgcctcttcatttgttacgatttgattcgtgcggatgttgctctcgagcttgcatggacaaacaacatgctggactttgctttcccctacctattacagttcatccgtgagtacacaagcaaggtagatgacctggtgaaggacaggattgaatcgcagaaagaagaaaaagccaaagagcaggaagagaaggacgtcgttgctcagcagaacatgtacgctcaattgctccctctcgccttgcctgctccgcctggtatggggggtccacctccgatgggtgggatgggtatgcctcctatgggcgggatgggtatgcctccgatgggtgggatgggtatgcctccgatgggtcctggtccgatgccggcatatgggatgcctccaatgggaaactactgagttggcttttgaagaacatagatgatgtcgattgtttcagtctttttttacacagagggagcatgaggatcccaaaggtatctttcaagttgtagattgatttgggttattggttgtttcagttaatattcttttggtaccagggcaattttggcgagcaatatctctagccgaggtagacttaatttactggttgctatatattatgatggggtaggatgaggatgagattaggttccagctgaagagtgagaggtggaagactggtaccatttgtatagcttgtgtgataaaaagactagatattttgggtgtacactcctccgtgttggtgttgccacccgtgaacataaacactgcctgtatgttatatgttacactttgtgttcagaggtttgggttttgtacctggaagaatgcttttgttgaacaaacacggtgtatttgtatctatatctgtatttgtattttgttaatggtcagtagttctcctgagcaaacttgtatcttttgctccattggacgtcggatgaaatatatatgacggtggcgatgatgtctcgtctcgtagtaagacttaaacgtaggaaacaaaaaaaaaactagaagactacgccgaacgaccgacaccaggggagtagg

SEQ ID NO: 5258 - DNA, 1961 bp, Zea mays
cggtctgatcggcttctcgggcaagcggtactcaggccgcttttttccaatcgttgcggacgggcagccagacgacggccacggcacgagaagcaggaagagaaggctagcccatcgatccaccggctacgcaactgagtctattaaactgacaccatggtcccacgcatctaatggtggtggctgattcatcaggatccgcattttgggcccacacgccagagagaggaggtctggtagtgcgagtaccacccacacgaacaccagttcactaatcactacctctccctctccgtcgcgacacaggccacggcgggcggcggcggaggcttccgtgcggctcttggcggattgaacgcccactcgagctgcgccggctgctgtttcagccgtccttagatagaccctgctttcctcccgggcaaatccaagttgcccaaatgccgacaccagtgaagtcggtgctgcccgtagtgctcctcggctgcggcggcgtcggccgctacctcctccgccacatcgtctcctgccgtcccctccacgccaaccagggcgtggccatccgggtggtgggcgtcgccgatagctcctccctgctcgtcgccgaagatgtccactccaccggcctcgatgacgcgctcctcacccagctctgcgccgccaagtccgcaggctctcccctctcctccctgctcggccgagggcactgtcagctgttcaagaaccctgaggctaggggcaaagtcatagacgccgctaccacactcggaagaacaactggtctggtgctagttgactgttctgcaacttatgacactgttagcctgctgaaagatgctgtggatcatggatgctgtgtcgtattggcaaacaagaaacctcttaccggtgcttatgaggattttcagaagttggtctccaacttccgtcggataagatttgaatctactgttggagcaggtttgcctgtgatagcttctgtaacccgtattattgcatctggagaccctattactcgtattgttggcagtttgagtggtacacttgggtatgtgatgagtgagcttgaggatggaaagaaatttagtgaagttgtaaaaactgccaagtcccttggctatacagaaccagatccacgtgatgatcttggtggaatggatgtggctagaaaggcattgatcctggctaggcttcttgggcaacagataagcatggagagtatcaatgttgagagtttatatcctagtgaattaggacctgatgcagtgtccacaaaggacttccttgaaagtggtttagtgcaacttgacaagagcatggaagaaagaatcagagcagcatcttcgagaggaaacgttcttcgctacgtctgtgagattgaaagcgcagggtgccaggtaggccttaaagagctcccaaaggattctgcgctgggtagattgaggggaagtgacaatgtggtcgagatatacagcagatgttaccagagctcccctctggtgatccagggcgcaggagctggcaacgacaccactgccgccggcgtccttgctgacataatcgatctccaagacctgttccagacgatggcttgatcgttgatcggcatccacaccagtacaccatcttgatttttgcaaggcaccagagcgtttgatactttgatcggtgccagtggaatccctccactgcccactggtgggcttcgctccttgtcatgtgtgcaatttgttcacgggcatgctctcaggctgagagcctgagacgtctgacattcgaaatgtaattttgagcaggcgtgtgggggatttctttacagtttacataaaggaactttgtttcagtgaaataatgtcgcggtctccacattaaactaataaacagtccgagctatattgccgctatctgatagtgaaataatgtcgctggcagcctgaaaccgtggccagtttgttgccaaa

SEQ ID NO: 5259 - DNA, 1691 bp, Setaria italica
ctgaagctgacacatgggtcccacgcttctagtggtggcgactgactcagcacggcccactcattgggtccacacgccagagagacgagctccgtgagtgcgagtacaccacacgagcacacggcggcggaggattcccggcggctcttggcggattcagcggccagtggaggtgcgccggccgcggcccatccagttcctagcccctgcccttaattccctcccgacgaatcgaagttgtggaaatgccggcgccggtgaagtcggtgctccccgttgtgctcctcggctgcggcggcgtgggccgctacctcctccgccacatcgtgtcctgccgtcccctccacgccaaccagggcgtggccatccgggtggttggcgtcgccgatagctcctccctgctcgtcgccgacgacgtccactccagcggcctcgatgatgcgctcctcacccagctctgcgccgccaaggccgccggctctcccctgtctgccctgctcggccaagggcactgtcagctgttccagaaccctgaggctaggagcaaagtcattgacgccgctaccatgcttggaagaacaactggcctggtactagttgactgttctgcaacctatgacactgttagtctgctgaaggatgccgtggaccatggatgctgcattgtattggcaaacaagaaacctcttaccggtgcttatgaggattttcaaaagttggtctccaacttccgtcggataagatttgaatctactgttggagcaggtttgcctgtgatagcttccgcaacccgtattattgcatctggagatccagtttcttgtatagttggcagtctaagcggtacacttgggtatgtgatgagtgagctggaggatggaaagaaatttagtgaagttgtgaaaaaagccaagtctcttggctatacagaaccagatccacgtgatgatcttggtggaatggatgtggctagaaaggcgttgatccttgctaggcttctggggcaacaaatcagcatggacaatatcaatgtcgagagtttatatcctagcgaattaggacctgatgcagtatccacagaggacttccttgaaagtggtttagtacaacttgacaagagcatggaagaaagagtgaaagcagcatcttcaagaggaaatgttcttcgctatgtctgtgagattggaagcacagggtgccaggtaggccttaaagaggtcccaaaagattcagcgctcggtagattgaggggaagtgacaatgtggtggagatatacagccgatgctacgagagctcccctctggtgatccaaggggcgggggctggcaacgacaccacagctgcaggcgttcttgctgatataatcgacctccaagacctgttcaggaagacggcatgattagtgtccacccccatcctgttagtaccagagcgtttgatagctgtacgtaatagccatccttgagtaatgagtggtggtgtcctctgtgggatgagagggttggtcgaggagttgaggtcgtatggacacttttgttcatccagctgctgcatactgttgcgagcaaattggcaaactgggacatgcgatgccgagtttttttttttccgagaaacaaatatttgtttgactgaaacaagatcccgttctgtagaagcaaccaggcatggtggtgctggtgatacctgg

SEQ ID NO: 5260 - DNA, 1556 bp, Panicum virgatum
ctctccgtcgcgtcacaggcgacggcggcggcgacgaaggattcccggctgctcttggtggactcgacggccgttggaggtctgcggccagcggtttcaggagggcctagatagactctgcttgcctccggacaaatccaagttggggaaatgccgacgccggtgaagtcggtgctgcccgtggtgctcctcggctgcggcggcgtcggccgctacctcctccgccacatcgtgtcctgccgtcccctccacgccaaccaaggcgtcgccatccgggtggtgggcgtcgccgatagctcttccctgctcgtcgccgacgacgtcagctcaagcggcctcgatgacgcgcttctcacccacctctgcgccgccaagtccgccggctctcccctgtcctccctgctcggccaagggaactatcagctgttcaggaaccctgaggctaggagcaaagtcattgacgctgctaccacgctcggaagaacaaccggtctcgtactagttgactgttcagcaacctatgacactgttagtctgatgaaggatgccgtggatcatggatgctgcattgtattggcaaacaagaaaccccttactggtgcttatgaggattttcaaattttggtctccaacttccgccgtataagatttgaatctactgttggagcaggtttacctgtgatagcttctgtaacccgtattattgcatctggagatccagtttctcgtatagttggcagtctaagtggtacacttggttatgtgatgagtgagctggaggatggaaagagatttagtgaagttgtaaaaacagccaagtctcttggctttacagaaccagatccacgtgatgatcttggtggaatggatgtggctagaaaggcattgatcctggctaggcttctggggcaacaaatcagcatggacaatatcgatgttgagagtttatatcctagcaaactaggacctgatgccgtatccacagaggacttccttgaaaacggtttagtacaacttgacaagggcatggaagaaagagttaaagcagcatcttctagaggaaatgttctccgctatgtctgtgagattggaagcacaaggtgccaagtaggccttaaagagctcccaaaagattccgcgctcggtagattgaggggaagtgacaatgtggtggagatatacagtcggtgctacgagagctcacctctggtgatccagggcgcaggagctggcaacgacaccacagctgcaggcgttcttgctgatataatggacctccaggacctgttccagaagccggcatgattgttgtccacggcgtgttgttagcaccggagcgtttagttgttgtgcgtgatagcatccttgagtactgctgatgtctcgggcctacggggagggttggtcggtcgaggagctagggacttgtggtcgtcgtcgcacggacatttttgttcattcagctgctgtactgtacgagcaaattgtcaagctacattggaacaacactggcgagttttctaagagaaataaatcttttgttccattgaaatatt

SEQ ID NO: 5261 - DNA, 1288 bp, Cenchrus ciliaris
  misc_feature (809)..(809): n is a, c, g, or t
  misc_feature (858)..(858): n is a, c, g, or t
  misc_feature (915)..(915): n is a, c, g, or t
  misc_feature (980)..(980): n is a, c, g, or t
  misc_feature (987)..(987): n is a, c, g, or t
  misc_feature (1038)..(1038): n is a, c, g, or t
  misc_feature (1055)..(1055): n is a, c, g, or t
  misc_feature (1066)..(1066): n is a, c, g, or t
  misc_feature (1177)..(1177): n is a, c, g, or t
  misc_feature (1193)..(1193): n is a, c, g, or t
  misc_feature (1201)..(1201): n is a, c, g, or t
  misc_feature (1228)..(1228): n is a, c, g, or t
  misc_feature (1244)..(1244): n is a, c, g, or t
  misc_feature (1284)..(1284): n is a, c, g, or t
cgaactctgtgagtgcgagcacacggcggcggaggattcccggcggctcttggcggattcagcggcggtgcgccggccgcgccccatccagttcctaggccctaggctctgccgacggtgaatccaagttgtggaaatgccgacgccggtgaagtcggtgctccccgtggtgctcctcggctgcggcggcgtcggccgctacgtcctccgccacatcgtgtcctgccgtcccctccacgccaaccagggcgtggccatccgggtggtgggtgttgccgatagctcctccctgctcgtcgccgacgacgtccattccagcggcctcgatgacgcgctcctcaccaacctctgcgccgccaaggccgccggttctcccctgtcctccctgctcggccaagggcactgtcagctgttccacaaccctgaggctaggagcaaagttattgacgctgctactacgcttggaagaacaactggtctggtactagttgactgttctgcaacctatgacactgttagtctgctgaaggatgctgtggatcatggatgctgcattgtattggcaaacaagaaacctcttaccggtgcttatgaggattttcagaaattgatctccaatttccgtcagataagatttgaatctactgtcggagcaggtttgcctgtgatagcttccgcgacccgtattattgcatctggagatccagtttctcgtatagttggcagcctaagcggtacacttgggtatgtgatgagtgagctggaggatggaaagagatttagtgaagttgtaaaaacagccaagtctnttggctatacagaaccagatccacgtgatgatcttggtggaatggatgnggcgagaaaggcgttgatcctggctaggcttttggggcaacaaatcagcatggaaantatcaatgttgagagcttatatcctagcgaactaggacctgatgcagtatccacagaggacttcnttgaaantggtttagtacaagttgacaggagcatggaagaaagagtgaaagcagcatnttcaagaggaaatgttnttcgctatgtntgtgagattggaagcacagggtgccaagtaggccttaaagaggtcccaaaagattcagcgctcggtagattgagaggaagtgacaatgtggtggagatatacagccggtgntacgagaggtcacctntggtgatncagggggcgggagctggcaacgacacnacagctgcaggcgttnttgcggatataatcgacctccaagacctgttccggaaganggcg

SEQ ID NO: 5262 - DNA, 1482 bp, Oryza sativa
gtgggctgggccgaatagacgattgaacaacaggccgaagaaaccaaaaatggtgtagcctgaaggtgaagctgtcaagcacccaaatggcggcgccggtgaggtcggtcctccccgtcgtcctcctcggctgcggcggcgtcggccgccaccttctccgccacatcgtctcctgccgcccgctccacgccaaccagggcgtcgccatccgggtgctcggcgtcgccgacagctcctctctgctcgtcgccgacgacctccactccaacggcttcgacgacgcgctcctcgctgatctctgcgccgccaagtccgccggctcgcccctatcttccctgctcgctcgagggcaatgtcagctattcaacaacactgaggctaggaggaaagtcattgacactgccagcgttctagggaaaacaactggtcttgtactagttgattgttctgcaacttatgatactgttggcatgctaaaggatgccgtggattgtggatgttgtgttgtattggcaaacaagaaaccgcttacttgtgcttatgaggatttcgaaaagttggtctccaacttccgtcgcataagatttgaatctactgttggagccagtctgcctgtaatagcttctgtgactcgtattattgcctctggagatccagtttctcgtattgttggcagtctgagtggtacacttggttatgtgatgagtgagctggaggatggaaagaaatttagtgaagttgtgaaaactgccaagtctcttggctatacagaaccagatccacgtgatgatctcagtgggatggacgtagctagaaaggcattgatcttagctaggcttctggggcaacagattagcatggagaatattaatgttgagagtttataccccagtgaattaggacctgatgcaatgtccacaaaggacttccttgaaagtggtttagtacagcttgataaaagcattgaagaaagagtaaaggcagcatctttgaaaggaaatgttcttcgctatgtctgtaagattgaaagcacagggtgccaagtgggccttgaagaactcccgaaaaactctgcactgggaaggttgagaggaagtgacaatgtggtggagatatacagcagatgctacgagagcgcccctctggtgattcagggcgctggagctggcaatgataccactgcagctggagttcttgctgacatacttgatctccaggatctcttccacaaaacggcttgaaatctatgtcttgtaggtcgaaccgcagagttgattgtgagtcgtgacttgtggggttcttttggtcacagtattacctaaataaatcttgagcagacatatccatttttgtactgtacgcagaaggtttttgaacaaatttggaagttggaaccaatgagcagtgtcatccttttgcttatggttatgcttatctgtatggcttattagcaactaaaatttaatttataagtaaaacttt

SEQ ID NO: 5263 - DNA, 1516 bp, Oryza sativa
ggccaatgcttaacccttctctgccgtcatctgaaaaaaaaaaagctgcgtgggctgggccgaatagacggccgaagaaaccaaaaatggtgaagctgtgaagcaccagtgccccaacaaatggcggcgccggtgaggtcggtgctccccgtcgtgctcctcggctgcggcggcgtcggccgccacctcctccgccacatcctctcctgccgccctctccacgccaaccagggcgtcgccatccgggtgctcggcgtcgccgacagctcctctctgctcgtcgccgacgacctccactccaacggcttcgacgacgcgctcctcgctgatctctgcgccgccaagtccgccggctcgcccttatcttctctgctctctcgagggcaatgtcagctattcaacaaccctgaggctaggaggaaagtcattgacactgccagcgttcttgggaaaacaactggtcttgtactagttgattgttctgcaacttatgatactgttggcatgctaaaggatgccgtggatcgtggatgttgtgttgtattggcaaacaagaaaccgcttacttgtgcttatgaggatttcgaaaagttggtttccaacttccgtcgcatgagatttgaatctactgttggagccggtttgcctgtaatagcttctgtgacccgtattattgcctctggagatccagtttctcgtattgttggcagtctgagtggtacacttggttatgtgatgagtgagctggaggatggaaagagatttagtgaagttgtgaaaactgccaagtctcttggctatacagaaccagatccacgtgatgatctcagtgggatggacgtagctagaaaggcattgatcttagctaggcttctggggcaacggatcagcatggagaatattaatgttgagagtttataccccagtgaatttggacctgatgcaatgtccacaaaggacttccttgaaagtggtttagtacagcttgataaaagcattgaagaaagagtaaaggcagcatctttgaaaggaaatgttcttcgctatgtctgtaagattgaaagcacagggtgccaagtgggccttgaagaactcccgaaaaactctgcactgggaaggttgagaggaagtgacaatgtggtggagatatacagcagatgctacgagagcgcccctctggtgattcagggcgctggagctggcaatgataccactgcagctggagttcttgctgacatacttgatctccaggatctcttccacaaaacggcttgaaacctatgtcttctaggtcgaaccgcagagttgattatgagtcttgtgacttgtggggttgttttggtcacagtattacttaaataaatcttgagcagatatcaatttttgtactgtacgcagaaggtttttgaacaaatttggaagttggaaccaatgagcagtgtcatccttttgcttatggttatgcttatctgtatggcttattagcaactaaaatttaatttataagtaaaacttt

SEQ ID NO: 5264 - DNA, 1505 bp, Cynodon dactylon
gagacaccagccctctccctccccgtgcaagcgaatacacttctccggcggctcttggccggtggagggcacgccgtcgtccgcggctgcatcgggttccgggcccgtgcttactttccggtggagaactcgagcagtagcgcaaatgccggcgcctgcgaagtcggtggtccccgtggtgctcctcggctgcggcggcgtcggccgccacctcctccagcacatcgtctcctgccggccgctccacgccagacagggcgtggccgtcgaggtggtgggcgttgcggatagctcctcgctcctcctcgtcgccgacgacgtccacgctggtgggttcaatgacgcgctcctcaccgacatctgcagtgccaaggcagccggctcgcctctatcttccctgctcggtcaagggcgctgtcagctgttcaagaaccctgaggcaggtgcaaaggtcatcgacgctgctgccacgcttggaagatcaactggtctggtactagtggactgctctgcaacttatgacaccgtcggtctgctaaaggatgctgtgaatcatggatgctgtattgcactggcaaacaagaagcctcttactggaggactttgaaaagttggtgtctaacttccggcgtataagatttgagtcaacggttggagcaggattgcctgtgatagctactgtaacccgtattattgcatctggagatcctatttctcgaatagttggtagtctgagtggtacacttggatatgtgatgagtgagctggaggatggaaagaaatttagtgaagttgtcaaaacagccaaatcccttggctatacagaaccagatccacgtgatgatctcagtgggatggatgtggctagaaaggcattgatccttgctaggcttttgggacagaggatcagtatggaggatatcaatgttgagagtttataccctagtgaattaggacctgatgccatgtccacaaaggacttccttgaaagtggcttagcacaagttgataagaccatggaagaaagagttaaggcagcatctctgagaggaaatgttcttcgctatgtctgtgagattggaagtacagggtgccaagtaggcatccgagagctcccaaaagattctgcactgggtagattgaggggaagtgacaatgtggtggagatttacagcagatgctacgagagctccccgctggtgatccagggcgccggagctggcaatgacaccaccgctgcaggtgttcttgctgacatccttgatctccaagatctgttccagaagacgggatagctggccatagcatccccggagtcatgatggcactgtagtgtgttggattgctgtatcttgcatgagtgctggtgtgatgtgttttgaaaattttgcccattccgctgctgcactgcctatactagcatgtcgtgaaattggtacacacaagatgcttgagctgatttcgatcaggcattgtagtgcagatatgatatcaacttttttttt

SEQ ID NO: 5265 - DNA, 1499 bp, Hordeum vulgare
cttgtactccagcagctcctctctggaccagacgagacgagacgaatcgaagccgatccgcctttccaaatgccgcaggcgcaggcgaggtcggtcctgccggtggtgctcctcggctgcggcggcgtcggccgccacctcctccgccacatcgtctcctgcaggccgctccacgccaaccagggcgtcgccatccgggtggtgggcgttggcgacagctcttcgctgctcgtcgcagacgacgtccgcgccaacggcctcgatgacgcgctcctcaacgacctctgctccgccaagtccgccggctcgcccctgtcctcgctgctcgctcgcgggcactgtcaggtgtttaacaagccggaggcaatggggaaagtcatcgatgccgctaccatgcttggaagaacaaccggtctggtgatagttgattgttctgcaacttatgacactgttggtgtgctgaaggatgccgtggatcatggatgctgcgttgttttggcaaacaaaaaacctcttacatgtgcttatgaggattttaaaaagttgacgtcccacttccgtcagataagatttgaatctacagttggagcaggtttgcctgtaatagcttctgtaacccgcattattgcatctggagatccagtttcccgaatcgttggcagtctgagtggtacacttggctatgtgatgagtgagctggaggatggaaagaaatttagcgaagttgtgaaaactgccaaggctcttggttatacagaaccagatccacgtgatgatctcagtgggatggatgtggctagaaaggcattgatcctagctaggcttctcgggcagcagatcagcatggagaatatcattgttgagagtttatatccgagtgagttaggacctgaggttatgtccacaacgaatttccttgagagtgggttgacaaaactcgatgagacgattgaagaaagggtcaaggcagcatctttgaggggaaatgttctgcgctatgtttgtgtcattggaaacacagggtgccaagtgggccttcaagaggtcccaaaagattctgcactggggagattgaggggaagtgacaatgtggtggagatatacagcagatgctacgagagctccccgctggtgatccagggtgcaggagccggaaacgacaccaccgccgcaggagttctcgctgatataatcgacctccaagatcttttccagacaagagcgtgattgtcttgtttagcaccaaggagtttgattattgagttgtatgatcgaccataatgtccattgaactgaaattggttttggcgtttgaggctgtatgaacatttttggttctgtttggctgctgttgatttgacaaatcaggatggtgctttgcactcgggctgccctttaaactttgggacatttcctgtgaaaataggcaaatatttccaatcactatggttgtcgatgaggactttgtggttaccgcaaagagaaataataacatgaag

SEQ ID NO: 5266 - DNA, 1324 bp, Pseudoroegneria spicata
  misc_feature (696)..(697): n is a, c, g, or t
ccagcagctgctctctggacgagacgaatcgaagccgatccgactttccaaatgccgcaggcgcaggctaggtcggtcctgccggtggtgctcctcggctgcggcggcgtcggccgccacctcctccgccacatcgtctcgtgcaggccgctccacgccaaccagggcgtcgccatccgggtggtgggcgttgccgacagctcctcgctgctcgtcgcagacgacgtccgctccagcggcctcgatgacgcgctcctcaacgacctctgctccgccaagtccgccggctcgcccctatcctcgctgctcgctcgcgggcactgtcaggtgttcaacaagccggaggcaatggggaaagtcatcgatgctgctaccatgcttggaagaacaaccggtctggtgatagttgattgttctgcaacttatgacactgttggtgtgctgaaggatgctgtggatcatggatgctgcgttgttttggcaaacaaaaaacctcttacatgtgcttatgaggattttaaaaagttggcgtcccacttccgtcagataagatttgaatctaccgttggagcaggtttgcctgtaatagcttctgtaacccgcattattgcatctggagatccagtttcccgaatagttggcagtctgagtggtacacttggctatgtgatgagtgagctggaggatggaaaaaannttagtgaagttgtgaaaactgccaaggctcttggttatacagaaccagatccacgtgatgatctcagtgggatggatgtggctagaaaggcgttgatcctagctaggcttctcgggcagcagatcagcatggagaatatcaatgttgagagtttatatccgagtgagttaggacctgaggttatgtccacaacggatttccttgagagtgggttggcaaaacttgatgagacaattgaagaaagggtcaaggcagcatctttgaggggaaatgttctgcgctatgtttgtgtcattggaaacacagggtgccaagtgggccttcaagaggtcccaaaagattctgcactggggagattgaggggaagtgacaatgtggtggagatatacagcagatgctacgagagctccccgctggtgatccagggtgcaggagccgggaacgacaccaccgccgcaggagttcttgctgatataatcgatctccaagatcttttcttgacaagagcgtgattgtcttgtttagcaccaaggagtttgattattgcgttgtatgatcgaccataatgtccattgaactgaaattggttttaacgtttgaggttgtatgaacattttcggttccatt

SEQ ID NO: 5267 - DNA, 1460 bp, Secale cereale
ctgctctctggacgagacgaatcgaagccgatccgactttccaaatgccgcaggcgcaggctagggcggtcctgccggtggtgctcctcggctgcggcggcgtcggccgccacctcctccgccacatcgtctcctgcaggcctctccacgcgaaccagggcgtcgccatccgggtggtgggcgttgccgacagctcctcgctgctcgtcgcagacgacgtccgcgccagcggcctcgatgacgcgctcctcaacgacctctgctccgccaagtccgccggctcgcccctatcctcgctgctcgctcgcgggcactgtcaggtgttcaacaagccggaggcaatggggaaagtcatcgatgctgctaccatgcttggaagaacaaccggtctggtgatagttgattgttctgcaacttatgacactgttggtgtgctgaagaatgctgtggatcatggatgctgtgttgttttggcaaacaaaaaacctcttacatgtgcttatgaggattttaaaaagttgacgacccacttccgtcagataagatttgaatctaccgttggagcaggtttgcctgtaatagcttctgtaacccgcattattgcatctggagatccagtttcccgaatcgttggcagtctgagtggtacacttggctatgtgatgagtgagctggaggatggaaagaaatttagtgaagttgtgaaaactgccaaggctcttggttatacagaaccagatccacgtgatgatctcagtgggatggatgtggctagaaaggcgttgatcctagctaggcttctcgggcagcagatcggcatggagaatatcaatgttgagagcttatatccaagtgagttaggacctgaggttatgtccacaatggatttccttgagagtgggttggcacagcttgatgaggcgattgaagaaagggtcaaggcagcatctttgaggggaaatgttctgcgctatgtttgtgtcattggaaacacagggtgccaagtgggccttcaagaggtcccaaaagattctgcactagggagattgaggggaagtgacaatgtggtggagatatacagcagatgctacgagagctccccgctggtgatccagggtgcaggagccggtaacgacaccaccgccgcaggagttcttgctgatataatcgatctccaagatcttttccagacaagagcgtgattgtcttgtttagtaccaaggagtttgattattgcattgtatgatcgaccataatgtccattgaaccaaaatcggttttggcgtttgaggttgtatgaacatttcggttctggttggctgctgttgatttgacaaatcaggatggtgctttgcactcgggctgtcctttaaaatttgggatatatcctgtgaaaataggcaaatttctttgtgaaatcatatctaaaaggctattaaaactgtccatatcttttagtc

SEQ ID NO: 5268 - DNA, 1580 bp, Hordeum vulgare
ggcggcccaaacgaccgaagccccaacggagcagctagaaactctgctgccggcgctaggaacactactccagcagctcctctctggaccagacgagacgagacgaatcgaagccgatccgcctttccaaatgccgcaggcgcaggcgaggtcggtcctgccggtggtgctcctcggctgcggcggcgtcggccgccacctcctccgccacatcgtctcctgcaggccgctccacgccaaccagggcgtcgccatccgggtggtgggcgttggcgacagcacttcgctgctcgtcgcagacgacgtccgcgccaacggcctcgatgacgcgctcctcaacgacctctgctccgccaagtccgccggctcgcccctgtcctcgctgctcgctcgcgggcactgtcaggtgtttaacaagccggaggcaatggggaaagtcatcgatgccgctaccatgcttggaagaacaaccggtctggtgatagttgattgttctgcaacttatgacactgttggtgtgctgaaggatgccgtggatcatggatgctgcgttgttttggcaaacaaaaaacctcttacatgtgcttatgaggattttaaaaagttgacgtcccacttccgtcagataagatttgaatctacagttggagcaggtttgcctgtaatagcttctgtaacccgcattattgcatctggagatccagtttcccgaatcgttggcagtctgagtggtacacttggctatgtgatgagtgagctggaggatggaaagaaatttagcgaagttgtgaaaactgccaaggctcttggttatacagaaccagatccacgtgatgatctcagtgggatggatgtggctagaaaggcattgatcctagctaggcttctcgggcagcagatcagcatggagaatatcattgttgagagtttatatccgagtgagttaggacctgaggttatgtccacaacgaatttccttgagagtgggttgacaaaactcgatgagacgattgaagaaagggtcaaggcagcatctttgaggggaaatgttctgcgctatgtttgtgtcattggaaacacagggtgccaagtgggccttcaagaggtcccaaaagattctgcactggggagattgaggggaagtgacaatgtggtggagatatacagcagatgctacgagagctccccgctggtgatccagggtgcaggagccggaaacgacaccaccgccgcaggagttctcgctgatataatcgacctccaagatcttttccagacaagagcgtgattgtcttgtttagcaccaaggagtttgattattgagttgtatgatcgaccataatgtccattgaactgaaattggttttggcgtttgaggctgtatgaacatttttggttctgtttggctgctgttgatttgacaaatcaggatggtgctttgcactcgggctgccctttaaactttgggacatttcctgtgaaaataggcaaatatttccaatcactatggttgtcgatgaggactttgtggttaccgcaaagagaaataataacatgaagaaaacacataaatagatggc

SEQ ID NO: 5269 - DNA, 1552 bp, Triticum aestivum
gcccaaacggccgaacccccaacggagcagctaaaaactctgctgccggcgctaggaacactccagcaactcctctctggacgagacgaatcgaagccgatccgagtttccaaatgccgcaggcgcaggctagggcggtcctgccggtggtgctcctcggctgcggcggcgtcggccgccacctcctccgccacatcgtctcctgcaggcctctccacgccaaccagggcgtcgccatccgggtggtgggcgttgccgacagctcctcgctgctcgtcgcagacgacgtccgcgccagcggcctcgatgacgcgctcctcaacgacctctgctccgccaagtccgccggctcgcccctgtcctcgctgctcgctcgcgggcactgtcaggtgttcaacaagccggaggcaatggggaaagtcatcgatgctgctaccatgcttggaagaacaaccggtctggtgatagttgattgttctgcaacttatgacactgttggtgtgctgaaggatgccgtggatcatggatgctgcgttgttttggcaaacaaaaaacctcttacatgtgcttatgaggattttaaaaagttgacgtcccacttccgtcagataagatttgaatctactgttggagcaggtttgcctgtaatagcttctgtaacccgcattattgcatctggagatccagtttcccgaatcgttggcagtctgagtggtacacttggctatgtgatgagtgagctggaggatggaaaattttttagtgaagttgtgaaaactgccaaggctcttggttatacagaaccagatccacgtgatgatctcagtgggatggatgtggctagaaaggcgttgatcctagctaggcttctcgggcagcagatcagcatggagaatatcaatgttgagagtttatatccgagtgagttaggacctgaggttatgtccacaacggatttccttgagagtgggttggcaaaacttgatgagacgattgaagaaaaggtcaaggcagcatctttgaggggaaatgttctgcgctatgtttgtgtcattggaaacacagggtgccaagtgggccttcaagaggtcccaaaagattctgcactggggaggttgaggggaagtgacaatgtggtggagatatacagcagatgctacgagagctccccgctggtgatccagggtgcaggagccgggaacgacaccaccgccgcaggagttctcgctgatataatcgatctccaagatcttttccagacaagagcgtgattgtcttgtttagcaccaaggagtttgattattgcgttgtatgatcgaccataatgtccattgaactgaaattggttttggcgtttgaggttgtatgaacattttcggttgtgtttggctgctgttgatttgacaaatcaggatggtgcctttgcactcaggctgtcctttaaaatttgggatatatcctatgaaaataggcaaatttctttgtgaaatcctatctaaaatgctattaaaactgtcaatttctttaatgaagtgcataagggtatattata

SEQ ID NO: 5270 - DNA, 1350 bp, Triticum aestivum
ccacgcgtccgcgaagccgatccgactttccaaatgccgcaggcgcaggctagggcggtcctgccggtggtgctcctcggctgcggcggcgtcggtcgccacctcctccgccacatcgtctcctgcaggtctctccacgccaaccagggcgtcgccatccgggtggtgggcgttgccgacagctcctcgctgctcgtcgcagacgacgtccgcgccagcggcctcgatgacgcgctcctcaacgacctctgctccgccaagtccgccggctcgcccctgtcctcgctgctcgctcgcgggcactgtcaggtgttcaacaagccggaggcaatggggaaagtcatcgatgctgctaccatgcttggaagaacaaccggtctggtgatagttgattgttctgcaacttatgacactgttggtgtgctgaaggatgccgtggatcatggatgctgtgttgttttggcaaacaaaaaacctcttacatgtgcttatgaggattttaaaaagttgacgtcccacttccgccagataagatttgaatctactgttggagcaggtttgcctgtaatagcttctgtaacccgcattattgcatctggagatccagtttcccgaatcgttggcagtctgagtggtacacttggctatgtgatgagtgagctggaggatggaaaattttttagtgaagttgtgaaaactgccaaggctcttggttatacagaaccagatccacgtgatgatctcagtgggatggatgtggctagaaaggcgttgatcctagctaggcttctcgggcagcagatcagcatggagaatatcaatgttgagagtttatatccgagtgagttaggacctgaggttatgtccacaacggatttccttgagagtgggttggcaaaacttgatgagacgattgaagaaaaggtcaaggcagcatctttgaggggaaatgttctgcgctatgtttgtgtcattggaaacacagggtgccaagtgggccttcaagaggtcccaaaagattctgcactggggaggttgaggggaagtgacaatgtggtggagatatacagcagatgctacgagagctccccgctggtgatccagggtgcaggagccgggaacgacaccaccgctgcaggagttctcgctgatataatcgatctccaagatcttttccagacaagagcgtgattgccttgttttagcaccaaggagtttgattattgcgttgtatatgatcgaccgtaatgtccattgaactgaaattggtttttggcgtttgaggttgtatgcacattttcggtcatgtttggctgctgttgatgttcagagttgccatgcgtcgtgtca

SEQ ID NO: 5271 - DNA, 1582 bp, Brachypodium distachyon
gcccaaaagcccaaccgaatttcagctgctttctgttcgcttaaaaaaaaaaagctcctctgttctgctctgctctctgaacgagaatcgaagcccgatcgatccctgtgagatgccgccgcaggcgcaggcgaagtcggtgctgccggtggtgctgctaggctgcggcggcgtcggccgccacctcctccgccacatcgtctcctgccgcccgctccacgccaaccagggcgtctccatccgggtggtgggcgtgtccgacagctcctcgctgctgctcgccgcagacgacctccgcgccggcgccggcctcgatgacgcgctgctaggcgacctctgcgctgccaagtctgccggctcgcccctctcctcactgctcgcccgcggacaatgtcagctgttcaacaagccggaggcaatgtccaaagtcatcgatgctgccaccatgctcggaaggacaaccggcctggtgctagttgattgttctgcaacttatgataccatcggtgtgctgaaagatgccgtggatcagggatgttgtgttgtattggcgaacaagaaaccactgacttcgtcttatgaggattttcaaaagttgacatcgaacttccgtcagataagatttgaatctactgttggagcaggtttgcctgtaatagcttccgtaacccgtattatcgcatctggagatccaatttctcgaatcgtcggcagtctcagtggtacactaggctatgtgatgagtgagctggaagatggaaaaagatttagtgaagttgtgaaaactgccaagtctcttggttatacagaaccagatccacgtgatgatctcagtgggatggatgtggctagaaaggcattgatcctagctaggcttctcgggcgacagatcagcatggaggatatcaatgttgagagtttgtatccaagtgaattaggacctgaggtaatatccacaaatgactttcttgaaagtgggttggcacagcttgatgagagcattgaggaaagagtcaaggcagcatctttaagaggaaatgttcttcgttatgttggtgttattgaaagcacagggtgccaagtgggtcttcaagaggtcccaaaagattctgcactggggagattgatgggaagtgacaatgtggtggagatatatagcagatgctacgagaactccccgttggtgatccagggcgcaggagcaggcaacgacaccaccgccgcaggagttctcgccgatatagtcgacctccaggatcttttccagaaaagggtgtgattactgtcttgtttagcaccaaggggagtttgcttgttgcctcgtacgattgttgatgacgatgtggagttaatccaccgatcggttcaagcctatgaggctgtatgaatgaaggaacacttgggaatttggatatggtttggctgctgcattgcttgtgcaaatcttgagcagccatggggatgctgctgtgcgcactttggttcgaaatttaggatatgacgtctgaagaaacgaccacttttttttttgccttggaccaaaaacacattcaaagagaattttaaaagcggtgaatttaat

SEQ ID NO: 5272 - DNA, 1398 bp, Brachypodium distachyon
atgccgccgcaggcgcaggcgaagtcggtgctgccggtggtgctgctaggctgcggcggcgtcggccgccacctcctccgccacatcgtctcctgccgcccgctccacgccaaccagggcgtctccatccgggtggtgggcgtgtccgacagctcctcgctgctgctcgccgcagacgacctccgcgccggcgccggcctcgatgacgcgctgctaggcgacctctgcgctgccaagtctgccggctcgcccctctcctcactgctcgcccgcggacaatgtcagctgttcaacaagccggaggcaatgtccaaagtcatcgatgctgccaccatgctcggaaggacaaccggcctggtgctagttgattgttctgcaacttatgataccatcggtgtgctgaaagatgccgtggatcagggatgttgtgttgtattggcgaacaagaaaccactgacttcgtcttatgaggattttcaaaagttgacatcgaacttccgtcagataagatttgaatctactgttggagcaggtttgcctgtaatagcttccgtaacccgtattatcgcatctggagatccaatttctcgaatcgtcggcagtctcagtggtacactaggctatgtgatgagtgagctggaagatggaaaaagatttagtgaagttgtgaaaactgccaagtctcttggttatacagaaccagatccacgtgatgatctcagtgggatggatgtggctagaaaggcattgatcctagctaggcttctcgggcgacagatcagcatggaggatatcaatgttgagagtttgtatccaagtgaattaggacctgaggtaatatccacaaatgactttcttgaaagtgggttggcacagcttgatgagagcattgaggaaagagtcaaggcagcatctttaagaggaaatgttcttcgttatgttggtgttattgaaagcacagggtgccaagtgggtcttcaagaggtcccaaaagattctgcactggggagattgatgggaagtgacaatgtggtggagatatatagcagatgctacgagaactccccgttggtgatccagggcgcaggagcaggcaacgacaccaccgccgcaggagttctcgccgatatagtcgacctccaggatcttttccagaaaagggtgtgattactgtcttgtttagcaccaaggggagtttgcttgttgcctcgtacgattgttgatgacgatgtggagttaatccaccgatcggttcaagcctatgaggctgtatgaatgaaggaacacttgggaatttggatatggtttggctgctgcattgcttgtgcaaatcttgagcagccatggggatgctgctgtgcgcactttggttcgaaatttaggatatgacgtctgaag

SEQ ID NO: 5273 - DNA, 1297 bp, Pennisetum glaucum
ctccacgccaaccagggcgtggccatccgggtggtgggcgttgccgatagctcctccctgctcctcgccggcgatgtccagtcaggcggcctcgatgacgcgctcctcacccacctctgcgccgccaaggccgccggctctcccctgtcgtccctgctcggccaagggcactgtcagctgttccagaaccctgaggctaggagcaaagtcattgatgccgctaccacgcttggaagaacaacgggcctggtactagttgactgttctgcaacgtatgacactgttagtctgctgagggatgctgtggaccatggatgctgcattgtgttggcaaacaagaaacctcttactggtgcttacgaggattttcaaaagttggtctccaacttccgccggataagatttgaatctactgttggagcaggtttgcctgtgatagcttctgtaacccgtattattgcatctggagacccagtttctcgcatagttggcagtctaagcggtacacttggttatgtgatgagtgagctggaagatggtaagagatttagtgaagttgtaaaaaccgccaagtttcttggctatacagaaccagatccacgtgatgatcttggtggaatggatgtggctagaaaggcgttgatcctggctaggcttctggggcaacaaatcagcatggacaatatcaatgttgagagcttatatcctcgcgaattaggacctgatgcagtatccacagagaacttccttgaaagtggtttaatacaacttgacaggagcatggaagaaagagtgagagcagcatcttcaagaggaaatgttcttcgctatgtctgtgagattggtagcacagggtgccatgtaggccttaaagagctcccaaaagattccgcgctcggtagattgaggggaagcgacaatgtggtggagatatacagccggtgctacgagagctcccctctggtgatccagggggcgggagctggcaacgacaccacagcggcaggcgttcttgctgatataatcgacctccaagacctgttccagaagacacaggcagcatgatcacagtgcccacccccaatccaatacagtagcaatgtacgcatccttgagtggtggtggagtctgtgggatgagaagagttgaggttgtgtgcacacttacttgtttgactgaaataagatcccgttctgtagaagcaagcaagcagacattggtggtgctcaactgctgctggtgatacccggtcgatgacattgtttttttttctatgatggaattcatgattttgttc

SEQ ID NO: 5274 - DNA, 1214 bp, Secale cereale
gactttccaaatgccgcaggcgcaggctagggcggtcctgccggtggtgctcctcggctgcggcggcgtcggccgccacctcctccgccacatcgtctcctgcaggcctctccacgccaaccagggcgtcgccatccgggtggtgggcgttgccgacagctcctcgctgctcgtcgcagacgacgtccgcgccagcggcctcgatgacgcgctcctcaacgacctctgctccgccaagtccgccggctcgcccctatcctcgctgctcgctcgcgggcactgtcaggtgttcaacaagccggaggcaatggggaaagtcatcgatgctgctaccatgcttggaagaacaaccggtctggtgatagttgattgttccgcaacttatgacactgttggtgtgctgaaggatgctgtggatcatggatgctgcgttgttttggcaaacaaaaaacctcttacatgtgcttatgaggattttataaagttgacgacccacttccgtcagataagatttgaatctaccgtatgcacatgctactagttggagcaggtttgcctgtaatagcttctgtaacccgcattattgcatctggagatccagtttcccgaatcgttggcagtctgagtggtacacttggctatgtgatgagtgagctggaggatggaaagaaatttagtgaagttgtgaaaactgccaaggctcttggttatacagaaccaggtctaaaagatatccacgtgatgatctcagtgggatggatgtggctagaaaggcgttgatcctagctaggcttctcgggcagcagatcggcatggagaatatcaatgttgagagcttatatccaagtgagttaggacctgaggttatgtccacaacggatttccttgagagtgggttggcacagcttgatgaggcgattgaagaaagggtcaaggcagcatctttgaggggaaatgttctgcgctatgtttgtgtcattggaaacacagggtgccaagtgggccttcaagaggtcccaaaagattctgcactagggagattgaggggaagcgacaatgtggtggagatatacagcagatgctacgagagctccccgctggtgatccagggtgcaggagccggtaacgacaccaccgccgccaggagttctcgctgatataatcgatctccaagatcttttccagacaagagcgtgattgtcttgtttagtacc

SEQ ID NO: 5275 - DNA, 2421 bp, Zea mays
atgcgccggcgaaaacctaggagtttgatgaaagttgaaagcgaccacttgagatttgaaagcggcttgcccgggtgccggccccgggccccgtccaacccccccccccccccccatcttgtcgttttttgcgcgccgtcgcctccctttctcccccaaaaccatccatcgtctctgcccgccatcccatttcccaatcgcctccaaccccccacaccccgcccgccgcaaacccctccatttccgccgcatttccctcgctgtcccagctcaccggtcggtcgggtgctggggctcgcggctcctctcttcctggggcctggaagggacggggaaggatgcaggccgcgaccaggagcgtctcttgcatcggcgcgcagccgtccgtcctcatccggtgcggcggtggtgcgctgtccgcttcgcccggcggcctcggaggagggggatgcagggtccgggtcgtcgccgtgctgcggtgctgcgcacaggagaagcgtccgcctcgggtgcggaaatccaaggaggagagaagggagatggtggagtccttcatcaacagctatcgagcttcaaacgaaggaaaattcccatcggttaaccttacacataaggaagttggagggtcatattatatagttcgtgaaatcgtgagggatatcatccaagagaatagagtccttggtcctggtggcttagatgctatggtgctgaattttgaagattttgctgattcttcagggtcatccatgaagcatgaactgggtcaagacaatatcgagatattagatacgtctggtagtgaagtcagtaagggttatgtgcctgaaatatccaacactgatggatcttttctattgcaagacaatgccatcagcaaccagacactgttgggttcttccaatatcttagaggctggtattttgaatagtgtggtccaaaatgggagtgcagcagatgcaatattcatggaaacaaaccttgagaaacaagatgaagttccatctggtgaatcaattgagtttgacttgaatagttctgaagagcaagctcatttatttgctcaggtttctgattcagatgaaaacattgcactagacagtcaggcggatgcacaggacgtgatggccagtagtgctaccaatagagctattcttcccttagaagcttctgctgtttatgatgctgcacttttaagagatcatgagacattgcctaatgataatcatgatgcatcaactgatagttccgtggatgatgcaagtcacgttgagacgaccaatggtgttcaagcaaagcaagcttctttacatgagcatgatgcatcaactggaaatgtatcgattgaaaatgctcagagcttagatggtcagtttagtaatatatctactgatccaataaatggtgctaaattggaggctgaagttgcaaccaagacagttgaagcgtctaaagtacacaggctgcaagatgggtttgagcaaccattggctgatgctagctgtgatgggcaagaaaactctgacagccctgtttctcatccagcattagatacaaaggggctgttgcacacagaagatcagcagagtgtggtacaggtagatgaaagtgaattcaagaactcaacatctgggatcacaaaggaagatttcaagcatgagcaaggaattagcactgcaacagtgatcagcaggcatgcactttgcctcctaactttgcgttgcatgcttactgtttataatttccttcacacgtcacaaagggcagcagtatattaggagaactttgaaagctcagcagaagaaagatgacaatctattctggcttgtgcttagggcatttgttgttgctatatcgaaaatctgggcaaaatgaacagtgcagaaaggcagcgtatgtggaactgaagatcgagtgaatccttcctagtggaaaacgagaaaccggtccatgaagttccatttctcccatgtgaatatagatgcgctacttttgtgccgcagtttaagtaatcttttttggagacagctggtctggtttgtagtcgcttcccactgtaggtgaaagaccatgttgggccgtgttcaacatttcacccatatagtcactccaaaacattgttttgcactttaaattgtactgatcgtagagtggattttgaatatgggtacgaggatgggtaagctgacggaaatagcttaaagtttagttatcctagtctggtgttcatgtgttagatgtttggtacaatggatgtcatgtgtcttttggtaaaaggaggatggatctcttttaatgctctatgaaatttgcagatttgttcattggatccacaaataaactgccgttggtttgttcttgttgaggtgaatttaggtttggatttgcctccccggttggagcgtaagcattgtttggttt

SEQ ID NO: 5276 - DNA, 555 bp, Saccharum officinarum
acacgccgcacccaaagcgaccaacctctgcttcacaccatacctgcctctgcctgccactgtgccacgccgcggcctcccgatgtcgtcgcagcgcccgggccgccaccagcgtcgcgcgtcgcagagcgtgttcgtgctcccggaaaacctggcctccctcgacgtcgacgcggcaggcgaggtgggtgccaaggccggcgggccggaaggcgccggcgccagcgccgagcagcaggcgaggccgcccgcggggcgtcaccgccgcgccatgtctgtggccgtggccaccagggacctcgagctgatcaaggaggacctcggcagctacaagctcggcgcttgagagtggccggccggcacgttgcgtcaggtgtatatagcatagcctgtgggttaaccgtactcggagctggctttgatcgacgctttacagtggctttacaaggtctctcctttgctcgttttgtttgctcaacacacgcgtgtaatactactactagtactatgtaactttttcattacgaagaggaagtatttggacatttttttttg

SEQ ID NO: 5277 - DNA, 753 bp, Setaria italica
aaccagacacacaccaccgaagcccaagtgaccagcctctgctcactcactcgtcactccgtacccaccccgtctgcccgcgaccccccgagcaaaggccgatgtcgtcgcagcggccgggccggcaccagcgccgggcgtcgcagagcgtgttcgtgctcccggagaacctcgccaccctagacgtcgacgcggcggccgaggccggcgggaaggccggttccgacggcgccggtgccgagcagcaggcagcgaggccgccggcggggcgccaccgcagggcgatgtcggtggccgtggcgtccagggaccttgagctgatcaaggaggacctcggcagctacaagctcggcgcttgatgagcatgccatgggtcatgggtgtgggttctcgttgcgtcatgtgtatatagccctgtgggttaaccgtacccgaagctggctttgatcgacgcttaatagaggctcaagtttaaggtcgtctcagttgcgctctttttttttcccgctcacgcatgtaaaatattactactgtgtaacttttcatcacgaagaagaaagtatttgaacttttaatcgcgtacggagatcggtgcctctgctccgtgacagcaggactgcaggagaacttgtcttccttgtagattgtagtttgatagccggaacggccgcgatgatcaccagctatcatttttcgcataaaaagagatggtatctgcgttgagttgcaaatgggcttcagattttagatgca

SEQ ID NO: 5278 - DNA, 627 bp, Panicum virgatum
cacacagaagccataagccatagccaagtgaccaggctctctgctcacagctcacacactccatagtccgtaccaccagtcccccgctgcctgagcgtccgcgacccccgagcaaggccgatgtcgtcgcagcggccgggccggcaccagcgccgggcgtcgcagagcgtgttcgtgctcccggagaacctcgccaccctcgacgtcgacgcggcggccgaggccggcgggaataaggtcggcccggacggcgccagcgccgagcagcaggcgaggccgccggcggggcgccaccaccgccgggcgatgtcggtggccgtggcgtccagggacctggagctgatcaaggaggacctcggcagctacaagatcggcgcttgagcctgccagaggccgtgcccgtgcgcctccacacgtcgcgtcgtgtgtgtatagagccctgtgggtgaaccgtacccgaagctggctttgatcgacgcttactagtggctcaagttcttaagttctccgttcctctctttctttctttttttttttggttcatgcgcgtaatactactgctatgtaacttctcatcacgacgaagaaagtatttgaacttttaatcccataccaagatcgatcggt

SEQ ID NO: 5279 - DNA, 572 bp, Panicum virgatum
ggacacacacaagccaagtgaccgcctctctgctcactcactccgtgccacccccgccgcctgcgcgtccgcgaaccccgagcgaggccgatgtcgtcgcagcggccgggccggcaccagcgccgggcgtcgcagagcgtgttcgtgctcccggagaacctcgccaccctcgacgtcgacgcggtggccgaggccggcgggaataaggccggcgccgagcagcaggcgaggccgccggcggggcgccaccgccgggcgatgtcggtggcagtggcgtccagggacctggagctgatcaaggaggacctcggcagctacaagatcggcgcctgagctcgccagaggccgtgcgcctccacacttggcgtcgcgtgtgtatagagccctgtgggtgaaccgtacccgaagctggctttgatcgacgcttactagttggctcaagttattaagttctccgttggtcttttttttttttggctcatgcctgtcacactactgctatgtaaacttctcatcacgacgaagaaagtatttgaacttttaatcgcataccaagatcgatcggtacctcc

SEQ ID NO: 5280 - DNA, 703 bp, Zea mays
caaaccaaacacacacacacacgcaggcagcagtcaagcggccaacctctgcttcacaccgtacctacctgcgagccacgcccacgccgcagcccccgatgtcgtcgcagcgcccgggccgccaccagcgccgcgcgtcgcagagcgtgttcgtgctcccagagaacctggcctccctcgacgtcgacgcggcggccgacgcgggcgccaaggccggcgggccagaaggcgccggcgccggcgccgagcagcaggcgaggccgcccgcggggcgtcaccaccgccgcgccatgtccgtggccgcggccgtggcctccagggagcttgagctgatcaaggaggacctcggcagctacaactacaaggtcggcgcctgagagagagagagagagaggagccggcacgctgcgtcatgtgtatagagcttgtgggttaaccgtacccagagctggctttgatcgacgattaacagtggcttaattacatggtctctctcttgctctttttgtttgcccacacacgcatgtataatagtactagtagtactatgtaactttttcactacaaagagaactatttggacattttaatagccgtattaatagcagctccaacgataccggattcctaattgatactagacggagagcagctcaataatagttatgtataatttaatacctaaatcctaaatttagcaagt

SEQ ID NO: 5281 - DNA, 1869 bp, Setaria italica
tcccgcccacccgcgtcactccgtctctccgctccgtcccacccgccgctgccgccgccgccgccgccttgcaggatccagatggcgtccgcggccgcgcccccgacctcgctctccctcgcggcccgcgcggccaccagggccgccgccgccgccgctgccaccccgctgcgcaggggtgggctcgcggcggggtgccagccggcgcggtcgctggcgttcgcggcgggcgacgcgcggctcgcggtccacgtcgcgtcgaggtgccggcaggcgtcgtccgcgcgggggacccgcgccgtggccaccatggccaagaagagcgtcggggacctcacggaggccgacctcgaggggaagcgcgtcttcgtgcgcgccgacctcaacgtgccgctcgacgagaaccagaacatcaccgacgacacccgcgtccgcgccgccgtccccaccatccagtacctcatcggcaagggcgccaaggtcatcctctccagccacttgggtcgccctaagggtgttactcccaagtttagcttagctcccattgtgccacggctgtctgagcttcttggcattcaggtgcaaaaagctgacgatgttattggccctgaagttgagaaattggtgtctgccttgcccaacggcggtgttttgctccttgagaacgtaagattttacaaggaagaggagaagaatgacccagagtttgctcagaagcttgcctccctagcagatctttatgttaatgatgcattcggaacagcccacagggcacatgcatcaactgagggagttaccaagttcttgaagccttctgttgcagggttccttttgcagaaggagcttgactaccttgttggagctgtttcgagccctaaacgtccatttgctgccatcgtgggtggctcaaaggtgtcatccaagatcggggttattgagtccctattggaaaagtgtgatatcctacttttgggcggtggtatgatcttcacattttacaaggcacaaggactctctgttggtgcttcattggttgaggaagacaaacttgagctcgcgacatctctccttgcaaaggcaaaggaaaagggtgtctcccttatgttgccaaccgatgttgtcattgctgataagtttgcccctgatgctaacagccagattgttccagcatctgcgattcctgatggttggatggggctggacattggtccagattctgttgcttcgttcaatgcagccctggatacaacccagacagtcatctggaatgggcccatgggtgtttttgaattcgacaagttcgctgtaggaactgaggctgttgcgaagaagttggcagagcttagcggcaagggtgtcacaaccatcattggaggcggagactctgttgcagctgtcgagaaggtgggagtagctgatgttatgagccacatctcaacgggaggaggtgccagtttggaattgttggaaggaaaggagcttcctggagttattgcgttggatgaagccgttgtgactgtatgaagctaagttttcattttgtttcaccttcatcttcgtggaccaatgtgaacttggtacattcttgcttgctcctcgtcagccgttcgacatgtaagagatcaatgctttatagagctactggaaattgtttgaataactacacaaataattacctgggtcataaactaaaccctaaagggcactagagcctatgtccggacctggtgcagtggtaaaactctccacttgtggctcagaggtcctggttccaaccaacctctttgcagaattttaaacaattttgcaagggtaaggctctctagttgcagaattttaaaagaattttgcaagggtaaggttatctag

SEQ ID NO: 5282 - DNA, 2043 bp, Zea mays
aaactcaccgagtttcggaaatgtgggactgagaagggacggcgatcccagatcacacagaggacaggggaaaacgaagccaccgagcccccacacgtcgccatccatcgccgtaatcgatcaccgccgtctcctcccccacacacccaccggaaccgtcgtcctgacctctcgccagcgataagcaaatctcctccccactttatcgtccacaaagccttcttcccgccctcccgaatcgctccctctctgtccctccgctccagccgccgccgccgcctccgccctccgaatcccaatggcgtccgcggccgctcctccaacctccctctccctcgcggcccgcgcggccaccagggcagccgccgccgccgccgccccgctgcgcaggggaggcctcgccacggcgtgccagccggcacggtctctggctttcgcggcgggcgacgcgcggctcgcggtccacgtcgcgtcgcgatgccggcaggcgttctccgggcgtggcacgcgggccatggccaccatggcgaagaagagcgtaggggaactcacggaggccgacctcgaggggaagcgcgtcttcgtgcgcgccgacctcaacgtgccgctcgacgagaaccagaacatcaccgacgacacccgcatccgggccgccatccccaccatccagtacatcctcagcaagggcgccaaggtcatcctctcaagccacttgggtcgccctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcgacgtctctacttgcaaaggctaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctggatacaaccaagacggtcatctggaacgggcccatgggtgtcttcgaatttgacaagttcgctgtaggaaccgaggctgtggcaaagaagctggcagaactcagcggcaagggcgtcacaactatcatcggaggcggagactccgtcgccgccgtcgagaaggtgggagttgctgacgttatgagccacatttccacgggaggtggcgctagcctggaattgttggaaggaaaggagcttccgggagttgttgcgttgaatgaagccgccactgtgactgtatgaagcatgctttcattttgtttcgtcttcgtcttcacgtgccgttgtatacttgctacattctcgcttgcacttgcacctcctcagccgctcgctcgaaatgtaagagaccaatgttttatagagctaatggaaatcgtttgaacaacgacgaccctaatagtatgtgatttaccgagtgatctttcctcggtaacgtaactagtgatataaaaaacattcaaaggcaatcttggctattcactttgtgcaccaggactagcttcgctgagcaaggtgtgaattttcttttgttcttttctttg

SEQ ID NO: 5283 - DNA, 1658 bp, Panicum virgatum
cccgccgcgcacccgacctcgctctccatcgcggcccgcgcggccaccagggccgccgccgccgccgccgccgccgccaccccgctgcgcagggggggcctcgcggcggcgtgccagccggcgcggtcgctggcgttcacggcggccgacgcgcggctcgcggtccacgtcgcgtcgcggtgccgccaggcgtcgtccgcgcgcgggacccgcgccgtggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgcgccgccgtcccgaccatccagtacctcatcggcaagggcgccaaggtcatcctctccagccacttgggtcgccctaagggtgttactcccaagtttagcttagctcccattgtaccacggctgtctgagcttcttggaattcaggtgcaaaaagctgacgattgtattggccctgaagttgagaaattggtgtctgccttgcccaatggtggtgtttgtctcctcgagaacgtaagattttacaaggaagaggagaagaatgacccagagtttgcgcagaagcttgcctcccttgcagatctttatgttaatgatgcatttggaacagcccacagggcacacgcatcaactgagggagttaccaagttcttgaagccttctgctgcagggttccttttgcagaaggagcttgactaccttgttggagctgtttcaagccctaaacgtccatttgctgccatcgtgggtggctcaaaggtgtcatccaagattggggttattgaatccctgttggaaaagtgtgatatccttcttttgggtggtggtatgatcttcacattttacaaggcacaaggactttctgttggttcttcgttggtcgaggaagacaaacttgagcttgcaacatctctgcttgcaaaggcaaaggaaaagggtgtctcccttatgttgccaactgatgttgtcattgctgataagtttgcccctgatgctaacagccagattgttccagcatcttcaattcctgatggttggatggggctggacattggcccagattctattgcttcattcaatgcagccctggacacaacccagacaatcatctggaatgggcccatgggtgtttttgaattcgacaagttcgctgtaggaactgaggctgttgcgaagaagttggcagagcttagcggcaagggtgtcacaaccatcattggaggtggagactctgttgcagctgttgagaaggtgggagttgctgatgttatgagccacatttcaacgggaggtggtgccagcttggaattgttggaaggaaaggagcttcctggagttgttgcgttggatgaagccgtccctgtgactgtatgagttttcaatttgtttctccttcatcttcgtgtaccatgtaaacttgctacactcttgctcgctccttgtcagccgctcgaaatgcaagatcaatgctttatagagctactggaaattgtttgaataactacacaaataatatgtgtttacctgagtcataactcataaaaacccataaagggcactgtagcctatttggctatagattacttgcg

SEQ ID NO: 5284 - DNA, 2159 bp, Zea mays
cccgcacccaccccaccggaaccgtcgtcccgacctctcgccagcgataagcaaatccccgcctcactctctcgtccacagacaaagccacgacccacaagtgcccccctcctcccgcgctcccaaatcactccctctctgtctctccactccactcgccgccgccgcccgaatctcaatggcgtccgcggccgccccgccaacctccctctccctcgcggcccgtgcggcaagcagggcggccgccgccccgctccgcaggggaggcctcgccgcggcgcgccagccggcgcggtcgctggcgttcgcggcgggcgacgcgcggctcgcggtccacgtcgcgtcgcggtgccggcaggcgtcctccgcgcgcggcacgcgggccatggccaccatggcgaagaagagcgtcggggacctcacggaggccgacctcaaggggaagcgcgtcttcgtgcgtgccgacctcaacgtgccgctcgacgagaaccagaacatcaccgacgacacccgcatccgggccgccatccccaccatccagtacctcctcggcaagggcgccaaagtcatcctctcaagccacttgggtcgccctaagggttttacacccaagtttagcttagccccccttgttgcacggttgtctgagcttcttggcattcaggtgcaaaaagccgacgatgttattggccctgaagttgagaagctggtggccgccttgcccaatggtggggttttgctccttgagaacgtaagattctacaaggaagaggagaagaatgacccagagtttgcgcagaagcttgcctccgtagcagatctttacgttaatgacgcgtttggaacagcccacagggcacatgcatcgactgagggagttacaaagttcttgaagccttctgttgcagggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaaggtctttctgtcggtgcttcgttggttgaggaagacaaactcgatcttgcaacatctctacttgcaaaggctaaggaaaagggtgtctcccttatgttgccaaccgatgttgtcatcgctgataagtttgctcctgatgctaacagccagattgttccagcatctgcaattcctgatggttggatggggctggatattggcccagattccattgctgcattcaacgcagccctggaaacaacccagactgtcatctggaacgggcccatgggtgtttttgaatatgacaagttcgctataggaactgaggctgtggcaaagaagttggcagaacttagccgcaagggtgtgacaactatcatcggaggtggagactctgtcgccgccgttgagaaggtcggagttgctgacgttatgagccacatttccaccggaggtggtgccagcttggaattgttggaaggaaaggagcttccaggagttactgcattggatgaagcagccactgtgactgtatgaagcaagttttcattttgtttcatcttcttttttggaagttaccgggggagggactcccacctgaataaggtgcgcaaggccaggattgttggctcaaccacagggagcgcacgccaccgcatcatcttcatgtaccattgtatacttgctacattcttgcttgctcctcctcagccgctcgaaatgtaggagatcaatgatttatagagctctggaaatcgtttgaacaaggagtaagcgacccaagtaatatgcttactgagtcatctttcctttgtgacgtaacaaattacataaaaacccttcgaaggtaacctagcctattcaaccattggtaactaggagttttatcctttgtgcaccaggaccagctttgccgagctaagtgtgaattttcttttctgttctttgtcaaagaagcaaactctagcgtcatgcctcgttagaatctagattttacgttatggagttctgctgctgaatctttttctgggccatgacattgtaaaattactgtttggtctctggcacaattttttttcgcttt

SEQ ID NO: 5285 - DNA, 2630 bp, Oryza sativa
gatcgatcgattcgatcacacggatcacacaaaaaaacaacggcgatcacggaaggcagcaagccccacacgtcgccgtcgcggcgatcaccgccgcctcctcccccacacaaccaccggtatcatcgacccccacctcccatcccaattcccaagttcccaacctctcgccagcgataagcaaatctccccctcccccctctcgtccacaaaaccctctttctttacgaaccccccaacccctcgtccccctcccgcctcccaccttctccgcgttccagcctccgcgcgcgctccctcgtcctcccccaatggcgtccgcggccgcgccgaccacgtcctcgctctccctcgccgccaggcgcgccgcggcggtggggcccgccgccgcgtcgccgctacggcgcggggggctggcggccgggtgccagccggcgcggtcgctggcgttcgcggcggccgcggacccgcggctggcgacccacgtcgcgtcgcggtgccggcaggcggcgtcgtcgtcctcgcgcgggacgcgcgccgtcgccaccatggcgaagaagagcgtcggggacctcaccgccgccgacctcgaggggaagcgcgtgttcgtgcgcgccgacctcaacgtcccgctcgacgacaaccagaacatcaccgacgacacccgtgtccgcgccgccatccccaccatccagtaccttatcaagaacggtgccaaggtcatcctctccagccacctgggtcgcccaaagggtgttactcccaagtttagcttggctccccttgtaccgcgattgtctgaacttctcggcatacaggtgactaaggcagaagatgttattggaccagatgttgagaaattggtatctgaattgccaaatggtagtgttttgctccttgaaaatgttagattttacaaggaagaggagaagaatgacccagagtttgccaagaagcttgcctccttagcagatctctatgtcaatgatgcattcggaacagcccacagagcacatgcatcaactgagggagttaccaagtttttaaagccttctgtcgcaggattccttttgcagaaggagcttgactaccttgttggagctgtttcaagccctaaacgcccatttgctgccatcgtgggtggttcaaaggtgtcatccaagattggggttatcgaatcccttttggagaaatgtgatatccttcttctaggtggtggtatgatcttcacattttacaaggcacaaggactctctgttggttcttccttggttgaggaagacaaacttgagcttgcaacatctctccttgcaaaggcaaaagaaaagggtgtctcccttctgttgccatctgacgttatcattgctgataagtttgctcctgatgctaacagccaggttgttccagcatctgctattcctgatggttggatgggtctggatattggtccagattcagtcgcgtcattcagctctaccctggaaacaacacagacagtcatttggaatggacctatgggtgtcttcgaatttgacaagtttgcagtaggaactgaggctattgcaaagaagttggcagaccttagcggcaagggtgttacaaccattattggaggaggtgattctgttgccgctgttgagaaggtgggagttgcagatgttatgagccacatttcaacgggaggtggtgctagcttggagctgttggaaggaaaggaacttcctggagtcattgcacttgatgaagctgtcactgtggccgtatgaggctaagtttcattttgttgcatcttcttcatgtaccattctaaacttgctatattctactcctttctcgcacctcttcaaccactcgaaatgtaagagaccaatgttttatagagatgctggaaatcgtttgaataacttcccagcattttgtgtttgttggatataccttacctcaggaaacataattatcaataccttacgttgtttcccccagaactttctctcatcatcttttttttttcttttgctaatttgctgggtaagtatgttttatttgcgtttttttttctttggcagagaagcaaactttagggtgcctgggcagtcgactgttgaaagtagatgtatccattgaaaattagtgaatcatggcatggcaggagttcatgctggattccggaacaaacagacaccttggagattttcataatccattgtgagcatttgatcatgtatttgcatgctggatgcgcacactggattcagctcaaaattcagatgaagggtgtgcaaccagaaactgatcactgaaagtgaaacatcatcacattttatgcccatgaaatttcttcaagatatttgcattaaccatggacatttgagcattcatgtataaactcctgtcacatctatatacttcaacaaactccgcatcggatctggacgtgcagtgcttccaatgatccaatcaatgttcatcctgccgcatcagaattcagacaaacctcatcactacatttttcttctggttgtcgagccatgagttcattagtttggatcgcagattttgtggtgtcgaacgctcaaaactctcttaataaaacgtggcatatttaagccgattccagttcatcaatgcct

SEQ ID NO: 5286 - DNA, 1758 bp, Leymus cinereus x Leymus triticoides
  misc_feature (29)..(29): n is a, c, g, or t
  misc_feature (1720)..(1720): n is a, c, g, or t
tctcccacctcgctcctcctctccactcnaccctcttccctgatcccagccccaatggcgtccactgccgcgccgcccgccgccctcgtcgtccgccgcgccgcgtccgcgtctgctgccgccgcggcgccgctccggcgcgcggggctcgcggctgggtgccagccggcgcgctcgctggcgttcgcggccggcgccgacccgcgcctcgcggtccacgtcgcgtcgcgctgccgggcggcctcgtccacgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggcgccaaagtcatcctcaccagccacttgggtcgtcctaagggtgttactcctaagtttagcctggctccccttgtgccccgattatccgagcttcttggcattgaggtgaaaaaagcagaagatgttattggcccagaagttgaaaaattggtggctgacctggcaaatggtgctgttttgctcctcgaaaacgtaagattttacaaggaagaggagaagaatgagccagagtttgcaaagaagcttgcgtcattggcagatctatttgtaaacgatgcattcggaacagcccacagagcacatgcgtcgactgagggagttaccaagttcttgaagccttctgttgcaggattccttttgcagaaggaacttgactaccttgatggagctgtttcaaaccctaagcgcccatttgctgccattgtgggtggctcaaaggtgtcatccaagattggggttattgaatccctgttggagaagtgtgatatccttcttttgggtggtggtatgatcttcacattttacaaggcacaaggactctctgttggttcttccttggttgaggaagataaacttgagctggcaacatctctccttgcaaaagcaaaggcaaagggtgtctcccttttgttgccatctgacgttgtcattgctgataagtttgctcctgatgctaacagtcagaccgtccctgcatctgcaattcctgatggttggatggggctggacattggaccagattcagtcaaaacatttaatgatgctttggacacaacacagacaatcatttggaatggaccaatgggtgtctttgaatttgacaagtttgcagtaggaactgaggctgttgcaaagaagttggccgagcttagcaaaaagggtgtgacaactattattggaggcggagactccgttgcggctgttgagaaggtgggagtggctgatgttatgagccacatctcaaccggtggtggcgctagcttggagttgttggaaggaaagcagcttcctggagtcgttgcacttgatgaaggtgtcatgacgaggtcggtgaccgtatgaggctaagcttcattttgttgcatcttaattcctttcatgtaccgtcctaaacctgccatgttctcctcctcctttgctcctcttcaaccactcagaaatgtaagagaccaatgttctatagagaaatgctgggaactgtttgaataacacccccaacaatttgtgctcacttgagttgccttttctcatctcacataattagcaccagcaaatgttntatttaaaaggcaaagatggaatgatgtttgtttgttc

SEQ ID NO: 5287 - DNA, 3236 bp, Triticum aestivum
ctccaccctcccctccttcccgatcccagccccagtcccaatggcgtccaccgccgcgccgcccgccgccatcgtcgcccgccgcgccgcgtccgcgtccgtggccgccgcgccgctccggcgcgcggggctcgcggccgggtgccagccggcgcgctcgctggcgttcgcggccggcgccgacccgcgcctcgcggtccacgtcgcgtcgcgctgccgtgccgcgtccgccgcgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgatacccgcatccgcgccgccatccccaccatcaagtacctcctcagcaacggcgccaaggtcatcctcaccagccacttgggtcgtcctaagggtgttactcctaagtttagcttggctccccttgtgccacgattatccgagcttcttggcattgaggtgaaaaaagcagaagatgttatcggcccagaagttgaaaaattggtggctgacctggcaaatggtgctgttttgctcctggaaaacgtaagattttacaaggaagaggagaagaatgacccagagtttgcaaagaagcttgcttcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggcgttacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgtccgtatgaagctaagcttcattttgtcgcatcttaattcctttcatgtaccgttttaaacctgccatgttgtcctccctcttttgctcgtcttcaaccactcgaaatgtaagagaccaatgttttatagagaaatactgggaactgtttgaataacaccccccagcaatttgtgctcacttgagttgccttttctcagctcacataattagcaccagcaaatgtttcatttataaggcaaagatggaaggatgttggttgaggatgtttgatttttgtcttgttttgttttcctttccaaagcaaactttagaggtgtcgaagatgcactttgtggatgtctgttgtgatcagcagtaaaaaattcggttcatgtcgaagttcaccatggaacaagcagacatgctcaccttccatttccaatttcagcataaatttgacggaccaacagagtgctgaagctgaccattgaaagcatcagcgcattttgtttgttgtaagaatgtcttattggtggaaattcttcagaaacatttcatttggggtttggccatgtcaggctttacacacaaacttactgcatatatggatttcgacgatcgacagttcagcatcatgaagagcgatatcacaaaggtgtttcttcattgtgggcactttctgcctccatgcatgcccagtaattctcatatttaacaccacacaagaatgcaaccaactcagcgtgcaattttaccacctggctccatgatatctcaaaatttaggtttagctcatgaaaatataccgcaaatgatagacaatacaagctcaaagggtatgtcatacatcaccctagaccaaggtacaagatggccacagaagtgcataaacagtactacagatatcgcagatcaaaatgtttatatctagcccaaaagaagcagtctaagatgcaggagaaataaattaaaaggtgataaatatatgtatactgaggaacaccagcaatcctaatggtacaaaagtttatgctaaaaggaagccctgacaaaagagctcacgtcacgtctcattagactcgttagaagcctcgttgaaagacgaggcgaggtattctgccagactcaatcctgatgttggatttgatattgttcggccttgattaggtgtctcctttttgcgcaatgactctggaagccaggacttggcaccatcgatgggtttcagtatgctgccaacgataggctgcaagccctgccaaggatcatcaaccatggacttcctgtagaagttcctctgatcttgcgatccagaatggttctggaagccaccccttccccctcttcctctcgaacctgggctgtggtagtagttctcacccctgccacgtccggaagacgagtgcgggctacctcttggtacataactcctcgggcttcctcttggttcgtaactcatcgggctaccccctggtccgtaattcatcgggttacctcttggtccgtaattcatcgggctacctcctggtccataattcatcgggctgccccctcggccaacattagggcctctgaacccaaagttgggttgatgtggatacggatcttgagctggagaagcagaatgtgggttccagtgaggtggaggtccaggaggtgttcctcggtatccagacataggagtctggaactgcataggacttctccatggactattccctggcgcaccttccatcggagattgggccatatggtgctggtgtggaggaggataattg

SEQ ID NO: 5288 - DNA, 1658 bp, Leymus cinereus x Leymus triticoides
  misc_feature (709)..(709): n is a, c, g, or t
cccaatggcgtccactgccgcgccgcccgctgccctcgtcgcccgccgcgccgcgtccgcgtccgccgcgtccgcgtccgccgccgccgcgccgctccgccgcgcggggctcgcggccgggtgccagccggcgcgctcgctggcgttcgcggccggcgccgacccgcgcctcgcggtccacgtcgcgtcgcgctgccgggcggcctcgaccgcgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggtgccaaggtcatcctcaccagtcacttgggtcgtcctaagggtgttacccctaagtttagcttggctccccttgtgccacgattatctgagcttcttggcatcgaggtgaaaaaagcagatgatgttattggcccagaagttgaaaaattagtggctgacctggcaaatggtgctgttttgctcctagaaaatgtaagattttacaaggaagaggagaagaatgagccagagtttgcaaagaagcttgcgtcattggcagatctgtttgtaaacgatgcattcggaacagcccacagagcacatgcntcgactgagggggttaccaagttcttgaagccttctgttgctggattccttttgcaaaaggaacttgactaccttgatggagctgtttcaaaccctaagcgcccatttgctgccattgtgggtggctcaaaggtgtcatccaagattggggttatcgaatccctgttggagaagtgtgatatccttcttttgggtggtggtatgatcttcacattttacaaggcacagggactctcagttggttcttccttggttgaggaagataaacttgagctggcaacatctctccttgcaaaagcaaaggcaaagggtgtctcccttttgttgccatctgacgttgtcattgctgataagtttgctcctgatgctaacagccagaccgtcgctgcatctgcaattcctgatggttggatggggctggacattggcccagattcagtcaaaacatttaatgatgctttggacacaacacagacaatcatttggaatggtccaatgggtgtctttgaatttgacaagtttgcagtaggaactgaggctgttgcaaagaagttggccgaacttagcaaaaagggtgtgacaactattattggaggcggagactctgttgcggctgttgagaaggtgggagtggctgatgttatgagccacatctcaactggtggtggcgctagcttggagttgttggaaggaaagcagcttcctggagtcgttgcacttgatgaaggtgtcatgacgaggtcggtgaccgtatgaggctaagcttcattttgttgcatcttaattcctttcatgtaccgttctaaacctgccatgttctcctccctcctttgctcctctacaaccactcgaaatgtaagagaccaatgttttatagagaaatgctgggaactgtttgaataacacccccaacaatttgtgctcacttgagttgccttttctcatctca

SEQ ID NO: 5289 - DNA, 1735 bp, Triticum aestivum
cggcacgaggccctcctgatcccagccccagccccaatggcgtccaccgccgcgccgcccgccgccctcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggcgccaaggtcatcctcaccagccacttgggtcgtcctaagggtgttactcctaagtttagcttggctccccttgtgccacgattatccgagcttcttggcattgaggtgaaaaaagcagaagatgttatcggcccagaagttgaaaaattggtggctgacctggcaaatggtgctgttttgctcctggaaaacgtaagattttacaaggaagaggagaagaatgacccagagtttgcaaagaagcttgcatcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgaccgtatgaggctaagcttcattttgtcgcatcttaattcctttcatgtaccgttctaaacctgccatgttgtcctccctcttttgctcgtcttcaaccactcgaaatgtaagagaccaatgttttatagagaaatactgggaactgtttgaataacaccccccagcaatttgtgctcacttgagttgccttttctcagctcacataattagcaccagcaaatgttttatttataaggcaaagatggaatgatgttggttgagga

SEQ ID NO: 5290 - DNA, 2522 bp, Brachypodium distachyon
caaggcaccaatccccccaaacgtctccatcgccgtgatcgccgccgcctccctcccccacacagccaccgcagccatcgtcccgacctctcaccagcgataagcaaatccgcctcccctttctcccgtccacaaaaccccctttctttacgaccccctgcccccttcccttccttcccggctcccacctcactcgctcgcgcacgcatctccggttctccccccccgcccccagcagaggctccgtccgaaaacccaaatggcgtccacggccgcctcacccgccgccctcgtcgccgcgcgccgcgccgcgtcgtcggccgcctcgccgctccgccgggccgggctcgcggccgggtgccaaccggcgcggtcgctggcgttcgcggccggcggcggcgccgacccgcggctcgcgatccacgtcgcctcgcgctgccgcgcggcgtcgtccgcccgcgggacgcgcgccgtggccaccatggcgaagaagagcgtcggcgacctcggccccgccgatctcgaggggaagcgcgtgctcgtgcgggccgacctcaacgtgccgctcgacgacagccagaacatcaccgatgacacccgtatccgcgccgccatccccaccatcaagtacctcctcagcaacggcgccaaggtcatcctcaccagccacttgggtcgccctaagggtgttactcctaagtttagtttagccccccttgtgccaagattatccgagcttcttggcatacaggtgcaaaaagcagatgatgttattggcccagaagttgaaaaattggtggctgccctgccaaatggtgctgttttgctcctcgagaatgtaaggttttacaaggaagaggagaagaatgagccagagtttgcaaagaagcttgctgcactagcagatctttacgttaacgatgctttcggaacagcccacagagcacatgcatcgactgagggagttaccaattttttgaagccttctgttgcagggttccttttgcagaaggaacttgactaccttgatggagctgtttcaaaccctaagcgcccgtttgctgccatcgtgggtggctcaaaggtgtcatccaagatcggggttatcgaatccctgttggagaagtgtgatatccttcttttgggcggtggtatgatcttcacattttacaaggcacaaggactctctgttggttcttccttggttgaggaagataaacttgagctggcaacatctctcctcgctaaggcaaaagaaaagggtgtctcccttttgttgccatctgatgttgtcattgctgataagttcgcccctgatgctaacagccagactgtggcagcatctgctattcctgatggttggatggggctggacattggcccagactcagttgcaacattcaacgcggcgctggagacaacacagacaatcatttggaatggaccaatgggtgtctttgaatttgacaagtttgcagtaggaactgaggccgttgcaaagaagttggccgagcttagcaaaaagggtgttacgactatcattggaggcggagactctgttgcggctgttgagaaggtgggggttgctgatgttatgagccacatctcgacgggaggtggtgctagcttggagttgttggaaggaaagcaacttcctggagtcgttgcattggatgaagctgtcactgtgggatccgtgaccgtatgaggctaagcttcattttgttgcatcttcttttttccatgcattgttctgaagtctcctcctccgtcacacctctaaaatcactcgatgtaagacaccaatgctttatagagaaatactgggaactgtttgaataaaccccacaccaatttgtgtttacttgtgctatcctttctaacaaaattagcacaagcaaacgtcttaatgtcagtcaaatgtaatgttgccttggttcagctttctgtgcctgtacctgctttgttcttgcataacaataaggatgtttgattttcgttgtcttctcttttccagggaagcaaactctagagtgtagattgtcgggaggtatatgcattttatggagattttctatgatcagtattcagtaggagttactgggtcatggcatgctgaattgctgaggttcaggctggaatatctagcttgggtgctccgtagcccttgtgagcactactgaaataaaatcagcacaaaacttacagaccaactgattgctgaagtgactgaaaacattgcgtatttcctcttcagagcaaaatatcagtgtgtaggaaattgttgcatgttcattttgagctgtcgtaaacaattaaaatcatcatatgtttgttcttgtgaaatgctatttacgactaaattgttcaggatattccatttggagttagacatgccagccgccggccagaggattggaggttattcgtgctgcggtatcagacaatttttctgctttcattcgtcaaagccttctagctaattttcatagatatacttatggttcggaaaactccattcg

SEQ ID NO: 5291 - DNA, 1681 bp, Brachypodium distachyon
tcccacctcactcgctcgcgcacgcatctccggttctccccccccgcccccagcagaggctccgtccgaaaacccaaatggcgtccacggccgcctcacccgccgccctcgtcgccgcgcgccgcgccgcgtcgtcggccgcctcgccgctccgccgggccgggctcgcggccgggtgccaaccggcgcggtcgctggcgttcgcggccggcggcggcgccgacccgcggctcgcgatccacgtcgcctcgcgctgccgcgcggcgtcgtccgcccgcgggacgcgcgccgtggccaccatggcgaagaagagcgtcggcgacctcggccccgccgatctcgaggggaagcgcgtgctcgtgcgggccgacctcaacgtgccgctcgacgacagccagaacatcaccgatgacacccgtatccgcgccgccatccccaccatcaagtacctcctcagcaacggcgccaaggtcatcctcaccagccacttgggtcgccctaagggtgttactcctaagtttagtttagccccccttgtgccaagattatccgagcttcttggcatacaggtgcaaaaagcagatgatgttattggcccagaagttgaaaaattggtggctgccctgccaaatggtgctgttttgctcctcgagaatgtaaggttttacaaggaagaggagaagaatgagccagagtttgcaaagaagcttgctgcactagcagatctttacgttaacgatgctttcggaacagcccacagagcacatgcatcgactgagggagttaccaattttttgaagccttctgttgcagggttccttttgcagaaggaacttgactaccttgatggagctgtttcaaaccctaagcgcccgtttgctgccatcgtgggtggctcaaaggtgtcatccaagatcggggttatcgaatccctgttggagaagtgtgatatccttcttttgggcggtggtatgatcttcacattttacaaggcacaaggactctctgttggttcttccttggttgaggaagataaacttgagctggcaacatctctcctcgctaaggcaaaagaaaagggtgtctcccttttgttgccatctgatgttgtcattgctgataagttcgcccctgatgctaacagccagactgtggcagcatctgctattcctgatggttggatggggctggacattggcccagactcagttgcaacattcaacgcggcgctggagacaacacagacaatcatttggaatggaccaatgggtgtctttgaatttgacaagtttgcagtaggaactgaggccgttgcaaagaagttggccgagcttagcaaaaagggtgttacgactatcattggaggcggagactctgttgcggctgttgagaaggtgggggttgctgatgttatgagccacatctcgacgggaggtggtgctagcttggagttgttggaaggaaagcaacttcctggagtcgttgcattggatgaagctgtcactgtgggatccgtgaccgtatgaggctaagcttcattttgttgcatcttcttttttccatgcattgttctgaagtctcctcctccgtcacacctctaaaatcactcgatgtaagacaccaatgctttatagagaaatactgggaactgtttgaataaaccccacaccaatttgtgttt

SEQ ID NO: 5292 - DNA, 1878 bp, Avena sativa
ccctctcccacccctcctctgcaccaccccagcctcctccccaatcccactcgcaatggcgtccactgccgcgccgcccgccgccctcgtcgcccgccgcgccgcatccaccgctgcgccgctccgacgcgcggggctcgcggccgggtgccagcctgcgcggtcgctcgcgttcgcggccagcggcgccgccggcgccgacccgcgcctcgcgatccacgtcgcctcgcgctgccgcgccgcgtcgtccgcgcgcgggacccgcgccgtcgccaccatggcgaagaagagcgtcggggacctcggcgccgccgagctcgaggggaagcgcgtgctcgtgcgggccgacctcaacgtgccgctcgacgacgcccagaacatcaccgacgacacccgtatccgcgccgccatccccaccatcaagtacctcctcgagaagggcgccaaggtcatcctctccagccacttgggtcgcccaaagggtgtcactcccaagtttagcctggccccccttgtgccaagattgtccgagcttctcggcattacggtgacaaaagcagatgatgttatcggcccagaagttgagaaacttgtggctgccctgccaaacggttctgttttgctcctcgagaacgtgaggttctacaaggaagaggaaaagaacgagcctgagttcgcaaagaagcttgctgcactagcagatctttacgtaaacgatgcgttcggaacagcccacagagcacatgcgtccactgagggagttaccaagtttttgaagccttctgttgcaggattccttttgcagaaggaacttgactaccttgatggagctgtttcaaacccgaagcgcccatttgctgccatcgttggtggctcaaaggtgtcatccaagattggggttattgaatccctgttggagaagtgtgatatccttcttttgggcggtggtatgatcttcacattttacaaggcacaagggctctctgttggttcttccttggttgaggaagataaacttgagctagcaacatctctccttgcaaaggcaaaagcaaagggtgtctcgcttttgttgccatctgacgttgtcattgctgacaagtttgctcctgatgctaacagccagacggtcgcagcatctgcaattcctgatggttggatggggctggacattggcccagattcagtcaaaacatttaatgatgccctggagacaacacagacagtcatttggaatggaccaatgggtgtctttgaatttgacaagtttgcagttggaactgaggctgttgcaaagaagttggctgagcttagcaagaagggtgttacaactattattggaggcggagactccgtggcggctgttgagaaggtgggagtggctgatgtcatgagccacatctcaacgggaggtggtgctagcttggagttgttggaaggaaagcagcttcctggagttgttgcacttgacgaagctgttgccgtgaccgtatgaggctaaggctcattttgttgaatcttattgtctttcacgtaccattctgaactgtgccattgccctcctccttcgcaactcttcgaccgctcgaaatgtaagagtccaatgttctatagagaaagtactgggaactgtttgaataacaccccgaacaatttgtgctcacttgagctaccctttctcagttgacattattgacgtttaaaatggtaaagatggaatgaggcttgctggttccctcagaattcctgtgtaagcaccaactttgacattttgctgtaaggatgtctgatttatgttttcttttgttttccaaagaagcaaactttagagatgttgactgttgggaaaaagatgcgcattgggatcgttgattgtcg

SEQ ID NO: 5293 - DNA, 2083 bp, Triticum aestivum
ctccacccgcccctccctcctgatcccagccccagccccaatggcgtccaccgccgcgccgcccgccgccctcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtgggcgacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcagcaacggcgccaaggtcatcctcaccagccacctgggtcgtcctaagggtgttactcctaagtttagcttggctccccttgtgccccgattatccgagcttcttggcattgaggtgaaaaaagcagaagatgttatcggcccagaagttgagaaattggtggctgacctggcaaatggtgctgttttgctcctggaaaacgtaagattttacaaggaagaggagaagaatgacccagagtttgcaaagaagcttgcgtcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccatttgctgccattgtgggtggctcaaaggtgtcatccaagattggggttatcgaatccctgttggagaagtgtgacatccttctttggttggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgaccgtatgaggctaagcttcatttgttgcatcttaattcctttcatgtaccgttccaaacctgccatgttgtcctccctcttttgctcgtcttcgaccactcgaaatgtaagagaccaatgttttatagagaaatactgggaactgtttgaataacacccccagcaatttgtgctcacttgagttgccctttcttagctcacataattagcaccagcaaatgttttatttataaggcaaagatggaatgatgttggttgaggatgtttgatttttgtcttgttttgttttcctttccaaagcaaactttagaggtgtcgaagatgcactttgtggatgcctgttgcgatcagcagtaaaaaattcggttcatgtcgaagttcaccatggaacaagcagacatgctcaccttccatttccaatttcagcataaatttgacggaccaacagagtgctgaagctgaccattgaaagcatcagcgcacgtttgtttgttgtaagaatgtcttattggtggaaattcttcagaaacatttcatttggggtttggccatgtcaggctttatacacaaacttactgcatatatggatttcgacgatcgacagttcag

SEQ ID NO: 5294 - DNA, 1741 bp, Hordeum vulgare
accaccaccaccccaccctcctcctcctcctcccctgatcccgctcccaatggcgtccaccgccgcgcagcccgccgccctcgtcgcccgccgcgtcgcgtccgcggccgcgccgctgcggcgcgcggggctcgcggccgggtgccagccggcgcgctcgctggcgttcgcggccggcgccgacccgcgcctcgcggtccacgtcgcgtcacgctgccgggccgcctcggccgcgcgcggggcccgcgccgtcgccaccatggccaagaagagcgtcggcgacctcaccgccgccgacctcgagggcaagcgcgtgctcgtgcgggccgacctcaacgtgccgctcgacgacaaccagaacatcaccgacgacacccgcatccgcgccgccatccccaccatcaagtacctcctcaccaacggcgccaaggtcatcctcaccagccacttgggtcgtcctaagggtgttactcctaagtttagcttggctccccttgtgcccagattgtccgagcttcttggtattgaggtgaaaaaagcagatgatgttattggcccagaagttgaaaagttggtggctgacctggcaaatggtgctgttttgctcctcgaaaatgtaagattttacaaggaagaggagaagaacgatccagagtttgcaaagaagcttgcttcgctggcagatctgtttgtaaacgatgcattcggaacagcccacagagcgcatgcgtcgactgagggagttaccaagttcttgaagccttctgttgcgggattccttttgcagaaggaacttgactaccttgatggagctgtttcaaaccctaagcgcccatttgctgccattgtgggtggctcaaaggtgtcatccaagattggggttattgaatccctgttggagaagtgtgatatccttcttttgggtggtggtatgatcttcacattttacaaggcacaaggactatcagttggttcttccttggttgaggaagataaacttgagttggcaacatctctgcttgcaaaagcaaaggcaaagggtgtctcccttttgttgccatctgatgttgtcattgctgataagtttgctcctgatgctaacagccagaccgtggcagcatctgcaattcctgatggttggatggggctggacattggcccagattcagtcaaaacatttaatgatgccctggacacaacacagacaatcatttggaatggaccaatgggtgtctttgaatttgacaagtttgcagtaggaacggaggctgttgcaaagaagttggccgagcttagcaaaaagggtgtgacaactattattggaggcggagactccgtcgcggctgtcgagaaggtgggagtggctgatgttatgagccacatctcaactggtggtggcgctagcttggagttgttggaaggaaagcagcttcctggagtcgttgcacttgatgaaggtgtcgtgacgagctcggtggccgtatgaggctaagcttcattttgttgcatcttaattcctttcatgtacggttccaaacctgccatgttctcctccctcctttgctcttcaaccactcgaaatgtaagggaccaatgttttatagagaaatgctgggaactgtttgaataataaccccccaacaatttgtgcccacttgagttgccttttctcagctcacataattagcaccagcaaatgttttatttaaaaggcaaagatggaacgaatgtttgtttgctc

SEQ ID NO: 5295 - DNA, 1732 bp, Triticum aestivum
tcgtcgcccgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgtgccgcgtccgccgcgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtaccttctcagcaacggcgccaaggtcatcctcaccagccacttgggtcgtcctaagggtgttactcctaagtttagcttggctccccttgtgccacgattatctgagcttcttggcattgcggtgaaaaaagcagaagatgttatcggcccagaagttgaaaaattggtggctgacctggaaaatggtgctgttttgctcctggaaaacgtaagattttacaaggaagaggagaagaatgacccagagtttgcaaagaagcttgcatcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgacatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgccagcttggagttgttggaaggaaaggagcttcctggagtcgttgcacttgatgaaggtgtcatgacgaggtcggtgaccgtatgaggctaagcttcatttgttgcatcttaattcctttcatgtaccgttccaaacctgccatgttgtcctccctcttttgctcgtcttcgaccactcgaaatgtaagagaccaatgttttatagagaaatactgggaactgtttgaataacacccccagcaatttgtgctcacttgagttgccctttcttagctcacataattagcaccagcaaatgttttatttataaggcaaagatggaatgatgttggttgaggatgtttgattttttgtcttgtttgtttcctttccaaagtcaaactttgaaggtgtcgaagatagaac

SEQ ID NO: 5296 - DNA, 2009 bp, Triticum aestivum
cgccgcgccgcgtccgcgtccgtcgccgcgccgctccggggcgcggggctcgcggccgggtgccagccggcgcgctcgctggcgttcgcggccggcgccgacccgcgcctcgcggtccacgtcgcgtcgcgctgccgtgcggcgtccgccgcgcgcgggacccgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtaccttctcagcaacggcgccaaggtcatcctcaccagccacttgggtcgtcctaagggtgttactcctaagtttagcttggctccccttgtgccacgattatctgagcttcttggcattgcggtgaaaaaagcagaagatgttatcggcccagaagttgaaaaattggtggctgacctggaaaatggtgctgttttgctcctggaaaacgtaagattttacaaggaagaggagaagaatgacccagagtttgcaaagaagcttgcatcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgctagcttggagctgttggaaggaaaggagctgcctggagtcgttgcacttgatgaaggtgtcatgacgaggtcggtgaccgtatgaggctaagcttcattttgtcgcgtctcaattcctttcatgtaccgttctaaacctgccatgttgtcctccctcctttgctcgtcttcaaccactcgaaatgtaagagaccaatgttttatagagaaatactgggagctgtttgaataacaccccccagcaatttgtgctcacttgagttgccttttctcagctcacataattagcaccagcaaatgttttattataaggcaaagatggaatgatgttggttgaggatgttcgatttttgtcttgctttgttttcctttccaaagcaaactttagaggtgtcgaagatgcactttgtggatgtctgttgtgatcagcagtaaaaaattcggttcatgtcgaagttcattgtggaacaagcaggcatgctcaccttccatctccaatttcagcataaatttgacggaccaacagagtgctgaagctgaccattgaaagcatcagcgcattttgtttgttgtaagaatgtcttattggtggaaattcttcagaaacatttcatttggggtttggccatgtcaggctttacacacaaacttactgcatatatggatttcgacgatcgacagttcagcatc

SEQ ID NO: 5297 - DNA, 1518 bp, Pennisetum glaucum
ggacgcgcggcttgcggtccacgtcgcgtcgcggtgccggcaggaggcgtccgcgcgcgggacccgcgccgtggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgcgccgccgtccccaccatccagtacctcatcagcaagggcgccaaggtcatcctctccagccacttgggtcgccccaagggtgttactcccaagtttagcttagctcccatcgtgccacggctgtctgagcttcttggcattcaggtgcaaaaagctgacgatgttattggccctgaggttgagaaattggtgtcttccttgcccaacggtagtgttgcgctccttgagaatgtaagattttacaaggaagaggagaagaatgacccagagtttgcacagaagcttgcctccctagcagatctttatgttaatgatgcatttggaacagcccacagggcacatgcatcaactgagggagttaccaagttcttgaagcctgctgttgcagggttccttttgcagaaggagcttgactaccttgttggagctgtttcgagccctaaacgtccatttgctgccatcgtgggtggctcaaaggtgtcatccaagatcggggttattgagtccctattagaaaagtgtgacatcctacttttgggtggtggtatgatctttacattttacaaggcacaagggctttctgttggtgcttcattggttgaggaagacaaacttgagctcgcggcatctctccttgcaaaggcaaaggaaaagggtgtctcccttatgttgccaactgatgtcgtcattgctgataagtttgcacctgatgcaaacagccagattgttccagcatctgcgattcctgatggttggatggggctggacatcggtccagattctgttgcttcgttcaatgcagccctggatacaacccagacagccatctggaacgggcccatgggtgtttttgaattcgacaagtttgctgtaggaactgaggctgtcgcgaagaagttggccgagcttagcggcaagggtgtcacaaccatcattggaggtggagactctgttgcagctgtcgagaaggtgggagtagctgatgttatgagccacatttcaacgggaggtggtgccagtttggaattgttggaaggaaaggagcttcctggagttgttgcgttggatgaagccgttgtgactgtaagctaagttttcattttgtaccaccttcatcttcgttactgatgtaaacttggtacattcttgctttttgctcctcgtcagccgctcgacatgtaagagatcaatgctttatagagctactggaaattgttttaataactacaaaaataattacctgggtcatgaactaaaccctaaagggcactagagcctatgtgtatttgtctattggttacttgggagctttt

SEQ ID NO: 5298 - DNA, 1997 bp, Triticum aestivum
ccgcgccgctccggcgcgcggggctcgcggccgggtgccagccggcgcgctcgctggcgttcgcggccggcgccgacccgcgcctcgcggtccacgtcgcgtcgcgctgccgggcggcgtccgccgcgcgcgggacacgcgccgtcgccaccatggccaagaagagcgtcggggacctcaccgccgccgacctcgagggcaagcgcgtgctcgtgcgggccgacctcaacgtgccgctcgacgacaaccagaacatcaccgacgacacccgcatccgcgccgccatccccaccatcaagtaccttctcagcaacggcgccaaggtcatcctcaccagccacttgggtcgtcctaagggtgttactcctaagtttagcttggctccccttgtgccacgattatctgagcttcttggcattgcggtgaaaaaagcagaagatgttatcggcccagaagttgaaaaattggtggctgacctggaaaatggtgctgttttgctcctggaaaacgtaagattttacaaggaagaggagaagaatgacccagagtttgcaaagaagcttgcatcactggcagatctgtttgtaaacgatgcattcggaacagcccacagagcacatgcctcgactgagggagttaccaagttcttgaagccttctgttgctggattccttttgcagaaggaacttgactacctggatggagctgtttcaaaccctaagcgcccattcgctgccattgtgggtggctcaaaggtgtcgtccaagattggggttatcgaatccctgttggagaagtgtgatatccttcttttgggtggtggtatgatcttcacattttacaaggcacaaggactctcagttggttcttccttggttgaggaagataaacttgagctggcaacatctctccttgcaaaggcaaaggcaaagggtgtctcccttctgttgccatctgacgttatcattgctgataagtttgctcctgatgctaacagtcagaccgtccctgcatctgcaattcctgatggttggatggggctggacattggcccagattcagtcaaaacatttaatgatgccctggacacaacacagacaatcatttggaacggaccaatgggtgtctttgaatttgacaagtttgcagtaggaactgagtctattgcaaagaagttggccgagcttagcaaaaagggtgtgacaactatcattggaggcggagactccgttgcggctgttgagaaggtgggagtggctgatgttatgagccacatctcaactggtggtggcgctagcttggagctgttggaaggaaaggagctgcctggagtcgttgcacttgatgaaggtgtcatgacgaggtcggtgaccgtatgaggctaagcttcattttgtcgcgtctcaattcctttcatgtaccgttctaaacctgccatgttgtcctccctcctttgctcgtcttcaaccactcgaaatgtaagagaccaatgttttatagagaaatactgggagctgtttgaataacaccccccagcaatttgtgctcacttgagttgccttttctcagctcacataattagcaccagcaaatgttttatttataaggcaaagatggaatgatgttggttgaggatgttcgatttttgtcttgctttgttttcctttccaaagcaaactttaaaggtgtcgaagatgcactttgtggatgcctgttgcgatcagcagtaaaaaattcggttcatgtcgaagttcaccatggaacaagcagacatgctcaccttccatttccaatttcagcataaatttgacggaccaacagagtgctgaagctgaccattgaaagcatcagcgcattttgtttgttgtaagaatgtcttattggtggaaattcttcagaaacatttcatttggggtttggccatgtcaggctttacacacaaacttactgcatatatggatttcgacgatcgacagttcagaatcatgaagagcgat

SEQ ID NO: 5299 - DNA, 1589 bp, Pseudoroegneria spicata
  misc_feature (12)..(12): n is a, c, g, or t
cgccgccgcgcngttccggcgcgcggggctcgcggccgggtgccagccggcgcgctcgctggcgttcgcggccggcgccgacccgcgcctcgcggtccacgtcgcgtcgcgctgccgggcggcgtcctccgtgcgcgggacccgcgctgtcgccaccatggcgaagaagagcgtcggggacctcaccgctgccgacctcgagggcaagcgcgtgctcgtgcgggccgacctcaacgtgccgctcgacgacaaccagaacatcaccgacgacacccgcatccgcgctgccatccccaccatcaagtacctcctcagcaacggcgccaaggtcatcctcaccagccacttgggtcgtcctaagggtgttactcctaagtttagcttggctccccttgtgccacgattatccgagcttcttggcattgaggtgaaaaaagctgatgatgttattggcccagaagtcgaaaaattggtggctgaactggcaaatggtgccgttttgctccttgaaaatgtaagattttacaaggaagaggagaagaacgagccagagtttgcaaagaagctcgcgtcacttgcagatctgtttgtaaatgatgcattcggaacagcccacagagcacatgcgtcgactgagggagttactaagttcttgaagccttctgttgctggatttcttttgcagaaggaacttgactaccttgatggagctgtttcaaaccctaagcgcccatttgctgccattgtgggtggctcaaaggtgtcatccaagattggggttattgaatccctgttggagaagtgtgatatccttcttttgggtggtggtatgatcttcacattttacaaggcacaaggactctcagttggttcttccttggttgaggaagataaacttgagctggcaacatctctccttgcaaaagcaaaggaaaagggtgtctcccttttgttgccatctgacgttgtcattgctgataagtttgctcctgatgctaacagccagaccgtccctgcatctgcaattcctgatggttggatggggctggacattggcccagattcagtcaaaacatttaatgatgccctggacacaacacagacaatcatttggaatggaccaatgggtgtctttgaatttgacaagtttgcagtaggaactgaggctattgcaaagaagttggccgagcttagcaaaaagggtgttacaactattattggaggcggagactcggttgcggctgttgagaaggtgggagtggctgatgttatgagccacatctcaactggtggtggcgctagcttggagttgttggaaggaaagcagcttcctggagtcgttgcacttgatgaaggtgccatgatgaggtcggtgaccgtatgaggctaagcttcattttgttgcatcttaattcctttcatgtaccgttctaaacctgccatgttgtcctccctcctttgctcgtcatcaaccactcgaaatgtaagagaccaatgttttatagagaaatactgggaactgtttgaataacaccccaacaatttgttcacttgagttatcttttgtcagcttcacattatttgcatca

SEQ ID NO: 5300 - DNA, 1681 bp, Saccharum officinarum
cgccaacctccctctccctcgcggcccgcgcggccaccagggcagccaccgccgccgccgccgccccgctgcgcaggggaggcctcgccgcggcgtgccagccggcgcggtcgctggcgttcgcggcgggcgacgcgcggctcgcggtccacgtggggtcgcggtgccggcaggcgtcctccgcgcgcggcacgcgggccatggccaccatggcgaagaagagcgtcggggacctcacggaggccgacctcgaggggaagcgcgtcttcgtgcgagccgacctcaacgtgccgctcgacgagaaccagaacatcaccgacgacacccgcatccgggccgccgtccccaccatccagtacctcctcagcaagggcgccaaggtcatcctctcaagccacttgggtcgccctaagggttttacacccaagtttagcttaggtcccattgtaggacggttgtctgagcttcttggcattcaggtgcaaaaagccgacgatgttattggccctgaagttgagaagctggtgtccgccttgcccaatggtggggttttgctccttgagaacgtaagattctacaaggaagaggagaagaatgacccagagtttgcacagaagcttgcctccctagcagatctttatgtcaatgatgcatttggaacagcccacagggcacatgcatcaactgagggagttaccaagtttttgaagccttctgttgcagggttccttttgcagaaggaacttgactaccttgtcggagctgtttcaagcccgaaacgcccatttgctgccatcgtgggtggttcaaaggtgtcatccaagattggggttattgaatccctgttggaaaagtgtgatatccttctcttgggtggtggtatgatcttcacattttacaaggcacaaggtctctctgttggtgcttcattggttgaggaagacaaacttgatcttgcaacatctctccttgcaaaggctaaggaaaagggtgtctcccttttgttaccagctgatgttgtcattgctgataagtttgcccctgatgctaacagccagattgttccagcatctgcaattcccgatggttggatggggctggatattggcccagacgctgttacttcattcaacgcagccctggatacatgccagacagtcatctggaacgggcccatgggtgttttcgaatttgacaagttcgctgtaggaactgaggctgtggcaaagaagttggcagaacttagcaccaagggtgtcacaactatcattggaggtggagactctgtcgccgcagttgagaaggtgggagttgctgacgttatgagccacatttccactggaggtggtgccagcttggaattgttggaaggaaaggagcttccgggagttgtcgcattggatgaagccgtccctgtggctgtatgaagcaagctttcattttgtttcatcttcatcttcacgtgccattgtatacttgctacattcttgcttgctcctcgtcagccgctctaaatgtaagcgatcaatgtgtttatagagctactggaaatcgtttgaacaacaaaacaaataatatgtgcttactgagtcatctttcctcggtatgaggattgaatgattgcgcgcgcgtggtgtcgtagcccgcaattccggaccggtgctgcaggtgcaagcgtctc

SEQ ID NO: 5301 - DNA, 1438 bp, Panicum virgatum
cgcgtcgcggtgccgccgggcgtcgtccgcgcgcgggacccgcgccatggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgcgccgccgtccccaccatccagtacctcatcggcaagggcgccaaggtcatcctctccagccacttgggtcgccctaagggtgttactcccaagtttagcttagctcccattgtaccacggctgtctgagcttcttggtattcaggtgcaaaaggctgacgatgttattggccctgaagttgagaaattggtgtctgccatgcccaatggtagtgttacgctcctcgagaacgtaagattttacaaggaagaggagaagaatgacccagagttcgcgcagaagcttgcctcccttgcagatctttatgttaatgatgcatttggaacggcccacagggcacacgcatcaactgagggagttaccaagttcttgaagccttctgttgcagggttccttttgcagaaggagcttgactaccttgttggagctgtttcaagccctaaacgtccatttgctgccatcgtgggtggctcaaaggtgtcatccaagatcggagttattgaatccctgttggaaaagtgcgatatccttcttttgggtggtggtatgatcttcacattttacaaggcacaaggactttctgttggttcttcattggtcgaggaagacaaacttgagctcgcaacatctctgcttgcaaaggcaaaggaaaagggtgtctcccttatgttgccaactgatgttgtcattgctgataagtttgcccctgatgctaacagccagactgttccagcatcttcaattcctgatggttggatggggctggacattggcccggattctattgcttcattcaatgcagccctggacacaacccagacaatcatctggaacgggcccatgggtgtttttgaattcgacaagttcgctgttggaactgaggctgttgcgaagaagttggcagaacttagcggcaagggtgtcacaaccatcattggaggtggagactccgttgcagccgttgagaaggtgggagttgctgatgttatgagccacatttcaacgggaggtggtgccagcttggaattgttggaaggaaaggagcttcctggagttgttgcgttggatgaagccaccactgtgactgtatgaagctaagttctcaatttgtttcaccttcatcttcgtgtaccgtgtaaacttgctacattcttgctcgctccttgtcagccgctcgaaatgtaagagatcaatgctttatagagctactggaaattgtttgaataactacacaaataatacgtgtttacctgagtc

SEQ ID NO: 5302 - DNA, 4972 bp, Oryza sativa
caaaaaaacaacggcgatcacggaaggcagcaagccccacacgtcgccgtcgcggcgatcaccgccgcctcctcccccacacaaccaccggtatcatcgacccccacctcccatcccaattcccaagttcccaacctctcgccagcgataagcaaatctccccctcccccctctcgtccacaaaaccctctttctttacgaaccccccaacccctcgtccccctcccgcctcccaccttctccgcgttccagcctccgcgcgcgctccctcgtcctcccccaatggcgtccgcggccgcgccgaccacgtcctcgctctccctcgccgccaggcgcgccgcggcggtggggcccgccgccgcgtcgccgctacggcgcggggggctggcggccgggtgccagccggcgcggtcgctggcgttcgcggcggccgcggacccgcggctggcgacccacgtcgcgtcgcggtgccggcaggcggcgtcgtcgtccgcgcgcgggacgcgcgccgtcgccaccatggcgaagaagagcgtcggggacctcaccgccgccgacctcgaggggaagcgcgtgttcgtgcgcgccgacctcaacgtcccgctcgacgacaaccagaacatcaccgacgacacccgtgtccgcgccgccatccccaccatccagtaccttatcaagaacggtgccaaggtcatcctctccagccacctgggtcgcccaaagggtgttactcccaagtttagcttggctccccttgtaccgcgattgtctgaacttctcggcatacaggtttctgcgttactgttatttctaattgaatctttacgggctaatttgatcacactgattaaaccatatttgtattcgcaaacaggtgactaaggcagaagatgttattggaccagatgttgagaaattggtatctgaattgccaaatggtagtgttttgctccttgaaaatgttagattttacaaggaagaggagaagaatgacccagagtttgccaagaagcttgcctccttagcagatctctatgtcaatgatgcattcggaacagcccacagagcacatgcatcaactgagggagttccttttgcagaaggagcttgactaccttgttggagctgtttcaagccctaaacgcccatttgctgccatcgtgggtggttcaaaggtgtcatccaagattggggttatcgaatcccttttggagaaatgtgatatccttcttttaggtggtggtatgatcttcacattttacaaggcacaaggactctctgttggttcttccttggttgaggaagacaaacttgagcttgcaacatctctccttgcaaaggcaaaagaaaagggtgtctcccttctgttgccatctgacgttatcattgctgataagtttgctcctgatgctaacagccaggttgttccagcatctgctattcctgatggttggatgggtctggatattggtccagattcagtcgcgtcattcagctctaccctggaaacaacacagacagtcatttggaatggacctatgggtgtcttcgaatttgacaagtttgcagtaggaactgaggctattgcaaagaagttggcagaccttagcggcaagggtgttacaaccattattggaggaggtgattctgttgccgctgttgagaaggtgggagttgcagatgttatgagccacatttcaacgggaggtggtgctagcttggagctgttggaaggaaaggaacttcctggagtcattgcacttgatgaagctgtcactgtggccgtatgaggctaagtttcattttgttgcatcttcttcatgtaccattctaaacttgctatattctactcctttctcgcacctcttcaaccactcgaaatgtaagagaccaatgttttatagagatgctggaaatcgtttgaataacttcccagcattttgtgtttgttggatataccttacctcaggaaacataattatcaataccttacgttgtttcccccagaactttctctcatcatcttttttttttcttttgctaatttgctgggtaagtatgttttatttgcgtttttttttctttggcagagaagcaaactttagggtgcctgggcagtcgactgttgaaagtagatgtatccattgaaaattagtgaatcatggcatggcaggagttcatgctggattccggaacaaacagacaccttggagattttcataatccattgtgagcatttgatcatgtatttgcatgctggatgcgcacactggattcagctcaaaattcagatgaagggtgtgcaaccagaaactgatcactgaaagtgaaacatcatcacattttatgcccatgaaatttcttcaagatatttgcattaaccatggacatttgagcattcatgtataaactcctgtcacatctatatacttcaacaaactccgcatcggatctggacgtgcagtgcttccaatgatccaatcaatgttcatcctgccgcatcagaattcagacaaacctcatcactacatttttcttctggttgtcgagccatgagttcattagtttggatcgcagattttgtggtgtcgaacgctcaaaactctcttaataaaacgtggcatatttaagccgattccagttcatcaatgcctgtatcagcaattggctgctgcgccccacggcagcagaaactcggatcatgaatcggactaggaatccagtactctagtatgctcttcctcgtccgactctgacaagaagacggccctccgtttcctctatatacctggattgtcccgtgcatccacggatagccatcgcaatttggcgagcacttctcggtcgcaagaaaaacttcaaaaattctcgtgcaccggctcgattttgcagccctcgaatttcactcgacaatcgaagccctcttggtgttttcttgggttttggagaaaaaggctataaatccctgcttttgatagttaatttgttgatgttcttgcacggatcatcaagtacggcatcaaagatggcgagttggggtaagttgccgtcgatggtccatagtaaaactccccttttccttctcgatatcacttttttttatcaaactgtaattttgatccattttttgttctgacattgcccgtgcgtttctcgctgcagatgacgatgaattttccgatgaggaagaacagtctatgggaaaaaggctttgggaggacgaagacgccggcgacgacttcgccgcggtgaaggacacgtgggacgacgacgacgacgttaaacctgggaaggagacggccgccacggcggcgagcacgaaacctcctgcaaccaaagggaagaagagccaggccaacgcgaaggcgaaggcagaagcagcagacgcaacaccgagtgaaacctctacctcgaatgccgctgctgagatagctcagaagcagcctgacgacgacgaacccatcgagaagttcgtcccaaaatcggagaaggaattcgccgagtacgccgagcgcatcgcgaaagatcttcttagaccttacgaggtatttgcattctcgtctcatattcttgtccgtgaaataattgcaaggagaatttggggtctaatgtttggttgtttctttcttcgtttcagaaaagctaccattacattggtcttatgaaggcgatgaacaagctcgccgtggcgtcgctgacgtcgacgagcgtgaaggagatcgtgtcgtccatgacgacggtggccaacgagaagctcaaggccgagaaggcggccgacgccggcaagaagaagccagggcagaagaagaagaggcttcacgtcaacaaggccgaagggcaaaagtttcgtgatgctgacgacgacgacgacgacgattgtctatcatcttaactcacaaagagcctcacagtgaatgacagacctgctctgttgttctgttcttgtgtcgagatccagacttagttgatttctgttggttttaatgtcaacttagttgatttctattgttttaatgtttgatttctgatcatacataagtgttcagatgatcctttatgcctcctatcaagtacctaccatgcaaaatttgcatgcgtttcgttccaaaatatatcagctctcctctgcatcctgtgaccacaatcaccagcagataatcaactcatgatgaaaaaactggcacaaactactaccactaatacttaggtatacaaggtgaaacgatctggttcatacagcagaatcatcatggtcacgttcatacatggtacatcagggaaacaacagaaatgccacataccttagcacaaagtcagaacaggataggtcttcggagcactagaggaacgcggcgaatgtcatgttatccaaagctaaaattgcatggaggagaagagaacactaaggatcactgctgctgctgctgctgctgcacatctgatggtttgcctccactgtcagtttcatttgctttgtatcctagtccaggatgcgatggtttttcactctcgccttcaaagtcgcgagcatcccgtagcgaggcctcgaaatcagtcgaatctacggctgtgggaaggaggctgccgatgtcatcttttgctccgaaaccaccagctcgcaagacatcctcagcagagatggcagcttccatgttcacatctccagattcatgactgttgactggactcacagtaatatctgaatctgcaaaccgctgcaaggtctcctgatctcggctccgtgcatcttctgtcattgtactcttctcatgattttgtcgtctgttgcctaagttctttgcatccatgccggtctcgaggagaggcgcaaaactcagacgaagcgcgcaacggtggaagggtcaagaactcgcctcttctcgttccctctacgccgccaactcgccgaggaagaactcgctagtactactacacaccagcggctagtcctctcggattggatcgccacgtg

SEQ ID NO: 5303 - DNA, 1549 bp, Setaria italica
cggcggcgatcggcgaagatcccgccacggccttgccctgcctccgcaaaccccgccctctagcacaaccccgtcccactccatgccaatggcgtcggcggcggcgccggcctctttctccctggctcgcccggccgtccgccgggccctggcctcggccgccaccgccaccgtgaagttccgccgagcgggcctggctgccgcgtgcccgccggcgcggtcgctgggctccttttccctcggcgacggcgccgaccggcgtctgccgatccacgtcccgccgcgctgccgctcggagtcgtcggcggggcgcgaggcgcgcgccgcggcgacgatggctaagaagagcgtgggcgacctcgccgccgcggacctcgaggggaagcgcgtgctcgtgcgcgccgacctcaacgtgcccctcgacgacaggcagaacatcaccgacgacactcgcgtccgcgccgccatccccacaatcaagcacctcgttaccaatggcgccaaggtcatcctctgcagtcatctgggtcgtcctaagggtgttactgccaagtttagcttagcaccccttgtaccaaggttgtctgaacttctaggtatacaggtgcaaaaggcagatgatgttattggtccagaagttgagaaattggtgtctgaactaccaaacggtagcattttactccttgaaaatgttagattctacaaggaggaagagaagaacgacccagagtttgcgaagaagcttgcctccctagcagatctttatgtaaacgatgcctttggaactgctcacagagcacatgcgtcaactgagggagttaccaagttcttgaagccctcagttgcagggtttcttttgcagaaggagcttgattaccttgtaggcgctgtttcaaatcctaaaccaccatttgctgccattgttggtggctccaaagtatcgtctaagatcggagttatagaatcactattggcgaaatgtgacatccttcttctgggtggtggtatgatcttcacgttttacaaggcacagggattctcagtaggctcttccttggttgaagctgacaagctcgagcttgcgacctctctcctttcaaaagctaaggagaagggtgtctcccttatgttgccaactgatgtggtcgtcgccgataagtttgctcctgatgctagaagtcaggttgttccagcatctgcaattcctgatggatggatgggtctagatataggtccagattcgatttcggcattcagttctgccctggaaactactcagacagtcatttggaatggacccatgggagttttcgaattcaagaagtttgcagttggaaccgaggcaattgcaaagaagttagctgagcttagtggcaagggtgtcacaacaataattggaggtggtgactccgttgcagctgtagagaaagtaggagttgctgatgttatgagccacatttcaactgggggtggtgcgagtttggagttgctggaagggagggaactcccaggagtagttgcgctggacgaagcttagttcctgcgctgc

SEQ ID NO: 5304 - DNA, 5470 bp, Ricinus communis
cgagaaaaagaattatagttatcatttccttgcaacattttattcgacaatcatggtatgttatcagacttgtattttcaatcttgtataaaaatcctcaacaagataaaatattgtgaaccatggacaatatatagctaccaaatggtaacgtgatgagtactataacgagaatttcttatttggtgctaagaattggtcaaattttcaaatgaagctcgaagctcaggactccatcgattggaaagcttgacatgagattctgccttcattccttgtagtgccaacctattgcttatgctttcttggataaatccatagggggcgaaaagtatcatccgacaatatagaaaattgattgacatcaagtatataaatcaggattgccaagtgacaaggccgcgcagcaatagatgcctattgaatatcagttttgacttcaaaccttcagcagccaatttcctcttgccctggcaataggcataatcaagtcactcactaccaatgaaacaaacatatatgaaaaagaaaaagataaaagtagtttaccttctaggcaacagataaaaataaaattaccacttccccaacttctaaatctcacacaccagaagacatggcttcctcaattctcctaattacaacacttaaactactaccactttcaagagctttgacagctgcccgatgagcatgcctctgccattttagcaaattgtaagactgcagaaccgaccaccttgcttgatttgacatctaaaccaggcagcaacaaacgtgagcatctctccccgaaagagaaaacatcaaatcaagtacgacgttgggagctacctggtttacagataatgggggttgcaaaagaacactaatgctcctaaatagattttcatcattttctccaccctctgcctcaccataaacaagagtttcagctgcaatgccagcaaaaagaaccatgcagtacctggacatcaagacaattatcacgatacacatcacttaagttaatataagaatttaccttgcttaaccaacatactaggacataaaaaaatgtaatgcagggaaacaattaaccagttatataaatgttgttaatcatccttcggaccatttacattaagaaaaagcccaaggaaatttttttacagcaactacatggtttaccatattgtacaacatttactataagcctagcatgctactttcactatcttatgcaaacagccactttagtcttctgttttctgtttctttttcctttttttcttttttaccttaatccagataaataccactcgtcattaaaaatagtagaaaagagttggttataactctaactgcaatagatacttccctttgagctgtggccgaagaactatagatcaagtaactggaaacaggactgcacatcaaacccacctgtcaaaggtagtgccactcagtcgtccatcagcaagctcattactcaacttttcatcccaaaactgagttcctgcctagagaaatgtgataattatgattttatgatgaaatcagaatcaaatagaatttctcaaatggcatcactgaaaatgaattgcaacagatgtagataggagaaatcaaattttagaaattttcatattattaaggcgtcatataaagttagcaccagattattaagtaaagtatcatactatcaacaggataaatagaaggcttttactagtatttatcacaaagagatgacgtaatagcatgtttgctcagtaatactagaaatcagccaagcaaagagtgaaaatcttaaaaaagaatgcacagattaagcaggagtacctggccttgaatgcccatttgcatcataacaattgggtctaaaatcacaccacgaattgggcaacccataaggtatgctgcaaatgaattggacaattaatcacatgggctggcaccagactagaaattcacaagggtaattatttaagaacctcatgcaagttaaaagaaaaaagtggtcagcactgactgtgcagacataacttttgaacaaaagaggtcagaacttaatatgctagaacaactttccacatttaatattgatcttttccccaagttgcagaaaaagcactaaggttgctgaagaaaaataccatctcattgcagcatctaaacaagcaataaattacatacctaccagaagatgacctgcttcatgaactaaaatacgccgcttgaatggaggccagtaacttgagatttgagctaagcaggtaccaccaaggaaaatagagtccataaaggctagtcctagtatgactgcaaggttaggtctaatttcaatcccttgtgaaacaagaaaagatgctccacccagaaaagcaatcattgcaaatcttgaacctccagaaagaccccatttctttggagcaaatttagacactggataaccgaatgagaaaatgcttaaattaagtgatatatcacaaaaattcgagccacaataacagaacaattgaaagataatgaagcataaattctgaaacaccaagtagaagtattaaataaagcaccttctaagcccgttgaagacttgaagacagccggcgtaacatctctagggccctctaaaactgcaaattggttaatataagctgtagataatgaataagaaaaagcatgtaaaagactgcagtttgcataatagcagataccgcaactcgtatcatcacatgcaaattgagcaaaataacagctttataataataaggaactaaaaagccataaataatgtaagtgaaattaccaatgttggtaaattttccaaaattgggcaagagacctctgttcttaaggaaaccataagcactgccaacaagcctcatatcatcagcatttaaacaagtatccaaaacctcccagtccctttgtgacccctcaaacagccccaaatcactgattccgaacccagttgatgaacacccattcatcgtctcagctgaattatccttattatcactgttcgtctctgtttctctggatttcaagaaccgaagagctccagcgaggtcctttcgcttcacagcatcctcgtactcccaccattcttttagagctcttgtaatgattttgattttcttattacggaaaatggaaatttttccggaaaacagattaggggaacagagaaagtgcgggaaattttgaaggtgcaaagtagcagaagccagatccataaaaaagaaatcaatgtggaaaaacctgtgagagattccagatattttgattttcagtaagatttcaagacatatcgtttacaatttacaaattccattccagcgaaatgagttgtgatagtggacttggatacatgtaacatatgtatacatgggcttggcttcgtacataattatatttggtttgggttggtaaaggaccacagcgataaaaatgcgacccagcactgaacggagagagataataaagtacaagtagtagtagcagtaaaaacccaattataaaaagtatcgaagatcttgaacctcacctcagcgataagagaaaatccgaaatccacacacattgcccattcattcctttcttcgttcttcccgtccacatccttaatttctctctctaataagtttccctttttttcacttccatataactgttgccttcttcttcttcttttagtccacacacaattcagcttcactctctttctcccaatacaccagcagtaatggcctctgctacagcacccactaccctttctcttctcaagactactgcttcttcttcctccaccacccgggcccgcgcttcccttctccctgtttctggcctccgccccaccactcttcgccgtctcggcttcgctgctgctgaccctgctttttctcaccacgttgcatcaaaaatccgttcttttggttctggcaaggcgtccagggctgttgtctccatggctaagaagagcgttggtgatctgactgctgctgatttaaaagggaagaaggtttttgtaagggctgatttgaatgttcctttggatgataaccagaaaattactgatgatactagaattagagctgctatccctactgttaagcatttgattcagaatggggctaaagtcattctttccagtcatttgggaaggccaaaaggtgttactccaaaattcagcttggcaccacttgttccccgattatcagaactccttggcattcaggttgtgaaggctgatgattgtattggtccagaagtagaaaaattggtggcttcacttcctgaaggaggtgttcttctcctggagaatgtgaggttttacaaggaggaggaaaagaatgagcctgaatttgcgaagaagctggcttccttagcagatctctatgtgaatgatgcatttggaactgcacatagagcacatgcctcaaccgagggagttacaaaattcttaaagccttctgttgctggcttcctcttgcagaaggagctggactacctggtaggtgcagtttcaagcccaaagaggccatttgctgccattgttggtggttcaaaggtctcatcaaaaattggagttattgagtcactccttgagaagtgtgatattctgcttttgggtggaggaatgattttcacattttacaaggcacaaggcctgtcagtgggttcatccctggttgaggaagataagcttgatttggcaacatctctccttgcgaaggccaaattgaaaggagtgtctcttttgttacccactgatgtggtaattgcagacaagtttgctcccgatgcaaacagtaaggttgtggctgcctcagccatccctgatggctggatgggattggatgtcggcccagaatctgttaagacattcaatgaagctttggaaaccactaaaactgtcatctggaatggaccaatgggagtgttcgagtttgacaagtttgcagttggaacagaggctattgcaaagaagctagcagagctcagtggcaagggagtcaccacaattattggaggtggagattctgttgcagctgtagagaaagtaggagttgctgaggttatgagccacatatcaactggtggtggtgcgagcttggaattgttggaaggcaaagagcttccaggtgttcttgctcttgatgaagctacaccagttgctgtgtaaggtcaaactgatatatatatatatatttttttttgtcccacatccctgtctgatcatcatcatctgactgtggtttaaaaaaatgagaaagggttcttgtagaaaatgtgagttgatgttgtaaatttttttttcattatcataaatgcgagaggtcccaattcccgctgtttcttcatgcctaaatagacagcgaggatagagccatccaagttcttaaataaattatgaaattattcttcatttttttgtttttcaagttgcataacttatttgaatgaattgatatatatatattta

SEQ ID NO: 5305 - DNA, 1808 bp, Cleome gynandra
cctcaaatcaacgataagagaaaatcttcatatcacccaatcgtttcttcttcaccattcctctccacatcttctccttctctccctattattaacgcccttctctccctcaactctcctaaagtcaaactctttcttacatggcatccgccgccgccagcactgccctctccctcctcaaatcctctggcggcgtcgcttcctctgctgccacccgcgctcgcgcctccctcttgcccgttccctcctccgcattggccgcttcctcctctcgccgtctcggcttctccgctgtcgtcgactcccgcttctccgcccacgtcgcgtctaaagtccgctctgtgcgcgggaagggcacgaggggagtggtttccatggcgaagaagagcgtcggggacttgacctccgcggatttgaaagggaaaaaggtcttcgtgagagccgatctgaatgtacctctcgatgacaaccagaacatcaccgacgacaccagaatccgagctgccatacccaccattaagtatttgatcgagaacggcgctaaagtcattctttccagtcatctgggaaggccaaagggtgtgacgccaaagtacagcttgacccctcttgttcccaggctgtccgagctcctgggtattcaggtcgtgaaggctgatgactgtatcggtcctgaggtggaaagcctggtggcttcccttcctgaaggtggggtcctacttcttgagaatgtgaggttttacaaggaagaagagaagaatgaacctgagtttgccaagaagctcgcatccttggctgacctttacgtcaacgatgcctttgggactgctcacagagcccacgcttcaaccgagggagtcgcaaagttcttgaagccatcagttgctggtttccttctgcaaaaggagctggactacctcgatggcgcggtctcagccccaaagagaccatttgctgccattgtgggtggctctaaggtctcatccaagattggagttattgagtcgctcctcgagaagtgtgatatccttctactcggtggtggaatgatctttacattctacaaggcacaaggcctttctgttggggcgtccctcgttgaggaagacaagcttgatttggcgacatcactccttgaaaaggctaaggccaaaggagtctctcttttgttaccaacagacgtagtggtcgctgacaagtttgctcctgatgctaacagcaagattgtggcagcatcagccattcctgacgggtggatggggttggacattggtccggactcagtgaaaacattcaaccatgcgttggacagcacccagacaatcatttggaacggaccaatgggagtgttcgagtttgacaagtttgcagttggaacagaggcggtggccaagaagctggcagagctgagtgggaagggagtgacgacaatcatcggaggaggagactcagtggcggcagtggagaaagtaggagtggcgggagtgatgagccacatctccacgggcggtggtgcgagtttggagttgttggaaggcaaagaacttcccggtgttaacgccctcgaggaagcaacgcctgttgcagtctgagcctctcctcttcttcttcttctctctcccgtagcttgtgaggaaaccatctgagttgtaaatcttcagtattggccttttgggatgtgaggcctcattcacattgtaccatacatacctttctccttctttcacccatccaaactcagacttttatagagtgacacatagagctcttccaataaattcatttctttctcgcagaacaaaaaaaaa

SEQ ID NO: 5306 - DNA, 1697 bp, Festuca arundinacea
ggcacgaggcacaaagccgctttctttaccacccccaccccctctcctacctcctctccactctacccttccccaatcccagccccaatggcgtccactgccgcgccgcccgccgccctcgtcgcccgccgcgcagcagccgcatccaccgcggcgccgctccgacgcgcggggctcgcggccgggtgccagccggcgcggtcgctggcgttcgcggccagcggcgccgccggcgccgacccgcgcctcgcgatccacgtcgcatcccgctgccgcgcggcgtcgtccgcgcgcgggacccgcgccgtcgccaccatggcgaagaagagcgtcggggacctcggcgccgctgagctcgaggggaagcgggtgctcgtccgggccgacctcaacgtgccgctcgacgacaaccagaacatcaccgacgacacccgtatccgcgccgctatccccaccatcaagtacctcctcgagaagggcgccaaggtcatcctctccagccacttgggtcgccctaagggtgttactcctaagtttagcttggccccccttgtgccaagattatccgagcttcttggcattacggtgacaaaagcagacgatgttattggcccagaagttgagaagttggtggctgccctgccaaacggagctgttttgctcctcgaaaacgtcaggttctacaaggaagaggagaagaatgagcccgagtttgcaaagaagctcgctgcactagcagacctttacgtaaacgatgcattcggaacagcccacagagcccatgcatccactgagggagttaccaagttcttgaagccttctgttgcaggattccttttgcagaaggaacttgactaccttgatggagctgtttcaaaccctaagcgcccatttgctgccatcgtgggtggttcaaaggtgtcatccaagattggggttattgaatccctgttggagaagtgtgatatccttcttttgggtggtggtatgatcttcacattttacaaggcacaaggactctctgtgggttcttccttggttgaggaagataaacttgagctggcaacaactctcctggcaaaggcaaaagcaaagggtgtctcccttttgttgccatctgatgttgtcattgctgataagtttgctcctgatgctaacagccagactgttgcagcatctgcaattcctgatggttggatggggctggacattggcccagattcagtcaaaacattcaatgatgccctggacacaacacagacaatcatttggaatggaccaatgggtgtctttgaatttgacaagtttgcagttggaactgaggctgttgcaaagaagttggccgagcttagcaaaaagggtgtcacaactattattggaggtggagactccgttgcggctgttgagaaggtgggagtggctgatgttatgagccacatctcaacgggaggtggtgctagcttggagttgttggaaggaaagcaactccctggagtcgtcgcattggacgaagctgtcacagtcaccgtatgaggctaagcttcaccctgttgcatcttcagttttcattgtactgttctaaacgtgctatgttctcctcgtttgcacctcttcgaccactcgaaatgtaagagaccaatgttttatagagaaatactgggagatgtttgaataacacccctcaccatttgtgttca

SEQ ID NO: 5307 - DNA, 2048 bp, Citrus sinensis
gtactcgttttgaaagtgaacttcaacgatgcataccaatttacaaacaattcgaagttgtattaaatttaatggggagtgtgtgtagtgccgtttaaacaagtgacggcatacattactcaatttttatatcataaacttgaaaagcatcgtcatcgtatcgatcatcttggacctctcctcaacgataagagaaatctccaatatcacccaatcgtttttcctcctcgctcttcacgtccacatcttcttcatcttccccacacattttccttccccattcttcaatcaaaccaaaacccacttcccatttctccactttgtcgacaaagtttcaatcttttgcgcctttactacgccactccactcccgccacatcaatggcttcagccaccgctcccactactttatctctcgtcaaaaccgccgcaagttcatccctttcttccccacgcgcctccttcctgcgcatgcccacttcagcatcccgcaggctggggttctccgcagccgacccgctgctgacctgccatgtggcgtcgaggctgagctcgattaagacgaagggcactcgtgcggtggtgtcgatggcgaagaagagcgtgggggagttgagtggagctgatttgaaagggaagaaggtgtttgtaagagctgacttgaatgtgcctttggatgataatcagaacattactgatgatactagaatcagagctgctgttcccaccatcaagcatttgattcaaaatggagctaaagtcattctttctagccacttgggaagaccaaagggtgttactccgaaattcagtttggctcctcttgtgcctcgtctttctgaactcctgggcattcaggttgtgaaggctgatgactgcattggtccagaggtagaaaagcttgtagcctcacttcctgaaggcggtgttcttcttcttgaaaacgtgaggttctacaaagaggaggaaaaaaacgatcctgagtttgccaagaagcttgcctctttggcagatctctatgtcaatgatgcttttgggaccgctcacagagcccatgcctcaactgagggagtcacaaaatatttgaagccttctgttgctggtttcctcttgcagaaggaactggactaccttgttggggcggtttcaagcccaaagaggccatttgctgccattgtgggcggttcaaaggtctcatccaagattggagttattgagtcactcctagaaacatgtgatatcctactccttggtggaggaatgatcttcacattttacaaggcacaaggaatctcagtgggttcatctctcgttgaggaggataagcttgaccttgctacaacacttcttgcaaaggccaaggctaaaggtgttaatcttttgttaccctctgatgtggtaattgctgacaaatttgctcctgacgcaaacagcaaggttgtgccagcaactgccattcctgatggctggatgggattggatattggaccagattctgttaagacattcaacgaagctttagatactaccaaaactgtcatctggaatggcccaatgggagtgtttgagtttgacaagttcgctgttggaacagaggcaatcgcaaagaagctagcagacctcagtggcaagggcgtaacaacaatcattggaggtggagactctgtagccgccgttgaaaaagttggagttgccggtgtcatgagccacatatcaactggtggtggtgccagtttggagttgttggaaggcaaagagcttccaggtgtcgttgctcttgatgaagctacaccagttgccgtgtaagatcaaaattattattattattattattctttttggcccacttttcaatgtgatttatgtttgtaaacgagaaatgaaaaccttgtaggaagatatgagttcatcttgtaaattttcacctttgtgatcaatgtatggtcccattcttgctgaaattgctaccaatcactgtatggatagggcaagcagagccacccaatctttttcaaataaattggctcttttcctcagtatttgctgcta

SEQ ID NO: 5308 - DNA, 1820 bp, Populus trichocarpa
agaaaatccaaaaaccaacacacaccgcccattcattccctccttcgttcttcccgtccacagcttcccccattattttcatctctcactcgcactccaaaagatcagagaaagagagcctcattttcacatccatataacccctcattccctcctcttttccttttagtccacacaacttctctcacaaaacagtccacaaacaccgccaaatggcctctgccacagcaccaacaactctatctctcctcaaaacagccgccgcctccacctccacttctgcccgtgcctcccttctcccagtctccacctctggcctccgcacaaccagcctccgtggtcttggtttctctgctgcagacccattgtttagttctcatgtggtgtccaaaatccgatctttcaagtcaaatggcagagcaccaagagctgtggtgtctatggcaaagaagagtgtgggtgacttgactgctgctgacttgaaagggaagaaagtgtttgttagagctgatttgaatgtgcctcttgatgagaatcagaaaattactgatgatactagaattagagccgctgttcctactattaaatatttgatttcaaaaggggccaaagttattctttctagtcatttgggacgaccaaaaggtgtaactccaaaattcagcttggcacctcttgttccccggttatctgaactccttggaattcaggttgtgaaagctgatgattgcattggtccagaggtagaaaagttggttgcttcacttcccgagggtggtgttcttcttcttgaaaatgtcaggttttacaaggaagaagagaagaacgaacctgaattcgcaaagaagcttgcttccatggcagatctttatgtaaatgatgcatttggaactgcacatagagcacacgcctcaactgagggagtcacgaaattcttgaaaccatctgttgctggtttcctcttgcagaaggagctggactaccttgttggggcagtttcaaacccaaagaggccatttgctgccattgtgggtggttctaaggtctcatcgaagattggagtcattgagtcactcctggagaagtgtgatatcctccttttgggtggaggtatgattttcacattttacaaggctcaaggcctcgcagtaggttcatccttggttgaggaagataagcttgatttggcgaccacactacttgagaaggccaaggcaaaaggagtgtctcttttgctacctagtgatgtggtaattgcagacaagtttgctcctgatgcaaatagcaagactgtgccagcatcagccatcccagatggttggatgggactggatattggaccagaatctgtgaaaacattcagtgaggctttgggaaccacccaaactgtcatctggaatggacccatgggagtgtttgagtttgagaagtttgcgaatggaacagaggccattgcaaagaagcttgctgagcttagtggcaagggagttacaactattattggaggtggagattctgttgcagctgtagaaaaagtaggagttgctgatgtcatgagccacatatcaactggtggtggtgccagcttggagttgttggaagggaaagagctaccaggtgtccttgctcttgacgaagtcgaacgagttgctgtgtaggataatttgatttccccccaatcccgttcccatttccatgtccttgcttttatttttacgaaagggagatgcaatgttgtagagaagtacgagtcatgctgtacgttgaggttggttaacaagagtgatccaagattttaaataaatagttggttttgatca

SEQ ID NO: 5309 - DNA, 2189 bp, Eucalyptus grandis
tgccgctcccttttcttacgtcgcgcgttgggagggagtaaaatgaatggcaaaagggggaagttctaagcagctaattcccaactcacaaagtcgaggggatgtaattaaattcctctcaatgatgatgtgcgcatcgcaatcatcggtacaggatgtgattttaacttggttcttttggtaagcgtcaggtgtcacgcgcggcccttgaatctgtacgtacctaggggagtctcaaagtcatcgaaaatcttggacctctcctcgacgataagagaaatccagaaaatctcccactcattccctccttcgatccccacgtccacatctttcgaccctcctcctatccagccgcataaaaactagacgccaaagcgacactcccccccaccactcctcgttcagcatcgattgttgttggctcggtgacggttttctggtttttcttccaagcagcaaagcaggtcaagggaaggtaaaatggcgtcggcggctgcacccaccgccttctctctcctctcctcctccgcctccgcctcctcctcctcatcctcatcctccacctctggctccgctctcctccacctccgctcctccggcctccgctcctccggcctccgccgcctgggcttcgccgctgccgacccgttcttggccgctcacgtggcttccaagctccgatctttgaggggcaaggggagcagaggggtcgtgtccatggccaagaagagcgtgggcgacttgaccggccctgccttgaaggggaagaaggtgttcgtgagggccgaccttaatgtgcctctcgacgacaaccagaacatcaccgatgacaccagggtccgcgccgccgtccccaccatcaagtacttgatccaaaatggcgccagagtcatcctctccagccacttgggccgacccaaaggggtgacaccaaagtacagtttggcacctcttgttccaaggctatctgaactccttggcattcaggttgtaaaagcagatgactgcattggccctgaggtagagaagttggtggcttcattgcctgagggcggtgttcttcttcttgagaacgtgagattttacaaagaggaagaaaagaatgaacctgagtttgccaagaagctggcatcattggcagatctgtatgtaaatgatgcttttggaacagcacacagggctcatgcttctactgagggggttactaagttcttgaagccctctgttgctggcttccttttgcagaaggagctagactatcttgttggggctgtgtctacccccaagagaccatttgctgccattgtgggtggctcaaaagtctcatccaagattggtgtgattgaatctcttctagagaagtgtgacatccttcttttggggggtggcatgatcttcaccttctacaaggcacagggtctctctgttggttcttccttggtggaggaagataagctggatcttgcaacatcgctccttaaaaaggccaaagcaaagggagtttctttattgttgcccactgatgtggttattgcggacaagtttgctccagatgcaaacagcaagatagtgccagcatctgccattcctgatggctggatgggattggatattggaccagactctattaagacatttaatgatgctctgggaactaccaaaactgtcatctggaacggacccatgggagtgtttgagtttgacaaatttgccgctggaactgaggctgttgcaaagaagctagcagagctcagtgccgcaggagtgacgaccattattggaggaggggactctgttgcagctgtggagaaagttggagttgctgatgtgatgagccacatatctactggtggtggtgccagtttggagttgttggaaggcaaagaacttcctggtgttgttgctctagacgaagccacgccagttcccgtgtgagattaacctgaggttaaattattttttgggcgacctatctttattcaagttggaataaattcttgtagaaaaaagcaatttctgtaggaaatgttttcttttgacgtgaatacagtcatatgcccttcaggtattgaaattctcagcagtttgtatgtaccaatggatgagagtcatctaaattggcgagtatcatgaacttgtgtctgttacatcagtgaatgaaagtgcttgagcatgtgtctatattttca

SEQ ID NO: 5310 - DNA, 2010 bp, Citrus sinensis
aacgatgcataccaatttacaaacaattcgaagttgtattaaatttaatggggagtgtgtgtagtgccgtttaaacaagtgacggcatacattactcaatttttatatcataaacttgaaaagcatcgtcatcgtatcgatcatcttggacctctcctcaacgataagagaaatctccaatatcacccaatcgtttttcctcctcgctcttcacgtccacatcttcttcatcttccccacacattttccttccccattcttcaatcaaaccaaaacccacttcccatttctccactttgtcgacaaagtttcaatcttttgcgcctttactacgcccctccactcccgccacatcaatggcttcagccaccgctcccactactttctctctcgtcaaaaccgccgcaagttcatccctttcttccccacgcgcctccttcctgcgcatgcccacttcagcatcccgcaggctggggttctccgcagccgacccgctgctgacctgccatgtggcgtcgaggctgagctcgattaagacgaagggcactcgtgcggtggtgtcgatggcgaagaagagcgtgggggagttgagtggagctgatttgaaagggaagaaggtgtttgtaagagctgacttgaatgtgcctttggatgataatcagaacattactgatgatactagaatcagagctgctgttcccaccatcaagcatttgattcaaaatggagctaaagtcattctttctagccacttgggaagaccaaagggtgttactccgaaattcagtttggctcctcttgtgcctcgtctttctgaactcctgggcattcaggttgtgaaggctgatgactgcattggtccagaggtagaaaagcttgtagcctcacttcctgaaggcggtgttcttcttcttgaaaacgtgaggttctacaaagaggaggaaaaaaacgatcctgagtttgccaagaagcttgcctctttggcagatctctatgtcaatgatgcttttgggaccgctcacagagcccatgcctcaactgagggagtcacaaaatatttgaagccttctgttgctggtttcctcttgcagaaggaactggactaccttgttggggcggtttcaagcccaaagaggccatttgctgccattgtgggcggttcaaaggtctcatccaagattggagttattgagtcactcctagaaacatgtgatatcctactccttggtggaggaatgatcttcacattttacaaggcacaaggaatctcagtgggttcatctctcgttgaggaggataagcttgaccttgctacaacacttcttgcaaaggccaaggctaaaggtgttaatcttttgttaccctctgatgtggtaattgctgacaaatttgctcctgatgcaaacagcaaggttgtgccagcaactgccattcctgatggctggatgggattggatattggaccagattctgttaagacattcaacgaagctttagatactaccaaaactgtcatctggaatggcccaatgggagtgtttgagtttgacaagttcgctgttggaacagaggcaatcgcaaagaagctagcagacctcagtggcaagggcgtaacaacaatcattggaggtggagactctgtagccgccgttgaaaaagttggagttgccggtgtcatgagccacatatcaactggtggtggtgccagtttggagttgttagaaggcaaagagcttccaggtgtcgttgctcttgatgaagctacaccagttgccgtgtaagatcaaaattattattattagtattctttttggcccacttttcaatgtgatttaagtttgtaaacgagaaatgaaaaccttgtaggaagatatgagttcatcttgtaaattttcacctttgtgatcaatgtatggtcccattcttgctgaaattgctaccaatcactgtatggatagggcaaacagagccacccaatctttttcaaataaattggctcttttcctcagt

SEQ ID NO: 5311 - DNA, 2048 bp, Citrus clementina
gtactcgttttgaaagtgaacttcaacgatgcataccaatttacaaacaattcgaagttgtattaaatttaatggggagtgtgtgtagtgccgtttaaacaagtgacggcatacattactcaatttttatatcataaacttgaaaagcatcgtcatcgtatcgatcatcttggacctctcctcaacgataagagaaatctccaatatcacccaatcgtttttcctcctcgctcttcacgtccacatcttcttcatcttccccacacattttccttccccattcttcaatcaaaccaaaacccacttcccatttccccactttgtcgacaaagtttcaatcttttgcgcctttactacgcccctccactcccgccacatcaatggcttcagccaccgctcccactactttctctctcgtcaaaaccgccgcaagttcatccctttcttccccacgcgcctccttcctgcgcatgcccacttcagcatcccgcaggctggggttctccgcagccgacccgctgctgacctgccatgtggcgtcgaggctgagctcgattaagacgaagggcactcgtgcggtggtgtcgatggcgaagaagagcgtgggggagttgagtggagctgatttgaaagggaagaaggtgtttgtaagagctgacttgaatgtgcctttggatgataatcagaacattactgatgatactagaatcagagctgctgttcccaccatcaagcatttgattcaaaatggagctaaagtcattctttctagccacttgggaagaccaaagggtgttactccgaaattcagtttggctcctcttgtgcctcgtctttctgaactcctgggcattcaggttgtgaaggctgatgactgcattggtccagaggtagaaaagcttgtagcctcacttcctgaaggcggtgttcttcttcttgaaaacgtgaggttctacaaagaggaggaaaaaaacgatcctgagtttgccaagaagcttgcctctttggcagatctctatgtcaacgatgcttttgggaccgctcacagagcccatgcctcaactgagggagtcacaaaatatttgaagccttctgttgctggtttcctcttgcagaaggaactggactaccttgttggggcggtttcaagcccaaagaggccatttgctgccattgtgggcggttcaaaggtctcatccaagattggagttattgagtcactcctagaaacatgtgatatcctactccttggtggaggaatgatcttcacattttacaaggcacaaggaatctcagtgggttcatctctcgttgaggaggataagcttgaccttgctacaacacttcttgcaaaggccaaggctaaaggtgttaatcttttgttaccctctgatgtggtaattgctgacaaatttgctcctgacgcaaacagcaaggttgtgccagcaactgccattcctgatggctggatgggattggatattggaccagattctgttaagacattcaacgaagctttagatactaccaaaactgtcatctggaatggcccaatgggagtgtttgagtttgacaagttcgctgttggaacagaggcaatcgcaaagaagctagcagacctcagtggcaagggcgtaacaacaatcattggaggtggagactctgtagccgccgttgaaaaagttggagttgccggtgtcatgagccacatatcaactggtggtggtgccagtttggagttgttggaaggcaaagagcttccaggtgtcgttgctcttgatgaagctacaccagttgccgtgtaagatcaaaattattattattattattattctttttggcccacttttcaatgtgatttatgtttgtaaacgagaaatgaaaaccttgtaggaagatatgagttcatcttgtaaattttcacctttgtgatcaatgtatggtcccattcttgctgaaattgctaccaatcactgtatggatagggcaagcagagccacccaatctttttcaaataaattggctattttcctcagtatttgctgcta

SEQ ID NO: 5312 - DNA, 2058 bp, Vitis vinifera
ggtgaatagtgaagtctcaaaagcatcgaaattcttcgacctctcctcaccgataagagaatccccacacgaaccacccaatcacatcaatccatccaaacccgtcttcacatccacaaaccccatttccccatttcccgatctcccaatctccctctccacccactttcactcccattttcattcaatttctctctctgaaccaccccccatcatcggcttcaccaatggcatccgcagctgcttcaccctcttcactatctctcctccactccacctctgccgctcgctcctccccgcgcctcccttcggcttccctccgcctccccaccctccctctccgccgtctgggcttcgccggcgccgctgctgactcgcttctgaccctccatgtggcgtccagaaccaggtcttttagagggaaggcttccaggggggtggtgtcaatggccaagaagagcgtgggtgacctcacgggggcggatttgaaggggaagaaggtgtttgtgagggtggatttgaatgtgcctcttgatgacaaccagaagattactgacgataccagggttcgagctgccattcccactatcaagtatttgatcgacaatggtgctaaagtcattctttctagccatttgggaagaccaaagggagtaactccaaaattcagcttggcgcctcttgtgccaaggttatctgagcttcttggcattcagattgtgaaggctgatgactgtattggcccagaggtagaaaagttagtgactgcacttcctgatggtggtgtactccttctcgagaatgtgaggttttacaaggaggaagaaaagaatgaacccgaatttgcaaagaagcttgcctccatagctgatctctatgtgaatgatgcatttggtactgcacatagagcccatgcctcaactgagggggtcactaagttcttgaagccatctgttgctggtttccttttacagaaggaactggactatctcgttggggcagtttcaagcccaaagaggccatttgctgccattgtgggtggttcaaaggtctcatccaagatcggagtcattgaatctctcctcgaaaagtgtgatatcctacttctaggtggaggaatgatcttcacattttacaaggcacagggtctctcagtgggttcatccctggtagaggaagataagctaagccttgctacatcacttctcgagaaggccaaggcaaaaggagtatctctcctgctacccaccgatgttgtgattgctgacaagtttgcccctgatgcaaacagcaagattgtgccagcatcagccattcctgatggatggatgggattggatattggacctgattctattaagatattcaatgaagctttggagaccaccaaaacagttatctggaacggaccgatgggagtgtttgagtttgataagtttgcagaaggaacagtggccgttgcaaagaagctagcggagctgagtgggaaggatgtgacaacaatcattggaggtggagattctgttgcagctgtggagaaagtaggagtcgctgatgtgatgagccacatatcaacgggtggaggtgccagtttggagttgttggaagggaaagaactccctggtgttgttgcccttgatgaagctactccagttccagtgtaagatcaattgatctgaatttttccccgtctccatcttgatgcccaatattcgggtttgtaaacgagaaataaaaatgttttaggaagatatgagttaatgttgtagattttcaccattgtcttgaatataagttcaaaattcaagctttgcattctccatttcttgctgaaattacatggaaaaagttgtaaggaacttgtaagggacaagaagaaccctccaaacttttccagaaatcaatcttctttttccctccggactattctgtgtactgtttttttgctgaattcttgctaatttttcctaatgtcgattattttgtcaaatacggactgctgatcatcctcatgatttcagtataatgtaaggccaattgtcatggactctactaggg

SEQ ID NO: 5313 - DNA, 1873 bp, Glycine max
ggtgaaatacatgagtgaaaagcaaggaagatcttgaacctctcctgaacgataagagaaatccaaaatcctctcaccacacccaatcgttcccgcgttgtcctccacgtcctcatcctttcatcacctctctcttccaccaaacaataaaaacctccaaacccactccagttaactccatacactctctctctctctctctctctctctctacaatggcctcagccgcagcccccacaactttctctctcctccactccaccaccccggcctcctcctcctccgccacctccgcctccccctcgcgcgtgcagctctcctcctccctccgctcgcgcccgctcgcgcgccgcctgggcttcgccgcggcggacccgctgctcgcggcgaatgtcgcagcgcgcgtcgcggcggtgagaggaggaaagggcgcgaggggggtggtgtcgatggcgaagaagagcgtgggggagctgagcgcggcggacctgaaggggaagaaggtcttcgtcagggccgacctcaacgtcccgctcgacgacaaccagaacatcaccgacgacaccagaattcgcgccgccattcccaccatcaaacacctaatccaaaacggcgccaaagttattctctccagccacttggggaggccgaagggtgtcactcccaaatacagcttggcacctcttgtgccccggctttctgagctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttactaaatacctgaagccatctgttgctggttttcttttgcaaaaggaacttgattaccttgttggggcggtatcaagccccaaaaggccatttgctgccattgttggtggttccaaggtctcatctaaaattggagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagcttggaaaatttttccatcctcagatttcggtgttgtcaatcttgtaaaagagcatatgttgtaggacccttcggagtctgttagtgtaaattttatcatgcttgagttattattggcttcacacataaattgcgtgtaactgtaaaccctggctgagagccataaattcgaataaatcttttagttgctgcca

SEQ ID NO: 5314 - DNA, 1800 bp, Catharanthus roseus
ctcattttccacgtcctcgcctccaaataatcaaacctcctttctttgcccctccctccaccactaactacatttctctctccctgccttcttcctctagccagttgctctccagacttggaattgggactttaacaatggcgtccgcagcggcaccacacactctctgcggcattcgcactgcttcatcatccaacgctagagccaccctcagtgctcccactactcgcttcctcctcaagaccccacttcgccgtttgggcttctctggagccgccgctgacccaattttcacccaccatgttgccaccaagctccgatccctcaaggcctctggtaagcccgttaggggtgttgcatccatggctaagaaaagcgttggcgacctcagtgccgccgacttgaagggcaagaaggtcttcgtcagagctgatttgaatgtcccgcttgatgataatcagaacattactgatgacactaggattagagctgctgttcccaccattaagcacttgatttctaacggcgccaaggtcattctatccagtcacttggggcgaccaaagggcgtgactccaaaattcagcttggcacctcttgttcccaggctatcagaattacttggtattcaggttgtcaaggccgacgactgtattggtccagaggtggaaaagttagtagcttcacttcctgatggtggtgttcttcttcttgagaatgtgaggttttataaggaggaagagaagaatgaacctgagtttgcaaagaaactcgcctctttggcagatctttatgtaaatgatgcatttggtactgcacacagagcacatgcgtctactgaaggagttacaaaattcttgaagccttctgttgctggtttcctcttacaaaaggagttagactatttagttggggcagtttcaagcccaaaaaggccatttgctgccatagtaggtggttcaaaggtttcctcaaagattggagtaattgaatcactcttagagaaatgtgacatcttacttttgggtggaggaatgatcttcactttctacaaagctcaaggtctttcagtgggttcctcactggtagaggaggacaaattagaacttgcaacatctctacttgcgaaggctaaggctaaaggagttagtcttctattaccttctgatgttgttgtggcagacaagtttgctcctgatgctgagagcaaggttgtgccagcatctgctatcccagatggctggatgggattagatattggaccagattctgttaaaacctttaatgatgccttggatacaacaaaaactgtcatctggaatggacctatgggagtttttgaatttgacaaatttgctgttggaacagagtccattgcaaagaaactagctgaattgagtgggaagggagtgacaacaattattggaggtggagattctgttgcagcagtggaaaaggtcggagtagctggtgtaatgagtcacatatccacgggaggtggtgcaagtctggagctgttggaaggcaaagaactaccaggagtcattgctcttgaagaagccgccacagttgccgtgtaaacaaactttaaactgatttttttttataaaacctaatcatttttccatgttatttgagtttgtaaaagagaaatataggatggcttgagctcgacatgtagattttcaccttggccttcaatacaaggtctgatttagcagttggtggttctgatcagctgaataaactcgcaatgtttgagaaatgaatgtattttagagtctaaatacatgtattgct

SEQ ID NO: 5315 - DNA, 1893 bp, Phaseolus coccineus
caacaaatcccttctttcacactgctttttcgtcacactcactcaaatcaaacactttctctgcaatggcctcagccgcagcccccaccactttctctctcctccactccgccacccccgccgcctcctcttcctcgcgcgtccagctctcctcctccctccgcgtccgccccctcacccgccgtctgggcttcacggccgcggacccgctgctggcggcgaatgtggctgcgcgggtggccgcggtgaaggtcgggaggggcaggagaggggtggtgtcgatggccaagaagagcgtgggcgacctgtctgcggcggacttgaaaggaaagaaggtgttcgtgagggcggacctcaacgtcccgctcgacgacaaccagaacatcactgacgacaccagaatccgcgccgccattcccaccatcaaatacctcatccaaaacggcgccaaagtcatcctctctagccacttggggcgaccaaagggtgtcactcccaaatacagcttggggcctcttgtacctcggctttctgaactcattggtttcccggttgtcaaggctgaggatagtattggtccagaagtggaaaagttggtggcttctcttccagatggaggtgttcttcttctagaaaatgtgaggttttacaaggaggaagaaaagaatgatcctgagcatgcaaaaaagcttgcctctctggcagatctgtttgtgaatgatgcatttggtactgctcatagggcacatgcatcaacagagggggttactaaattcttaaagccatctgttgctggttttcttttgcaaaaggaacttgattaccttgttggggcagtatcaagcccaaaaagaccatttgccgccattgttggtggttccaaggtctcatctaaaattggagtgattgagtcacttttagaaaaggttgacatccttcttcttggtggtggaatgatcttcacattttacaaggcacaaggtctttcagtcggatcttcccttgtagaggaagataaattggatcttgctacaacactacttgcaaaagccaaggaaaagggggtgtctctcttgttacctagtgatgtggtgattgcagacaaatttgctcctgatgcaaacagcaaggtcgtgccagcgtctgccatccctgatggctggatgggattggatattggtcccgattctgttaagtcattcaatgaagcattggatactaccaaaaccatcatatggaatggaccaatgggagtgtttgaatttgacaagtttgctgttgggacagaggctattgccaagaagctagctgatctcagtgaaaagggggtcaccacaattattggaggaggagattctgttgcagctgtggagaaagttggagttgccaatgtcatgagtcacatatctactggtggtggtgccagtttggagttattggaagggaaagagcttcctggagtcgttgctcttgatgaagccacaccagtccctgtgtaagataagtgtcatcatggaaatttttcccatcccagttgtcagtgttgtcaatcctgtgaaagagcatatgttgtaggaccattccgagtctgttagtgtaaatttaatcatgcttgagttattggcttcactcataaattgcgtgtaactgtaaacactggctgagagccataaattcaaaataaatccttgagttactggcagcagcattttgcactttgatttgtcttatataacactcgtgagtggtgccatttggtcacgtgcacagtgtaataagtcttaaacaatgacgaggactattgcaggaacagaaaatgaaaggtacggtgcaaaatttgctgccagtgcaatctattttaaattaaaataaatctattagttactgccagaa

SEQ ID NO: 5316 - DNA, 1679 bp, Phaseolus coccineus
cactcactcaaatcaaacactttctctgcaatggcctcagccgcagcccccaccactttctctctcctccactccgccacccccgccgcctcctcttcctcgcgcgtccagctctcctcctccctccgcgtccgccccctcacccgccgtctgggcttcacggccgcggacccgctgctggcggcgaatgtggctgcgcgggtggccgcggtgaaggtcgggaggggcaggagaggggtggtgtcgatggccaagaagagcgtgggcgacctgtctgcggcggacttgaaaggaaagaaggtgttcgtgagggcggacctcaacgtcccgctcgacgacaaccagaacatcactgacgacaccagaatccgcgccgccattcccaccatcaaatacctcatccaaaacggcgccaaagtcatcctctctagccacttggggcgaccaaagggtgtcactcccaaatacagcttggggcctcttgtacctcggctttctgaactcattggtttcccggttgtcaaggctgaggatagtattggtccagaagtggaaaagttggtggcttctcttccagatggaggtgttcttcttctagaaaatgtgaggttttacaaggaggaagaaaagaatgatcctgagcatgcaaaaaagcttgcctctctggcagatctgtttgtgaatgatgcatttggtactgctcatagggcacatgcatcaacagagggggttactaaattcttaaagccatctgttgctggttttcttttgcaaaaggaacttgattaccttgttggggcagtatcaagcccaaaaagaccatttgccgccattgttggtggttccaaggtctcatctaaaattggagtgattgagtcacttttagaaaaggttgacatccttcttcttggtggtggaatgatcttcacattttacaaggcacaaggtctttcagtcggatcttcccttgtagaggaagataaattggatcttgctacaacactacttgcaaaagccaaggaaaagggggtgtctctcttgttacctagtgatgtggtgattgcagacaaatttgctcctgatgcaaacagcaaggtcgtgccagcgtctgccatccctgatggctggatgggattggatattggtcccgattctgttaagtcattcaatgaagcattggatactaccaaaaccatcatatggaatggaccaatgggagtgtttgaatttgacaagtttgctgttgggacagaggctattgccaagaagctagctgatctcagtgaaaagggggtcaccacaattattggaggaggagattctgttgcagctgtggagaaagttggagttgccaatgtcatgagtcacatatctactggtggtggtgccagtttggagttattggaagggaaagagcttcctggagtcgttgctcttgatgaagccacaccagtccctgtgtaagataagtgtcatcatggaaatttttcccatcccagttgtcagtgttgtcaatcctgtgaaagagcatatgttgtaggaccattccgagtctgttagtgtaaatttaatcatgcttgagttattggcttcactcataaattgcgtgtaactgtaaacactggctgagagccataaattcaaaataaatccttgagttactggcagcagcattttgc

SEQ ID NO: 5317 - DNA, 2545 bp, Populus trichocarpa
atccactgacatgcatccatagtccatatgagctcgagacaaagcggccgaaccaatcgaacctaaacttttgtgggaggaggacgggcacctgccagctgaactaaccaaacctcttggcaatcggcaccgtagttgttacttgtggcagttgcagtaaagcccaaaaccgtcaagagtagtaaagtagtgagaagtgacaatcttaaaggcatcgaacatcaacaacctcacttcaacgataagagaaaatccaaaatccaacgcacatcgcccattcattccctccttcgttcttcccgtccacacccgccccattgttttttctctctccaaagatcagagagagagagagagcctcatttcccatccatataatatagccttccatcccctcctcttctccttttagtccacccaacttctctcacaaaattcacactcaaaaacactccacaaacaccgccaaatggcctccgccacagcaccaacaactctctctctccttaaaacagccgcctcctccacctccacatctgtccgggcctccctactcccagtctccacctccggcctccgcacaaccagcctccggggtcttggtttctctgctgcagacacattgtttagctctcatgtggtgtccaaaatacgatctttcaagtcaaatggtaaagcaccaagagcagtggtgtctatggcaaagaagagtgttggtgacttgacagctgctgatttgaaagggaagaaagtcttcgttagagctgatttgaatgtgcctcttgatgataatcagaatattactgatgatactagaattagagccgctatccctactattaaatacttgatttcaaatggggctaaagttattctttctagtcatctgggacgaccaaaaggtgttactccaaaattcagcttggcacctcttgtaccccggttatctgaactccttggaattcaggttgtgaaagctgatgattgcattggcccagaggtagaaaaattggttgcttcacttcctgatggtggtgttcttcttcttgagaatgtcaggttttacaaggaagaagagaagaatgaacctgaatttgcaaagaagcttgcttccttggcagatctttatgtaaatgatgcatttggaactgcacatagagcacatgcctccactgagggggtcacaaaattcttgaaaccatctgtttctggtttcctcttgcagaaggagctggactaccttgttggggcagtttcaaccccaaagaggccatttgctgccattgtgggtggttccaaggtctcatccaagattggagtcattgagtcactcctggagaagtgtgatatccttcttttgggtggaggtatgattttcacattttacaaggctcaaggcctcccagtaggttcatccttggttgaggaagataagcttggtttggcaacatcgctccttgagaaggccaaggcaaaaggagtgtctcttttgctacccagtgatgtgataattgcagacaagtttgctcctgatgcaaatagcaagattgtacctgcatcagccatcccagatggttggatgggactggacattggaccagaatctgtgaagacattcagtgaagctttgggaaccacccaaactgtcatctggaacggacccatgggagtgtttgagtttgacaagtttgcagttgggacagaggccattgcaaagaagcttgctgagcttagcggcaagggagttacaactattattggaggtggagattctgttgcggctgtagaaaaagtaggagttgctgatgttatgagccacatatcaactggcggtggtgccagcttggagttgttggaagggaaagagcttccaggtgtccttgcactagatgaagtcgaacgagttgctgtgtgagattatttgatttttttccccattcccatgccgatgcttttattgttacgagagagagatgcgatgttgtagaagaagtacgagtcatgtcatacattttctgtgtcttcaataggaggggtctgattccacctttgcctttcttgcttcttactaaattgccaagagagacattgagggtagttaacaagaacgatccagcattttaaataatagttgacaattcttcttcttcttcttcatcttcctcacttgccaataaattgacattttatgatttgagaagtaaaagtaacattgaagaatccggaaaggagggaaaaaagagagaggctaactttagatgttggcttcgtgtttctatcccatctttgtgattcagtcctagctttgcaagattagccagccattgaaggcaaaataccggtctcttgcctggattagtcatttaggcaattcacatgaaagtattgtgcagataatgaaaaaattggataatcaatacaagtagttgagagaagtttatatattctactcggaatgctaccatatctgtccataacaggactgagttgagaaagctgtagggctgtgttctcgctaaggacactggttcctttcagcttcctc

SEQ ID NO: 5318 - DNA, 1930 bp, Musa acuminata
cgtaatctccacctctcgtcgctcaccacccaaatcaccgaatcctcgctctccaccgctcctcagcgataagaaaaatccacaaacaccccgttgctgtccacaacacaaaccccctctctcccttctttttcagtccatcactccttggacgccctctcttgctctcgcgaaggtgtacagattcatggcttccaccgccgccacctccttctccctcctcccaacctcctcttcccgccggcgagtggcggcggtggtggcgccgtcccggctgactctccggtcgccgtcccggcggttggggttcgctggggtcgcggctgactcgctgctggcggcccacgtggcggccaagatccggacggtggccgggaggagcgggaaagggccccgcggggtggcggtcatggccaagaagagcgtgggggacctcacggctgcggacctcaaggggaagaaggtcttcgtccgggctgatctgaacgtgcccctcgacgaggaccgcaacatcacggacgacaccaggatccgggcggccgttcctaccatcaagcacttgatcagcaacggggccaaagtcatcctctccagccatctgggacgcccgaagggtgtcacgccaaaattcagcttgagccctttagttcctaggctgtctgaactccttggaatcaaggttgagaaagccgatgattgcatcgggccagaagttgaaaaattggtcaatgcactgccagaaggtggtgttctacttctcgaaaatgtgagattctataaagaggaagagaagaatgaacctgaatttgcaaagaagcttgcagcactagctgacctttacgtcaatgatgccttcggaacagcacacagagcacatgcttcaacagagggcgtgaccaaattcttgaagccttctgtcgctggttttcttttgcaaaaggaacttgattaccttgttggtgctgtttcaaaccccaagagaccatttgcggcaattgttggtggctcaaaggtgtcatctaagattggggtgattgagtcactgttggagaagtgtgatatccttcttttgggcggaggaatgatattcacattttacaaagcacaaggtttccccgtgggttcttcattggtagaggatgacaaacttgagcttgcgacatcacttctcgcaaaagccaaagctaagggcgtgtctcttttgttgccaactgatgttgttattgccgataaatttgcacctgatgcacagagcaaggttgtgccggcatctgaaattcctgatggttggatggggttggatgtcggaccagattcagttaagacattcaacgatgcactagatacaaccaagaccattatttggaatggtcccatgggagttttcgagtttgataagtttgccactggaactgaggcaatcgcaaagaagttggcggaacttagtgggaagggtgtgacaacaatcatcggaggtggagactctgttgctgcagttgagaaagttggagtagctgatgtaatgagtcacatatcaaccggtggcggagctagcttggagttgttggaaggcaaggagcttcccggcgtcgttgcattggatgaagcagttgttgtagccgtatgagactaactatcatcgcagatactggcctatgtttcccatcaagaagaagcatatcagtgtgatgatttctttcacctcagtttctggggttgctcataacaggtggattaccaccctgttttagttcatattatgttctcgaataatgtttaaattcagtctgttgtcatttatttttattgtgtctcctgcagaaagtcagctggtcaagtttgtgtcacaatccatcaactgatgagatgagtatgtttgatattatggtgataaatttacatgtgccatcatgctaaaaacctcctgcca

SEQ ID NO: 5319 - DNA, 2038 bp, Musa acuminata
ctccaccttcctttctcccaccccacgccacaaacgaagcccaaatcttctcatcgaacccctcgctctccaccgctcttcagcgataagaaaaatccacgaacccccgcttctgctccacatcacattccccctcctccttactttttaatccatcactcgtgtctccgcgacctccttgcttggcttctctctctctctctctctctctctctctctctctctctcgctctcgcctttgcgaagagtttacgatccatggcttccaccgccgccacctccttctccctcctcccgacctcctcccgcaggcggtcgacgacggcggcggcgctactctccggcgcggtagccctccgttcgccgcttcggcggctgggtttcgccggggccgcggccgacccgcttctggcggcgcacgtggcggcgaagatcaggtccgtggccgggaggagcgggaaggggtcgcgcggggtggcgtccatggccaagaagagcgtgggggacctcaccgccgccgacctcaaggggaagaaggtattcgtccgggcggatctgaacgttcccctcgacgagaaccgcaacatcaccgacgacaccaggatccgagcggccgtgcccaccatcaagcacttgatcagcaatggggccaaagtcatcctctccagtcatctgggacgcccgaagggtgtcacaccaaaattcagtttgaacccaattgtgcctaggctttctgaactacttggaatcaaggttgagaaagcagatgattgtattggaccagaagttgaaaaattggttaatgctctacctgaaggtggcgttctacttcttgaaaatgttagattttataaagaggaagagaaaaatgatcctgaattcgcaaagaagcttggagcactagctgacctttatgtgaatgatgcttttggaacggcccatagagcacatgcatcaacagagggtgtcaccaagttcctgaagccctccgtcgctggttttcttttgcaaaaggaacttgattatcttgttggtgctgtttcaacccccaagagaccatttgcagctattgtaggtggctcaaaagtatcatctaagattggggtgattgaatcactgttggagaagtgtgatatccttcttctcggtggcgggatgatattcacattttacaaagcacaaggtttctcagtgggttcttctttggtagaagacgacaaacttgagcttgcatcatcacttcttgcaaaagccaaagcgaagggcgtgtctcttttgttaccaactgatgtcattattgcagataaatttgcagctgatgcagagagcaaggttgtgccagcgtctgaaatccctgatggttggatggggttggacattggaccggattcagttaagacatttagtgatgcattggatacaaccaagaccattatttggaacggtcccatgggagtttttgagtttgacaagtttgctgtgggaactgagtcaattgcaaagaagttggcagagctcagcgggaagggggtgacgacgatcattggaggtggagactctgttgctgcagtcgagaaagttggagttgctgatgtgatgagtcacatatcaactggtggtggagctagcttggagttgttggaaggcaaggagcttccaggagttgttgctttggatgaagcagttgctgtagctgtatgagactaaactttgttaccagaggtgctggcttatgtttcccaataataattgtcaatgtgatgatctctttcacctctatttcgcccaaaagaggatggatagagatttaagagtttgccgctgtcgagttcctgggatcactcataataagtgcattctaccctgttgtagttcatttttgattcattgagattgtcacaaagtatggcaaaacgaaacgttcttgtttcgagtgggtcaaagatgcggtgtagtttattatgcctcctgtagcaagtcagcttggcttgtgccacgatggataatgagtatgtatgcctattgcctgattttgcaa

SEQ ID NO: 5320 - DNA, 1915 bp, Nicotiana benthamiana
  misc_feature (1782)..(1782): n is a, c, g, or t
  misc_feature (1813)..(1813): n is a, c, g, or t
  misc_feature (1839)..(1839): n is a, c, g, or t
gctgaaggaacttcggcacgaggtcacactctctgcttttgccgtaggacagaatcgtcgagtttagtgacgaagactgtaatcaatggcatcagctacagcttctcactctttgtgcggcatccccgccacctcatcctctactaccaacaagtctattgccccttcatctgctcgcttcctcgccaaaactcctccccgcggcctcggcttcgctggcgccgccgctgattctctcttcaccaaccacgtggcaaccaagctccgatccctcaagagctcctccaagcctgttaggggcgttgcttctatggccaagaaaagcgttggtgacctcaccgctgccgagttgaagggcaagaatgtcttcgtcagggccgatttgaatgtcccacttgatgataaccagaacattactgatgacactagaattagagctgccgtccctactatcaagcacttgatggccaatggtgctaaagttattctctccactcacctgggacggccaaaaggagtcactcctaaatacagcttggcacccctagtccccaggctatccgaactgcttggaatccaggttgtgaaggctgaggactgcattggtccggaagttgagaagttggttgcttcacttcccgagggtggtgttcttcttctcgagaacgtgagattctacaaggaggaagagaagaatgaacctgagtttgcaaagaaacttgcatcattggcagatctttacgtgaatgatgcattcggtacagctcacagagcacacgcctctacagagggagttactaaatttttgaagccttctgttgcaggtttcctcttacaaaaggaattggactacttagtcggggcagtttcaaatccaaagaggccatttgctgctattgtgggtggttcaaaggtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggcgaaaggagtcagtctcttgttaccatctgatgttgtgattgcagataaatttgctcctgatgcaaacagcaagattgtgccggcatctgctatcccagatggttggatggggttggacattggaccagactctgttaagactttcaacgatgccttggataccacaaaaacagtgatctggaatggacctatgggggtgtttgaatttgacaagtttgctgttggaacagaggcaattgcaaagaagctcgcggacttaagtgggaaaggagtgacaactatcattggaggtggagattctgttgcagctgttgagaaagttggagttgctagcgtgatgagccacatatccactggtggtggtgccagtttggagctactggaaggcaaggtgctccctggtgtcgttgctctagatgaagcagatgcccctgttgctgtgtaaaacaatttgtactaattcttttttctccggtgatcagcataatcagtggtaatttccagttgggaagcattgagttgatgttgtagatttttcaggttatattgttatataatgtcccctttctttaacccatgttattttgtctaaataaagggcgagtatatcagttatagacagctatccttttgatgtccttcaacaaactctatccttgatttggttcagtttggaggaacttctttagacataanaacttttgccatgtgaacaaactcatgctgngtgttaatgttcacctgcccttcgcnttaaatgacgcctttaatacgtggtggtttatgtaaagtgagattactgttagttatgcagttatgaaacttctgg

SEQ ID NO: 5321 - DNA, 1947 bp, Elaeis guineensis
tcctttccatgcgataaggcccgcccgataaaaccaccctaaatgccagcttctcaccgaaacatcgaaccatccctcctctccacctctccccaacgataagaaaatattcccctccacccccgtctccacaaatccctttccttcttgttcgctactcttctcgcatctcttcccctttccaactctctctctctcgctaagagccaacgatggcttccgccgcatcacccacctccctttctcttcgtctgtcctgctccgcctccacgtccccgtcctcgtcccggcggcaggtggcggcggtctctttccccgcctcccgcggtgccgtcgcgctccgatcggcggtccaccgcctgggcttcgctggggctgcggcggacccgctgctggcgatccacgtggcggcgaagatccgggcggtgaccgggcagagtgggaggggtcctaggggcgtggcggccatggcgaagaagagcgtcggggacctcactgccgcggacctcaaggggaagcgggtgttcgtgagggcggatctcaacgtgcccctcgatgagaaccagaacatcaccgacgatactaggattcgggcggccgtgcccaccatcaagcacttgatggggaagggggccaaagtcattctctccagccatctgggacgcccaaagggtgtcacaccaaaatacagcttgagtcctcttgtccctaggctctctgaacttcttggcatcaaggttgagaaagctgatgactgtattggcccagaagttgagaaaatggttgctgcacttccagaaggtggtgttctgcttctcgaaaatgtaaggttttataaggaggaagagaaaaatgaaccagagtttgcaaagaagcttgcatccttagctgacctttatgtgaatgatgcatttggaacggcacacagagcgcatgcatcaacagagggtgtcaccaagttcttgaagccctctgttgctggtttccttttgcaaaaggaacttgactatcttgttggtgccattgcgaaccccaagaggccatttgctgccattgtaggtggttcaaaggtgtcatccaagattggagtgatcgagtcattgctggagaaatgtgacatccttcttctgggtggaggaatgatcttcacattttacaaggcacagggcctttcagtgggttcttccctggtagaagaggacaaactagagcttgcaacgtcacttcttaagaaggccaaatctaaaggggtttctcttatgttgcccaccgatgttgtcattgctgacaagtttgctgccgatgcaaatagcaaggttgtaccatcaacggcgattccggatggttggatgggcttggatattggaccagattcagtaaagtcgttcagtgatgcactggaaacaaccaagacagtcatttggaatggtcctatgggagttttcgaatttgaaaagtttgcagttggaactgaggcaattgcaaagaagttggcagagcttagcgggaagggcgtgacgacaattatcggaggtggagattctgttgcggcagttgagaaagtgggagtagctgatgttatgagccacatatccacgggtggtggagccagcttggaattgttggaagggaaggagcttccaggagttgtggctctcgatgaagctgtccctgttgctgtatgaggccaagttttattccgaagccgctgtctgtcgttgtggttcctgaaagaaattaaccatgttgtggtctctctcacctgggttttacccagaagtggagtcagtcaaggtgtcaagagctcttgtagagtttctgggattggccaatagcggtcttttttttttgttccttgcgttgatgttttcttgtgatgtggtgccaatttgttgttgaaataaaaatctcctgcactaggataaacaggtcaatattgtagatgca

SEQ ID NO: 5322 - DNA, 1726 bp, Nicotiana tabacum
agagaagagtgtaaacaatggcatcagctacagcttcccacactttgtgcggcatccccgccacctcatcctctactaccaacaaggctattgccccttcatctgctcgcttcctcgccaaaactcctctccgccgcctcggcttcgctggcgccgccgctgattctctcttcaccaaccacgtggctaccaagctccgatccctcaagagctcctccaagcctattaggggcgttgcttctatggccaagaagagcgttggagacctcaccgctgccgagttgaagggcaagaaagtcttcgtcagggccgatttgaatgtcccacttgatgataaccagaacattactgatgacactagaattagagctgccgtccctactatcaagcacttgatggccaatggtgctaaagttattctctccagtcacctgggacggccaaaaggagtcactcctaaatacagcttggcaccactggtccccaggctatccgaactgcttggaatccaggttgtgaaggctgaggactgcattggtccagaagttgagaagttggttgcttcacttcccgagggtggtgttcttcttctcgagaacgtgagattctacaaggaggaagagaagaacgaacctgagtttgcaaagaaacttgcatcattggcagatctttatgtgaatgatgcattcggtacagctcacagagcacatgcctctacagagggagttactaaatttttgaagccttctgttgcaggtttcctcttacaaaaggaattggactatttagtcggggcggtttcaaatccaaagaggccatttgctgctattgtgggtggttcaaaggtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggcgaaaggagtcagtctcttgttaccatctgatgttgtgattgcagataaatttgctcctgatgcaaacagcaagattgtgcctgcatctgctatcccagacggttggatggggttggacattggaccagactctgttaagactttcaacgatgccttggataccacaaaaacagtgatctggaatggacctatgggggtgtttgaatttgacaagtttgctgttggaacagaggcaattgcaaagaagctcgcggacttaagtgggaaaggagtgacgactatcattggaggtggagattctgttgcagctgttgagaaagttggagttgctagcgtgatgagccacatatccactggtggtggtgccagtttggagctactggaaggcaaggtgctccccggtgtcattgctcttgatgaagcagacgcccccgttgctgtgtaaaacaatttgtactaattcttttttctccggggtcaacataatcagtggtaatttccagttaggaagcattgagtcgatgttgtagatttgtcgggttatattgttatataatgtcctttttttaacccatattatttttgtctaaataaagggcgagtatatcagttatagacagctatccttttgatgtctttcaacaaactctatccttgatttggttcagtttggaggaaattctttagacgtaagaactttgccatctg

SEQ ID NO: 5323 - DNA, 1779 bp, Manihot esculenta
atttcaatcttcgttcttcccgtccacatcctcccaactcttttacttcttctttttttaacatttagcccacacatctcctctccctctccaaacactcattactctctccttccttccctccctctctctcaaacggaccgctagtgatggcctctgctgcagcacccactaccttttcccttcttaaaaccacagcttcttcctcctccactatccgagctcgcgcttcccttcttccagtttcctccactggcctccgctccaccgggcttcgccgcctcggcttttctgctgctgacccagtttttggtcatcatgttgcttcaaaaattcattcatttgggtccggtaaggcctcgagggcagtggtatccatggcgaagaagagcgtgggagacctgacggctgcggatttgaaggggaagaaggtatttgtgagggctgatctgaatgtgcctttggatgacaaccagaaaatcactgatgacactagagttagagctgcaatccccacgattaagcatttgattcaaaatggagctaaagtcattctttctagtcatttgggacgcccaaaaggtgttactccaaagttcagcttggcgcctctcgtaccccgtttatcagaactcctcgggattcaggttgtgaaggctgatgattgcataggcccagaagtagaaaaattgttggcttcacttcctgaaggtggtgttcttctccttgagaatgtgaggttttacaaggaggaagaaaagaatgaacctgaatttgcaaagaagcttgcttctttagcagatctctatgttaatgatgcatttgggactgcacatagagcacatgcctcaactgaaggagtcacaaaattcttaaaaccatctgttgctgggtttctcttgcagaaggagctggactaccttgttggggcagtttcaaacccaaagaggccttttgctgccattgtaggtggttcaaaggtctcatccaagattggagttattgaatcgctccttgagaagtgtgatatcttgcttttgggtggaggaatgatattcacattttacaaggcacaaggtctctcggtgggctcatccttggttgaggaagataagcttgagttggcaacatcgctccttgaaaaggccaagtcaaaaggagtttctcttttgttacccactgatgtaataattgcagacaaatttgcccctgatgcaaacagtaaggttgtgcctgcatcagccattcctgacggctggatgggattggatattggaccagaatctgttaagacatttaatgatgctttggaaactaccaaaactgtcatctggaatggaccaatgggagtgtttgaatttgacaagtttgcagttggaacagaggctattgcaaaaaagctagcagagcttagtggcaagggagtcacaacaattattggaggtggagattctgttgcagctgtagaaaaagtaggagttgctgatgttatgagccacatatcaactggtggtggtgccagtttggagttgttggaaggcaaagagcttccaggtgttcttgctcttgatgaagccaccccagttgctgtgtaagattaatatattatttccctcctcgtccttgagtctgtgcctttatgagaaagggttattgtagagagatacgagttcatgttgtaaatttttctttgttttgtcatgctaaattgtggaagtagacagcaaggatgagcaaagagaggcatccaagtttttaaataaatggttcatttttatc

SEQ ID NO: 5324 - DNA, 1462 bp, Manihot esculenta
caacccactaataatggcctctgctgcagctcccacaaccctttcccttctcaaaaccacatcttcttcctcatcctcctccacccgcgcccgcccttctcttcttccagtttcctccgctggcctccgctccaccagtcttcgccgccttggcttcgctgctgctgaccctattttaactcgtcatgttgcatccaaaattcaatcttttggttccggtaaggcctcgagggcagtggtcctcatggcgaagaagagcgtgggagacctgacggctgcggatttgaaggggaagaaggtcttcgtgagggctgatctgaatgtgcctttggatgacaaccagaacatcactgatgatactagagttagagctgcaatccctacaattaagcatttgattcaaaaaggagctaaagtcatcctttctagtcatttgggacggccaaaaggtgttactccaaaattcagcttagctcctcttgtaccccgcctatctgaactccttggaattcaggttgtgaaggctgatgattgcataggcccagaagtagaaaaattggtcgcttcgcttcctgaaggtggcgttcttctccttgagaatgtgaggttttataaggaggaagaaaagaatgaacctgaatttgcgaagaagcttgcttctttagcagatctctatgtcaatgatgcctttgggactgcacatagagcacatgcctcaactgaaggagtgacaaaattcttaaaaccatctgtcgctgggttcctcttgcagaaggagctggactaccttgttggggcagtttcaaatccaaagaggccatttgctgccattgtaggtggttcaaaggtctcatccaagattggagttattgaatcactccttgagaagtgcgatatcctgcttttgggtggaggaatgattttcacattttacaaggcacaaggcctctcggtaggctcatctctggttgaggaagataagcttggtctggcaacatcactccttgagaaggccaagtcaaaaggagtgtctcttttgttacccagtgatgtggtaattgcagacaaattttctcctgatgcaaacagtaaggttgtgccatcatcagccattcctgatggctggatgggattggatattggaccagaatctgtgaagacattcagtggtgctttggaaactaccaaaactgtcatctggaatggaccaatgggagtgtttgaatttgacaagttcgcagttggaacagaggctattgcaaagaagctagcgcagcttagtggcaagggtgtcacaacaattatcggaggtggagattctgttgcagctgtagaaaaagtaggagttgctgatgtaatgagccacatatcaaccggtggtggtgccagtttggagttgttggaaggcaaagagcttccaggtgtccttgctcttgatgaagccataccagttgctgtgtaa

SEQ ID NO: 5325 - DNA, 1859 bp, Euphorbia peplus
tccattccccatcatccatttcgttcttcccgtccacatcctctcttcttctctttatcatcatcttctccattttcacatcctcttcatttcttcaaacaccttcttctcttcaatggcttcagctacagcacccacttctctttccctcctcaaaacaacttcatcttcatcatcttcttcctctcgctctcgttcccttctccccgtttccggcctccgttcaaccaccctccggggcctcgggttcgctgctgcagaccctcttttctcccaccatgttgcttccaagattcgctctttcggttccggtaaggcttcccgggctgtggtttccatggctaagaagagtgttggggatttgagtgctgctgaattgaagggcaagagggtttttgttagggctgatttgaatgttcctcttgatgatgctcagaatattactgatgatactaggattagagctgctattcctactattaagcatttgattcaaaatggtgctaaagttattctctccagtcacttggggcgtccaaaaggtgttactccaaagttcagtttggcacctctcgtgccccgtctttctgaactcctcggcattcaggttgttaaagctgacgactgcattggccctgaggtcgaaaaattggtggcttcacttcccgaaggcggtgttcttctccttgagaatgtgaggttttacaaggaggaagaaaagaacgagcctgagtttgcaaagaagcttgctgccttagcagatctatacgtgaatgatgcatttggaactgcacatagagctcacgcctcaaccgagggagtcacaaagtatttgaagccttcagttgctgggttcctcttacaaaaggaactagactaccttgttggagccgtttcgaccccaaagaggccctttgctgccattgtaggtggttcaaaggtctcgtcaaagatcggagttattgaatcacttctcgagaagtgtgacattcttcttttgggaggaggaatgattttcaccttttacaaggcacaaggcctctcggttggttcctccttggttgaggaagacaagcttggattggccacggaactcctcgctaaagccaaggcaaaaggagtgtctcttttgttgccaacagatgtcgtaattgcagacaagtttgctcccgatgcgaatagcaaggtcgtgccagcatcagctatccctgatggttggatgggattggatattggaccggattctgtcaagacattcaatgatgctttggaaactaccaaaactgtcatctggaacggacccatgggagtgttcgaattcgacaagtttgcgtttggaacagagtctgttgcaaagaagctagcagagctaagtgggaagggagtgacaacaatcatcggaggtggagattcagttgcagcagtagaaaaagtaggagttgccgatgttatgagccacatatcaaccggtggtggtgccagtttggagttattggaaggcaaagaacttcccggtgttctcgctcttgatgaagccacaccagtagccgtgtaagcttattttttccccctgatccctccctagatttcctgatctatataataggagaaagggttatgttgttgtagagagatatgagttgtctgtaaattttctttgtcgtcttaattacgctagaggtcctccaattcttcccttttctccatttcttcattctgaaagagactctgaggatggtcaagagagccatcaaagttttcaataaaatggttcagtcttcaccaatcactcttcattgtttcatttatttttttgttataattattaaatagaggcgttagaaggaaatgcccgtaat

SEQ ID NO: 5326 - DNA, 1875 bp, Glycine max
tgaaagagaaatttatatattgcaggaatatatgagtgaaaaaacaaggaagatcttgaacctctcctgcacgataagagaaatccaaaatcctctcatcacacccaatcgttcccccattgtagtccacgtccacatcctttcatccccccccactcgttaaattcccaaacacactcaaactcaaacactctctctttctctctctacaatggcctcagccgcatcccccaccactttctctctcctccactccgccaccccttcctcctcctccaccgccacctccgcctccccctccccctcgcgcgtgcagctcacctcctccctccgcgcccgcccgctgcgccgcctgggcttcgccgcggcggacccgctgctcgcggcgagtgtagcggcgcgcgtggcggcggtgagaggaggaggaaagggcgcgaggggggtggtgtcgatggcgaagaagagcgtgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggcggccgaagggtgtcactcccaaatacagcttggcgcctcttgtaccccggctttctgagctcattggtatccagattgtcaaggccgaggacagtattggtccagaagtagaaaagttggtggcttctcttccagatggaggtgttctccttctagaaaatgtgaggttttacaaggaggaagaaaagaatgaccccgagcatgcaaaaaagcttgcctctctggcagatctgtatgtgaatgatgcatttggtactgctcacagggcacatgcatcaacagagggtgttactaaatacctgaagccatctgttgctggttttcttttgcaaaaggaacttgattaccttgttggggcagtatcaaaccccaaaaggccatttgctgccattgttggtggttccaaagtctcatctaaaattggagtgattgagtcacttttagaaaaagttgacatccttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgctcctgatgctaatagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgacctcagtggaaagggggtgaccacaattattggaggaggagattctgttgcagctgtggagaaagtaggagttgctagtgtcatgagccacatatctactggtggtggtgccagtttggagttattggaaggcaaagagcttccaggagtccttgctcttgatgaagccgtcccagtcgctgtgtaagacacttttcatcttggaaaattttcccatcctcaggtgtcagtgttgtcaatcttgtaaaagagcatatgttgtaggacccttcgaagtctgttagtgtaaattttatcttgcttgagttattattggcttcacacataaattgcgtgtaactgtaaaccctggctgagagccataaattcaaataaatcttttagttgctggca

SEQ ID NO: 5327 - DNA, 1975 bp, Tabernaemontana elegans
cacctacctagttatctgactatacgtggagtataagtaaatcatacgtaattattccttaccgtacctcctcctacaacgaagtaagaagaacctcccactaccaaacaaaactaaactctacctacctctttacttttactaccgtaccaaactaactacctttctttcgtcctccacacacctcattattctctccgtcccgcccacagagacttacaacacaactcttctccttctggtcttcgcaggcaccactgaaagttgcacttggactaaacaatggcatcagcagcggcaccgcacacattctgtgccattcgcacagcttcatcatccaccactagagctaccctcaatgcccccaccacccgcttcctcctcaagaccccacttcgcagtctgggtttcgctggagccgccgctgattcaattttcatccatcatgttgccaccaagctccgatccctcaaggcctctggcaagcccgttaggggtgttgcctccatggctaagaagagcgttggcgacttaactgcagccgacttgaagggcaagagggtgcttctcagagccgatttgaatgtccctcttgatgataaccagaacatcactgatgatactaggattagagctgctattcccaccattaagtacttgatttctaacggggctaaggtcattctgtccagtcacttggggcgaccaaaaggtgtgactccaaagttcagcctggcacctcttgttcccaggttatctgaattgcttggtattcaggttgtcaaggctgatgattgtattggtccagaggtcgaaaagttggtagcttcacttcctgagggcggtgttcttcttcttgagaacgtgaggttttacaaagaggaagagaagaatgaacctgagtttgccaagaaactcgcctctttggcagatctttatgtaaatgatgcatttggaactgcacacagagcacatgcctctactgaaggagttacaaaattcttgaagccttctgttgctggtttcctgttacaaaaggagttggactatctagttggggcagtttcaaacccaacaaggccattcgctgccatagttggtggttcaaaggtttcctcaaagattggagtgattgaatcactcttggaaaaatgtgacatcttgcttttgggtggaggaatgatcttcacattctacaaagctcaaggtctttcagtgggatcttccctggtagaggatgataaattagaacttgcaacttctctacttgagaaggccaaggctaaaggagttagtcttttgttacctactgatgttgttgtggcagacaagtttgctcctgatgctgaaagcaaggttgtgccagcatccggtattccagatggctggatgggattggatattggaccagagtctgttaaaacattcagcgatgccttggggacaacaaaaactgtcatctggaatggtcctatgggagtttttgaatttgacaaatttgctgtcggaacagaggctgttgcaaagaaactagctgaactcagtgggaagggagtgacaacaattattggaggtggggattctgttgcagctgtggaaaaggttggagtagctaatgtcatgagtcacatatccactggaggtggtgcaagtttggagctgttggaaggcaaacaacttccaggagttattgctcttgatgaagccatcccagttgctgtgtaaatgaatgttaaactgatttttttcaacctaatcagttttccatgttatttgtgtttgtaaacgagagatgtaggatgctatgagctcgacctgtagattttcaccttggccttcaatacaaggtctgatttagcacttcttgttcaaatcagctgaataaatgcaaaatatttgaggaagaaatgtatttaaagtccaaaatatatatgtgttgtttcgttttttatggcaatgactcaggatgtatttt

SEQ ID NO: 5328 - DNA, 2257 bp, Gossypium raimondii
aggattagtgtaatttgttgagtgagtcaaaagttgtaacatatgattagggatctcagcccaatgttgatattcagatcctatcggctgcgaccttattagcggacaaagagaaatagtgagggagtgtgggcaaatcaagaaaagcatcgaacatcttcagcctctcctcaacgataagaaaaacaagaggtatctgatttcctcctcctcacatccaatcatttctccctttgcgcttcacgtccacatcttccccattcccatccaccgttacataaactccttttccccccctctctcacagtttccttgtctctttgccttcacaacttacaactcagcgtctccactctctttctctcttcgcctccaaatggcttctgccaccacttccaccactttttccctcctcaaaaccaccgcctccaccacctcttcctccgcctcccgctcttctgcatccctcatccgccttccctccactcgccgccacctcaaatcctcttctctcatccacagcctaggcttctcctccgctgcttctggggactctctgctttccctccatgtctcctccaaagttcgatctttcaagggaaaagggtcaagaggggttgtttcaatggccaagaagagtgttggggacttgactgccgctgatttgaaagggaagaaagtgtttgtgagggctgacttgaatgttccattggatgatagccagaacatcactgatgacaccaggattcgtgctgctattcccaccatcaagcatttgattcagaatggagctaaagtcattctctctagccacttggggcggccaaagggtgttactccaaaattcagcttggctcctcttgtacccaggctttctgaattacttggcattcaggttgtcaaggctgatgactgcattggtccagaagtagaaaagttagttgctgcacttcctgaaggtggtgttcttcttcttgaaaatgttagattttacaaggaagaggaaaagaatgaacctgaatttgcaaagaagcttgcttcgttagctgatctctttgtcaatgatgcatttgggactgcacatcgagcacatgcatcaacagagggtgttacaaaattcttgaagccatcagttgctggtttccttttacagaaggaactagactaccttgttggtgctgtttcaagccccaaaaggccttttgctgccattgtgggtggttcaaaggtctcttccaagattggcgtcattgaatcactccttgagaaatgtgacattctccttcttggtggtggtatgattttcacattttacaaggcacaaggcctatcagtcggttcatccctggtagaggaggataagcttgaacttgcaacatcacttcttgcaaaggccaaggcaaaaggagtgtctcttttgttacccactgatgtggttatcgccgacaagtttgcccctgatgcaaacagcaagattgtgccagcatctgctatccctgatggctggatgggattggatattggacctgattctgtcaagacattcaatgaagctttggatactacccaaaccatcatctggaatggaccaatgggagtgtttgaatttgagaaatttgcagttggaactgaggctattgcaaagaagctagctgaacttagtggcaagggagtgacaacaatcattggaggtggagactctgttgctgctgtagaaaaggttggagttgctgatgtcatgagccacatatcaactggtggtggtgccagtttagaattgttggaagggaaggagcttccaggtgtgattgccctggatgaggctgttccggttgctgtgtaagatcgaatcaaattttccacatcctcactgtttagtgatttattcacaaatgaaatgctttatgatgaaagagatctttttgtaaatgtacaacattaaatcactagaagagcccttttctgcctcttcctttcttgctccttcctaaatggttgtcagaagagtgttgctcaaataaattgctttatttttatccaaaccttttcttgcattatgatatttctcgtagccgtcctgtatggttctcttctgcaagtattgtaatatgcccctttttttcttccctttacattgcattttatattctttgtattacaaagtcaaaaccacataaaagcatgattcgtgcttctgcttgttgaactctatgaagctaatgagaattccatcttacaaattcttgcaaactcaaaa

SEQ ID NO: 5329 - DNA, 1706 bp, Trifolium pratense
caaaaaatcacacacactctctctccacaatggcttcagctacagcacctacaactctctctctcctccccaccacaaaatcatcatcaggccaatctgtggccccatccccctcccgtgtccaactatcctcattcctcggtgcccgtccactccgccgactggggttcgcttctgctgaccccttgttggcagtgcaggtggcgtcgaaggtgaggtcagtgagcgggagaggaatgagagtggtgtccatggcgaagaagagtgttggagatttgagtgcggcagaattgaaaggaaagaaggtttttgtgagggctgatttgaatgttcctcttgatgataatcagaatattactgatgatactagaattcgtgctgctattccaactatcaaacatcttattcaaaatggtgctaaagtcatcctttctagtcatttgggaaggccaaagggtgtcactcccaaatacagcttggcacctctcgttccccggctttccgaactcattggaatcgaggttattaaggctgaggacagtattggtccagaagtagaaaagttggtcgcttcccttccagatggtggagttctacttctagaaaatgtgaggttttacaaggaggaagaaaagaacgatcccgaacatgcaaagaagcttgccgcactcgcagatttgtatgtgaatgatgcatttggaactgctcacagggcacatgcatcaacagaaggagtcactaaatacttgaagccatctgttgctggttttcttttgcaaaaggaacttgactaccttgtcggggcagtatcaaccccaaaaaggccatttgctgcaattgtgggtggttccaaggtgtcatctaaaattggagtgattgaatcacttctagaaaaagttgacatccttcttctcggtggaggaatgatcttcaccttttacaaggcacaaggtctttcagttggttcatccctagtggaggaagataaattggagcttgctacaacactaattgcgaaagccaaggcaaagggtgtgtcactcttgctaccaagtgatgtcgtgattgcagacaaattcgctcctgatgcaaacagccagatcgtgccagcatctgccatccctgatggttggatgggattggacattggcccagattctattaaaacattcaacgacgcattggataccaccaaaaccgtcatatggaatggaccaatgggagtgtttgagtttgacaagtttgctgttggaacagaggctattgcaaagaagttggctgacctcagtggaaagggggtgacaactattattggaggaggagattctgttgcggctgtggagaaagtaggagtcgccgatgtcatgagccacatatccactggtggtggtgcaagtttggagctattggaaggcaaagagcttccaggtgtcctcgctctcgatgaagccgtaccagttgccgtgtaagacagttttcagcttgtaattttttccaaccctcgtgttaagtgttctcacaaccttgtaaaagagcttatgttgtagtacccttccgagtttgttagtgtatattttatcatgctttagtttctcttcacacataaattgcttgtaattgtaaaccaacctaggctgagtgccataaattcaaataaatctactataaaaaaataaaaattcaaaaaaatcttccattagttagtc

SEQ ID NO: 5330 - DNA, 2123 bp, Gossypium hirsutum
ggcacgaaggtgagggactggtgggcaaatcaagaaaagcatcgaacatcttcagcctctcctcaacgataagaaaaacaagaggtatctgatttcctcctcctcacatccaatcatttctccctttgcgcttcacgtccacattttcgccattcccatccaccgttacataaactccttttccccccctctctcacagtttccttgtctctttgccttcacaacttacaactcagcctctcctctctctttctctcttcgcctccaaatggcttctgccaccacttccaccactctttccctcctcaaaaccaccgcctccaccacctcttcctccgcctcccgctcttctgcatccctcatccgccttccttccacgcgccgccacctcaagtcctctcctctcatccacagcctaggcttctcctccgctgcttctggggactctctgctttccctccatgtctcctccaaagttcgatctttcaagggaaaagggtcaagaggggttgtttcaatggccaagaagagtgttggggacttgactgccgctgatttgaaagggaagaaagtgtttgtgagggctgacttgaatgttccattggatgatagccagaacatcactgatgacaccaggattcgtgctgctattcccaccatcaagcatttgattcagaatggagctaaagtcattctctctagccacttggggcggccaaagggtgttactccaaaattcagcttggctcctcttgtacccaggctttctgaattacttggcattcaggttgtcaaggctgatgattgcattggtccagaagtagaaaagttagttgctgcacttcctgaaggtggtgttcttcttcttgaaaatgttagattttacaaggaagaggaaaagaatgaacctgaatttgcaaagaagcttgcttccttagctgatctctttgtcaatgatgcatttgggactgcacatcgagcacatgcttcaacagagggtgtcacaaaattcttgaagccatcagttgctggtttccttttacagaaggaactagactaccttgttggtgctgtttcaagccccaaaaggccttttgctgccattgtgggtggctcaaaggtctcttccaagattggagtcattgaatcactccttgagaaatgtgacattctccttcttggtggtggtatgattttcacattttacaaggcacaaggcctatcagtcggttcatccctggtagaggaggataagcttgaacttgcaacatcacttcttgtaaaggccaaggcaaaaggagtgtctcttttgttacccactgatgtggttatcgctgacaagtttgcccctgacgcaaacagcaagattgtgccggcatctgctatcccagatggctggatgggattggatataggacctgattctgttaagacattcaatgaagctttggatactacccaaaccatcatctggaatggaccaatgggagtgtttgaattcgacaaatttgcagttggaactgaggctattgcaaagaagctagctgaacttagtggcaagggagtgacaacaatcattggaggtggagactctgttgctgctgtagaaaaggtcggagttgctgatgtcatgagccacatatcaactggtggtggtgccagtttagaattgttggaagggaaggagcttccaggtgtgattgccctggatgaggctgttccggttgctgtgtaagatcgaatcaaattttccacatcctcacaaatgaaatgctttatgatgaaagagatctttttgtaaatgtacaacattaaatcactagtagagcccttttctgcctcttcctttcttgctccttcctaaatggttgtcagaagagtgttgcttaaataaattgctttatttttatccaaaccttttcttgcattatgatatttctcgtagccgtcctgtatggttctcttctgcaagtattgtaatatgccccttttgttcttccctttaagttgcattttatattctttgtattacaaagtcaaaaccacataaaagcatgattcgtgcttctgcttgttgaactctatgaagctaatgagaattccatctcacaaattcttgaaac

SEQ ID NO: 5331 - DNA, 1683 bp, Vinca minor
aatggcgtcagcagcagcaccacacactttctgcggcggcattcgcgcagcttcatcgtccaccacttctagagcctccctcactactttccgattcctcctcaagaacgccccaattcgccgtctgggtttctccggagccgccgctgatccaatcttcaccctacatcttgccaccaagctccgatcactctccggcaagcccgttaggggcgttgcatctatggccaagaagagcgttggtgacctctctgctgctgatttgaagggcaagaaggtctttgtcagagctgatttgaatgtccctcttgatgataaccagaatattactgatgatactaggattagagctgctatccctaccattaagtacttgatttctaatggcgctaaggtcattctttccagtcacttggggcgaccaaaaggtgtgactccaaaatacagtctagcgcctctagttcccaggttgtctgaattacttggtattcaggttgtcaaagctgatgactgtattggtccggaggtcgaaaagttggtagcttcccttcctgagggtggcgttcttcttcttgagaatgtgaggttttacaaggaggaagagaagaacgagcctgagtttgcaaagaaacttgcctctttggcagatatttttgtaaatgatgcctttgggactgcacatagagcacacgcctctactgaaggagttaccaaattcttgaagccttcggttgctggtttcctcttacaaaaggagttggactatctagatggggcagtttcaaacccaaaaaggccatttgctgccatagtaggaggttcaaaggtttcatcaaagattggggtgattgagtcgctcttggaaaagtgtgacatcttacttttgggtggaggaatgatcttcactttctacaaagcgcaaggtctttcagtgggatcttcactggtagaggaagacaagttagaacttgcgactactctacttgcaaaagctaaggctaaaggagttagtcttctattacctactgatgttgtggtggctgacaagtttgctcctgatgctgaaagcaaggttgtaccggcatctggtatcccagatggttggatgggcttggatattggaccagattctgttaaaacattcaacgacgctttggacacaacaaaaactgtcatctggaacgggcctatgggagtttttgaattcgacaaatttgctgttggaacagaggccattgctaagaaactagctgaactaagtgggaagggagtgacaacaattatcggaggcggagattctgttgcagccgtggagaaggttggagtagctaatgtgatgagtcacatatccaccggaggtggtgcaagtttggagctgttggaaggcaaagaactaccgggagtcgttgctcttgatgaagccatcccagttgcagtgtaaaacaaactgattctttttcaacctaatcatttttccatgttatttggatggtttgtaatagagagagagagagagagatttataggatcacaataggagttcgacctgtagattatctatcacctttggccttcaatacaatgtctgatttttagcaacttcttgtttgaatctgctaaataaacttgtaatgtttgatcaaataaatgtattttgaaagtccaaatatatctattgcttac

SEQ ID NO: 5332 - DNA, 1687 bp, Nicotiana benthamiana
cacactctctgctctttgccgtaagacagaaccgagaagagtgtaatcaatggcatcagctacagcttctcacactttgtgcgccatccccgccacctcatcctctactaccaacaaggctattgccccttcatctgctcgcttcctctctaaaactcctctccgccgcctcggcttcgctggcgccgccgctgattctctcttcaccaaccacgtggctaccaagctccgatccatcaagagctcctccaagcctgttaggggcgttgcttctatggccaagaagagcgtcggagacctcaccgctgccgagttgaagggcaagaaagtcttcgtaagggccgatttgaatgtcccacttgacgatagccagaacattactgatgacactagaattagagctgccgtccctactatcaagcacttgatggccaatggtgctaaagttattctctccagtcacttgggacggccaaaaggagtcactcctaaatacagcttggcaccgctagtccctaggctatccgaactgcttggaatccaggttgtgaaggctgaggactgcattggtccggaagtcgagaagttggttgcttcacttcccgagggtggtgttcttcttctcgagaacgtgagattctacaaggaggaagagaagaacgaacctgagtttgcaaagaaacttgcatcattggcagatctttacgtaaacgatgcatttggtacagctcacagagcacatgcctctacagagggagttactaaatttttgaagccttctgttgcaggtttcctcttacaaaaggaattggactatttagtcggggcagtttcaaatccaaagaggccatttgctgctattgtgggtggttcaaaagtttcatccaagattggagtgatcgaatcacttttagagaaatgtgatatattgcttttgggtggaggaatgatctttaccttctacaaggctcagggtctttcagttggttcctccttggttgaggaagacaaactagaactcgctacatcactcctagagaaggccaaggagaaaggagtcagtctcttgttaccatctgatgttgtgattgcagataaatttgctcctgatgcaaacagcaagattgtgccgtcatctgctatcccagacggttggatggggttggacattggaccagactctgtcaagactttcaatgatgccttggataccacaaagacagtgatctggaatggacctatgggggtgtttgaatttgacaagtttgctgttggaacagaggcaattgcaaagaagctcgcggacttaagtggggaaggagtgacgactatcattggaggtggagattctgttgcagctgttgagaaagttggagttgctagcgtgatgagccacatatccaccggtggtggtgccagtttggagctactggaaggcaaggtgctccccggtgtcattgctctagatgaagcagacgcccctgttgctgtgtaaaacaatttgtactaattctttttttttccggtggtcaacataatcagtggtaatttccagttgggaagcattgagttgttgttgtagatttttcaggttatattgttatataatgtcctatttttaacccatgttatttttgtctgaataaagggcgagtatatcagttatagacagctatccttttgatgt

SEQ ID NO: 5333 - DNA, 1705 bp, Musa acuminata
atggcttccaccgccgccacctccttctccctcctcccaacctcctcttcccgccggcgagtggcggcggtggtggcgccgtcccggctgactctccggtcgccgtcccggcggttggggttcgctggggtcgcggctgactcgctgctggcggcccacgtggcggccaagatccggacggtggccgggaggagcgggaaagggccccgcggggtggcggtcatggccaagaagagcgtgggggacctcacggctgcggacctcaaggggaagaaggtcttcgtccgggctgatctgaacgtgcccctcgacgaggaccgcaacatcacggacgacaccaggatccgggcggccgttcctaccatcaagcacttgatcagcaacggggccaaagtcatcctctccagccatctgggacgcccgaagggtgtcacgccaaaattcagcttgagccctttagttcctaggctgtctgaactccttggaatcaaggttgagaaagccgatgattgcatcgggccagaagttgaaaaattggtcaatgcactgccagaaggtggtgttctacttctcgaaaatgtgagattctataaagaggaagagaagaatgaacctgaatttgcaaagaagcttgcagcactagctgacctttacgtcaatgatgcctttggaacagcacacagagcgcatgcttcaacagagggtgtgaccaaattcttgaagccttctgttgctggttttcttttgcaaaaggaactcgattaccttgttggtgctgtttcaaaccccaagagaccatttgcggcaaattgttggtggctcaaaggtgtcatctaagattggggtgattgagtcactgttggagaagtgtgatatccttcttttgggcggaggaatgatattcacattttacaaagcacaaggtttccccgtgggttcttcattggtagagaatgacaaacttgagcttgcgacatcacttctcgcaaaagccaaagctaagggcgtgtctcttttgttgccaactgatgttgttattgccgataaatttgcacctgatgcacagagcaaggttgtgccggcatctgaaattcctgatggttggatggggttggatgtcggaccagattcagttaagacattcaacgatgcactagatacaaccaagaccattatttggaatggtcccatgggagttttcgagtttgataagtttgccactggaactgaggcaatcgcaaagaagttggcggaacttagtgggaagggtgtgacaacaatcatcggaggtggagactctgttgctgcagttgagaaagttggagtagctgatgtaatgagtcacatatcaaccggtggcggagctagcttggagttgttggaaggcaaggagcttcccggcgtcgttgcattggatgaagcagttgttgtagccgtatgagtctaactatcatcgcagatactggcctatgtttcccatcaagaagaagcatatcattgtgatgatttctttcacctcagtttctggggttgctcataacaggtggattaccaccctgttttagttcatattatgttctcgaataatgcttaaattcagtctgttgtcatttatttttattgtgtctcctgcagaaagtcagctggtcaagtttgtgtcacaatccatcaactgatgagatgagtatgtttgatattatggtga

SEQ ID NO: 5334 - DNA, 1851 bp, Medicago truncatula
gaaaaaaagcaaggaagatctagaacctcacttcaacgataagagacatccaaaatccccaaaccacacccaatcgttcttcctttgatctttacgtccacatctttcttctatattcccctttccttcattgagttcactctcactccaaaacaatctcacacaaacacactctctctctctctacaatggcttcagctacagcccccacaaccatctcactcctccccaccactaaatcctcttccccatccaccactccatgcccctcccgcatccatctctcctcattcctcggcgcccgcccacttcgccgacttgggttcgctgcagctgaccctctgttggcggtgcaggtggcgtcgaaggtgaggacagtaagcgggagaggagtaagaggagtggtgtcaatggcgaagaagagtgtgggagatttgagtggtgctgaattgaagggaaagaaggtttttgtgagagctgacttgaatgttcctcttgatgataatcagaatattactgatgatactaggatccgtgctgctattccaactattaaatatctaattcagaatggtgctaaagttattctttctagtcatttgggaaggccaaagggtgtcactcccaaatacagcttggcacctcttgttcccaggctctccgaactcattggaattgaggttattaaggccgaagacagtattggtccagaagtagagaagttggtagcttctcttccagacggaggagttctacttctagaaaatgtgaggttttacaaggaggaagaaaagaatgatcctgaacatgcaaaaaagcttgccgcacttgcagatctgtatgtgaatgatgcattcggtactgctcacagggcccatgcttcaacagagggagtcactaaatatttgaagccatctgttgctggttttcttttgcaaaaggaacttgactaccttgttggggcagtatcaagcccaaaaaggccatttgctgcaattgtgggtggttccaaggtctcatctaaaattggagtgattgagtcacttctagaaaaagttgacatccttcttctcggtggaggaatgatcttcacattttacaaggcacaaggtcttgcagttggttcatcccttgtagaggaagataagttggagcttgctacaacactaattgctaaagccaaggcaaagggtgtgtcactcttgctgccaagtgatgtggtgattgcagacaaattcgctcctgatgcaaacagccagatcgtgccagcatctgccatccctgatggttggatgggattggacattggtccagattctattaaaacattcaatgaagcattggataccacccaaaccatcatatggaatggaccaatgggagtgtttgagtttgacaagtttgctgttggaacagagtctattgcaaagaagttggccgacctaagtggaaagggggtgacaactattattggaggaggagattctgttgcagctgtggagaaagtaggagttgccgatgtcatgagccacatatccaccggtggtggtgcaagtttggagctattggaaggcaaagagcttccaggtgtccttgcccttgatgaagccacaccagtcgccgtgtaagacaattttcagcttgtaattttttcccaccctcggtttcagtgttctcacaaccttgtataagagcttatgttgtagtaccctcccgagtttgttagtgtaaattttatcatgcttgacctattctcttcacacataaattgcttgtaactgtgaacctaggctgaaagccataaattcaaataaatcttccattagttgctgcattagtttgttttttaca

SEQ ID NO: 5335 - DNA, 2097 bp, Gossypium hirsutum
tcaagaaaagcatcgaacatcttcagcctctcctcaacgataagaaaaacaagaggtatctgatttcctcctccccaatccaatcatttctccctttgcgcttcacgtccacatcttcgccattcccatccaccgttacataaactccttttccccccctctctcacagtttccttgtctctttgccttcacaacttacaactcagcctctccactctctttctctcttcgcctccaaatggcttctgccaccacttccaccactctttccctcctcaaaaccaccgcctccaccacctcttcctccgcctcccgctcttctgcatccctcatccgccttccttccacgcgccgccacctcaagtcctctcctctcatccacagcctaggcttctcctccgctgcttctggggactctctgctttccctccatgtctcctccaaagttcgatctttcaagggaaaagggtcaagaggggttgtttcaatggccaagaagagtgttggggacttgactgccgctgatttgaaagggaagaaagtgtttgtgagggctgacttgaatgttccattggatgatagccagaacatcactgatgacaccaggattcgtgctgctattcccaccatcaagcatttgattcagaatggagctaaagtcattctctctagccacttggggcggccaaagggtgttactccaaaattcagcttggctcctcttgtacccaggctttctgaattacttggcattcaggttgtcaaggctgatgattgcattggtccagaagtagaaaagttagttgctgcacttcctgaaggtggcgttcttcttcttgaaaatgttagattttacaaggaagaggaaaagaatgaacctgaatttgcaaagaagcttgcttccttagctgatctctttgtcaatgatgcatttgggactgcacatcgagcacatgcttcaacagagggcgttacaaaattcttgaagccatcagttgctggtttccttttacagaaggaactagactaccttgttggtgctgtttcaatccccaaaaggccttttgctgccattgtgggtggctcaaaggtctcttccaagattggagtcattgaatcactccttgagaaatgtgacattctccttcttggtggtggtatgattttcacattttacaaggcacaaggcctatcagtcggttcatccctggtagaggaggataagcttgaacttgcaacatcacttcttgcaaaggccaaggcaaaaggagtgtctcttttgttacccactgatgtggttatcgctgacaagtttgcccctgacgcaaacagcaagattgtgccagcatctgctatccctgatggctggatgggattggatattggacctgattctgttaagacattcaatgaagctttggatactacccaaaccatcatctggaatggaccaatgggagtgtttgaatttgagaaatttgcagttggaactgaggctattgcaaagaagctagctgaacttagtggcaagggagtgacaacaatcattggaggtggagactctgttgctgctgtagaaaaggttggagttgctgatgtcatgagccacatatcaactggtggtggtgccagtttagaattgttggaagggaaggagcttccaggtgtgattgccctggatgaggctgttccggttgctgtgtaagatcgaatcaaattttccacatcctcactgtttagtgatttattcacaaatgaaatgctttatgatgaaagagatctttttgtaaatgtacaacattaaatcactagaagagcccttttctgcctcttcctttcttgctccttcctaaatggttgtcagaagagtgttgctcaaataaattgctttatttttatccaaaccttttcttgcactatgatattatatagccgtcctgtatggttctcttctgcaagtattgtaatatgcccctttttttcttccctttacattgcattttatattctttgtattacaaagtcaaaaccacataaaagcatgattcgtgcttctgcttgttgaactctatgaagctaatgagaattctatcttac

SEQ ID NO: 5336 - DNA, 1948 bp, Cajanus cajan
aaaaaaaaatgtcttcatgattgcacgaggcacatatatgagtgaaaagcaaggaagatcttgaacctctcctgaacgataagagaaatccaaaatcctctcacctcacccaatcgttccccctttgtactccacgtccacatctttcatctctctctctaataaaacccccaaacacccctttctcacacacaaacacacactcactcactcactccacaccacaatggcctcagccgctgcccccaccaccttctccctcctccactccgccgccgcgggctcctccgcctcctcctcctcctccgccgccgcgcgcgtgcagctctcctcctcctccctccgcgtccgccccctctcccgccgcctgggcttcgcggccgccgacccgctgctggcggccaacgtggcggcgcgcgtggcggccgtgaggggcgggagtgccgcgagaggggtggtgtcgatggcgaagaagagcgtgggggacttgagcgcgtcggacttgaaggggaagaaagtgttcgtgagagctgacctcaacgtcccgctcgacgacaaccagaacatcaccgacgacaccagaatccgcgccgccgttcccaccatcaagcacctcatccagaacggcgccaaagtcatcctctctagccacttggggcgaccaaagggtgtcactcccaaatacagcttggcacctcttgtaccccggctttctgaactcattggcatccaggttgtcaaggctgatgacagtattggcccagaagtagaaaagttggtggatgctcttccagacggaggtgttcttcttctagaaaatgtgaggttttataaggaggaagaaaagaatgatcctgagcatgcaaagaagcttgcctctctggcagatctgttcgtgaatgatgcatttggtactgctcacagggcacatgcatcaacagagggtgttactaaatacctgaagccatctgttgcaggttttcttttgcaaaaggagcttgattaccttgttggggcagtatcaagccccaaaaggccatttgctgccattgttggtggttccaaggtctcgtctaaaattggagtgatcgagtcacttttagaaaaagttgacatccttcttcttggtggaggaatgatcttcacattttacaaggcacaaggtctttcagtgggttcatcccttgtagaagaagataagttggagcttgctacatcactacttgcaaaagccaaagcaaagggtgtctctctcttgttaccaagtgacgtggtgattgcagacaaatttgctcctgatgcaaacagcaaggtcgtgccagcatctgccatccctgatggctggatgggattggatattggtccagattctgttaaatcattcagtgaagcattggataccaccaaaaccatcatatggaatgggccaatgggagtgtttgaatttgacaagtttgctgttggaacagaggctattgcaaagaaattggctgacctcagtggaaagggggtgaccacaattattggagggggagattctgttgcagctgtggagaaagtaggagttgctagtgtcatgagtcacatatctactggtggcggtgccagtttggagttattggaaggcaaagagcttccaggagtccttgctcttgatgaagccacaccagtccctgtgtaagactgttttcaacttggaaaattttcccatcctcgggtgtctgtcatcaaccatgtaaaagagcacatgttgtaggacccttcggagtcttttagtgtaaatttatcatgctcgagttattttcttcacacataaattgcgtgtaactgtaaacccaggctgagagccataaattcaaataaatccattagttgctgccaaaagctttttgcactttggttttgagtcttaatggatataagctttagaagagttcttgagtttctc

SEQ ID NO: 5337 - DNA, 1657 bp, Cicer arietinum
ctctctctacacaatggcttcagctacagcacccacaactctctcactcctccccaccaccaaatcctcttccccatccgcctccccatcctcctcccgcgtccacctctcctccttcctcggcgcccgcccactccgccgacttggattcgcagctgccgaccccttgttggcagtgcaggtggcatcgaagttgaggacagtgagcgggagaggagcgagaggagtggtgtcgatggcgaagaagagtgtgggagacttgagtgcggcggaattgaagggaaagaaggtgtttgtgagggcggacttgaatgtcccgcttgatgataaccagaacattactgatgatactaggatccgtgctgctataccaactattaaacatcttattcaaaatggtgccaaagtcattctttctagtcacttgggacggccaaagggcgtcactcccaaatacagcttggcacctcttgttccccggctttctgaactcattggaatccaggttattaaggccgatgacagtattggtccagaagtagaaaagctggtggcttcccttccagaaggaggagttctacttctagaaaatgtgaggttttacaaagaggaagaaaagaatgatcctgaacatgcaaaaaagctcgcctcactcgcagatctatatgtgaatgatgcattcggtactgctcacagggcacatgcatcaacagagggtgtcactaaatacttgaagccatctgttgctggttttcttttgcaaaaggaacttgactaccttgttggggcagtatcgagcccgaaaaggccatttgctgcaattgtgggtggttccaaggtctcatctaaaattggagtgattgagtcacttcttgaaaatgtcgacatccttcttcttggtggagggatgatctttacattttacaaggctcaaggtctttcggtcggttcatcccttgttgaggaagacaagttggaacttgctacaacactacttgcaaaagccaaggcaaagggggtgtcactcttgctaccgagtgatgtcgtgattgcagacaaatttgctcctgatgcaaacagccaggtcgtgccggcatcggccatccctgatggatggatgggattggacattggtccagattctattaaaacattcaacgaagcattggataccaccaaaaccatcatatggaatggaccaatgggagtgtttgagtttgacaagttcgctgttgggacagaggctattgcaaagaagttggctgacctaagtggaaagggggtgaccactattatcggaggaggagattctgttgcggccgtggagaaagtaggagttgccagtgtcatgagccacatatccaccggtggtggtgcaagtttggagctattggaaggcaaagagcttccaggtgtcctcgctctcgatgaagccacaccagttgctgtgtaagacagttttcagtttggaattttttcccaccctcggtgtcagtgttctcacaaccttgtaaaagagtttatgtcgtagtactcttccgagtttattagtgtaaattttatcatgcttgagttattctcttcacacatcataaattgcttgtaactgtaaacccaggctgagagccataaattcaaataaatcatccattagttg

SEQ ID NO: 5338 - DNA, 1882 bp, Trigonella foenum-graecum
gggaactatcacatgatgtgaaatggaacatatatgaaggaaaaaaggaaggaagatctagaacctctcctcaacgataagagaaatccagaatcccgaaaccacacccaatcgttcttcctttggtcctcacgtccacatctttcttctatattcattttcacctcacacaataaaacacctcaaaacattcatcccttcacttcactctcactctaaaaccacactttctctctctacaatggcttcagctacagcccccacaaccctctcactcctccccaccactaaatcttcagccacatctgctccatcctcctcctctcgcgtccagctgtcctcattcctcggccgcccactccgccgacttgggttcgcagctgctgaccctttgttggcggtgcaggtggcctccaaggtgaggacagtaaccgggaaaggagtaagaggagtggtgtcgatggcgaagaagagtgtgggtgatttgagtggggcggagttgaagggtaagaaagtgtttgtcagagctgacttgaatgttcctcttgatgataatcagaatattactgatgatactaggatccgtgctgctataccaactattaaatatcttattcagaatggtgctaaagttatactttctagtcatttgggaaggccaaagggtgtcactcccaaatacagcttggcacctcttgttccccggctctcggaactcattggaatcgaggttataaaggccgaagacagtattggtccagaagtagaaaagttggtggcttctcttccagacggaggagttctacttctagaaaatgttaggttctacaaggaggaggaaaagaatgatcctgagcatgcaaaaaagctcgccgctctagcagatctgtatgtgaatgatgcatttggtactgctcacagggcacatgcatcaacagagggagtcactaaatatttgaagccatctgttgccggttttctcttgcaaaaggaacttgactaccttgttggggcagtatcaaccccaaagaggccatttgctgctattgtgggtggttccaaggtctcatctaaaatcggagtcatcgagtcacttcttgaaaaagttgacatccttcttcttggtggaggaatgatcttcacattttacaaggcacaaggtctttcagttggttcatcccttgtagaggaagataagttggaacttgctacaacactaattgcgaaagccaaggcaaagggggtgtcactcttgctaccaagtgatgtcgtgattgcagacaaattcgctcctgatgcaaacagccagatcgtgccagcatctgccatccctgatggttggatgggattggacattggtccagattctattaaaacattcaacgaagcattggataccaccaaaaccatcatatggaatggaccaatgggagtgtttgagtttgacaagtttgctgttggaacagaggctattgcaaagaagttggctgacctcagtggaaagggggtgacaactattattggaggaggagattctgttgcagccgtggagaaagtaggagtcgctgatgtcatgagtcacatatccaccggtggtggtgcaagtttggaattattggaaggtaaagagcttccaggtgtcctcgctctcgatgaagccactccagtcgccgtgtaagacaattttcagcttgtaattttttcccaccctcggtttcagtgttctcacaaccttgtaaaagagcttatgttgtagtaccctcccgagtttgttagtgtaaattttatcatgcttgacttattctcttcacacataaattgctttgtaactgtaaacctaggctgagagccataaatttaaataaatcatccattagttgct

SEQ ID NO: 5339 - DNA, 1859 bp, Cucurbita pepo
attatagcccattcgttttcactgttctttttgttcatatctcccattcaatctctccctcccttcacaaatcatcgtcgtcctcccatttcatcctcataaaaggcgcccccagatcgccaaatcgccctgttctccatttctgctctgcttcatccatggcttctgcagcttcccgcgccacttttccatcttcttcccacaaaatcctcttacacttcgttcaacccgctctgcccttcttcaattttcgcccaccgccgcttcctctgactcaattcgccttcgcgccgctgcaactcagcgcttaggtttcgctgccgcagacccacttttctccctccatgtggcttccaagattcggtcgtttaggggcaaggcctcgagggtgtggtgtccaataggctaagaagagtgttggggatttgactgcggctgacttgaaggggaagaaagtgttcgtgagggctgatttgaatgtgccgttggatgataatcagaatattactgatgatactaggatcagagctgctatccctacgatcaagtatttgactgataatggagctaaagtgcttttatccagccatctgggacgaccaaaaggtgtgactccaaaatacagcttggcacctcttgtgcctaggctgtctgaactccttggcattgaggttgtgaaggctgatgactgcattggtcccgaggtcgaaaaattggtcgcttccctgcccgagggcggagttcttctcctcgaaaatgttcgattctacaaggaagaagagaaaatgagccagagtttgcaaagaagctggcttctctagctgatctttatgtgaacgatgcatttggaactgcccacagagctcatgcttcaactgagggagtcaccaagtttttgaagccatccgtggctggtttcctcttgcaaaaggaactcgactatctagtgggggccgtgtcaagcccaaagagaccatttgctgctattgttggtggttcaaaggtctcgtcgaagatcggagtgatcgagtcacttctagaaaagtgtgacatcctacttcttggtggtggaatgatatttacattttacaaggcacagggactttccgttggctcgtctctggtcgaagaggataagctagattagcaaccacgctcctcgcgaaggccaaggcgaaaggagtatcgcttctactaccaaccgatgtcgtcattgcagacaagtttgctcccgacgcaaacagcaagatcgtccctgcatctgccatccctgatggatggatgggactcgacattggaccagattctgtaaagacattcaatgatgcgttggacactacccaaactatcatctggaatggaccgatgggagtgttcgagttcgacaagtttgcagtcggaacggaggcgatcgctaagaaactcgcggagctcagtggaaagggggtgacaaccatcatcggcggtggagactcggttgcagctgtggagaaggtaggagttgcgagcgtcatgagtcacatttcaactgggggtggtgctagtttggagttgttggaaggcaaagaacttcccggcgtccttgctcttgacgaggccgtacccgttgccgtgtaggtgatcggtatggattattcgattacattcttttcgcctcccatctcaattgaatgcttaaattgcaatgttaacagagaaatatgttgttgtagagaagatgagtttttgtagtttaagtggtaacttcaactgctgctccctttctgtctctgcatttgaattcctctttggctgctggaacagactatagggataaccactgttttaaaagttgtaataaatttgtgcatgaacgtcca

SEQ ID NO: 5340 - DNA, 1904 bp, Malus domestica
ctcaatctctcaaaagcatcgaacacttagaacctctccccaacgataaggagaaatccacaacccccacacataccgcccaatcagtcccattgttcttcccgtccacatctctcccaatccacaaaaatcgaaaaaaccaccccattaacctctcatctcactcagtcaacctccgtttactatcccacacccccaacagcaatggcctccaccaccgcacccaccaccttctccctcctccactccgccactgcttccacctcccgcacccgcgcttccctctcccatgtctccctcccctcctccctcaaacccactgccctccgccgccttggcttctccgctgccgaccccctcctcgctcttcaagtagcttccaaagtccgatcctttggatccggcaaaggggtcagaggcgttgttgcgatggcgaagaagagcgtcggggacctttcggcggcggagctgaaggggaagaaggtgtttgtcagggctgacttgaatgtgcctttggatgacagccagaacatcaccgatgatactagaatccgcgctgctatccccaccattaagcatttgattgagaatggggctaaagtcatcctttccagtcatttgggacgaccaaaaggtgtgaccccaaaatttagcttggcacctcttgtacctcggctttcggagcttcttggcattcaggttgtcaaagctgaggattctattggtccagaagtagagaagctggtggcttcacttcctgaaggtggtgttcttcttcttgaaaatgtgaggttttacaaggaagaagagaagaatgatcctgagcatgcaaagaagcttgccgccttagcagatctttatgttaacgatgcatttgggactgcacatagagctcatgcctcaactgagggagtcacaaaattcttgaggccatctgtagccggtttccttttgcagaaggaactcgactatctcgttggggcagtatcaagccccaaaaggccatttgctgccattgttggtggttcaaaggtctcatccaagatcggagtgattgagtcacttttagagaaggttgatatcttacttcttggtggaggtatgattttcacattttacaaggcacaaggtctctcggtcggttcatctctggtagaagaagataaactcgaacttgctacatcactcatggcaaaggccaaggcaaaaggagtgtctcttttgttgcccactgatgtcgtaattgcagacaagtttgctcctgatgcaaacagcaagattgttccagcttcaagcatccctgatgggtggatgggattggatattggtccagactctattaagacattcaatgatgcactggataccactaaaaccatcatctggaatggaccaatgggagtgtttgagtttgacaagttcgcagaaggaacagagtctgttgcaaagaagcttgcagaacttagtgggaagggagtaacaacaatcatcggaggtggagattctgttgcggccgtggagaaagtaggagttgctagtgtgatgagccacatatcaactggtggtggtgctagtttggagctgttggaaggcaaggaacttcctggtgtacttgctcttgatgaagccatactagttcctgtgtaaggaccttttttttttcctctgcatttttttccctgcccaccgtgttggtgtttaattcgagtctgtaaacaagaaatggcgtgtaggaagatgtgagttcgagttgtaaatgtctaatgttacctttcatataaggtcccaatatgtctctatataaagtttccataagagatggcagggagggacaaaggcagccgttcgatcaatctaataaatttgttctttgcaacattttctttttaaaatgtctcatggtt

SEQ ID NO: 5341 - DNA, 1900 bp, Malus domestica
cacattttgccacttttttcaatctcacaaaatcatccaacactttgaacctctcctcaacgataaggaggagtccacagccccccacacaaaccacccactaaatcccgttgttcttctcctccacatctctcccagtatacacagttggaaaaacaaccacattaacctttcatctcactcagtcaacctccgtttactatcccacacctccaccaacagcaatggcctccaccaccgcacccaccaccttctccctcctccactccgccaccacctccacctcccgcacccgcgcttccctctcccacgtctccctcccctcctccctcaaacccaccgccctccgccgcctcggcttctccgctgccgaccccctcctcgcacttcaagtagcttccaaagtccgatcctttggctccggcaaaggggtcagaggcgtcgttgcgatggcgaagaagagcgtcggggaccttaccgcggcggagctgaaggggaagaaggtgttcgtcagggctgacttgaatgtgcctttggatgacagccagaacatcactgatgatactagaatccgcgctgctatccccaccattaagcatttgattgagaagggggcgaaggtcatcctttccagtcatttgggacgaccaaaaggtgtgaccccaaaatttagcttggcacctcttgtacctcggctatcggagcttcttggcattcaggttgtcaaagctgaggactctattggtccagaagtagaaaagctggtggcttcacttcctgaaggtggtgttcttcttcttgaaaatgtgagattttacaaggaagaagagaagaatgatcctgagcatgcaaagaagcttgccgccttagcagatctttatgtcaacgatgcctttgggacagcacatagagctcatgcctcaactgagggagtcacaaagttcttgaggccatctgttgctggtttccttttgcagaaggaacttgactatctcgttggggctgtatcaagcccaaaaagaccatttgctgccattgttggtggctcaaaggtttcatccaagattggagtgattgagtcgcttttggagaaggttgatatcttacttcttggtggaggtatgattttcacattttacaaagcacaaggtctctcagtcggttcatctctggtggaagaagataaactagaacttgctacatcactcatggcaaaggccaatgcaaaaggagtgtctcttttgctgcccactgatgtcgtaatcgcagacaagtttgcccctgatgcaaacagcaagattgttccagcttcaagcattcctgacgggtggatgggattggatattggtccagactctattaagacattcaatgatgcactggataccactaaaaccataatctggaatggaccgatgggagtgtttgagtttgacaagttcgcagaaggaacagagtctgttgcaaagaagcttgcggaacttagtgggaagggagtgacaacaatcatcggaggtggagattctgttgcagccgtggagaaagtaggagtcgctagtgtgatgagccacatatcaactggtggtggtgcgagtttggagttgttggaaggcaaagaacttcctggtgtacttgctcttgacgaagccacaccagttcctgtgtaagaacaatcttttttcctgtttgtttttttccctgcccaccgtgttggtgtttcattcgagtctgtaaacgagaaatggcatgtaggaagatgtgagttcgagttgtgaatgtctgatgttaccttcagtataaggtcccattatgtctatataaagtttccataagagatggcggggagggacaaacgcagccgtccgagcaatctaataattttgttctttgcgaccctttc

SEQ ID NO: 5342 - DNA, 1792 bp, Arabidopsis lyrata
atggaagtaaacttttgttttgatcaaaagacatgatctttgtgaatgtggcccagattgtatgcagaggaaggtgaaagaattatgataacctctcatcaacgataagacaaaatccagaaacttgtaatatcatccaatcctctcactcttcttccttattctctcactttcactctctctacccgtcgacttcacatggcttccaccgcagcaactgcagctctttcgatcatcaaatccaccggtggcgccgccgttacccgctcctcccgcgcctccttcttacccattccatccaccgctgtctccgcacgtcgcctcggcttctccgccttcgttgactcgcgtttctccgtccacgtggcctccaaggtccagtccgtgcgcggaaagggcaccaggggagtgattacgatggcgaagaagagtgttggagatctgacttctgctgatttgaaggggaagaaggtgtttgttagagctgatctcaatgtacctctcgatgacaatcaaaatatcactgacgacactagaatcagagccgccattcccaccattaagtttttgattgagaatggtgctaaggtcatcctctccactcatttgggaaggccaaagggtgtcactccaaagttcagcttggctcctcttgttcccagattgtcagagctccttggtattgaggtcgtgaaagctgatgattgtattggtccacaagtggaaagcttggtggcttcccttcctgaaggaggagttttgcttcttgagaacgtgaggttttacaaggaggaagagaagaacgaacctgagtttgctaagaagcttgcttctctagctgacctttatgtcaatgatgctttcgggactgctcacagagcccatgcttcaacagagggagtcactaagttcttgaagccatcagttgctggtttccttttgcaaaaggagttggactaccttgtgggtgcggtttcaaacccaaagagaccatttgctgccattgtgggaggttcaaaggtctcatctaagattggagttatcgaatctcttcttgagaaatgtgacattcttctgcttggtggtggaatgatctttacattctacaaggcgcaaggtctttctgttggctcttcccttgttgaagaagacaagcttgaattggctacatcactccttgctaaggctaaggccagaggagtctctctgttgttaccaacagatgttgtgattgctgacaagtttgctcctgatgccaacagcaagattgtgccagcttcagccattcctgatgggtggatgggattggacatcggtccagactcggtgaaaactttcaacgaagctctggataccacacagacagtcatttggaatggaccaatgggggttttcgagtttgaaaagtttgcacaaggaactgaggcggtagcgaataaactagcagagctaagtaaaaagggagtgacaacgataataggaggaggagattcggtggcagcagtggagaaagtgggagtagcaggagtcatgagtcacatctccacaggtggtggagccagtttggagctcttggaaggcaaagtgcttcccggtgtggtcgtgcttgatgaagcaacgccagtcaccgtttaacaaaattctctttattattattacacctgaagggacctaaatgagtttcttctttttctgttgtaaatctgttattgttgtaccaccaatccatagagagaggagagactctttttgtctcaaataaaattaaaatccaatgactttcgttattttg

SEQ ID NO: 5343 - DNA, 2000 bp, Aristolochia fimbriata
cagtaatggtgagatgaaaagggcacggaaatgaaggagagccattcccaccactcagaggtagctgtggagacagaaaatccaagggtctgtggaaacatcgacatcttccttcttctctcaacctctcctcgacgataagagaatccatccccgcatccaatcacacaactttctctctcatccaagccacagaaacctttcaattctcaaaaccacaccacccttctctcttttcttttcctttctcgtgtggccagcccagcaagggagactgaagcggaaacccaagttcctgaagcgcctcgtgttctctccacctcttccgctccatggcagctgcaacatcttccacctcgctttccctcctcccttcttcttctcgccaacgggcctccgcccacgccgcacccaattgcctcaatgtcgccggcctccggtcccgggccccgttcgcccgccgcctcggttttgcaggagttgcagttgacccacttgttgcccacgttgctgcaaggatcagtaatgtggcgagtgctggcaagggcccgcgaggggtggtgtccatggcgaagaagagcgtgggtgatctctcggcgtctgatttgaaggggaagaaagtctttgtcagggctgatttgaatgtccctcttgatgacaatcagaacattaccgacgataccagggttcgggcggcaatccccactatcaagcacttgattaacaatggagctaaagtcatcctctcaagccatttggggcgtcccaagggtgtcaccccaaaattcagcttgaagcctcttgtacccaggctgtctgaactcctcggtattacggttcaaaaggctgatgattgcattggagaggaagttgagaaaatggtggcttcccttccagagggaggagtacttcttctagagaatgtgagattttacaaagaagaagagaagaatgaccctgaatttgcaaagaagctagcatcgcttgcagacctgtatgttaatgatgcctttggaactgctcacagagctcatgcctccacggagggagtcaccaagtatttgaagccctctgtggctgggtttcttctgcagaaggagcttgattaccttgttggagctattgcaaaccccaagagaccatttgctgccattgttggtggctcaaaggtttcttcaaaaattggtgtgattgaatcactgctggagaagtgtgatatccttcttttgggtggaggaatgatctttacattctacaaggcgcaaggtctgtcggtgggttcatctcttgtggaggaagacaagcttgatcttgcaacatcacttcttgcgaaagctaaggccaaaggagtctctctcttgttaccctctgatgttgtcattgctgataagtttgctccggatgcaaacagcaaggttgtgccatcatctgcaattcctgatggttggatgggacttgatattggtcctgattctgtgaagacattcagtgatgccttgggaaccaccaagactgtcatctggaatgggcccatgggtgtttttgagtttgacaaatttgctgttggaacagaggcaattgcaaagaagctcgctgagctgagtaaaagtggtgtgacaacaattattggaggtggagactctgttgcagccgtggagaaggtaggagtggctgatgtgatgagccacatttcaacaggtggtggggctagcttggagcttttggaaggtaaagagcttccaggagttcttgcacttgatgaagccacgccggttgcagtttaagatcattaattttttcttctgtaacgtttttgcttctgcaagggaggctagtgtttcattttcttcatgtggaaggttgttgtacaatgagaaatagcaaaatgggagaaataataataagagttgatggtgtatggatatcgggataggtttcaataaaaggattcttttatttcaatttttctgtcctctgttactgttttatcagttgcataa

SEQ ID NO: 5344 - DNA, 2153 bp, Gossypium hirsutum
cgaaaagttgtaacatatgattagggatctcagcccaatgttggtattcagatcctatcggttgcgaccttattagcggacaaagagaaatagtgagggagtgtgggcaaatcaagaaaagcatcgaacatcttcagcctctcctcaacgataagaaaaacaagaggtatctgatttcctcctcctcacatccaatcatttctccctttgcgcttcacgtccacatcttccccattcccatccaccgttacataaactccttttccccccctctctcacagtttccttgtctctttgccttcacaacttacaactcagcgtctccactctctttctctcttcgcctccaaatggcttctgccaccacttccaccactttttccctcctcaaaaccaccgcctccaccacctcttcctccgcctcccgctcttctgcatccctcatccgccttccctccactcgccgccacctcaaatcctcttctctcatccacagcctaggcttctcctccgctgcttctggggactctctgctttccctccatgtctcctccaaagttcgatctttcaagggaaaagggtcaagaggggttgtttcaatggccaagaagagtgttggggacttgactgccgctgatttgaaagggaagaaagtgtttgtgagggctgacttgaatgttccattggatgatagccagaacatcactgatgacaccaggattcgtgctgctattcccaccatcaagcatttgattcagaatggagctaaagtcattctctctagccacttggggcggccaaagggtgttactccaaaattcagcttggctcctcttgtacccaggctttctgaattaattggcattcaggttgtcaaggctgatgactgcattggtccagaagtagaaaagttagttgctgcacttcctgaaggtggtgttcttcttcttgaaaatgttagattttacaaggaagaggaaaagaatgaacctgaatttgcaaagaagcttgcttcgttagctgatctctttgtcaatgatgcatttgggactgcacatcgagcacatgcatcaacagagggtgttacaaaattcttgaatccatcagttgctggtttccttttacagaaggaactagactaccttgttggtgctgtttcaagccccaaaaggccttttgctgccattgtgggtggttcaaaggtctcttccaagattggcgtcattgaatcactccttgagaaatgtgacattctccttcttggtggtggtatgattttcacattttacaaggcacaaggcctatcagtcggttcatccctggtagaggaggataagcttgaacttgcaacatcacttcttgcaaaggccaaggcaaaaggagtgtctcttttgttacccactgatgtggtcatcgccgacaagtttgcccctgatgcaaacagcaagattgtgccagcatctgctatccctgatggctggatgggattggatattggacctgattctgtcaagacattcaatgaagctttggatactacccaaaccatcatctggaatggaccaatgggagtgtttgaatttgagaaatttgcagttggaactgaggctattgcaaagaagctagctgaacttagtggcaagggagtgacaacaatcattggaggtggagactctgttgctgctgtagaaaaggttggagttgctgatgtcatgagccacatatcaactggtggtggtgccagtttagaattgttggaagggaaggagcttccaggtgtgattgccctggatgaggctgttccggttgctgtgtaagatcgaatcaaattttccacatcctcactgtttagtgatttattcacaaatgaaatgctttataatgaaagagatctttttgtaaatgtgcaacattaaatcactagaagagcccttttctgcctcttcctttcttgctccttcctaaatggttgtcagaagagtgttgctcaaataaattgctttatttttatccaaaccttttcttgcattatgatattatatagccgtcctgtatggttctcttctgcaagtattgtaatatgcccctttttttcttccctttaagttgcattttatattctttgtattacaaagtcaaaaccacataaaagc

SEQ ID NO: 5345 - DNA, 1719 bp, Zingiber officinale
  misc_feature (186)..(186): n is a, c, g, or t
  misc_feature (322)..(322): n is a, c, g, or t
  misc_feature (340)..(340): n is a, c, g, or t
  misc_feature (451)..(451): n is a, c, g, or t
  misc_feature (457)..(457): n is a, c, g, or t
  misc_feature (824)..(825): n is a, c, g, or t
ttccaccgccgccgcctccctctccctcctcccaacctcctcgtaccgacggcgtgtggtggcggcgtctgcctccgccgcggcctgtcttcgacctgggctccgacggatgggtttcgccttcgcggcgggtgatcgtttgctgaccgctcacgttgccgacaggatcctggcggtggctgggangagcgggagagggattcgtggagtggtgtcgatggctaagaagagcgttggtgacctcactgtggctgacctcaaggggaagaaggtgttcgtccgagcggatctgaatgtgcccctcgatgaggaccgtaacatnacagatgatactaggatncgtgcggctgtgccgaccatccagcacttgatcagcaaaggggccaaagtcatactctccagccatctgggacgtccaaagggtgtcacgccaaaatttagcttggccccnatagtncctaggctttctgaacttcttggaatcaaggttgagaaagctgatgattgcattggtccagaagttgagaaattggtcaatgcacttcctgaaggtggtgttctcttcttgaaaatgtaagattctacaaagaagaagagaaaaatgaacctgaattcgccaagaagctggcagcactagcagatctatatgtaaatgatgcatttggaacagcacatagagcacatgcatcaacggagggggtcaccaagttcttgaagccctctgtctctggttttctactgcaaaaggaacttgattatcttgtaggcgctgtttcaagccccaacagaccttttgcagcaattgtaggtggttcaaaagtgtnntctaagattggagtaattgaatcactgttagagaaatgtgatattcttcttttgggtggaggaatgatattcacattttacaaagcacaaggcttctcagtgggttcttctttggtagaggatgacaaacttgagcttgcaaaaactcttattgcaaaagccaaagccaaaggtgtctctcttttgttgccaactgatgttgttgtggctgataagtttgcacccgatgcagacagcaaggttgtgccagcatctgaaattcctgatggttggatgggactggatattggcccagatacagttaagacatttaatgatgcactggatacaaccaagacggttatttggaatggtccaatgggagtgtttgagtttgacaagtttgcttttggaactgaggccattgcaaagaagttagcggagctcagtggaaaaggcgtgacgacaatcattggaggtggagattctgttgctgcggtagagaaagttggagtagctgatgtaatgagccacatatcaacgggtggtggggctagcttggagctgttggaaggaaaagagcttccaggagttgttgcattggatgaagcaattgctgtacctgcatgaacttgatggcaggttaagatttcttttggaatctgatttacttgtcagaaacgatggcctaaattccatttaagagctatatcattgtgatggctcctttctcttgtttcgtccctcccaagagaacccctcaagactcggaagagtttcctgctgtagagtttttttgctagttataagtggatcataccttttaaattgtcacaagttgccttttaaacagtgttggtgaaacaacctgtttattttcaagtcagattctctttgtacctgattgtgataata

SEQ ID NO: 5346 - DNA, 1734 bp, Tripterygium wilfordii
acaccctctccgtctaaacagagaaagtagagcagcagcaaaaatggcctctgccgcagcacccactactctctctctcctcaagatcgcaacttccgtctccggaacacgtgcacgctcctccctccttccagttccctcttccaccctcctccgtggcactcctcttccccgtcttgggtttgcggctgcggaccccatttttgctcatcatgtggcctccaaggtccaatctatgaaggcctccaagccatctagaggcgtcgtttccatggctaagaagagcgttggtgatctgactgcctcggacttgaaggggaagaaggtttttgtgagggctgatctgaacgtgcctctggatgatagccagaacatcactgatgacactaggatccgcgctgcgattcctactatcaagcatttgattcagaatggtgctaaagttattctttctagccatttgggtagaccgaaaggtgtcactccaaaattcagcttggcacctcttgtacctaggctatctgaactacttggaattcaggttgtgaaggctgatgattgtattggacctgaggtagaaaagttggtggcttcacttcctgatggtggtgttcttctacttgagaatgtcaggttttacaaggaggaagaaaagaatgaacctgagtttgcaaagaagcttgcttccttagctgacctctatgttaatgatgcattcggaactgcacatagagcacacgcctcaactgagggggtcacaaagttcttgcagccatctgtcgctggcttccttttgcagaaggaattggactaccttgttggggcagtttcaagcccaaagaggccattcgctgccattgtgggtggctcaaaggtctcctccaagattggagttatcgagtcactcctagaaaagtgtgatatcctacttttgggtggaggaatgattttcacattttacaaggctcaaggtctttctgttggttcatccttggtggaggaagataaactcgatcttgcaacaacgttgcttgagaaggcgaagtcacgaggagtgtctcttttgttgcccgctgatgttgtaattgccgacaaatttgctcctgatgcaaacagcaagattgtgccagcatctgagatccctgatggctggatgggattagatattggacctgaatctatcaagacattcaatgaggctttggatacaacccaaaccgtcatctggaatggaccaatgggagtgtttgagtttgacaagttcgcagttggaactgaggctattgcgaaaaagctagcggagcttagtggcaagggcgtgacaacaatcattgggggtggagactctgttgcagcagtggaaaaagtaggagtcgccgagaagatgagccacatttcaactggtggtggtgctagtttagagttgttggaaggcaaagaacttccaggtgtccttgctcttgatgaagcaatcccggtccctgtgtcagcttagttacaaaaaatttcccttccctcaagtcgaccatcttacgccataatttctgaatgagagatggagcaatgtagcgagagaatgtgagttcatgttgtaaatttttacatttgccttcaatcaatgtaaggtctcaaactattaccacctcctctacttttctttgcttcttttgtaaaatctgccaagaagtctttggagaaagggtgaagggagcattgaatttttgttcaaataaa

SEQ ID NO: 5347 - DNA, 1736 bp, Zea mays
aggactagtctggtactggtagcatattggtatttgcctatttggtacccagacccacgcggcggcacccgccaccgatcgagccgctccggcgagcgcagcgcagcccacggcatttgccgatttgtgaaggagcgtgaaaaagcccttcccacgctgggccccgcctccgcgacgcgagcccacacgtccgtttccggtgccttggccagacaggcagcccatgtgctgagctcacatgcctgccgctcccacacctcgccaccctcctgcctcctccgcatccgcgccccctcgcttagcctaaaccgcggggcagctagtctcgccaccgcaggccgcaccggtcatcacaccggagcgcacgcggggagcccccgtagagttccggggcgaccaggccaactaacgccatgaaggaggaaggcggcggcggggacgcggggttcgtgcgggcggaccagatcgacctcaagagcctggacgagcagctggagcgccatctcacccgcgcctggaccatggagaagcgcaaggaggaggcctccgccggcgctggcgccggcgccaggcagcaccagcagtcccggcgcccgcggagggaggactgggagatcgaccccgccaagcttgtcgtcaagggcgtcatcgcccgcggcacctttggcaccgtccaccgcggcatctacgacgctcacgacgtcgcagtgaaactacttgattggggagaggatgggcatagatcagaacaagacattgcagcactaagagcagctttttcacaagaggtctctgtttggcataagcttgaccatccaaatgtaaccaagtttattggagctataatgggtgcaagggatctgaatattcaaacggaaaacggccacattggcatgccaactaatatctgctgtgtcgttgtggagtaccttcctggtggtgcactaaaatcatttctgataaagaacaggagaaagaagctagcttttaaggtcgttgttcaaatcgctcttgaccttgccaggggattaagctatctccattccaagaagattgtgcaccgtgatgtgaagactgaaaatatgcttcttgacaaaacgagaaccgtgaagatcgctgattttggtgttgctcgccttgaagcttcaaatcccagtgacatgacgggcgaaactggaacgcttggttacatggcacctgaggttctcaatggaaatccctacaacaggaaatgcgatgtttacagcttcgggatctgtttgtgggagatatactgctgtgatatgccatatcctgacttgagcttttctgaggtcacgtctgcggttgtccgtcagaacctgaggccggagataccacgctgctgcccgagctctctatcgaacgtgatgaagcgctgctgggacgccaaccccgacaagcgacctgagatggccgaggcggtgtccatgctggaggcgatcgacacgtcgaagggtggaggcatgatccctgtggaccagcggccaggatgccttgcgtgcttccggcagtacagaggtccatgacagataggtggaaacctgttggagctgcggcctctagatctcgtggatgccgatcgatcgcgtgttgttttctggggaagcaaactggttaatggagctagcccgccttaccggctcgtgtaaatcctctgtccatcaattctgtaactctgttttatcgattaatgaaaagaaccgggcttgctcgac

SEQ ID NO: 5348 - DNA, 1970 bp, Setaria italica
agttttactgaatattctttcgccaaaccacgtggtagtacatttgtacacacaaggggtagaagcagaacaggatcgtgtcccatcggtgattactgattacctcctcctaggctcccctaccatctactactacatctagcccgtgccgtacgccggcctcccccagtccccacctcctcactcgagccgctccggcgagcgcagcccacggcatttcccagcgtaaaaactccacagaaaaaaacccagcccacgctgggccccgcccggcgagcccacccgtccgcttccgcttgcctcggcactcggcaagcaggcagcccatgtgctgagctcacatgcctgccgctaccacgcctcgccgccacccttcttccccctccgcctcctcctacctagccacctcatcgctagcctaaccgcggcagccaccacaccacacgccaccagtccaccacaccaaaccgcacgctctagtcgtgagggggcgatcaggcgaagcggcgcgcgatgaaggagggggctggcggcggcggcggcggcggcgggggaggagttgttggaggagaggacggcgggttcgtccgggcggaccagatcgacctcaagagcctggacgagcagctggagcgccacctcagccgcgcatggaccatggagaagcgcaaggaggaggcctccgccggcgccaaccagcgcggcggcgccgccgggaggcagcactcccttcgcccccggagggaggactgggagatcgaccccgccaagctcgtcgtcaagggcgtcatcgcccgcggcaccttcggcaccgtccaccgcggcatctacgacggccacgacgtcgcagtgaaattacttgattggggtgaggatggtcataggtcagaacaagatattgcagcactaagagcagcattttcacaagaggtctctgtttggcataagcttgaccatccaaatgtaactaagtttataggagctataatgggtgcaagggatctgaatattcagacagaaaatgggcacatcggcatgccaactaatatctgctgtgttgttgtggagtatcttgctggaggtgcactaaaatcatttctgataaagaacaggaggaggaagttagcttttaaggttgttgtccaaattgctctcgaccttgctcgagggttaagctatcttcactcaaagaagattgtgcaccgtgatgtgaagactgaaaatatgcttcttgacaaaacaagaactgtgaaaattgctgattttggtgttgctcgccttgaagcttctaatcccagtgatatgaccggtgaaaccggaacacttggttacatggcacctgaggttcttaatggtaatccttataacaggaaatgtgatgtctatagctttggaatttgtttatgggagatatactgctgtgacatgccatatccagatttgagcttctcagaggtcacgtctgctgttgttcgacagaacttgaggcctgagataccgcgctgctgtccaagttctttagcaaatgtgatgaagcgttgctgggatgcgaaccccgacaagcgacctgagatggccgaggttgtgtctatgatggaggcgattgacacatcaaagggtggaggcatgattcccgttgatcagagaccaggatgcctttcgtgcttccgtcagtacagaggtccgtgattgacgggcttttctggagctgtggtctgaagattgacccctagatcctgtgtatgtcgattgcatttgttttctgggaagcaaactggttaatggagctagtgtgcttgtgatcccttgtctgagaagcccttcgtatgtaaattctccgtccatcccatctgtaactctgtttatcaatgaatgaaagaaccggctcgctcgtctatgtttcctgatgcaaatatttctgcatgatcggagaaaaaaagaaaacagtagcagcttggaaggaaccctca

SEQ ID NO: 5349 - DNA, 2131 bp, Oryza sativa
gtcctatgttggaaattgccttagccctcaggctggtactctaagcagttttattgcttttaatcaagccgcaattttataattcgtatacattttaccataatttatataataattggttttaattttttaagtgcagaaatcaattccatacgcctcaatccataatttatatagtattttttaaggatcaaaaagtatttaaaaccgcaagtagagctgccctcgaaatgaaatccatacgcctcaatcccgccctcacgccggtataaatacaccaccgcgagccgagacggcgatcgatcccccgcccaaacaacaccggccaccacacgacgcagcagcagcgagaaacgaacgtcgaagaagaagaagacgagggggaaaaaccgcggaaaaccacgcgccgctgggcgcgcgctgggctgggcccctcgcgcgcgacgcgacacgacacgacacgacacgacggcacgagcccaccccgtctccctcccgtctccctccccctccccctccccggccgctgcctgcctcggcagcccatgtgctcacatgccactccgcctcgccactctcttcccccctcctcctctcctagcctagcctagccactgctcgctcgcttgctcacttgctctgttgctcaccaccaccaccaccaccacacggcgggatgaaggagggcggcggcgatggagggttcgtgcgggcagaccagatcgacctcaagagcctggacgagcagctggagcgccacctgagccgcgcgtggaccatggagaagcgcaaggaggaggcggccgccgaccagcgtggcagcaagccgcccgcgctcgccgccgcgcactactcgcagaaccgcaggcagcggagggaggagtgggagatcgaccccgccaagctcgtcgtcaggggggtcatcgcccgcggcaccttcggcaccgtccaccgcggcgtctacgacggccacgacgtcgcagtgaaattacttgactggggagaggatgggcataggtccgaacaagacatcgcagcactaagagcagctttttcacaagaggtctctgtctggcataagctggaccatccaaatgttacaaagtttataggggctataatgggcgccagggatctagatattcaaacagaaagcggacatcttgccatgccaagtaatatctgctgtgttgttgtggagtaccttgctgggggttcactaaaaggatttctgataaagaataggagaaagaagttagcttttaaagttgtggttcagatagctcttgaccttgccagggggttaagttatcttcactcaaagaagatcgtgcaccgtgatgtaaagactgaaaatatgcttcttgacaagacaagaactgtgaaaattgctgattttggtgttgctcggcttgaggcttcaaatcccagtgatatgacaggggaaacaggcacccttggttacatggctcctgaggttctcaacggcagtccatacaacaggaaatgcgatgtttatagctttgggatttgtttatgggagatatactgctgtgatatgccatatccagatttgagcttctcagaggtcacgtctgctgttgttcgtcagaatttaaggcctgagatgccacgctgctgtccaagttctctggcaaacgtgatgaaacgctgctgggatgcgaaccctgacaagcgacctgagatggccgaggtggtgtctatgttggaggcgatcgatacttcgaagggtggaggcatgatccctgtagatcagcgacaaggatgcctttcatgcttcaggcagtacaggggtccgtgacggatggagcacgctggagttgtatctgcagattgacggctacatctcgtgtaattcgattacatttgttttaaggtacgtaagcaaactggttatggagctagcatgcttaagacctttggtttgtgtagccctctgatgtaaattccctgttcatcccttctgtttatcaatgaagaaccagctcggctcgttcatccatgtttgatgttccctgatgtaaatatttcaccagtatcgacgagtagtagcaatgaagagacccccaaaaagatatgatgattgacctgttttggcttgcttcgctct

SEQ ID NO: 5350 - DNA, 1956 bp, Brachypodium distachyon
agtatctctcggttctcacttctccgtctcagcccccggcctttcccaggcagtcccgtccccttccgcgtataaaacagagcacaccgcccgccccgccaaacccgaaaacgatcagatcagatcaagcgccccaggcaaaaccggcgagcgagcaaaacccgccgaaaaaagagaaagaaatcccgggggagatctaaccaccaaatccacgcgcccctggggccctcgccgcgcgacacgacaccaccctccctctccccctgccctgccacggcactcgtcgtttcggcggcagccccatgtgctcgcatcacatgcacgctcctcctcgccggtcctagtccctgctgccaccacctcctcctggccctagcctcgcgccttcgccgcatccacccgcatccacaggcgcaccattagtctctctcgctgctgctgcggctgcttggagcgcgggatcctgttcctgcgttggaggggctgcgagtgaggccggagcacggggagatgaaggaggcgggcggagatggtgggggtgaaggggcggcggcggggccggggttcgtgagggcggaccagatcgacctcaagagcctggacgagcagctggagcgacacctcagccgcgcctggaccatggagaagcgcaaggaggagggggacaaggacgccaagcagcagcagcagcagccgcggcggcgggagggatgggaggccgaccccgccaggctcgtcgtcaggggcgtcatcgcccgcggcaccttcggcaccgtccaccgcggcgtctacgacggccacgacgtcgcagtgaaattgcttgattggggggaggatggtcataggtcagaacaagaagtaacagcagtaagagcagctttttcacaagaagtaactgtctggcataagcttgatcatccaaatgtaactaagtttattggagctatcatgggtgctagggatctgaatattcagacagaaaatggaaatattggcatgccaaccaatgtctgctgtgttgttgtcgagtatctccctggaggagcactaaaaacatttctgataaagaacaggagaaggaagttagcttttaaagtcgtggtccaaatagctctcgatcttgccaggggattaagttatcttcactcgaagaagattgtgcaccgtgacgtgaagactgaaaatatgcttcttgacaaaacaagaactgtgaaaattgctgatttcggtgttgctcgccatgaggctgcaaaccccagtgatatgacaggcgagacaggcacccttggttacatggcacctgaggttctcaatggcaatccttacaacaggaaatgcgatgtgtatagctatgggatctgcttgtgggaggtatactgctgcgatatgccatacgcagatttgagcttctctgaggtcacatctgctgttgttcgtcagaatctgaggccggagataccacgctgctgcccaagctcgttcgcgaacgtgatgaagcgctgctgggacgcgaaccctgacaagcggccggagatggccgaggtggtgtccatgttagaggcgatcgacacttccaagggcgggggcatgatccctgtggatcagccgacagggtgcttctcgtgcttccggcagcgcaggggcccttgatggatgaatggatggatctgctgcgagctggaggacaggagtagtagttctctgcttgcagaattgaccgctagatttcgcttagttgattccatttgctttgattttaaggtaagcaaactctggtaaaaatggagctagctagtgtgcttgtgatctctcgacaagcccgtctcctgtaaattcgttagtctcttttttcatgaaaaaagaaccggctcgttcgtctatggttaatttccgtgatgatatttcaccaagattttgattgttctttttgggccttcagcgttaacaaaatcgaga

SEQ ID NO: 5351 - DNA, 1399 bp, Brachypodium distachyon
atgaaggaggcgggcggagatggtgggggtgaaggggcggcggcggggccggggttcgtgagggcggaccagatcgacctcaagagcctggacgagcagctggagcgacacctcagccgcgcctggaccatggagaagcgcaaggaggagggggacaaggacgccaagcagcagcagcagcagccgcggcggcgggagggatgggaggccgaccccgccaggctcgtcgtcaggggcgtcatcgcccgcggcaccttcggcaccgtccaccgcggcgtctacgacggccacgacgtcgcagtgaaattgcttgattggggggaggatggtcataggtcagaacaagaagtaacagcagtaagagcagctttttcacaagaagtaactgtctggcataagcttgatcatccaaatgtaactaagtttattggagctatcatgggtgctagggatctgaatattcagacagaaaatggaaatattggcatgccaaccaatgtctgctgtgttgttgtcgagtatctccctggaggagcactaaaaacatttctgataaagaacaggagaaggaagttagcttttaaagtcgtggtccaaatagctctcgatcttgccaggggattaagttatcttcactcgaagaagattgtgcaccgtgacgtgaagactgaaaatatgcttcttgacaaaacaagaactgtgaaaattgctgatttcggtgttgctcgccatgaggctgcaaaccccagtgatatgacaggcgagacaggcacccttggttacatggcacctgaggttctcaatggcaatccttacaacaggaaatgcgatgtgtatagctatgggatctgcttgtgggaggtatactgctgcgatatgccatacgcagatttgagcttctctgaggtcacatctgctgttgttcgtcagaatctgaggccggagataccacgctgctgcccaagctcgttcgcgaacgtgatgaagcgctgctgggacgcgaaccctgacaagcggccggagatggccgaggtggtgtccatgttagaggcgatcgacacttccaagggcgggggcatgatccctgtggatcagccgacagggtgcttctcgtgcttccggcagcgcaggggcccttgatggatgaatggatggatctgctgcgagctggaggacaggagtagtagttctctgcttgcagaattgaccgctagatttcgcttagttgattccatttgctttgattttaaggtaagcaaactctggtaaaaatggagctagctagtgtgcttgtgatctctcgacaagcccgtctcctgtaaattcgttagtctcttttttcatgaaaaaagaaccggctcgttcgtctatggttaatttccgtgatgatatttcacca

SEQ ID NO: 5352 - DNA, 1819 bp, Sorghum bicolor
cccctggtggagcccgcaaccgcaacacgggtcctggcctcctggcctcctgccgtcacttgccttcccgtaccccgtgcctacttcggcaacccgctgtcccatgcgctcacatggagactcccgcaggagctcgaaccacctccgcctcgccacctcttcctcttcgtcttccccagtagcagccgccgccgccacccactgcggcagccaaaccacgtgaggccttccacgccgctcaacccccacagcatccgctgccaccgccgctcatcacctccccggcgctcccggctccaactactgcaagcatgaggcagcccaccagcgcgggcggcgacgctgggttcgtgcgcgcggaccagatcgacctcaagagcctggacgagcagctcgagcgccacctcggacgcccggcggagcggggagtcggcctagcctccgggacggggagccgccgcggcgagtccgcgaggctgcagggcccggaggagctgacgccgctgcggcggtgccgtgaggactgggagatcgaccccgccaagctcgtcatcaagggcgtcatcgcgcgcggcacctttggcaccgtgcaccgcggcgtctacgacggccaggacgtcgccgtaaaaatgcttgactggggcgaggatggtcatagatcagaacaagaaattgctgcactaagagcagcgtttgcacaagaggtcgctgtgtggcataagcttgaccatccaaatgttactaagtttattggggctataatgggtgcaagagatttaaatatacagacggaaaatggacatcttggcatgccaagtaatatttgctgtgttgttgttgagtaccttcctggaggtgcactgaaaaattttctgataaagaacaggagaaggaagcttgcctttaaagttgtggtccaaatagctcttgaccttgccaggggattatgctatctccactcaaagaagatagtgcatcgtgatgtcaagactgaaaatatgcttctggacaaaacgagaactgtaaaaattgctgattttggtgttgctcgagtcgaggcttcaaatcctagcgatatgacgggtgaaacagggacacttggttacatggctcctgaggttctcaatggccatgcttacaacaggaagtgtgacgtgtacagctttgggatctgcctgtgggagatatactgctgtgacatgccgtaccctgatcttagcttttctgaagtcacctctgccgtggttcgccagaacctgaggcctgagataccacgatgctgcccgagctcgctagcgaacgtgatgaagcggtgctgggacgcgaacccggacaagcgccccgagatggcggaggtggtgtccatgctggaggcgatcgacacgtccaagggtggcggcatgatccccaaggaccagtcgcagggctgcctctcgtgcttccgccggcaccgaggcccctaacgcagacgcaggcccaggttgcttatacccggtgaaatgaaatgatgacagtggtatctacaacttcatttgtaatctaatcgcagaactggtataacggagaagcttcccattgcttgtcatgggtgtaaatggatggggtggttgacgattgatgtccttgtatgctcgcttcgagttctaatgcttgctgtaagttaaggtcaggtgtagagagagttgctgcggccgtttgctcacatcgttaatttcattcatggccgtgacgtgaagcagggttattatgtactgttggattaaccatctctttacatataatgttattaattattaaataacacatgaattatcttcag

SEQ ID NO: 5353 - DNA, 1846 bp, Sorghum bicolor
cccctggtggagcccgcaaccgcaacacgggtcctggcctcctggcctcctgccgtcacttgccttcccgtaccccgtgcctacttcggcaacccgctgtcccatgcgctcacatggagactcccgcaggagctcgaaccacctccgcctcgccacctcttcctcttcgtcttccccagtagcagccgccgccgccacccactgcggcagccaaaccacgtgaggccttccacgccgctcaacccccacagcatccgctgccaccgccgctcatcacctccccggcgctcccggctccaactactgcaagcatgaggcagcccaccagcgcgggcggcgacgctgggttcgtgcgcgcggaccagatcgacctcaagagcctggacgagcagctcgagcgccacctcggacgcccggcggagcggggagtcggcctagcctccgggacggggagccgccgcggcgagtccgcgaggctgcagggcccggaggagctgacgccgctgcggcggtgccgtgaggactgggagatcgaccccgccaagctcgtcatcaagggcgtcatcgcgcgcggcacctttggcaccgtgcaccgcggcgtctacgacggccaggacgtcgccgtaaaaatgcttgactggggcgaggatggtcatagatcagaacaagaaattgctgcactaagagcagcgtttgcacaagaggtcgctgtgtggcataagcttgaccatccaaatgttactaagtttattggggctataatgggtgcaagagatttaaatatacagacggaaaatggacatcttggcatgccaagtaatatttgctgtgttgttgttgagtaccttcctggaggtgcactgaaaaattttctgataaagaacaggagaaggaagcttgcctttaaagttgtggtccaaatagctcttgaccttgccaggggattatgctatctccactcaaagaagatagtgcatcgtgatgtcaagactgaaaatatgcttctggacaaaacgagaactgtaaaaattgctgattttggtgttgctcgagtcgaggcttcaaatcctagcgatatgacgggtgaaacagggacacttggttacatggctcctgaggttctcaatggccatgcttacaacaggaagtgtgacgtgtacagctttgggatctgcctgtgggagatatactgctgtgacatgccgtaccctgatcttagcttttctgaagtcacctctgccgtggttcgccagaacctgaggcctgagataccacgatgctgcccgagctcgctagcgaacgtgatgaagcggtgctgggacgcgaacccggacaagcgccccgagatggcggaggtggtgtccatgctggaggcgatcgacacgtccaagggtggcggcatgatccccaaggaccagtcgcagggctgcctctcgtgcttccgccggcaccgaggcccctaacgcagacgcaggcccaggttgcttatacccggtgaaatgaaatgatgacagtggtatctacaacttcatttgtaatctaatcgcagaactggtataacggagaagcttcccattgcttgtcatgggtgtaaatggatggggtggttgacgattgatgtccttgtatgctcgcttcgagttctaatgcttgctgtaagttaaggtcaggtgtagagagagttgctgcggccgtttgctcacatcgttaatttcattcatggccgtgacgtgaagcagggttattatgtactgttggattaaccatctctttacatataatgttattaattattaaataacacatgaattatcttcagtaaatccgattttggagcgaagataaa

SEQ ID NO: 5354 - DNA, 1442 bp, Panicum virgatum
  misc_feature (361)..(361): n is a, c, g, or t
  misc_feature (520)..(520): n is a, c, g, or t
  misc_feature (882)..(882): n is a, c, g, or t
  misc_feature (983)..(983): n is a, c, g, or t
  misc_feature (1051)..(1051): n is a, c, g, or t
  misc_feature (1123)..(1123): n is a, c, g, or t
  misc_feature (1154)..(1154): n is a, c, g, or t
  misc_feature (1238)..(1238): n is a, c, g, or t
  misc_feature (1250)..(1250): n is a, c, g, or t
  misc_feature (1297)..(1297): n is a, c, g, or t
  misc_feature (1394)..(1394): n is a, c, g, or t
gccgctcgcacgcctcgccctcgcctcgccgccgccacccttccccttccccctgcttcctagccacctcatcgctagcctaaccgcggagccaccacacctcacgccatcagtcagtccatcacaccgagccgcacggtcgagtcgtgactcgtgaggcgatcaggcgaaccggcacgcgatgaaggagggcggcggcggcggcgggggaggaggaggaggaggtgacggggggttcgtccgggcggaccagatcgacctcaagagcctggacgagcagctggagcgccacctcagccgcgcctggaccatggagaagcgcaaggaggaggcctccgccggcgccaaccagcgcggcggnggcgggaggcagcactcgctccgcccccggagggaggactgggagatcgaccccgccaagctcgtcgtcaagggcgtcatcgcccgcggcaccttcggcaccgtccaccgcggcatctacgacggccacgacgtcgcagtgaaattgcttgattggggngaggatggtcataggtcagaacaagatattgcagcactaagagccgcattttcacaggaggtctctgtttggcataagcttgaccatccaaatgtgactaagtttattggagctataatgggcgcaagggatctgaatattcagacagaaaatggacacatcggcatgccaactaatatatgctgcgttgttgtggagtaccttgctggaggtgcactaaaatcatttcttataaagaaccgaagaagaaagttagcttttaaggtggttgtccaaattgctcttgaccttgccaggggcttctaatcccagtgatatgaccggcgaaactggaacacttggttacatggcacctgaggttnttaatggcaatccttataacaggaaatgtgatgtctatagctttggaatatgtttatgggagatatactgctgtgatatgccatatccagatttgagcttntcagaggtcacgtctgctgttgttcgacagaacttgaggcccgagataccgcgctgctgtccaagttntttagcaaacgtgatgaagcgttgctgggacgcaaaccccgacaagcgacctgagatggctgaagttgtgtntatgttggaggcgatcgacacatcaaagggnggaggcatgattcccgtcgatcagcgaccaggatgccttgcgtgcttccgtcagtacagaggtccgtgattgatggacagtgcnggagctgtggtntgaagattgacctctagatcctgtgtacctagattgcatttgttttntgggaagcaaattaaactggttgatggaggtagtgtgctttgatcccttgtttgagaagccctcttatgtaaattcctcgttcatcccttatatgtntcttttatcaatgaatgaaagaaccggctcgctgtccatgttttcctg

SEQ ID NO: 5355 - DNA, 1844 bp, Gossypium raimondii
cctcattaacacatcacccgtcgccttcaggcaaaatccatgtgctcacatgcctcttctctgagcttttgaaacaaacaaataaacaaaattattaataaaaaaaaacccagtcttttctttccttaccttatttatatatattggaaagaaattattttgatggaatttttataatcttacacagaaaaattaacatggtgaattaaaaaacaaactataatattatattatattatatatatacttgtattttagatcaggattgagttctctagttttcagttgagatttttgatagagacacagaatcagaaatagctcaaacaagtaagtgaaagtgaagaaaaacttgaagaaaagatagtttttgaagaataaatttgtgttttcttggtttgggttttttgagaagatgaaggagcagaaaagtgaaagtggaggagggtatgtaagagcagatcagatagatctgaagagcttagatgagcaacttcaaaggcatcttagtagagcatggacaatggagaagaataagaacaggaaagaagaaggtgaggacggcggcggcggcggcggcggagaacagctcaggtcaagcagcaacactgtgagaagacaagagtgggagattgatccttctaagcttatcatcaaaagtgtaatagctcgtggtacttttggtactgttcaccgtggtatttatgatggccaagatgttgctgttaaacttctcgactggggagaagagggtcacagatcagcggctgaaatagcttcacttcgagcagcttttacacaagaagttgccgtgtggcataagcttgatcatcctaatgtaacaaagttcataggggcgacaatgggctcatcggacttgaacatacaaacggaaaatggccaaatcggcatgccgagtaacatgtgttgtgttgttgttgaatattgtcctgggggtgcattgaagtcttacctgataaagaataggagaaggaagctggcctttaaagtagtcgttcaattggcactagatctcgcacgagggttaagctatcttcattccaagaagattgtccatagagatgtcaaaactgaaaacatgcttttggacaagacacgaactgtgaaaatagccgatttcggggttgctcgtcttgaggcttcaaaccctaatgacatgaccggagagaccggaacacttggttacatggcacccgaggtccttaacggcaatccctacaatagaaagtgcgatgtgtacagttttggtatctgtttatgggaaatatactgctgtgacatgccatatcccgatctcagcttctcggaagtgacgtcagctgtcgtccgccagaatctaaggccggaaatacctcgttgctgtccgagttcacttgcaaacgtaatgaagcgatgctgggatgccaacccggacaaaagaccggagatggacgaagtggtgtcgatgattgaggcgatagatacatcgaaaggtggaggaatgatcccacatgatcaagctcaaggttgtttatgttttcggagatatcggggaccgtgataatggttgaaccctaaagatatgtagtcagggattagggttccaattgattcatattgaattgaaaatggaaagatgggaatgcaatgtaagatccaaaattgtggagtttattgactaagaaaatgtttcacaatttctgctattttaaacttacctttttgtaaagcttttctcttcttttttttatgctacacctgaaaatgcttccaatttgaaaaatggttaattgtagaaacttaaatttatttttacttcttaacatattttactattaaaataa

SEQ ID NO: 5356 - DNA, 1831 bp, Setaria italica
cccctggtggggcccgcaacacgagtccctgcctccctgtgtcagttgccttcccgtaccccccgacccccgtgcctacttcggcaacccgctgccccatgcgctcacatggagactcccgcacgaagtcgaaccacctccgcctcgccacctcttccccttccccagtagccgccgccgccacaaccaccctctgcggcagccaaaccacgtgagcacctccgcgccgctcaccccccacagcgtccccctgccgcagccgccgcgcgcctcactccccggccctcccgagtcccgacgccaccgctccaagcatgaggcagcccaccagcgcgggcggggacgcggggttcgtgcgcgcggaccagatcgacctcaagagcctggacgagcagctcgagcgccacctcggccgccccgcggagcggggcgtgggcccggcttccggaacggggagccgccgcggcgagtccgcgaggctgggcccggaggagctcacgccactgcggcggtgccgggaggactgggagatcgaccccgccaagctcgtcatcaagggcgtcatcgcgcgcggcaccttcggcaccgtccaccgcggcgtgtacgacggccaggacgtcgccgtaaaattgcttgactggggcgaggatggtcataggtcagaacaagaaattgctgcgttgagatcagcatttgcacaagaggttgctgtctggcacaagcttgatcatccaaatgttaccaagtttattggggctataatgggtgcaagagatttaaatgtacagacggaacatggacatcttggcatgcctagtaacatttgctgtgttgttgttgagtaccttgccggaggtgcactgaaaaattttctgataaagaacaggagaaggaagcttgcctttaaagttgttgtccaaatagctcttgaccttgccaggggattatgctacctccactcaaagaagatagtgcatcgtgacgtcaagactgaaaacatgcttctggacaaaacgagaactgtgaagattgctgattttggcgttgctcgagttgaggcttcaaatcctggtgatatgaccggcgaaacagggacgcttggttacatggcacctgaggttctcaacggtcatccttacaacaggaagtgtgacgtttacagctttgggatctgcctgtgggagatatactgctgcgacatgccgtacccggatcttagcttctcagaagtcacttctgctgttgttcgccagaacctgaggcccgagataccgcgctgctgcccgagctcgctagcgaacgtgatgaagcggtgctgggacgcgaacccggacaagcggcccgagatggcggaggttgtgtccatgctggaggcgatcgacacgtccaagggcggcggcatgatcccgacggaccagacgcagggctgcttctcctgcctccgccgtacccgaggcccctaacgccgtggatctggtcgcagtaacgcgtacccggtgaagtgacgctattattgctcggtagaactcagtgtaaaatctagttgcggaacagggtataatggagaaatttctcacgggtgtaaatgaatgggctgttcgacatcgtccttgtatgtttgctgcggattctagatgcttgctgcacgttaaggtcaggcttagagagaattactgtggccgaggaattgaaattcatggccgtgtcgtgaagcaggcttatgtactgttggattcaccatctctttacataatgttgatataatgaatgaataacatgaaatcgaatatggatcatcatccggatatcagactggaaccgaaagggagaa

SEQ ID NO: 5357 - DNA, 1502 bp, Gossypium hirsutum
ggaatttttataatcttacacagaaaaattaacatggtgaattaaaaaacaaactataatattttattatattatatatatacttgtattttagatcaggattgagttctctagttttcagttgagatttttgatagagacacagaatcagaaatagctcaaacaagtaagtgaaagtgaagaaaaacttgaagaaaagatagattttgaagaataaatttgtgtttttttggtttgggttttttgagaagatgaaggagcagaaaagtgaaagtggaggagggtatgtaagagcagatcagatagatctgaagagcttagatgagcaacttcaaaggcatcttagtagagcatggacaatggagaagaataagaacaggaaagaagaaggtgaggacggcggcggcggcggagaacagctcaggtcaagcagcaacactgtgagaagacaagagtgggagattgatccttctaagcttatcatcaaaagtgtaatagctcgtggtacttttggtactgttcaccgtggtatttatgatggccaagatgttgctgttaaacttctcgactggggagaagagggtcacagatcagtggctgaaatatcttcacttcgagcagcttttacacaagaagttgccgtgtggcataagcttgatcatcctaatgtaacaaagttcataggggcaacaatgggctcatcggacttgaacatacaaacagaaaatggtcaaatcggcatgccgagtaacatgtgttgtgttgttgttgaatattgtcctgggggtgcattgaagtcttacctgataaagaataggagaaggaagctggcctttaaagtagttgttcaattggcactagatctcgcacgagggttaagctatcttcattccaagaagattgtccatagagatgtcaaaactgaaaacatgcttttggacaagacacgaactgtgaaaatagccgatttcggggttgctcgtcttgaggcttcaaaccctaatgacatgaccggagagaccggaacacttggttatatggcacccgaggtccttaacggcaatccctacaatagaaagtgcgatgtgtatagtttcggtatctgtttatgggaaatatactgctgtgacatgccatatcccgatctcagcttctcggaagtgacgtcagctgtcgtccgccagaatctaaggccggaaatacctcgttgctgtccaagttcacttgcaaacgtaatgaagcgatgttgggatgccaacccggacaaaagaccggagatggacgaagtggtgtcgatgattgaggcgatagatacatcgaaaggtggaggaatgatcccatatgatcaagctcaaggttgtttatgttttcggagatatcgaggaccgtgataatggttgaaccctaaagatatgtagtcagggattagggttccaattgattcatattgaattgaaaatggaaagatgggaatgcaatgtaagatccaaaattgtggagtt

SEQ ID NO: 5358 - DNA, 1685 bp, Gossypium hirsutum
ggcaaatccatgtgctcacatgcctcttcccttagcttttgaaacaaacaaataaacaaaattattaataacataaaacccagtcttttctttccttaccttatttatatatattggaaagaaattattttgatggaatttttataatcttacacagaaaaattaacatggtgaattaaaaaacaaactataatattatattatattatattatattttatatatacttgtattttagatcaggattgagttctctagttttcagttgagatttttgatagagacccagaatcagaaatagctcaaaaaagtaagtgaaagtgaagaaaaacttgaagaaaagatagtttttgaagaataaatttgtgttttcttggtttgggttttttgagaagatgaaggagcagaaaagtgaaagtggaggagggtttgtaagagcagatcagatagatctgaagagcttagatgagcaacttcaaaggcatcttagtagagcatggacaatggagaagaacaagaacaggaaagaggaaggtgaggacggcggcggcggcggagaacagctcaggtcaagcagcaacactgtgagaagacaagagtgggagattgatccttctaagcttatcatcaaaagtgtaatagctcgtggtacttttggtactgttcaccgtggtatttacgatggccaagatgttgctgttaaacttctcgactggggagaagagggtcacagatcagcggctgaaatagcttcacttcgagcagcttttacacaagaagttgccgtgtggcataagcttgatcatcctaatgtaacaaagttcataggggcgacaatgggctcatcggacttgaacatacaaacggaaaatggccaaatcggcatgccgagtaacatgtgttgtgttgttgttgaatattgtcctgggggtgcattgaagtcttacctgataaagaataggagaaggaagctggcctttaaagtagtcgttcaattggcactagatctcgcacgagggttaagctatcttcattccaagaagattgtccatagagatgtcaaaactgaaaacatgcttttggacaagacacaaactgtgaaaatagccgatttcggggttgctcgtcttgaggcttcaaaccctaatgacatgaccggagagaccggaacacttggttacatggcacccgaggtccttaacggcaatccctacaatagaaagtgcgatgtgtacagttttggtatctgtttatgggaaatatactgctgtgacatgccatatcccgatctcagcttctcggaagtgacgtcagctgtcgtccgccagaatctaaggccggaaatacctcgttgctgtccgagttcacttgcaaacgtaatgaagcgatgctgggatgccaacccggacaaaagaccggagatggacgaagtggtgtcgatgatggaggcgatagatacatcgaaaggtggaggaatgatcccacatgatcaagctcaaggttgtttatgttttcggagatatcggggaccgtgacctaaagatatgtattcagggattagggttccaattgattcatattgaattgaaaatggaaagatgggaatgcaatgtaagatccaaaattgtggagtttattgactaagaaaatgtttcacaatttctgctattttaaactgacctttt

SEQ ID NO: 5359 - DNA, 2042 bp, Theobroma cacao
catacaacataagtacttaaaacaaaaagacaaccgaacaaaacaaaagggccacgagggggagagagatacagaagcagcagaagaagagaagaaagaagcagaagccagaaggagcagaaacaacaacagccagcagtaacacaagaaaaccaaaagtgggtcacaacaacacacgtcgtcttcaggcaaaatccatgtgcccacatggctgtttgtgagttttgaaagaaacaaataaacaaacaaaaaaaacccaactttttttattacttgtttttcctcatatttttatatatatatatacatatacatgagattgtcactgagttctagtttttagtatagattttggacagagagacccagaatcagaagtagctcaaacaagaatagaaagtgaagaaaaactaagaaaaaggtttccaaaaattgttcctttcttcttcttcttctttttttttactgtttgctggtttctgagagtaaagttgtgatttatagttggagttgagaagatgaaggagaaaagtgagagtggtggaggagggtatgtaagagcagatcagatagatctgaagagcttggatgagcaactccaaaggcatcttagtcgagcatggacgatggagaagaacaagaacaggaaagaggaaggagaggaaggtggtggaggtggagaacagctaaggccaagcaacaccatgagaagacaagagtgggagattgatccttctaagcttatcatcagaggtgtcatagctcgtggcacctttggtactgttcaccgtggtatttatgatggccaagatgttgctgttaaactccttgactggggagaagagggccacagatcagaggctgaaatagcttcacttagagcagcttttacacaagaagttgctgtgtggcataaacttgatcatcctaatgtaacaaagtttataggggcaacaatgggctcgtcagagctgaacatacagacagaaaatggtcacattggcatgccaagtaatgtttgttgtgttgttgttgaatattgtcctgggggtgcactgaaatcttacctgataaagaatcgaagaaggaagctggcctttaaagtagttattcaactggcactagatcttgcacgagggttgagctatattcattccaagaagatagtccatagagatgtcaaaacagaaaacatgcttctggacaagacacgtactgtgaaaatagctgattttggggttgctcgccttgaggcttcaaatcctcacgacatgactggagagactggaacgcttggttacatggccccagaggtccttaatggcaatccctacaatagaaagtgtgatgtgtatagttttggtatctgcttgtgggagatatactgctgtgacatgccataccctgatctcagcttctcagaagtgacatctgctgttgtccgccagaatctgaggccagagatacctcgttgctgtccgagttctcttgcaaatgtaatgaagcgatgttgggatgccaaccctgacagacggccggagatggatgaggtggtgtccatgatagaggctattgacacatcgaagggcggaggcatgatcccgcatgatcagcctcagggttgtttgtgttttcggagatatcgcggaccttgatattgttacacccccttgaatcaaaaggtgctttcagggtagagtccaatttattcatatttaattgaattggaaagatggcaatgtaagagctgaaagtaggaaattgtggagtttattggctaaaagaaattccgcaatatctgctattcgaacatgcattttgtaaagcttttctttctttatcttttcccccctcctttctcctcctctatttttcttcatttaagagtactctgtatctgatccaccggccagttatataacaggtgggccacacacactcacagaagctttgatgtccccattaagatgatcactggcttatcagctatctgatattgtgcatgcaagaaatgcttttcctaataaattttaaaaatgctt

SEQ ID NO: 5360 - DNA, 1756 bp, Zea mays
tacttcggcaacccgctgtcccatgcgctcacatggaatggaagctcccgcacgaactcgaaccaccttcgcctcgccacctcttcctcttccccagtagccgccgtcacccacccactgcggcagccaaaccacgtgaggccttccacccagctcaagcccacagcatccactgacactgccaccgccgctcacctccccggcgttcccggctccaccaactactgcaagcatgaggcagcccaccagcgcgggcggcgacgctgggttcgtgcgcgcggaccagatcgacctcaagagcctggacgagcagctcgagcgccacctcggacgccgggcggagcggggagtcggcctaccctccgggacggggagccgcggcggcgagtccgcgaggctgggcccggaggagctgacgccgctgcggcggtgccgtgaagactgggagatcgaccccaccaagctcgttatcaagggcgtcatcgcgcgcggcacctttggcaccgtccaccgcggcgtctacgacggccaggacgtcgctgtaaaattgcttgactggggtgaggatggtcatagatcagaacaagaaattgctgcactgcgagcagcttttgcacaagaagttgttgtctggcataagcttgaacatccgaacgttactaagtttattggtgctataatgggtgcaagagatttaaatatacagacagaacatggacatcttggcatgcccagtaatatttgctgcgttgttgttgagtacctccctggaggtgcactgaaaagttttctgataaagaacaggagaaggaagcttgcctttaaagttgtggtccaaatagctcttgacattgccaggggattatgctatctccactcagagaagatagtgcatcgtgatgtcaagactgaaaatatgcttctggacaaaacgagaactgtaaaaattgctgattttggtgttgcccgagttgaggcttcaaaccctagcgatatgacgggcgaaacagggacacttggttacatggctccagaggttctcaacggccatgcttacaacaggaagtgtgacgtgtacagctttgggatctgcctgtgggaggtatactgctgtgacatgccgtaccccgaccttagcttttctgaagtcacctctgccgtggttcgccagaacctgaggcctgagataccgcgctgctgcccgagctcgctagcgaacgtgatgaagcgatgctgggacgcgaacccggacaagcgtcccgagatggcggaggtggtgtccatgctggaggtgatcgacacgtccaagggtggcggcatgatccccaaggaccagacgcagggctggctctcgtgtttccgccggtaccgaggcccctaacgcagagttgcttttacccggcgaaatgatgatattggtctccacgactcagtgtaatctaatcgcagaactggctataattgagagttttctcgttgtcctgggcgtaaatgcatggatgggccggcagttgacgattgatgtccgttcaaatgcttgctgtaagttaattcaggtgtagagggagttgctgtggccgtttgctcacatcgtttaatttcatggccgtgacgtgaagcaggtcatttttagaaaaaaaatatgtattaatatttcagtctctatcgattgacacatatagttgtccaaagttacatctaacaaatagctaaagttcttttagggctagtttgagaacctattttcctaaggaat

SEQ ID NO: 5361 - DNA, 1765 bp, Zea mays
cacgaaaccccttgtgggacccacaaccgcaacacgagtcctcggctcctgacctccgggtctggcctccggcgtcacttgccctcccgtaccccgtgcggccgtgcctacttcggcaacccactatctcatgcgctcacatggagactcccgcacgaactggaatcatctccgcctcgccacctcttcatcttcttccccagtagccgccgccaccaccactgcagcagccaaaccacgtgacacctcccgcgccgctcaaccccacagcatccgttgccaccgccgctcacctccccggcgctcccggctacaaccactgcaagcatgaggcagccaaccagcgcgggcggcgacgctgggttcttgcgcgcggaccagatcgacctcaagagcctggacgagcagctcgagcgccacctcggacatcccgcggagcgggtagttggcccagtctctgggacagggagccgccgcggcgaaacggccaagctgggtccggaggagctgacgccactgcagcggtgccgtgaggactgggagatcgaccctaccaagctcatcatcaagggcgtcatcgcgcgcggcacctttggcaccgtccaccgcggcgtctacgacggccaggacgtcgctgtaaaattgcttgactggggcgaagatggccatagatcagaacaagaaattggtgcactaagagcagcgtttgcacaagaggtcgctgtctggcataagcttgagcatccaaacgttactaagtttattggggctataatgggcgcaagagatttaaatatacaaacggaacatggacagcttggcatgccaagcaatatttgctgtgttgttgttgagtaccttgctggaggtgcgctgaaaaattttctgataaagaacaggagaaggaaacttgcctttaaagttgtggtccaaatagctcttgaccttgccaggggattatgctacctccactcaaagaaaatagtgcaccgtgatgtcaagactgaaaacatgcttctggacaagacgagaacggtaaagatcgctgattttggtgttgctcgagtcgaggcttcaaatcctagcgatatgacgggagaaacagggacgcttggttacatggctcctgaggttctcaatggccatgcttacaacaggaagtgtgacgtgtacagctttgggatctgcctgtgggagatatactgctgtgacatgccgtaccctgatctcagtttttctgaggtcacctctgccgtcgttcgccagaatctgaggcctgagataccgcgctgctgcccgagctcgctagcgaatgtgatgaagcgatgctgggacgcgaacccggacaagcgtcccgagatggcggaggtggtgtccatgctggaggcgatcgacacgtccaagggtggcggcatgatccctaaggaccagacgcagggctgcctctcgtgcttccgccagtaccgaggtccctaacgcagggttgtttatttatacccggtgaaatgatgatattggtctctacactacaactcagtgtaatctaatcgcagaagtggctatataatggagaagcttatcattgcttgccatgggtgtaaatggatggggcggggtggttgacgattggtgtgcttgtatgctcgcttcgagttataatgcttgctgtaagttaaggtgtggacggagttgctgttgccgtttgctcacatcgttaaattcgtgggcgtgacatgaagcaaggttatgtactacgtattggatt

SEQ ID NO: 5362 - DNA, 1991 bp, Gossypium raimondii
agagaggtagaggatagtccaatgacatcattgatgagaagagaaatttggcagagtagaaagtaggctgtttgaaagggacagttgggttggacttgcatatacaaccagagataaacccccatttaaaacaaagctacgaccgtgaatcccataaatgcataaaaaatacaaagcaggaggaagaagaagaagcagccgatacagaaacaaagaaaccaccgtaagtgggtcacaacaacagacgtcgtcttcaggcagtaatccatgtgcccacatggctgtttgcgagtttgaaagaaaccaataaacaataaccccccaaaagaaaacacaactctctttcatttatttcttttcatatatatataaaatattatttaagattatgattgagttgtagtttttagtgtagattttggagagatacccagaatcaggaatagttgaaaaaagctaatagttttaaaagactgttcctttctctgttttggaggagtgtgaagatgaaggagaaaagtgagagcgggggaggagggtatgtaagagcagatcagatagatctgaagagcttggatgagcaacttcagaggcatcttagtagagcatggacgatggagaagaacaagaacaacagggaagataaaggagaggaaggcggcggacagctgaggcctagcaacactgggagaagacaagagtgggagattgatccttctaagcttatcatcaaaagtgttatagctcgtggcacttttggaaccgttcatcgtgggatgtatgatggccaagatgttgctgttaaacttcttgactggggagaagagggccacagatccgaggccgaaatagcttcacttcgagcagcttttactcaagaggttgcggtgtggcataagcttaatcatcctaatgtaacaaagtttataggggcgacaatgggctcatcggacctgaacatacagacggaaaatggtcaaattggcatgccaatttgttgtgttattgtggaatattgtcctgggggtgcactgaaatcctacttgataaagaatcggagaaggaagttggcttttaaagtagtcattcaattggctctagatcttgcacgagggttgagctatcttcactcccaaaagattgtccatagagatgtcaagacagaaaacatgcttctggacaagacgcgtaccgtaaagattgctgatttcggggttgctcgactcgaggcttcgaaccctaatgacatgaccggagagactggaacacttggttatatggcaccagaggtccttaacggcaatccctacaataggaagtgtgatgtgtatagcttcggtatctgcttatgggagatatactgctgtgacatgccgtatcctgatcttagcttctcggaagtgacatcggctgtcgtccgtcagaatctgaggccggagatacctcgttgctgtccgagttctcttgcaaatgtaatgaaaagatgctgggatgcaaaccccgacaaacggccggagatggacgaagtggtgtcgatgttggaggcgattgacacatcaaaaggcggaggcatgattccgcatgatcaaactcaaggttgtttgtgtttccggagataccgcggaccttgatattgaattaaatatggtagcagagctaagtaacattccagtttattcatatatttcatttgaattggaaagtaagagctgatgaaagtagaaagttgtggagttcaatatctgctattccagcatccatatgtctcttttggataatgggaacagaggcggaaggcattggaagtcgaggtcttggcccttaaacaattttgatttttcatattttcttttcttaatttgtgtttataactttatatgttttacagtatcagataaaattttatgccttcctcaaaatgaaattcatatactttttactaaaacttaaaattttttatagtaatttttaataatagattcaaaccccca

SEQ ID NO: 5363 - DNA, 1470 bp, Secale cereale
gtgtccgactcctcgggcgtgctccaagtatgaggcttccaggcgcaggcggcggcgggagcggggacgcggggttcgtgcgggcggaccagatcgacctcaagagcctcgacgagcaactggagcgccacctcagccgccaggagcgggacgcgctagtcccggcgcagccagggagccgccgcggcgggtccgcgaggctgggggagccgcagccgccgccgcagcagcgccggcgccgggaggactgggaggttgaccccgccaagcttgtcatcaaaggcgtcattgcccgcggcaccttcggcaccgtccaccgcggcgtctatgacggccaggacgttgccgtgaagttgcttgactggggggaggatggtcatagatcagaacaagaaattaccgcactaagatcagcattcgcccaagaggttgctgtgtggcataagcttgatcatccaaatgttacgaagtttattggggctataatgggtgcaagagatctaaatgtacagacagaacatgggcatcttggcatgccgagtaatatctgctgtgttgttgttgagtaccttgctggtggtgcactgaaaaatttcctgataaaaaataggcgaaggaagctagcctttaaagttgtggtccaactagctcttgaccttgccaggggattaagctatcttcactcggagaagatagtgcatcgtgacgtgaagactgaaaatatgcttctcgacaaaacaagaaccgtgaaaattgctgtattttggggttgctcgagtcgaggcttcaaaccctagtgacatgacgggtgaaacaggcacacttggttacatggcacctgaggtcctgaatggtcatccttacaacaggaaatgcgatgtttatagctttggaatctgcttatgggagatatactgctgtgacatgccatatcctgacctcagcttctcagaagtaacttctgccgttgtccgccagaacctgaggccagagataccgcggtgctgtccgagcgccttggccaacgtgatgaagcggtgctgggacgcgaaccccgacaagcggcccgagatggccgaggtggtggccatgatagaggccatcgacacgtccaagggcggcggcatgatccctatagaccactcgcaggggtgcttcgcctgcttccgtcagtaccgaggcccctaacggtctgatctgacggtgtcacctggttggtgatctagaatcttagtgtagtagtactactactactttactaatcacgtcagttatggctaatttagtaaacgcccgcttaatctcatcatcattgtatgtatgccttgtgcgaaccctaatgcttggcatgccctaggatcaagctcggagtttagtatgagtctgacagggtgggcaggtcacaggtggtcttacagtctcatggtctgaagcggacacactgtactgttgaagtttatatatgttcac

SEQ ID NO: 5364 - DNA, 1388 bp, Gossypium hirsutum
tatataaaatattatttaagattatgattgagttgtagtttttagtgtagattttggagagatacccagaatcaggaatagttgaaaaaagctaatagttttaaaagactgttcctttctctgttttggaggagtgtgaagatgaaggagaaaagtgagagcgggggaggagggtatgtaagagcagatcagatagatctgaagagcttggatgagcaacttcagaggcatcttagtagagcatggacgatggagaagaacaagaacaacaggaaagatgaaggagaggaaggcggcggacagctgagacctagcaacactgggagaagacaagagtgggagattgatccgtttaagcttatcatcaaaagtgttatagctcgtggcacttttggaaccgttcatcgtgggatgtatgatggccaagatgttgctgttaaacttcttgactggggagaagagggtcacagatccgaggccgaaatagcttcacttcgagcagcttttactcaagaggttgcggtgtggcataagcttaatcatcctaatgtaacaaagtttataggggcgacaatgggctcatcggacctgaacatacagacggaaaatggtcaaattggcatgccaatttgttgtgttattgtggaatattgtcctgggggtgcactgaaatcctacttgataaagaatcggagaaggaagttggcttttaaagtagtcattcaattggctctagatcttgcacgagggttgagctatcttcactcccaaaagattgtccatagagatgtcaagacagaaaacatgcttctggacaagacgcgtaccgtaaagattgctgatttcggggttgctcgactcgaggcttcgaaccctaatgacatgaccggagagactggaacacttggttatatggcaccagaggtccttaacggcaatccctacaataggaagtgtgatgtgtatagcttcggtatctgcttatgggagatatactgctgtgacatgccgtatcctgatcttagcttctcggaagtgacatcggctgtcgtccgtcagaatctgaggccggagatacctcgttgctgtccgagttctcttgcaaatgtaatgaaaagatgctgggatgcaaaccccgacaaacggccggagatggacgaagtggtgtcgatgttggaggcgattgacacatcaaaaggcggaggcatgattccgcatgatcaaactcaaggttgtttgtgtttccggagataccgcggaccttgatattgaattaaatatggtagcagagctaagtaacattccagtttattcatatatttcatttgaattggaaagtaagagctgatgaaagtagacagttgtggagttcaatatctgctattcca

SEQ ID NO: 5365 - DNA, 1469 bp, Manihot esculenta
ttttttgtcacttggaaatgaaggagaagagtgaaaccggaggtgggtatgtgagagcagatcagatagatctgaagagcttggatgagcaactccagaggcatttaagtagagcatggactatggagaagaacaagagcaagaaagatggagaagaaggagaagcagcacttcaaagacctctaaacgacactataacaaggcaagaatgggagattgacccatctaaactcataatcaaaggtgttatagctcgtggaaccttcggcaccgttcaccgtggcgtctatgatggccaagatgttgctgttaaacttcttgattggggggaggagggtcacaggtcagatgctgaaatagcttcacttagagcagcttttactcaagaagttgctgtgtggcacaagcttgatcatcctaacgtaactaagtttattggggcaacaatgggctcatcagagttgaacatacaaactgagaatgctcacatcggcatgccaagtaatgtttgctgtgttgttgttgaatattgtcctggaggtgctttgaaatcttacctcataaaaaacaggagaaggaagctggcatttaaagtagttgttcaactggcactagatcttgcacgagggttgagctatctccattctcagaagattgtccacagagatgttaaaacagaaaatatgcttctggacaagacacgtacagtgaaaatagctgactttggtgttgctcgcctggaagcatcaaatcctaatgacatgactggagagactggaacacttggatatatggctcctgaggttctcaatggcaacccgtataatagaaagtgcgatgtatacagttttggaatttgcctgtgggagatatactgctgtgatatgccatatccagacctcagtttctcagaagtgacatctgctgttgtccgacagaatctgaggcctgaaataccccggtgctgcccaagttctcttgccaacgtgatgaagcgatgttgggatgcaactcctgacaagcggcctgagatggaagaggttgtgtccatgttagaggcaattgacacatccaagggcggaggaatgatccctctagaccaacctcaaggttgtctctgtttccgaaggtatcgagggccataaatgttgtcttcaggactgggggacagtggattctattatttctattattcaaaatggtatcttattcatttgaagatgctggggtataaaagctgaggctatagtaaaactgcggaggctgtagtctatgaggagccctgcagtaactgttcttttattggataaggcattctgtaaagctctttgtttttttttttttttctggacttcttgttctgttatgtaagaattatgcatcttatttgactggccattcatatcatggatgggccagacacccttttctatatcataagtcttaatatgaaattgatttgatcatca

SEQ ID NO: 5366 - DNA, 1725 bp, Elaeis guineensis
agagatcccaactggtcagagacacgttgtcttcaggcaacccatgtgctcacatggaacatagagcaaagagaaccagtgggagagtggggagagcaggagcagaagaagaggaggggaagagagaagaagaagatagaagaagggagagaagaggagctctcatcagtttctctaagtaggtaagaacagaaaggagaacaagaacaagaactctcgcacttgctagtggttaactcttccttgagagaagaagatcgagggagagaggagatgaaggaagggggagatggggttcgtgcgggcggaccagatcgatctgaagagcctggacgagcagctggagaggcacctgagccgggcatggacgatggagaagaagaaggaggaggagagaggcggcggccgaggggagaggcagagggaagactgggagatcgatccctccaagctggtcatcaaaggggccatcgcccggggcaccttcggcaccatccaccgcggtgtttacgacggccaggatgtcgcagtgaagttgcttgactggggagaagaaggtaacaggacagaagctgaaattgctgcactcagggcagctttttctcaggaagtttctgtttggcataagttagatcatcccaatgtaaccaagtttataggggctaccataggtggcagagatctaaatatacaaacagaaaatggccatcttggcataccgagtaatgtatgctgtgtcgtcgtcgagtaccttcctggtggtgcactgaaaacatttcttatcaaaaaccggagaagaaaattagccttcaaagttgtcgttccaatggctcttgatcttgcaaggggactgagttatctgcattcaaaaaagatcgtgcacagagatgtgaagacagagaatatgcttctggataagacaagaacagtaaaaattgctgactttggtgttgcccgtgtcgaggctcaaaatcctaatgacatgacgggtgaaacaggaacacttggttacatggcacctgaggtcctcaatggcgatccttacaacagaaaatgtgatgtttacagttttggcatttgcttatgggaaatatactgctgtgatatgccatatcctgatcttagcttctcagaggttacgtctgcagttgttcggcagaacctgaggccagagataccaagatgttgcccaagctccctggccaatgtaatgaagagatgctgggatgcgaaccctgacaagcgacctgagatggatgcagtggtagctatgttggaggcgatagacacatcaaagggtggaggaatgatccctcttgatcagccccaaggatgtctgtcatgctttcgcaagaacagaggtccttgatgactcaagacttagcaaaccacggccctttaattgctctaaagatgcagaccttggcgatcagattgtaccgacctacgtaaacaaatctggtttcctggagctgaggtggtgggatccttgttttagttgaggagctctgcacatctctcagtctcattagttgatgtaaagaatttttcacctttgtgtgtattagaatattgggcggccagttttaggattagctcacgtttcaggtatcgtgtaagatgattcatatgtaaactattttggtttatttcaatcttcttttttactaaaataaacacagaggctcgcaatacaggaagtagttatacagaataacttattac

SEQ ID NO: 5367 - DNA, 2117 bp, Cajanus cajan
cacaaaaggaaaaaaaaaaaaaaaactcaccaaacaactaaacaaggcatggcacagacacacagagagaaagagatctttgggttcaataaattagaagttgaagggcttgttaattagaagaagagcaaagtgggtcagaaacacacgtcgtgttcaggcaaaatccatgtgcccacatggatgattgagagaaagagagagagaaagtgagagtattgtatttatgacctcaacatcaccacaagcagcagcagcagcaacaacacctggagtggcagcaaaaacatactagtagcagaagagagacacaatagacccaccaaggaaattttgctcaaaacaagaacttgctaccaaagttggtaacttttgatggttctaagtgagttgagtttgaaagtccatagtggggtgtagtgatttttgatttttgagtttggagtggggaaggaagagaagggttgagtgggagaaatgaagaagagtgagagtggggggtatgtgagagcggatcagatagatctgaagagcttggatgagcagcttcagaggcatctgagtagggcatggaccatggagaagaacaaggagaaggaagaagatgaggttgaagggaggtcaacaagaagcagacaagaatgggagattgacccttccaaactcataatcaagactgtcattgctcgtggtacttttggcactgttcatcgtggaatttatgatggccaagatgttgcagttaagctccttgactggggggaagagggccatcggtcggaggctgaaatagcctctttgagagcggcttttactcaagaagttgctgtttggcacaagcttgaccatcctaatgtaaccaagtttattggggcaacaatgggaacatcagagctacagatacaaacggaaaatggtcatataggcatgccaagtaatgtttgttgtgttgttgttgaatattgtcccggaggtgcgctgaagtcttatctcattaaaaaccgaagaaggaagctggcttttaaagtggttgttcaactggctcttgaccttgcaagagggttgagctatctccacatgaagaagattgtccatagagatgttaaaacagaaaatatgctactggacaagacacgaactttgaaaatagctgatttcggagtagctcgtattgaggcttccaatcctcatgacatgacaggtgaaactggaacccttggttacatggcacctgaggttctaaatggcaatccatacaatagaaagtgtgatgtgtatagttttggcatatgcttatgggagatatactgctgtgacatgccatatcctgaccttagcttctcagaagtaacatcagctgtcgtacgacagaatctgaggccagagattccgcgatgttgtcctagctctctggcaaatgtgatgaaaagatgctgggatgcgaatcctgataagaggccagagatggatgaagttgtgtccatgttggaagctattgacacttcaaagggtggaggtatgatccctcatgatcagcctcaaggttgtttatgttttcgcaggtatcgaggaccttgaaagatttttcactgccaaggaaatcgattgtggagggatgatatagtgttctggtgatcagtttgtattttatttcattgaaggaatagggaaggaagactaaggatggaatgcatacacaaaaactgtgaaagcaatagtgaatgaagagctctacaattacttgttactttgttgggctataatttttgtaaagctaattgtgctctctcctcattgcacccatttttatgatatttctatgtaagttgtacacttgacagtagtagcatggattgttccaacactaatatcaaagtcctgatgggtcatttgatgtcctatgagcgtacaagtgatctgttttgggaagatctgctcatgtgcagaaaaacatgacctataatatgtggaataaatacaatttggccattaaaagatgttatatgttgtagattgaggaaagtttttgcttgtaaaattgacagttcaaattgtcaacttgctgacaagtatgttgaacttatctacttgttaacaagtttatctctacggtcaaa

SEQ ID NO: 5368 - DNA, 1640 bp, Aristolochia fimbriata
atcaggcaatccatgtgcccacatggatcataatactagtcatagaggaagagaagagagagaaacagtggaaagagaggaaaacaaactcccccaagaagcagcacaaggcggcaaaacacccattaactccaatccgaccttttcctctatctcctccgggaacgttgagaacaggggaaaaaacagcgggactgagtcggaaatgaaggagactagtgatgggttcgtcagggcggatcagatcgacctgaagagcctcgatgatcagcttgagaggcacctcactcgggcatggaccatggagaagaagaaagaggaaagggtcgccaggcaagagtgggaaatcgatccctccaagcttattataaaaagcgtaattgctcgaggcactttcgggactgttcatagaggaatttatgacggacaagatgttgcagtaaaactgcttgactggggggaggagggacataggacagaagcagaaattgcttcgctgcgttcagctttcacacaagaagtcgcagtctggcataagcttgatcatcctaatgttactaagtttataggtgcaactatgggctcatctgacttaaatatacaaacagaaaatggccatattggcatgcctagcaacatatgttgtgttgttgtggagtatcttgctgggggtgcacttaaatcatacctcataaaaaatcgaagaaggaagcttgcttttaaagtagtggtacagttggctctggatcttgctcgagggttgagttatcttcactcagaaaagatagtccatagagatgtgaagacagaaaatatgcttctggataagacccgaacagtaaaaattgcagattttggggttgctcgtgttgaagctcaaaatcctaacgacatgacgggtgagacaggaacacttggttatatggcccctgaggtgctgaatggcaacccatataacagaaaatgtgatgtatacagctttggcatctgcttgtgggaaatttattgctgtgacatgccatatcctgatcttagcttctcggaggtgacctctgcagttgttcgacaaaatttgagacctgagattcctcgctgttgtccaagttccttggccaatgtgatgaagagatgctgggatgcaaacccagataagagacctgagatggatgaagtggtgaccatgttagaggcgatagacacatccaagggcggagggatgattcctttggaccagcaacagggatgtttgtgcttcaggagatatcggggaccgtaacaaagactctcctctgcagaaaaatttttagttgggccctgagatgatggagaatgagctcagtgtaatcacaatttgtaattagaggatgaagctttgcagttatggatggctaccaccagaaggaaagccgggcacaccattcgcctttctggttgctgcactgtataaaggttttctcttcattgtgtatttgattgactagcctgctctagggatttgactggcttttcaactagtttgtaagatgagcttctatattttaatgataatatgacgaattgaataattgagattatgatcttgaaaggtgtggatgaaaggatactacaataatactggaatagacacggttccttcaaac

SEQ ID NO: 5369 - DNA, 1446 bp, Gossypium hirsutum
gagtgtgaagatgaaggagaaaagtgagagcgggggaggagggtatgtaagagcagatcagatagatctgaagagcttggatgagcaacttcagaggcatcttagtagagcatggacgatggagaagaacaagaacaacagggaagataaaggagaggaaggcggcggacagctgaggcctagcaacactgggagaagacaagagtgggagattgatccttctcagcttatcatcaaaagtgttatagctcgtggcacttttggaaccgttcatcgtgggatgtatgatggccaagatgttgctgttaaacttcttgactggggagaagagggccacagatccgaggccgaaatagcttcacttcgagcagcttttactcaagaggttgcggtgtggcataagcttaatcatcctaatgtaacaaagtttataggggcgacaatgggctcatcggacctgaacatacagatggaaaatggtcaaattggcatgccaatttgttgtgttattgtggaatattgtcctgggggtgcactgaaatcctacttgataaagaatcggagaaggaagttggcttttaaagtagtcattcaattggctgtagatcttgcacgagggttgagctatcttcactcccaaaagattgtccatagagatgtcaagacagaaaacatgcttctggacaagacgcgtaccgtaaagattgctgatttcggggttgctcgactcgaggcttcgaaccctaatgacatgaccggagagactggaacacttggttatatggcaccagaggtccttaacggcaatccctacaataggaagtgtgatgtgtatagcttcggtatctgcttatgggagatatactgctgtgacatgccgtatcctgatcttagcttctcggaagtgacatcggctgtcgtccgtcagaatctgaggccggagatacctcgttgctgtccgagttctcttgcaaatgtaatgaaaagatgctgggatgcaaaccccgacaaacggccggagatggacgaagtggtgtcgatgttggaggcgattgacacatcaaaaggcggaggcatgattccgcatgatcaaactcaaggttgtttgtgttttcggagataccgcggaccttgatattgaattaaatatggtagcagagctaagtaacattccagtttattcatatatttcatttgaattggaaagtaagagctgatgaaagtagacagttgtggagttctatatctgctattccagcatccattttgtaaagctttgctaatccatatgtctctttcggataatgggaacagaggcggaaggcattggaagtcgaggtcttggcccttaaacaattttgatttttcatattttctttcttaatttgtgtttataactttatatgttttacagtatcagataaaattttatgccttcctcaaaaa

SEQ ID NO: 5370 - DNA, 1904 bp, Quercus alba
tctctatgcggaaacacacgtcgtgttcaggcaatatccatgtgcccacatggatgatatagtctagagactaagagagagagttactctgttactgatactactactacttgtagacagacatcattataatccagagcagtcagcaccaccacaaccacaacaacaaggagcagcgatagttaagtgaaaaacatagatacacacacaaaaagacacaaactatcaatcagaacccgttactctttttgtaccttaaccgttgaactttgacacgaccaacatagagagagagagagagagatgaaggagaagagtgaaagtggaggtgggtatgtgagagcggatcagatagatctgaagagcttagacgagcagcttcagagacatctaagcagggcatggactatggaaaagaacaagaagagagaggaagatcagcaagagcaagaagcagcaaggtccactgtcaccaggaggcaagagtgggagattgacccctctaagctcatcatcaaggctgtcatagctcgtggaactttcggcaccgttcaccgcggcatttatgatggtcaagacgttgctgttaaacttcttgattggggggaggagggccacaggtcagatgctgaaatagcttctcttagagctgcttttacacaggaggttgctgtttggcacaagcttgaacatcctaatgtaacaaaatttattggggcaacaatgggttcatcagagctaaacatacaaacagataatggccacataggcatgccgagtaatatttgttgtgttgtagtggagtattgtcctggcggtgctctaaaatcttacctcataaagaaccgaagaaggaagctagcttttaaagtagttgtccaacttgcactggatcttgcaagagggatgagctatcttcactcccagaagattgtccacagagatgttaaaacagagaatatgcttctggacaagacacgcactgttaaaatagctgattttggagttgctcgtattgaggcttcaaatcctaatgacatgactggcgagactggaacccttggttacatggcaccggaggttctcaatggcaatccatataacaggaaatgtgatgtgtacagttttggcatatgcttgtgggagatatactgctgtgatatgccgtaccctgacctcagcttctcggaagtaacatcagctgttgttcgccagaatctgaggccagagataccccgttgttgcccaagctctcttgcaaatgtaatgaagcgatgctgggatgctaaccctgataaacggccagagatggatgaggtagtgaccatgttggaggccattgacacgtcgaagggtgggggtatgatcccaaatgatcaggctcagggttgtttatgtttccgaaggtatcgtgggccttgaaatatttcaactccttgaagcaaagagattgtggtgatatgcaacaaagtcataagagttctggatccaatttgtatcttattcaaaattaaaaggttgaaaatgaagggaaaagcaaactgtggaggctaaaagctaagagaagctctccaatatttgttactctattggactatagattttgtaaagctgtttttttctttctcataatcttttctcttactttgaaaattttaatacataatagtttagttgctatgatcatagggcttatctgttctaacaaacgggcatgtgcgtgggcctgcactgacacacacattcctgagtacctgatggctcaactctatggaggttatgaactgttgtacttgataatagttgtttatcatgccctttttgaggtcatctagatgttgagggaaaaagctgagcatattgaacaagttgccaaagttatcaatggttatgtgatctagttg

SEQ ID NO: 5371 - DNA, 1675 bp, Brachypodium distachyon
atgaggtttcccagcgcgggcggcggcgggagcggggacgcggggttcgtgcgggcggaccagatcgacctcaagagcctcgacgagcagctggagcgccacctcagccgccacgagcggaccgagccacccccgccgcagcccgggagccgccgcggcgagtccacgaggccaggggacgcgcagccggccccggcgcagcagccgcgccggcgccgggaggactgggaggttgaccccgccaagctcgtcatcaaaggcgtcatcgcccgcggcaccttcggcaccgtccaccgcggcgtctacgatggccaggacgtcgccgtaaaattgcttgactggggggaggatggtcatagatcagaacaagaaattactgcactaagatcagcattcgcacaagaggttgctgtctggcataagcttgatcatccaaacgttactaagtttattggggctataatgggtgcaagagatctgaatgtacagacagaacatgggcatcttgggatgccgagtaatatttgctgcgttgtggttgagtaccttgctggtggtgcactgaaaaatttcctgataaagaacaggagaaggaagttagcgtttaaagttgtggtccaactagctcttgaccttgctaggggattgagctatcttcattccgagaagatagtgcatcgtgatgtcaagactgaaaacatgcttctggacaaaacaaggacagtgaaaattgctgattttggtgttgctcgagttgaggcttcaaatcctagtgatatgacaggtgaaacaggcacacttggttacatggcacctgaggttctcaatggtcatccttacaacaggaaatgtgatgtttacagctttggaatctgtttatgggagatatactgctgcgacatgccatatcctgatctgagcttctcagaagtaacttctgctgtcgttcgccagaacttgaggcctgagataccgcgctgttgtccaagcgctttggcgaacgtgatgaagcgctgctgggatgccaaccccgacaagcggccggagatggccgaagtggtgtccttgatagaggcgatcgacacgtccaagggcggcggcatggtcccaatagatcagtcgcagggatgcttcaactgcttccgtcagcaccgaggcccctgacgctgacactttgattttgatctcatggctctgcccgatcaatccatctcgctagatctcagtgtaatctaatcacaccgtcgtggtaaatggagaagttctatgatgtaaatgcctgcttcatctcatccttgtatgcttttctgctaatcctaatgcttgaaatgcggtaggatcaagcttcagagtttagtgtaagtctgccagggctgttcacgggttttacagtctcatgctcatgatgtggacttctcattgtactattgcagtttatgtctttacagaatgtgaataaagaacataattcaagatgtattgttgtagcactcggatttcattcgaaccgagctcaaggatagcaagattcatagaaacatttttatgtgcgtgcttggaaaggaagattttatttccaagctgcaaaattatttgtgatttgtgaaatttctgcagtgtaaacggccaaagtgttttttagaaagatagggcttttgcccctgttccattcata

SEQ ID NO: 5372 - DNA, 1749 bp, Secale cereale
aaaaaccacgcacaaaatccaacccaatccactccctctccacgcgccgctgcgcgacacgacaccaccctcccctgccaccattccgaggcagaggcaggcagtcccatcccatgtgctctgctcacatgctcgccgaccgatcctcactgcccgtcctagcctcctagccgcagctcgccagcacgccaggcggtcgccgcgagtgagtgagtgagtgaggcgcgggaggtcgggagatgaaggaggcggctgttggcggcggcggggacggggacggggccggggggttcgtgcgggcggaccagatcgacctcaagagcctcgacgagcagctcgaccgccacctcgcccgcgcacggaccatggacaaccccaagcccaagcgcaaccaggaccagccgcagccgcgccacgactgggaggccgaccccgccaggctcgtcgtccgcggcgtcatcgcgcgcggcaccttcggcaccgtccaccgcggcgtctacgacggcctcgacgtcgcagtgaaactgcttgattgggggagggatggtcacaggtcagagcaagaaattacagcaataagatcagccttttcacaagaagtctccgtctggcataagcttgatcatccaaatgtgactaagtttataggggctataatgggtgctggggatctgaatattcagacagaagatggaaacattggcatgccaagtaatgtctgctgtgtcattgtggagtaccttgctggaggtgcactaaaaacatttctgataaagaacaggagaaggaagttagcttttaaagttgtggtccaaatagctcttgaccttgccaggggattaagctatcttcactcaaagaagattgtgcatcgtgatgtgaagactgaaaacatgcttcttgacaaaacaagaactgtaaaaatcgcggatttcggtgttgctcgccatgaggctgcaaaccccagcgacatgacaggcgaaacaggcacccttggctacatggcacctgaggttctcaacggcaacgcttacaacaggaaatgcgacgtctacagctacgggatctgcctttgggaggtgtactgctgcgacatgccgtacgcggacctgagcttctcggaggtcacgtccgctgttgtccgtcagaacctgaggccggagatcccgcggtgctgcccgagcgcgtttgcgaacgtgatgaagcggtgctgggacgcgaaccccgacaagcggccggagatggcggaggtggtgacgatgctggaggcgatcgacacgtccaagggcgggggcatgatccccgtggaccaggcgcggggcatcgggtgcctctcgtgcctcaggccgcgcaggggcccctgaccgaatgcgcgacggatcacgcggcaaagcgggtgcagtgtcctttctgcaatgccctcgatctcgcgtttggttgattgcatttgctttagtttcaaccaaggtgcgcaaaccggtttgacccttggtttggcaggcaacccatctgatgtaaattcccctgtctctaccccttcccttctgcttatgctcgttcgtctatgtttttttctgtgctcatgtctcatcctggtctgcaccacctatcatccataagaatagtgttcctgaggcctcatttattatttgtaaaaaaaatttaagtaaacttgtcgtacctttttcctatttttatttttttgtattttttttcttaaaagttaagttaaaacgtttagttagttag

SEQ ID NO: 5373 - DNA, 1486 bp, Brachypodium distachyon
catgaggtttcccagcgcgggcggcggcgggagcggggacgcggggttcgtgcgggcggaccagatcgacctcaagagcctcgacgagcagctggagcgccacctcagccgccacgagcggaccgagccacccccgccgcagcccgggagccgccgcggcgagtccacgaggccaggggacgcgcagccggccccggcgcagcagccgcgccggcgccgggaggactgggaggttgaccccgccaagctcgtcatcaaaggcgtcatcgcccgcggcaccttcggcaccgtccaccgcggcgtctacgatggccaggacgtcgccgtaaaattgcttgactggggggaggatggtcatagatcagaacaagaaattactgcactaagatcagcattcgcacaagaggttgctgtctggcataagcttgatcatccaaacgttactaagtttattggggctataatgggtgcaagagatctgaatgtacagacagaacatgggcatcttgggatgccgagtaatatttgctgcgttgtggttgagtaccttgctggtggtgcactgaaaaatttcctgataaagaacaggagaaggaagttagcgtttaaagttgtggtccaactagctcttgaccttgctaggggattgagctatcttcattccgagaagatagtgcatcgtgatgtcaagactgaaaacatgcttctggacaaaacaaggacagtgaaaattgctgattttggtgttgctcgagttgaggcttcaaatcctagtgatatgacaggtgaaacaggcacacttggttacatggcacctgaggttctcaatggtcatccttacaacaggaaatgtgatgtttacagctttggaatctgtttatgggagatatactgctgcgacatgccatatcctgatctgagcttctcagaagtaacttctgctgtcgttcgccagaacttgaggcctgagataccgcgctgttgtccaagcgctttggcgaacgtgatgaagcgctgctgggatgccaaccccgacaagcggccggagatggccgaagtggtgtccttgatagaggcgatcgacacgtccaagggcggcggcatggtcccaatagatcagtcgcagggatgcttcaactgcttccgtcagcaccgaggcccctgacgctgacactttgattttgatctcatggctctgcccgatcaatccatctcgctagatctcagtgtaatctaatcacaccgtcgtggtaaatggagaagttctatgatgtaaatgcctgcttcatctcatccttgtatgcttttctgctaatcctaatgcttgaaatgcggtaggatcaagcttcagagtttagtgtaagtctgccagggctgttcacgggttttacagtctcatgctcatgatgtggacttctcattgtactattgcagtttatgtctttacagaatgtgaataaagaacataattcaagatgtattgttg

SEQ ID NO: 5374 - DNA, 2058 bp, Phaseolus coccineus
aaaaggaaaaagggaagagaaaaacaaagacacaccaaacaagagagagccacagagacgcacagtgagagatctttggtttcaataaattagaagaagttgaaggttttgataatcgcagggaaccaaagtggggcagaaacacacgtcgtgttcaggcaaaatccatgtgcccacatggatgattgagagagagagagtgagggagtaagggtgagagagtgttgtatttatgacctcaacatcaccacaggcagcaacagcagcaacacctgcagtggcagcataaacatatagaagaagaagaggagagacacaagagacccaccgaggaaattttgttcaaaaccagaacttgctcctaaagttagcatcttttgatgattttaagtgggtggaggttcaaagtccgtagtggggtgtggtgaattttattttggagtggggaagaggtgagagagatgaagaagagtgagagtggggggtatgtgagagcggatcagatagatctgaagagcttggatgagcagcttcagaggcatctgagtagagcatggactatggagaagaacaaggagaaggaggaagaggaggttgaaggaaggtccacaagaagcagacaagagtgggagattgacccctctaagcttgtcatcaagactgtcattgcccgtggcacttttggcacagttcatcgtgggatttatgatggacaagatgttgcagttaagctccttgactggggggaagagggtcatcgatcagatgctgaaatagcttctttgagagcagcgtttactcaagaagttgccgtttggcacaagcttgaccatcctaatgtaaccaggtttcttggggcaacaatgggaacatcagagctacagatacaaacagaaaatggtcatataggcatgccaagtaatgtttgttgtgttgttgttgaatattgtcctggaggtgcactgaagacttatcttattaaaaaccgaagaaggaagctggcttttaaagtggttgttcaactggctcttgaccttgcaagagggttgagctatctccacacaaagaagattgtccacagagatgttaaaacagaaaatatgcttctggacaagacacgaaccttgaaaatagctgattttggagtggctcgtattgaggcttccaatcctcatgacatgacaggtgaaactggaacccttggttacatggctcctgaggttctaaatggtaatccatacaatagaaagtgtgacgtgtacagtttcggcatatgcttatgggagatatactgctgtgacatgccatatccggaccttagcttctccgaagtgacatcagctgtagtacggcagaatctgaggccagagattccacgatgttgtcctagctctctggcaaatgtgatgaaaagatgctgggatgccaatcctgataagaggccagagatggatgaagtagtgtccatgttggaagctattgacacttcaaagggtggaggtatgatccctgttgatcagcctcaaggttgtttatgttttcgcagctatcgaggaccttgaaagatttttcactgtcaaggaaatcgattatggagggatgatgatatacagtattctggaaaatcagtttgtatttgatttcattgaaggaatagggaaggaagactcaggatggaatgcatacacaaaaagtgtgaaggccacagacgagctctgcaattacttgttactttgttgggctataatttttgtaaagctaattgtgctctctcctcattgcacccatttttataatattttctatgtaagttgtacacttgacagtagtagcatggattgttccaacactaatatcaaagtcctcctgaggggtcatttgatgtccgatgagcctacaagtgatctgttttgggaagatctgctcatgtgcagaaagacacctataatatatggaataaatatacaatttggccataaaatatgttatctgttgagattgagattgaggaagcttattgtttatccaatcttacatgatattttgaatgtcaaggat

SEQ ID NO: 5375 - DNA, 1572 bp, Secale cereale
aaccacgcacaaaatccaacccaatccacctccctctccacgcgccgctgcgcgacacgacaccaccctcccctgccaccattccgaggcagaggcaggcagtcccatcccatgtgctctgctcacatgctcgccgatcgatcctcgctgctcctcctagcctagcctagccgcagctcgccagcacgccaggcggtcgccgtgagtgagtgagcaaggcgcgggaggtcgggagatgaaggaggcggctgtgggcggcggcggggacggggccggggggttcgtgcgggcggaccagatcgacctcaagagcctcgacgagcagctcgaccgccacctcgcccgcgcacggaccatggacaaccccaagcccaagcgccagccgcagccgcagccgcgccacgactgggaggccgaccccgccaggctcgtcgtccgcggcgtcatcgcgcgcggcaccttcggcaccgtccaccgcggcgtctacgacggcctcgacgtcgcagtgaaactgcttgattggggggaggatggtcacaggtcagagcaagaaattacagcaataagatcagccttttcacaagaagtctccgtttggcataagcttgatcatccaaatgtaactaagtttataggggctataatgggtgctggggatctgaatattcagacagaagatggaaacattggcatgccaagtaatgtgtgctgtgtcattgtggagtaccttgctggaggtgcactaaaaacatttctgataaagaacaggagaaggaagttagctttcaaagttgtggtccagatagctcttgaccttgccaggggattaagctatcttcactcaaagaagattgtgcatcgtgacgtgaagactgaaaacatgcttcttgacaaaacaagaactgtaaaaattgcggactttggtgttgctcgccatgaggctgcaaaccccagtgatatgacaggcgaaacaggcacccttggctacatggcacctgaggttctcaacggcaacgcttacaacaggaaatgcgacgtctacagctacgggatctgcctttgggaggtgtactgctgcgacatgccgtatgcggacctgagcttctcggaggtcacgtccgctgttgtccgtcagaacctgaggccggagatcccgcggtgctgcccgagcgcgtttgcgaacgtgatgaagcggtgctgggacgcgaaccccgacaagcggccggagatggcggaggtggtgacgatgctggaggcgatcgacacgtccaagggcgggggcatgatccccgtggaccaggcgcggggcatcgggtgcctctcgtgcctcaggccgcgcaggggcccctgaccgaatgcacgacggatcacgcggcaaagcgggtgcagtgtcctttctgcaatgccctcgatctcgcgtttggttgattgcatttgctttagtttcaaacaaggtgcgcaaaccggtttgacccttggtttggcaggcaacccatctgatgtaaattcccctgtctctacccttcccttctgcttatgctcgttcgtctatgttttttctgtgctcatgtc

SEQ ID NO: 5376 - DNA, 2272 bp, Vitis vinifera
ataaattcatgagtgcgaagcaaataatacaacatctataatgataggagaaacgcctctctaatagtagggctatttttttctcctaagaggatagatgggtaagagttatttgtggaatatgctatcgctcttatggaagtagacaaaaaatgaagctttatgaaggtcttgtttgttagaatcacatggaattccatcaaccctaatggaaatttgtagcatctttgaattaaaggaaattcatagtcattaaaaagacttgaaagctctaaaaatggagaataaaggaccttgtttcttttggaaaagtattataattttggagacgaaagaaacagtagaattgaagaaatatggaagttgcagggaagtataaagaggaagaggtggtggcagtggaggttggacagagggagggggagactaaggtgggtcagaaacacatgtcctattcaggcaatatccatgtgcccacatgtatgatatatatttgacggagagagaaaaaaagaagggaagaagaaacaataagaggaaaaaaagtgagaggagtgagatgaaagagagtggggacacacagaaacaaaacccaccaacaacccctcctctcattagctcttcctctccaacattggcagttactcttgtctctgcgactgcttcttctgctttcttatcttggggtgttggtattcttccactactgtttctgtgttcacatgttttacatataagatagttggttataggttttatagagtgtgtgggaagtctattgaagaaaaatgaaggagaagagtgacgggtttgtgagggcagatcagatagatctgaagagcttggatgagcagcttcagaggcatctcagcagagcatggactatggagcagaagaaggagcagcaggaagagaggcccaatactcgagaagagtgggagattgatccttccaagctcgtcatcaagagtgtcatcgctcgtggcacttttgggacggttcatcgtggggtttacgatggccaagatgttgcagttaaacttcttgattggggagaggagggccacagaacagaggctgaaatagcttcacttagagcagcttttacacaagaagttgttgtatggcacaagcttgatcatcctaatgtaactaagttcattggggctacaattggctcatcagagctaaacatacaaacagaaaatggtcacattggcatgccaagtactgtatgttgtgttgttgttgaatatcttcctgggggagcactgaaatcttacctcataaagaaccatagaaggaagctggctttcaaagtagttgtccaactggcactagatcttgcacgagggttgagctatcttcattctaagaagattgtccacagagatgtgaaaacagagaacatgcttctggacaagactcgtactttaaaaattgctgactttggggttgctcgcatggaggcttcaaatcctaatgacatgacaggcgagactggaacccttggttacatggcaccagaggttctcaatggcaacccgtataataggaaatgcgatgtgtacagttttggtatctgcttgtgggaaatttattgctgtgacatgccatatccagatctcagcttctcagaagtgacctcagctgttgtccgccagaatctgaggcctgagatacctcgttgttgcccgagctctcttgcgaatgtaatgaagcgatgctgggatgctaaccctgacaagcgcccagagatggacgaggtggtatcgatgctggagggcattgacacatccaagggtggaggtatgatccctctagatcaacctcaaggctgtttctgttttggcaagtaccgagggccttgaaagaattgctctctaaagcaaagagatggtacagagttctggaaatccagcttgtatttaatttaaggtggaagatttgggatttcagagatgaagggatacagaaatgcggtttggttttagccttttaggataagaggaactcatcaatttctgtttgtttgtcggatttttggatgctgtaaatcttttcttctttcgttttcccttaaaaaggaaattgtgtatttgatagagtggccgattccaggatttgttggcctaaacaacgtttctgtaagatgagctttcatgtaacagtcagatattgccatgttgaactgttaattcaacagggtaaattgctaaaaaatgcctttcctgatgtgcattactgagggcttaatttggaacaatttttt

SEQ ID NO: 5377 - DNA, 1676 bp, Arachis hypogaea
acaaaggagccaaagaaagagaagcagcagtggcagcaagcaccattacaacacaacattcacaaacacacatatatagacccaacaaggaaacactgctcaaaaactgaacttgatgccaaagtttgtaacttttcatttttcctaagcaactttaccattaaaaacggtaacgggtgtgttgtgattcttgcttttgtgagcactagtgaagagaagaactgatagagagagagatgaagaagaatgagagtggtggttatgtaagagcggatcagatagatctgaagagcttggatgagcaactacaaaggcacctgagcagagcatggacgatggaaaagaacaaagaaaagcagcagcaagaagatgatgctgccatggctgctgctgctgctgctgctgaaggagcaaggtcatcatcaagaacaaggcaagaatgggagattgacccttccaagctcctaatcaagtctgtcattgctcgtggaacttttggcactgttcatcgtggtgtttatgatggccaagatgttgcagttaagcttcttgattggggggaagagggccatcgttccgaagcggaaatagcttctctgagggcagcttttacacaagaagttgctgtttggcataagcttgaccatcctaatgtgaccaagttcattggggcgacaatgggaacatcagatctacagatacaaacagagaatggtcacataggcatgccgagcaacctctgttgtgttgtggttgagtattgtcccggaggtgcgctgaagtcttatctcattaaaaatcggcgaaggaagttggcttttaaagtggttgtccaactggcacttgaccttgcaagagggttgagttatctccacatgaagaagattgttcaccgagatgttaaaacggaaaatatgcttctggacaagacgcgaaccttgaagatagctgattttggtgtagctcgcatcgaggcttccaatcctcatgacatgactggtgaaaccggaactcttggttatatggctcccgaggttctaaatggtaatccatacaatagaaagtgcgacgtgtacagtttcggtatatgcttatgggagatctactgctgtgacatgccatatcctgaccttagtttctcggaagtaacatcggccgtcgtacgacagaacctgaggccggagattccgcgttgttgtccaagctctctggcaaatgtgatgaagaggtgctgggatgccaatcccgataagcggccggagatggacgaagtggtgtcgatgctggaagctattgacacctcgaaaggcggaggtatgatccctcttgatcaacctcagggttgtttatgtttccggaggtatcgaggaccttgaacaagatttttcatactatcaaggaatctaatcgattgcaagaaagggaagctatacaaaatcagtttgtaatttgattttcattcaaaggataggagaagaagaagaagaagagagtgaagaagagtgtgaaaggcataggtaaatgaagaagagctctaatatatactttttgtaaagctaatttgtgctctcctcattgcatccatttttatgatatattttctatgtaagttcctctcatacactcttggaagtagtagcactccaacaccaatatcaaggatggttggttcagtt

SEQ ID NO: 5378 - DNA, 1192 bp, Glycine max
atgaagaagagtgagagtggggggtatgtgagagcggatcagatagatctgaagagcttggatgagcagcttcagaggcatctgagtagagcatggactatggagaagaacaaggagaaggaggaagaagaggttgaaggaaggtccacaagaagcagacaagaatgggagattgacccctccaagcttgtcatcaagactgtcattgctcgtggcacttttggcactgtccatcgtggaatttacgatggccaagatgttgcagttaagctccttgactggggggaagaaggccatcggtcagatgctgaaatagcttctttgagagcggcttttacacaggaagttgctgtttggcacaagcttgaacatcctaatgtaaccaagtttattggggcaacaatgggaacatcagagctacagatacaaacggaaaatggtcatataggcatgccgagtaacgtttgttgtgttgttgttgaatattgtcctgggggtgcgctgaagtcttatctcattaaaaatcgaagaaggaagctggcttttaaagtggttgttcaactggctcttgaccttgcaagagggttgagctatcttcacacaaagaagattgtccacagagatgttaaaacagaaaatatgcttctggacaagacacgaaccttgaaaatagctgattttggagtagctcgtattgaggcctccaatcctcatgacatgacaggtgaaactggaacccttggttacatggctcctgaggttctaaatggcaatccatacaatagaaagtgtgatgtgtacagtttcggaatatgcttatgggagatatactgctgtgacatgccatatcctgaccttagcttctcagaagtgacatcagctgtcgtacgacagaatttgaggccagagattccgcgatgttgtcctagcgctctggccaatgtgatgaaaagatgctgggatgcgaatcctgacaagaggccagagatggatgaagtggtgaccatgttggaagctattgacacttcaaagggtggaggtatgatccctcatgatcagcctcagggttgtttatgttttcgcagttatcgaggaccttgaaagatttttcactgtcaaggaaattgattatggagggatgatatacaggttctggaaatcagtttgtattttatttgattgaaggaatagg

SEQ ID NO: 5379 - DNA, 2143 bp, Glycine max
gagagagagaaagagaaaacgtattatatttatgacctcaagacatcaccacaagaaacagcagcagcaactgcagtggcagcaaaaaacatagtaatagtaatagtagaggaagagagacacaagagacccaccaaggaaattttgctcaaaaccagaacttgctaccaaagttaacatcttttgatgattccaagtgactttgagcttcaaagtccatagtggggtgtggtgaattttttgaattttgaagagaagaagtgtgtgtgtgtgtgtgtgtgtgagagagagagagagagagagatgaagaagagtgagagtggggggtatgtgagagcggatcagatagatctgaaaagcttggatgagcagcttcagaggcatctgagtagagcatggactatggagaagaacaaggagaaggaggaagaagaagaggttgaaggaaggtccacaagaagcagacaagaatgggagattgacccctctaagcttgtcatcaagactgtcattgctcgtggcacttttggcactgtccatcgtgggatttatgatggccaagatgttgcagttaagctccttgactggggggaagaaggccatcggtcagatgctgaaatagcttctttgcgagcggcttttacacaagaagttgctgtttggcacaagcttgaacatcctaatgtaaccaagtttattggggcaacaatgggaacatcagagctacagatacaaacagaaaatggtcatataggcatgccgagtaatgtttgttgtgttgttgttgaatattgtcctgggggtgcactgaagtcttatctcattaaaaaccgaagaaggaagctggcttttaaagtggttgttcaactggctcttgaccttgcaagagggttgagctatctccacacaaagaagattgtccacagagatgttaaaacagaaaatatgcttctggacaagacacgaaccttgaaaatagctgattttggagtagctcgtattgaggcctccaatcctcatgacatgacaggtgaaactggaacccttggttacatggctcctgaggttctaaatggtaatccatacaatagaaagtgtgatgtgtacagttttggcatatgcttatgggagatatactgctgtgacatgccatatcctgaccttagtttctcagaagtgacatcagctgttgtacgacagaatttgaggccagagattccgcgatgttgtcctagcgctctggcaaatgtgatgaaaagatgctgggatgcgaatcctgacaagaggccggagatggatgaagtggtgaccatgttggaagctattgatacttcaaagggtggaggtatgatccctcatgatcagcctcagggttgtttatgttttcgcagttatcgaggaccttgaaagatttttcactgccaaggaaattgattatggagggatgatatacagtgttctggaaatcagtttgcattttatttgattgaaggaatagggaaggaagactcaaggatgaaatgcatacacaaaaagtatgaaagcaatagttaatgaagagctctgcaattacttgttactttgttgggctataatttttgtaaagctaattgtgctatctcctcattgcacccatttttatgatatttctatgtaagttgtacacttgacagtagtagcatggattgttccgacactaatatcaaagtcctgatgggtcatttggtgtcctatgagcctacaagtgatcttttttgggaagatttgctcatgtgcagaaagacatgacttataatatgtggaataaatatacaatttgaccattaaaagatgttatatgttgtagattgaggaaagcttttgtttatacattttacacttaaaatagtcaacttgatggcaagtatattgaagttatcaacttgatgacatgtatatttctacggttaaaaatattaatggcatggttggtagagtgaaatggaattgagaagaaatatttgaattgaagtagtgtgataaaagtatgggactactaatttttgaaattttttcttcatttttactctacttcatctctatcaaacgcactataaaggatcggaataagataagtaacatttcgagactaggttgttatata

SEQ ID NO: 5380 - DNA, 1802 bp, Euonymus alatus
gagagggagacatatgaggtggtgcaacagcagaagcagcagcaggcagtagcagagagacggtggtgggtcagaaacacacgtcgtgttcaggcagagtccatgtgcccacatggacttgatggcaaatcccaaaacaacaagtaccgaataggatagatagcctaccagaaacttaaaaagaccaactatactctgttttatggaggaagttgtactacttgctgtacctataatagttgattgttgctgttggcagtggtgaacacaaagaccccatcgccttgaaagtgaaataagactcaccaacaccagaaagtaagtaactttttgttgtttagtactgttttctcgggagagagtattgagagagatgaaggagaagagtgagggaggtgggtatgtgagggcagatcaaatagatctgaagagcttagatgagcagctgcagaggcatcttagcagggcatggaccatggagaagagcaaggacaagagagaagaaggagaagcagaacagcgacccacaaatgctgcgactagggaagagtgggagattgaccccgccaagctcattatccaagctgtcattgctcggggcacttttggcactgttcaccgtggcgtttatgatggccaagatgtcgccgttaaacttctagactggggcgaagaaggccacaggtcagaggctgaagtagcttcacttagagcagcttttacccaagaagttgttgtctggcacaagcttgatcatcctaatgtaactaagtttattggggcgaccatgggctcatcagatctacacatacaaacagaaaatggtcatgttggcatgccgaataacgtgtgttgtgttgttgttgaatactgtcctggaggtgctctcaaatcctaccttataaagaacaggagaaagaagctggcttttaaagtagttgttcaactagcactagatcttgcacgggggttgagctatctccattccaagaagattgtccacagagatgttaaaacagaaaacatgcttctggacaaacaacgtactgtaaaaatagctgacttcggtgttgctcggcttgaagcttctaatcctcatgacatgacaggagagacgggaacgcttggatatatggcacctgaggttctcaatggaaacccgtataatagaaagtgtgatgtgtatagttttggtatttgcttgtgggagatatactgctgtgacatgccatatcctgatcttagcttctcggaagtgacgtcagctgtcgtccgccagaatctaaggccagaaattcctcgctgttgcccaagctctcttgcatatgtgatgaaaagatgctgggacgcaagcccagacaagcggcctgaaatggacgaggtggtatccctgttggaggcaattgatacatccaagggtggaggtatgatacccggcgatcagcctcaaggttgcttctgttttcgcaggcacagaggaccttgaaagaatctcgctcgacggaagtgccgctcagatagaagacagtgagagttgtgaaacccattttgtatttaattcattgaaaagattgggattttagagctgaggcattcaaaactggaggctacatgccaagagaaaccttgcagaaccttgttttcgttataggtcatgcattgtgtaaagctctctctcttcgtttgtccttgctttgttttgaaagaattatgcatctgggcgcacagatgaccaaccctgctctctctatgtaagatgagttctactgtccaagataatatagactatgggtttatctgcc

SEQ ID NO: 5381 - DNA, 1807 bp, Oryza sativa
gttgtcatcatcactggcctactcctagtgcgcctagtacttcgccttccccccacaccccaatgcgctctcacatggagtcgtcgtcgtctccccaaacacgacgacctcgaaccgcctccgtccccgcctcgccaacccgtccccttcccctgtagccaccgcgaccaccaccaccaccacgccgcggcatccacaacgccaccagagtacagagacgttccacccaccccgggccaccgaacccaacccccccagctcgctcgatcgatcgctagctccgacgacaggtttgagcgcgatgaggcatcccggcgcgggcggcgggagcggggacgccgggttcgtccgggcggaccagatcgacctcaagagcctcgacgagcagctggagcgccacctcggccgccccgcggagcgggccgcgtcgcagcacgggggcagcgggagccgccgcggcgagtccgccaggctcgggctcggggaggagccgccgcaggcgccgcaccatcagcggcgccgggaggactgggagatcgaccccgccaagctcgtcatcagaggcgtcatcgcccgcggcacgttcggcaccgtccaccgcggcgtctacgacggccaggacgtcgctgtcaaaatgcttgactggggggaggatggccatagatcagaacgagaaatttcttcactaagagcagcatttgcacaagaggtcgctgtctggcataagcttgatcatccaaatgttaccaagtttattggggctataatgggtgcaagagatttaaatatacagacagaacatggacattttggcatgccaagtaatatttgctgcgttgttgtcgagtaccttgccggaggtgcactgaaaaattttctgataaagaacaggagaaggaagctagcctataaagttgtggtccaattggctcttgaccttgctaggggattaagctatcttcactcaaagaagatagttcatcgtgatgtgaagactgaaaatatgctccttgacaaatcaagaacagtgaaaatcgctgattttggtgttgcacgaattgaggcttcaaatcctagtgatatgacgggtgaaacaggcacacttggttacatggcacccgaggttctcaacggccatccttacaacaggaagtgtgatgtatatagctttggaatctgcctatgggagatatactgctgcgatatgccgtatcctgatctgagtttctcagaggtcacttcagctgttgttcgtcagaacttgaggcctgagataccgcgctgctgccctagctccttggccaacgtgatgaagcgctgctgggacgcgaacccggacaagcggccggcgatggcggaggtggtgtccatgctggaggcgatcgacacgtccaagggcggtggcatgatcccgaccgaccagccacagggatgcttctcgtgcttcggtcggcaccgaggcccctgacgaacttgatctgatggcgtcactgataatttgttatcgctatatctcagtgtaatctaatcgcattcgctatggctaatttgaggagctgtgtgattgatgtaaatgccttaacggtccagcacctcagcttcatcgtcgtatgatcgctgcgaatcctaatgcttggcctatgataagatcgagcttagaagagattattgtgacagagctgccgacgaagtttacaatctcatcatatatggtcatgaagtagacccactgtactattgcagtgtaatcgacatctttgcagaatgttaataaaagaacaaaatcaggatgtataattccgagtac

SEQ ID NO: 5382 - DNA, 1573 bp, Cucumis melo
acacaacaacgacgacaacaacaagaaacaacaacaatccccaattcccaattttctcttcatttctgatttgaaaattccatcccaatttcttccctccattccaaccctcacaaattcccgtttccccccttttgatttctgttgctgaatcggtaaaaatgaaagagaacaatgatgggtttgttcgtgcggatcagattgatctcaagagcttagatgaacagcttgagaggcatcttagtagagctttgactatggagaagaacaagaagaaagatgaagataccggcaatagctttctcacttctgcacctatcgctcgtagtaggtctactaaagttgctgctaaggaccggctaggagtgggagatcgatccctctaaattgattatcaagagcgtcattgctcgtggtacttttggcactgtccaccgcggcgtttatgacggactagatgtcgccgtcaagttgctggattggggagaagaaggtcacaggacagaagctgaaattgcttcactaagggcggcttttaaacaagaagttgctgtttggcataaactagagcatccaaatgttactaagtttataggggcaacaatgggctcagcagagttacagatccaaactgaaaatggtctaataggcatgccaagcaacatatgttgtgttgtggtggaatatcttgccggggggtgctcttaaatcttatctcataaaaaacaggagaaggaagctagctttcaaggtggttgtccagctggcccttgatcttgctagagggctgagttaccttcattcacagaagattgttcacagagatgtaaagacagaaaacatgctattggacaaaacacgtacagtcaaaattgctgattttggtgttgctagagttgaggcctcaaatcccaatgacatgactggggagaccgggacacttggttacatggctccagaggtcctcaatggcaacccatataacaggaaatgtgatgtgtacagcttcggtatctgcctgtgggaaatttattgctgtgacatgccatatcccgaccttagtttctctgaagtaacctctgccgtggttcgtcagaatctgaggccagagataccgagatgttgccctagctctctagcaaatgtaatgaagcgttgctgggatgcaaccccagacaagcgacccgagatggatgaagtagtttccatgttggaggccattgacacttccaagggtggaggtatgattcctgttgatcaagctcagggttgtctatgctttcgaaaatatagagggccctaaagatttgtttttgtttgaattggatacgaaaatctgataaaattattttgaagatgaaagggaaaaaaccataatgtgattgtggtaatgacaaatagaagaagtaggaaaagaaaaatatctatatatatattgagggtgaggctagtagtaaaatagatgatggtggtgggtacataaaccagggactttgctgcctttcactttgccattggatgtaagccttttgtaatgacattaaattgaatgaattgtaagattgaaatggta

SEQ ID NO: 5383 - DNA, 1548 bp, Aquilegia formosa
ttgaagaagaagaagaaagaagaaagaagaaagaagaaaaacaaactctacatacccaccaaccattttccacatttttgttcttcttcaagaagaagaagaagaaggaaaaatatgaaggaaacaagtgatgggtttgtgagagcagatcaaatagatctaaaaagcttagatgaacaacttgaaagacatttaagtagagcatggactatggagaaaaaaagagaagaaggtagtggaggtaaagataaagaaagggttagagaagaatgggaaattgatccaactaaacttattattaaaactgttattgctcgtggcacctttggtactgttcatagaggaatctatgatggacttgatgttgctgttaaattgcttgactggggagaggaaggccatagaacagaagctgaaattgcttcactcaggacagcatttactcaagaagttgctgtttggcataagcttgatcatcctaacgtcaccaagtttataggggctacaatgggaaatgcagagctgaacatacaaaccgatactggacacattggcatgcctagtaatatttgctgtgttgttgtcgaatatcttcctgggggtgcactgaaatcataccttataaagaaccgtagaagaaagctggcttttaaagttgttaatcaactggctctagatcttgcaagagggttaagttaccttcattctcaaaagattgtccacagagacgtgaaaacggagaacatgcttttggataaaagccgcacagtaaaaatagctgactttggagttgctcgggttgaggcacaaaaccctaatgacatgacaggggaaactgggacccttgggtatatggctcctgaggtcctcaacggaaatgcatataataggaaatgtgatgtgtacagttttggtatctgcttgtgggaaatctattgctgtgacatgccgtatcctgatctcagtttctcagaaataacatctgctgttgtccgccagaatctcagaccagaaatgcctcgctgctgcccaagctctctatcaaatgtaatgaagagatgttgggatgcaaacccagacaagcggccagagatggatgaggtggtatccatgttggaggcaattgacacatcaaaaggtggtggtatgatcccagttgaccaatctcaaggctgtatgtgtttccgcagtaaaagagggccttgaaagaacaacagtccattgtagaagcatataaatgatttgattcatagtacaaaagctcagaaaaactgagaatttgtgtgcaaggaatttgcaatttgagagctgggaagatacaatcattacatgcttgagaggagaagctctacggaatcttatattctagttggatgaagcaaatcttatttcttctttttctttgtcgatgtgtatttctttggccagccagttataatttataatccttccatgggaaactggctctccccacctgttatgtatcattagcatgttaactaaagaacaaataactgtatattaccgcccaaaacattcatacaatcc

SEQ ID NO: 5384 - DNA, 1461 bp, Aquilegia formosa
gttcttcttcaagaagaagaaggaaaaatatgaaggaaacaagtgatgggtttgtgagagcagatcaaatagatctaaaaagcttagatgaacaacttgaaagacatttaagtagagcatggactatggagaaaaaaagagaagaaggtagtggaggtaaagataaagaaagggttagagaagaatgggaaattgatccaactaaacttattattaaaactgttattgctcgtggcacctttggtactgttcatagaggaatctatgatggacttgatgttgctgttaaattgcttgactggggagaggaaggccatagaacagaagctgaaattgcttcactcaggacagcatttactcaagaagttgctgtttggcataagcttgatcatcctaacgtcaccaagtttataggggctacaatgggaaatgcagagctgaacatacaaaccgatactggacacattggcatgcctagtaatatttgctgtgttgttgttgaatatcttcctgggggtgcactgaaatcataccttataaagaaccgtagaagaaagctggcttttaaagttgttaatcaactggctctagatcttgcaagagggttaagttaccttcattctcaaaagattgtccacagagacgtgaaaacggagaacatgcttttggataaaagccgcacagtaaaaatagctgactttggagttgctcgggttgaggcacaaaaccctaatgacatgacaggggaaactgggacccttgggtatatggctcctgaggtcctcaacggaaatgcatataataggaaatgtgatgtgtacagttttggtatctgcttgtgggaaatctattgctgtgacatgccgtatcctgatctcagtttctcagaaataacatctgctgttgtccgccagaatctcagaccagaaatgcctcgctgctgcccaagctctttatcaaatgtaatgaagagatgttgggatgcaaacccagacaagcggccagagatggatgaggtggtatccatgttggaggcaattgacacatcaaaaggtggtggtatgatcccagttgaccaatctcaaggctgtatgtgtttccgcagtaaaagagggccttgaaagaacaacagtccattgtagaagcatataaatgatttgattcatagtacaaaagctcagaaaaactgagaatgtgttcaaggaatttgcaatttgagagctgggaagatacaatcattacatgcttgagaggagaagctctacggaatcttatattctagttggatgaagcaaatcttatttcttctttttctttgtcgatgtgtatttctttggccagccagttataatttataatccttccatgggaaactggctctccccacctgttatgtatcattagcatgttaactaaagaacaaataactgtatattaccgcccaaaacattcatacaatcc

SEQ ID NO: 5385 - DNA, 1795 bp, Citrullus lanatus
caaaatccatgtgcccacatggatgatggagataggaaaacagagtagaaaccaatcacactcctctctctctacttgtacttttcttgtgcacactactattaatttttctctttcttttttcttctctttctctctctctctgattgaacccagaaatccacagacacacaaacaaaacccatcattccagtaacccaaaacaggaaccatagcctctgtgtctttgaattcctgtcattgattttgtcgaaattggtgggaaaatatgaaagaaaagagtgaaagtggaggtgggtatgtgagagcagatcaaatagatctgaagagcttagacgagcagttacagagacatttgagcaaagcatggaccatggagaagaacaagaagagggaagatgaggaaggcgtcggcgtcggcggcggtggaggaggaggcgtcggcggaggaaggccggctatcactaggcaggagtgggagattgacccttctaaactcatcatcaaagccgtcatagctcgtggcacttttggaactgttcatcgtggaatttatgatggtcaagatgttgctgttaaacttcttgactggggggaagaggggcataggtcggaggcagaaatcgcgtcgcttagagcggcttttacacaagaagttgctgtttggcacaagcttgaccatcctaatgttacaaagtttataggagcaacaataggctcctcagatctacacgtacaaacagaaaatggccaaattggcatgcccagcaatatttgttgtgttgttgttgaatattgtcctggaggtgctctgaaatcctacctcataaagaacaggaggaaaaagctggctttcaaagtagtcgtgcagctagcattagaccttgcaagagggttgagctatcttcattcacagaagattgttcatagagatgtcaaaacagaaaatatgcttctggacaaaacgagaacggtaaaaattgcagactttggcgttgctcgtgttgaggcctcaaatcccaatgatatgactggcgagactggaacacttgggtatatggctccagaggttctcaatggcaatccatataacaggaaatgtgatgtctacagctttggcatctgtttatgggaaatatactgctgcgatatgccatatcccgaccttagcttctcagaagtgacatcagctgttgtccgacagaatctgaggccagagattcctcggtgttgcccgagctcgcttgcaaatgtaatgaagcgatgctgggatgctaacccggacaagcgtccagagatggatgaggttgtaaccatgttggaagcaatcgacacatcaaagggtggaggtatgatccccctcgatcagtcgcaaggctgtttttgcttccgcaggtaccgggggccttgaacgtgtttgcttcttcatcgagcaaaaatgatggcagcagcgacaatgcaatatcgaagatattcaaattgtaatttgtccaattgaaaaggaattggaactttgagagtcaagggaataagtagagtggaggttatataggcttaagaggagctaagcaatatctgtatttgtagtgtggattttgtaaagcttttctttctttgtaccaatcccttccctctccttgtgaaggaaaaaaaaaaaaaaaaaaaagagtaaattttccttgaaagataagctttaatgttcttctgttatcttggattgaacatttacaaagcttcattaataatatttgggcaatgctgtggctttcctttaaaggggaagtcttgggatcaa

SEQ ID NO: 5386 - DNA, 1124 bp, Manihot esculenta
atgaaggagaagagtgaaaatggtggcggatatgtgagagcagatcagatagatctgaagagcttggatgagcagcttcagagacatctaagtagagcatggactatggagaagaacaagaaagatggagaagaaggagaagcagcagtgcaaagacagctaaacgacaccgtaacaaggcaagaatgggagatttgcccatctaagctcatcatcaaaggtgttatagctcgtggcacctttggcaccgttcaccgtggcatttatgacggccaagatgttgctgttaaacttcttgattggggggaggagggtcacagttcagcagctgaaatagcttcacttatagcagcttttacacaagaagttgctgtgtggcacaagctcgatcatcctaatgtaactaagtttatcggggcgacaatgggatcatcagagttgaacatacaaactgagaatggtcatatcaacatgccaagtaatgtttgttgtgttgttgttgaatattgtcctgggggtgctttgaaatcttacctcataaagaacaggagaaggaagctggcatttaaagtggttattcaattggcactagatcttgcacgagggttgagctatctccattctaagaagattgtccacagagatgttaaaacagaaaatatgcttctggacaagacacgtacagtgaaaatagccgactttggtgttgctcggctggaagcatcaaatcctaatgacatgactggagagactggaacacttggatacatggcacctgaggttctcaatggcagcccatataatcgaaaatgtgatgtctatagttttggaatttgcctgtgggagatatactgttgtgacatgccatatccagacctcagtttctcagaagtgacatctgctgttgtccgacagaatctgaggccagaaataccccgttgttgtccaagctctctcgccaacgtaatgaaacgatgctgggatgcaaatcctgacaagcggcctgagatggaggaagttgtgtccatgttagcggcaatcaacacctccaagggtggaggtatgatccctgttgatgaagctcaaggttgtctctgtttccgcaggcaccgagggccgtaaat

SEQ ID NO: 5387 - DNA, 1163 bp, Cucumis sativus
tgttgctaaatcggtaaaaaatgaaagagaacaatgatgggtttgttcgtgcggatcagattgatctcaagagcttagatgaacagcttgagaggcatcttagtagagctttgactatggagaagaacaagaagaaagatgaagataccggcaatagctttctcacttctgctcctatcgctcgtagtaggtctactaaagtcgctgctaaggaccggcaagagtgggagatcgatccctctaaattgattatcaagagcgtcattgctcgtggtacttttggcactgtccaccgcggcgtttatgacggactagatgttgccgtcaagttgctggattggggagaagaaggtcacaggacagaagctgaaattgcttcactgagggcggcttttaaacaagaagttgctgtttggcataaactagagcatccaaatgttacgaagtttataggggcaacaatgggctcagcagagttacagattcaaactgaaaatggtctaataggcatgccaagcaacatatgttgtgttgtggtggaatatcttgccgggggtgctcttaaatcttatctcataaaaaacaggagaagaaagctagctttcaaggtggttgtccagctggcccttgatcttgctagagggttgagttaccttcattcgcagaaaatcgttcacagagatgtaaagaccgaaaacatgctattggacaaaacacgtacagtcaaaattgctgattttggtgttgctagagttgaggcctcaaatcccaatgacatgactggggagaccgggacacttggttacatggctccagaggttctcaatggcaacccatataacaggaaatgtgatgtgtacagcttcggtatctgcctgtgggaaatttattgctgtgacatgccatatcccgaccttagtttctctgaagtaacctctgccgtggttcgtcagaatctgaggccagagataccgagatgttgcccaagctctctagcaaatgtaatgaagcgttgctgggatgcaaccccagacaagcgacccgagatggatgaagtagtttccatgttggaggccattgacacttccaagggtggaggtatgattcctgttgatcaagctcagggttgtctatgctttcgaaaatatagagggccctaaaga

SEQ ID NO: 5388 - DNA, 1766 bp, Citrullus lanatus
gatctgttaattggctgggaactggaaaaaaaaaaaagaaaaagaaaattcgagagaaaaagaaaaagaaaaagaaaataataaatagagaaggagaccgaagtgggtcagaagcacacgttatgagcaggcaaattcatgtggccacatggatgattggagaagccattgcagattttgtggaaacgaagaacaacaaagaaacaacagcagcgattccagcagcagcaacaacaagaatcatcaatttccaatttacttccaatttctgaattgaatccatcaatttcttgcttccacccgaaccaccgattcttgcttaccgctttgattttgtcgctaaatcggaaatgaaagagaacaatgatggatttgtgcgtgcggatcagattgatctcaagagcttggatgaacagcttgagaggcatcttagtagagccttgaccatggagaagaacaagaagaaagatgaagatggtggtaatagctttctcacttctgcgcctatcgctcgcagtaggtctactaaagtcgccgctaaggaccggcaggagtgggagatcgatccgtccaaattgattatcaaaagcgtcattgctcgtggtactttcggcaccgtccaccgcggcgtttacgacggactagatgtcgccgtcaagttgctggattggggagaagaaggtcacaggacagaagctgaaattgcttcactaagggccgcctttaaacaggaagttgctgtttggcataaactagagcatcccaatgttacaaagtttataggggcaacgatgggctcggcagagttacagatccaaactgaaaatggtctaataggcatgccaagcaacatatgttgtgttgtggtggaatatcttgctggaggcgcccttaaatcttatctcataaaaaacaggagaaggaagctagctttcaaggtggttgtccagctggcacttgatcttgctagagggttgagttaccttcattcacagaagattgttcacagagatgtaaagacagaaaacatgctgttggacaaaacacgtacagtcaaaattgctgattttggcgttgctagagttgaggcctcaaatcccaatgacatgactggggagaccgggacacttggttacatggctcctgaggttcttaatggtaacccatataacaggaagtgtgatgtgtatagtttcggcatctgcctgtgggaaatttattgctgtgatatgccatatcctgaccttagtttctccgaagtgacttctgctgttgttcgtcagaatctgaggccagagataccgagatgttgcccgagctctctagcaaatgtgatgaagcgttgctgggatgcgaccccagacaagcggcctgagatggatgaagtagtttccatgttggaggccattgacacttccaagggtggaggtatgattcctgttgatcaagctcagggttgtctatgctttcgaaaatatagaggaccctaaagatttgtttgtttgtttgaattggatacgaaaatttgataaaattattttgaagatgaaagggaaaaaaccataatgtgattgtggtaatgacaaatagaagtaggaaaagaaaaaatatattgaggtggggctagtagtaaaatagatgatggtggtgggtacataaaccagggactttgctgcctttcactttgtcattggttgtaagccttttgtaatgacattaaattgaatgaattgtaagattgaaatgcaagaatggtatcttcttcc

SEQ ID NO: 5389 - DNA, 6608 bp, Ricinus communis
aaccaaaccacctctcctctcctctatatgattacacaataagcctgtcagtatatataagatggtgatcatcatcatcatcaccatcatcatcatcactatcacaagtatagtgtagtatagatacagatagaccccaagaagaacagcagcagctaccataccaaagtcttgaaattaaaaacaatacaaccgcaacaggtccacacttcacatgcagttactcttttgtctttgtccctttgcacttcaacaacaaaccaacttcagctcaagttaacctctgcttgctagctatccacagtttacttttacacttgtaaccagaaacagagactctgttcgtttatccacagcaaagggaaagaaagaatagcaaaaaaatgaaggagaagagtgaaagtggaggtgggtatgtgagagcagatcagatagatctgaaaagattagatgaacagcttcaacggcatctaagtcgagcatggactatggaaaagaacaagaacaagaaagatactggtgaagaaggagaagcagcaacagcagcagcagcagcagctgctgctcaaagacctttaaagaacaatactattactaggcaagaatgggagattgatccttctaaactcattatcaaaggcgttatagctcgtggaacctttggcactgttcatcgtggtatttatgatggccaagatgttgctgttaaacttcttgattggggggaggagggtcacaggtcagatgcagaaatagcttcacttagagcagcttttactcaagaagttgctgtgtggcacaagcttgatcatccaaacgtaactaagtttattggggcgacaatgggctcatcggacttgcacatacaaacagagaatggtcacattggcatgccaagtaacatttgctgtgttgttgttgaatattgtcctgggggtgctttgaaatcatacctcataaagaacaggagaaggaagctggcatttaaagtggttattcagttagcgctagatcttgctcgagggttgagctatcttcattctcagaagattgtccatagagatgtcaaaacagaaaatatgctattggacaagactcgtacagtgaaaatagccgactttggtgttgctcgcatggaagcatcgaatcctaatgacatgactggagaaactggaacacttggatacatggcacctgaggttctcaatggaaacccatataatagaaagtgcgatgtctacagttttggtatctgcttgtgggagatatactgctgcgatatgccatatccagacctcagcttctcagaagtcacatctgctgttgtccgacagaatcttaggccagatataccccgttgttgcccgagctctctagcaaatgtaatgaaaagatgctgggatgccaatcctgacaagcggccagagatggatgaggttgtgtcaatgttagaggcaattgacacctccaagggtggaggtatgatacctggcgatcaacctcaaggttgcctttgtttccgcaggtaccgaggcccataaatgttgtatggatgatcagaaactgagttctaagattccaattgatatctttttttcaattgaagatgctgggtttaaagagctgagattatagtaaactgcggaggctatatgctaagaggagccctgcggcgactgtttcttaatcggatcatgcattatgtaaagctctttttcttttttcttttttcttttttcttttttctttttttcattttactttgttcttgttgagaactcttcatccaatttgagtggccagtcatagcatcgatgggatggatgcccattctgtataatgagccttgatatcaaatttgatgtgatcatcatgagttacattccatggcatgaaactgttactgtcatatctgttgaatgctaacatcttttgtagctttcagagctgcctgcaaacttgacatatgacatttttaggagtccaaggaaatgggaagaaagagagttgaggaaagacagaggccatacaaaaaatctgtcatcattagcttgatgtttcatcaggggctaaacaaattgaattgggttcaagtattgaggtgttcggatttggtatattataattataagtgagctctaagatcaatcgagttcaaatttaattgccctaaaatattaaagctcgaaaccctagttgagtctaaattaaaatatgagattaaagtttgattgttggtcttcaatcaacataaaatacaatgctaacaacaggaattcatgaacaaaatgatgaaaatatgagaatgtttttaacatgaatgaattaatgttgggagtaatgaattacactctcaactcacgttttgattcatccgaatcgaaaatctcagactgactgagcaaatgacaaagaagaattctactcaatataaagcagttcatcacctaatttgctgaaagagattgacaaactcgcattcatatcactgaaaatgcatcaagccctagccagcaatcttgtaacttggattaactaaattatccagaccagagaccacttgcattgattctatgacatcaccaaccttcaaatcagccaaaaaatcctcattttctgtaacatagccgaacacagcgtaccgaccatccaatatatttgcattgctgggagtcagttcactttctttcagcagccaaaatatctgacttgaagcagagttattctcaaactcctgtagaaaacaaaacaaacgatgaatctaacaaacttaacttcaaagtgaaatgaacttttcacacgaacacttaaaaacacaggagcatcaagagagatgagagagagagatgcagcaaatatcaaatgcactcacatccctggccatggccattgttccaaatgcattgaatggaagccttgtctgagccttatacaaaccaagctcctgtcaagtcacatgacatgtaaaatcagcatagcagaaattttagcagcaaaatagaaagatatgagaagagtttggaaaagattagcctctagaagggaaatagtgaaatctgcaaaacatattttgcatttctcaatgctatattaaccctttctttcggaatgaagataataagatatactatttcctatctactttcttgccttgtcctcccacttcaaattaccaaacagggtgtgaatcttccaagaaaacaataatcggcactttaacaataccatatcacaacagaagctaaaactagagccgaaaacacattacatttcatccagtgcaatgagtatcataaattttcagatcagcagccgggagcttttataccaatgcaacagtcttgtttggccatttactttctgattgtttaattcattagctctatctatatagaatgatagacagatagatagatagatagagagagagagagcagcttacttctaatgtttccccatagaaaggtgccttctccccattcaccataatttctaatggtattgtccgagttttctctgtactaggatcaataaagccttctgcagggccttcaggatctccagtttggacaacaaagccatccgctgcaatacatcaaaggaagtctatatgttacatctgcagaacatgattttaactaaaggcagcttatccgcagtatggatggaggtgatattggaaagaggcgtaagagaaaaaacagaaatgacacaagtttgggtgctttctatgcacatatatccaattacctgcagcctaaaggtagaagaggtgcactaattgccaacaaacctggttatgtggtctcaaatattgcacaactgctttaaggggaaacaagaatgacatgaatttgtttctagtatatttacctctctggatttccatgccatcatagaagtgcctttccaccaagtcaacaaaattcccagcagttaccggagcattatatccatctagaacaatgtggaatacacactcttccatgttaggattgtctttaaccttgaccttcatatccacagctgctctccccttcaagagaggcatattttgatattcttcaggtacttcgtaagggaagccatccaccatatcctcttcaacactgcagaaacccaatgccccaggaacatctcagctgcagtcaatgacaagggtataaatgagaatagtttatcttacaggattaatttttctaagtcctgaatttttatgtgacaaccaggagacagttatagaagtatgacatcaacacattgtcattgctgatccatatccccatggaaataggaagaaccaaaattttcaagaatattgcaatcttatcattttgagccacagtgggatatcaaaattgccaaggtaaagaacttattagaatggaaactaaacagatgatcattctctatatataaaaggaagaatcgctaagagattaatgttcatttatacatcactcagcaggtgagcaattgaattagtgtgtgactagctggatttaacttgatcactttggagaaaaatagaggtttttaaaaaagaagcacaacaaaagatgaaaataagaacaaattaagagatgttgttttcataaatttagagtctggaatctctcagcattacatgaaatggaggtaaatcatacctactaaggcatatggctcagcagcataatctacttgcaatgcagtggtagaaatcttttcacgattgagagcatctattaagcatttacttatattaccaggttaaagaaacttttgctcgtcaacttgcaaactaccataactttgttagaactgttaattgagatcagaataagcagaagaacatgatgacctgaaactgcttcctttgtcattcagaagaagtactgaaatgtatgtcacatactataaccattttgttacttttacttatttcatcatctcaaaagactttttgatagctataaggctatcacacttaaacaagtacgttaattgctctttcgagattttaaatcaatacctaatattcctcatttcttctccttctctttttaacgtaatcatgaacttcaatcttcaccatgccattaatataaatgcttataaaacttaccccccaacataattaagcagctccttctgtttggatgccacagcatctctattcctatcttcaacaatctgttgaagttcatccattccagcttctagcttgtcaagcagttccactccatggtccttctttgattcagccaatcctgaaataattaaggttttcccctgcttaagggaccgagatgcctgcctcacattctacattgcatcgagagataattatcatgatactattaatcacacatctccaaaataagtaaagaatagatatctatttagagtacattatcaataccaagttacacaaatgataaaaggtttaagggtcttactctctcgactgaatcaagtgcctttactccagcaaccttgagactttctgtgatatcttcaagtggtttctgtacttcccttatagctttattatcaattggaagtgcatatcttaacaatgctccagggtccttaattggcggtccagatattagcactgaaagattaggcaatgcaggactaacagcgtatgcaatattactggacagatacaatgaaggtactccagtaatcaacccaactgccaatgcaagagaaatcgcacattcctttatcgaaaatgacttccctttctgctcaacgatagccaaaagaaactgttcacaattaattctcgacaactgaaacaaaacaactataaccaaaaaactacacacattcaactcattcttgttgcatgcagccgtgaatctatagctactattttagtacactaattaaccgatcaaaagaaccgtaaaaagatcccagtttcacagcaagtttgaaatgtaaaccaattttgcaataaattctcatacacaaaatcaagtatctcacaggccttttttggaataaatcgcgtgcaataattcaattcaatatattcttgaaaaatcagttatggtttgatttcatttatttcaaaaggctatgagcttcccaaacatgaattgaccaaatagaatctaattgagacttgccaatcacatccagagcgtcctgctgaactagaaatgacaaatattatgaaataaagctaattacaagccatccacatgaacaaaatgagacccattaacgttttactcccaaattaagtggtaaattcaatttcaggtataagttcatcatcaaaagtaaaacgcaattccataattcaactttattattacctgttgaaattgatgtgaatttttaatagagcacctgggtatcatccgcctacccaacaaagcagcattgttatggaaagtgtttgcaaagccaaattcgtttctgggtttgattaagaatttggaattactagcaacacaagaacaattttggcattggataattgctgctgccataactgaagcttaaagctttttctttttctttttctttttttaggtagataacaaagatataaatatatataacattactaagttgcaacaaaaaattgaaatatacactttgag

SEQ ID NO: 5390 - DNA, 1469 bp, Aquilegia formosa
acagagagagagagagatcaactgaacaacaacaacaacaacaccgccccaccttaatatacttgattttgtcttcttagcttcctttccactcttaaaaaaggtcagttttttttttcatttctcatttatttcatttcatcaaacagtttgtttacaaagaagaagaagaagaagaagtctttggtttgtaattatagtgtttaaggaagaagaagaagatgaaggaaagtggagatgggtttgttagagcagatcaaattgatttaaaaagcttagatgaacaacttgaaaggcatttaaatcgagttagaactatggaaatggaaaaaaagagagaagaaggtgaaagaaataaagaaagggttaaaagagaagaatgggaaattgatccaagtaaacttattatcaaaagtgttattgctagaggtacttttggtactgttcatagaggtgtttatgatggtcttgatgttgcagttaaattgcttgattggggggaagaaggccacagatcagaggctgaaattgccgcacttagggcagctttcactcaagaagtggttgtctggcataaacttgatcatcctaatgtaactaagtttatcggggcaacaatgggaagctcagagctaaagatacaaactgaaaatggtcgtgttggtatgccaagtaacttttgttgtgttgttgttgaatatctcccgggtggtgcgctcaagacttatttgataaaaaatcgaagaaggaaactggctttcaaagttgtcgttcaacttgcactagatcttgcacgaggtttgagctacctccactcccagaagatcgtccacagagatgtgaagacagaaaatatgctcttagataagacacgtgcggtaaaaatagctgactttggggttgctcgtgttgaggctcaaaaccctaatgatatgacaggagagactggtactcttggttacatggcccccgaggttctcaatggaaatccatacaacagaaaatgtgatgtgtacagttttggcatttgcttgtgggaaatatactgctgtgatatgccttatcccgatctaagtttctcggaagtgacatctgctgttgtccggcagaatttgaggccggatataccacgttgttgtccgagctctctagcaaatgtaatgaagcgatgctgggatgcaaaccctgacaagcgcccagagatggatgaagttgtttccttgttggaagccattgacacatcaaagggtggaggtatgatccctgtcgatcaatctcagggttgcttttgcttccgtaagaaacgggggccttagaaagaactgtgcttttgcacataacgaagtctaatatctgtgggaatttgaaattcggacaggcaatgtgactttgtagttgtggaatatgtagtttcagagccgaaaagagatggtactgaatataggagcttcacaaatatcatctccttt

SEQ ID NO: 5391 - DNA, 1629 bp, Euonymus alatus
cagaaacttgaaaagaccaactatactctgttttatagaagaagtagtactacttgctgtacctataatagttgattgttgctgttggcagtggtgaacacaaagaccccatcgtcttgaaagtgaaataagactcaccaacaccagaaagtaagtaactttttgttgcttagtactgttttctcgggagagagtattgagagagatgaaggagaagagtgagggaggtgggtatgtgagggcagatcaaatagatctgaagagcttagatgagcagctgcaaaggcatcttagcagggcatggaccatggagaagagcaaggacaagaaaggagaaggagaagcagaacagcgacccacaaatgctgcgactagggaagagtgggagattgaccccgccaagctcattatccaaactgtcattgctcggggcacttttggcactgttcaccgtggcgtttatgacggccaagatgtcgccgttaaacttctagactggggtgaagaaggccacaggtcagaggctgaagtagcttcacttagagcagcttttacccaagaagttgttgtctggcacaagcttgatcatcctaatgtaactaagtttattggggcgaccatgggctcatcagatctacacatacaaacagaaaatggtcatgttggcatgccgaataacgtgtgctgtgttgttgttgaatactgtcctggaggtgctctcaaatcctaccttataaagaacaggagaaagaagctggcttttaaagtagttgttcaactagcactagatcttgcacgggggatgagctatctccattccaagaagattgtccacagagatgttaaaacagaaaacatgcttctggacaaacaacgtactgtaaaaatagctgacttcggtgttgctcggctcgaagcttctaatcctcatgacatgacaggagagacgggaacgcttggatatatggcacccgaggttctcaatggaaacccgtataatagaaagtgcgatgtgtatagttttggtatttgtttgtgggagatatactgctgtgacatgccatatcctgatcttagcttctcggaagtgacgtcagctgtcgtccgccagaatctaaggccagaaattcctcgctgttgcccaagctctattgcatatgtgatgaaaagatgctgggacgcaagcccagacaagcggcctgaaatggacgaggtggtatccctgttggaggcaattgatacatccaagggtggaggtatgatacccggcgatcagcctcaaggttgcttctgttttcgcaggcacagaggaccttgaaagaatctcgctcgatggaagtgccgctcagatagaagacagtgagagttgtgaaacccattttgtatttaattcattgaaaagattgggattttagagctgaggcattcaaaactggaggctacatgccaagagaaaccttgcagaaccttgttttcgttataggtcatgcattgtgtaaagctctctctcttcgtttgtccttgctttgttttgaaagaattatgcatctgggcgcacagatgaccaaccctgctctctctatgtaagatgagttctactgtccaagataatatagactatgggtttat

SEQ ID NO: 5392 - DNA, 1490 bp, Eschscholzia californica
gggttgttgctgctgtgtattaacataatagtttagagagagaaaagatgaaggaaaacaatgatgggtttgttagagcagatcaaattgatttgaagagtttagatgaacaattagagaaacatcttagtagagcatggactatggagaagaaaagagatgaaactgttggtggtggagaaggaacaccaaaagataaagatagacaagaatgggagatcgatccaactaaacttattatcaaaacagtaattgctcgtggtacttttggtactgttcatagaggcatttatgacggcattgatgttgcagttaaaatgcttgattggggagaagagggtcatagaacagaagctgaaattgctgcacttaggtctgcttttactcaagaagtcgttgtatggcataagcttgatcatcctaatgtaaccaagttcataggggcgacaatgggtaattcagggttgagcatacaaaccgacaacggtttcattggaatgccgagtaatatatgttgtgttgttgttgaatatctacctggaggagcactaaaatcttacctcataaaaaatagaaggaggaagctagcttttaaagtcgttcaccaaattgccttagatctcgctcgagggttgagttatcttcactcaaagaagattgtccacagagatgtaaagacagaaatatgcttttggataagacccgcactgtgaaaatagccgactttgggttgctcgtgtcgaagctcagaaccctcacgacatgactggcgagactgggaccttaggttacatggctcctgaggtactaaatgggaacccgtataacaggaagttgtgatgtttattagcttttggtatatgcttgtgggagatatactgttgtgacatgccgtatcctgatttaagtttctcagaagtgacatcagctgttgttcgtcagaatctaagacctgagatacctcgttgttgcccaagttctttggcgaatgtaatgaaacgatgttgggatgcaaaccccgataaacgaccagagatggatgaagtcgtaacgctgttagaagccattgatacgtcaaagggtggaggaatgatcccagtcgatcaagctcaaggttgtctatgctttcgtaagaaaaggggaccataaagaacccttatgggaacaaaattgaactattgaagtatattgagtgaacaaaagctcattaagaaaatgggtgtttcagaggagagaagatttggttgatgtatgataaagagaatctctgtatctaaatctctccttcagtggtgtatagcttttcttttgttcattctatgtttattgtgtatttccattgaaatccaggttattcggttgaattcttctccatctattctgtaacaataatcttttttatttttatgtaactaaagaagacaaatttaccctgaataatgttgagttcgaaagattttaaaaagttgacaatctaatacataattatt

SEQ ID NO: 5393 - DNA, 1464 bp, Cucumis sativus
gaacaaacccattattcaactgacccagaacacgaaccattgtttctgtgtctttcaatttctgtcgttggtttgttgaaattggtgggaaattatgaaagaaaagagtgaaactggaggtgggtatgtgagagcagatcaaatagatctgaagagtttagatgagcagttacagagacatttgagcaaagcatggactatggagaagaacaagaggagggaagatgaggaaggtgtcggcatcggcggcggcggcggcggcggcggtggtggaggaggtgttggcggtggaagacccgcaatcactagacaggagtgggagattgacccttccaaactcatcatcaaagctgtcatagctcgtggcacttttggaactgttcatcgtggagtttatgatggtcaagatgttgctgttaaacttcttgactggggagaagagggtcataggtcagaggcagaaatcgcgtcccttagagcggcttttacgcaagaagttgctgtttggcacaagcttgaccatcctaatgttacaaagtttataggagcaacaataggctcctcagatctacacatacaaacagaaaatggccaaattggcatgcccagcaatatttgttgtgttgttgttgaatattgtcctggaggtgctctgaaatcctacctcataaagaacagaaggaaaaagctggctttcaaagtagtcgtccagctagctttagaccttgcaagagggttgagctatcttcattcacagaagattgttcatagagatgtcaaaacagaaaatatgcttctggacaaaacgagaacggtaaaaattgcagactttggcgttgctcgtgttgaagcctcaaatcccaatgatatgactggtgagactggaacacttgggtatatggctccggaggttctcaatggcaatccatataacaggaaatgtgatgtctacagcttcggcatctgtttatgggagatatactgctgcgatatgccgtatcccgaccttagcttctcagaagttacatcagctgttgtccgacagaatctgaggccagagattcctcggtgttgccccagctcgcttgcaaatgtaatgaagcgatgctgggatgctaacccggacaagcgtccagagatggatgaggttgtaaccatgttggaagcaattgatacatcgaagggcggaggtatgatccccctcgatcagtcacaaggctgtttttgcttccgtaggtaccgggggccttgaacacaattgcttcttcatcgagcaaagatgacgacagcaacgacaatgcaatatcaaagatattcaaattgtaatttgtccaattgaaaaggaattggaacttgagagtcaagggataagtagagtgaaggtttataggctttaagaggagctacgcaatatctgtgtttgtagtgtggattttgtaaagcttttctttctttgtagcaatc

SEQ ID NO: 5394 - DNA, 1390 bp, Hordeum vulgare
accagatcgacctcaagagcctcgacgagcaactggagcgccacctcagccgccaggagcgagacgcgccagccccggcgcagccaggcagccgccgcagcgggtccgcgaggctgggggagccgcagccgccaccgccgcagcggcggcgccgcgaggactgggaggttgaccccgccaagctcgtcatcaaaggcgtcattgcccggggcaccttcggcaccgtccaccgcggcgtctacgacggccaggacgttgccgtgaagttgcttgactggggggaggatggtcatagatcagaacaagaaattaccgcactaagatcagcattcgcacaagaggtcgctgtgtggcataaacttgatcatccaaatgttacgaagttcattggggctataatgggtgcaagagatctaaatgtacagacagaacatgggcatcttggcatgccaagtaatatttgctgcgttgttgttgagtaccttgctggtggtgcactgaaaaatttcctgataaaaaataggagaaggaagctagcctttaaagttgtggtccagctagctcttgaccttgccaggggattaagctatcttcactcggagaagatagtgcatcgtgatgtgaagactgaaaatatgcttctcgataaaacaagaaccgtgaaaatcgctgatttcggggttgctcgagtcgaggcttcaaaccctagtgacatgacgggtgaaacaggcacacttggttacatggcacctgaggtcctgaatggtcacccttacaacaggaaatgcgatgtgtatagctttgggatctgcttatgggagatatactgctgcgacatgccgtatcctgacctcagcttctctgaagtaacttctgccgttgtccgccagaacctgaggccggagataccgcggtgctgcccgagcgccttggcgaacgtgatgaagcggtgctgggacgcgaacccggacaagcggcccgagatggctgaggtggtggccatgatagaggccattgacacgtccaagggcggcggcatgatcccgatagaccactcgcagggatgcttcgcctgcttccgtcagtaccgaggcccctgacggtgtcacctggctggtgatctagaatctttagtatactctactaatcacgtcagttatggctaatgtagtaaatgcccgcttcatctcaacattctatgtatgccttgtgaagaccccaatgcccaaggatcaagctcggagtttagtacgagtctgaccaggaggggcaggtcaccggtggtcttacagtctcatggtctggagagaagccgacacactgtaccattgcagcttatatgtttacttgcagaatgtgaataaagaacatattccccgtttggaatgca

SEQ ID NO: 5395 - DNA, 1583 bp, Secale cereale
gcgacacgacaccaccctcccctgccaccattccgaggcagaggcaggcagtcccatcccatgtgctctgctcacatgctcgccgatcgatcctcactgcccctcctagcctagcctagccgcggcgcgccacacagcaggagcaggcggtcgcggtgactgagtgagcaaggcgcgggaggtcgggagatgaaggaggcggctgtgggcggcggcggggacggggccggggggttcgtgcgggcggaccagatcgacctcaagagcctcgacgagcagctcgaccgccacctcgcccgcgcacggaccatggacaaccccaagcccaagcgccagccgcagccgcagccgcgccacgactgggaggccgaccccgccaggctcgtcgtccggggcgtcatcgcgcgcggcaccttcggcaccgtccaccgcggcgtctacgacggcctcgacgtcgcagtgaaactgcttgattggggggaggatggtcacaggtcagagcaagaaattacagcaataagatcagccttttcacaagaagtctccgtctggcataagcttgatcatccaaatgtaactaagtttataggggctataatgggtgctggggatctgaatattcagacagaagatggaaacattggcatgccaagtaatgtgtgctgtgtcattgtggagtaccttgctggaggtgcactaaaacatttctgataaagaacaggagaaggaagttagctttcaaagttgtggtccagatagctcttgaccttgccaggggattaagctatcttcactcaagaagattgtgcatcgtgacgtgaagactgaaacatgcttcttgacaaaacaagaactgtaaaaattgcggactttggtgttgctcgccatgaggctgcaaaccccagtgatatgacaggcgaaacaggcacccttggctacatggcacctgaggttctcaacggcaacgcttacaacaggaaatgcgacgtctacagctacgggatctgcctttgggaggtgtactgctgcgacatgccgtacgcggacctgagcttctcagaagtcacatccgcggttgttcgtcagaacctcgaggccggagatcccgcggtgctgcccgagcgcgtttgcgaacgtgatgaagcggtgctgggacgcgaaccccgacaagcggccggagatggcggaggtggtgacgatgctggaggcgatcgacacgtccaagggcggggcgatgatccccgtggaccaggcgcggggccgtcgggtgcctctcgtgcctcaggccgcgcaggggcccctgaccgaatgcacgacggatcacgcggcaaagcgggtgcagtgtcctttctgcaatgccctcgatctcgcgtttggttgattgcatttgctttagtttcaaacaaggtgcgcaaaccggtttgacccttggtttggcaggcagcccatctgatgtaaattccccctgtctctacccctccccttctgcttatgctcgttcatctatgctttttctgtgctcatgtctcatcctggtctgcaccagctaccatccataagaatagtgttcctgaggcctcatt

SEQ ID NO: 5396 - DNA, 1860 bp, Eucalyptus grandis
gttgtgtgtgcgtctgtgttgtagcaacaacagcagcagcatcagtaagagagagagagacagagagacagtacctggaaaacccattctcaatcctaataattatagtcataacctcatcatcatcatcatcatcatcaaccacaacctgttgcagtatcagcagtacgaaaagcacttgcacttgcacttgcacgcacaccaacgcggccgaggagagacgcaggcgacacgctctccacacacccacctgcattaaagtccgctctcgcccccttggacgtcgccggagagggagagggacagaagggaagcggaggggcgaggatgaaggagaagggagagagcggaggagggtacgtgagagcggatcagatagatctgaagagcctggacgagcaactccagaggcacctgagcagagcatggacgatggagaagaacaagaacgccgacaccaacggcgacgggaaacaggagaacgatgcgttagcgaggaggcccgcgtacggcggcggcgggagccgcctccccaccaggcaggagtgggagattgacccgtccaagctcgtgatcaagagcgtcatcgctcgcggcactttcgggactgttcatcgcggcatttacgacggccaagacgtcgctgtcaaacttcttgactggggggaagagggacacagatcagaggctgaaatagcttcccttagagcggcatttacacaagaagttgctgtttggcacaagctggagcatccaaatgtgactaagttcataggggcgaccatgggcacgtcagatttgcatatacaaagtgagaatggtcatattggcatgccaagtaacatttgttgtgttgttgtggagtattgccctggaggggctttgaaatcttacctcatcaagaaccgaaggaagaaactggctttcaaagtagtcattcaactggctcttgatcttgcacgagggttgagctatctgcactccaagaaaattgtgcacagagacgttaagactgaaaacatgctcttggacaagacacgcactcttaaaatagcggattttggagttgctcggattgaggcttccaatcctcatgacatgactggtgagacgggaactcttggttacatggctccagaggttctcaatggtagtgcttatgaccgaaagtgtgatgtgtacagcttcggtatttgcttgtgggaaatatactgttgtgatatgccataccctgatctgagcttctcggaagtgacatcagctgttgtccgtcagaacttgaggccggagatcccgcgttgttgtccgagctcgcttgcgaatgtcatgaaacgctgctgggatggaaatcctgacaagagacccaaaatggatgaggtggtagccatgttggaggctatcgacacctcgaaaggaggaggtatgatccctctcgatcagtcgcagggttgcttctgtttccgcaaacaccgaggtccttgaatgttggtgcagccacgtcaagtgaagtgacagtcgagcatctgagaaagaacatctggaatttgatctgtatgtaatacaattaaagagggtggagtgcatgggctgagggcattcgattggagggttagatatcaagttcttatgtttctctttctttttctgcgttggttaattttgtttttaagtaggtgaagagccctatgtttttctttgttatggatcctgtaaagcttgatctgctcttcactatcactttccattggtggaggaaactgacagtaaatattgttaggggcaataaagaaaaaatttgttgaacccaaaaccttctggttttcatatattctgatatgcacttgtccttggatatgccaa

SEQ ID NO: 5397 - DNA, 1624 bp, Amborella trichopoda
ctctctctctctctctatatatatatatatatatctctatttctcattttctctttttgtgtctgaaagtgtggattgaacccaacatagtttaaagatgaaggagagcggtgatggatttgttagagcagatcagatagatctgaagaaccttgatgaacagttagagaggcatctgagtagggcatggactatggagaagaatgggaataggagagtgagagaggattgggagattgatcctagcaaattggttgtaaggaatgtgcttgctcgaggaacttttggtactgttcatcgtggggtttatgatgggcaggatgttgcagttaagctactagattggggtgaagaggaaaacagaacagaggctgagttagcatcacttcgagcagcatttacacaggaagtggctgtctggcacaagcttgatcatcctaacgtaacaaagtttataggggctacaatgggcggttcagaactaaaaatacaatcagaagacggtgagttcggcatgccaagcaatgtatgttgtgtggtggttgaatatcttcaaggaggtgcactgaagtcctatctaattaaaaatcggcgaaggaagttggctttcaaagttgttgtccaattggctctggatcttgcacgagggctgagttaccttcattctaagaagattgtacatagagatgtgaaaacagaaaacatgcttttggataagtcacgcactgttaaaattgctgattttggggttgctcgtgttgaggcgcaaaacccaaatgacatgactggtgagacaggaacccttggttacatggcgcctgaggtccttaatggcaatccatacaatagaaaatgtgatgtgtacagttttggcatctgcttatgggagatttactgttgtgatatgccctatcccgacctcagtttttcagaggttacctctgcggttgtacgacagaatttgaggcctgagataccaaggtgttgtccaagctctttggccaatgtgatgaagaagtgttgggatgcaaatcccgacaaaaggcccgagatggatgaggtggtttcaatgttggaggccatcgacacctccaaggggggcggcatgatccctctcgatcaacaaaagggttgtctctgttttcgcaaatatagaggaccttgaatctcttccggggcaaatcctttggttactacgtttttctcaactttgaaggttcttcagttaaaaaacaagtcactattattatcagcagcttgaagaaatgatcatggatttgaagatgtgagaagctgcttggcttggaaggagaagctgcttggcttggaaggagaagctgtgtgaatattctcatattggtgatctataatagtgttaagtctgtctattatagaatgtaaaaggcttttccttgtcctgactggtgagttgtaatggctgggttagtgttgtaagatataagcttttactaacatttcattattctactctttttcaaataaattctatgttattggactgctttttgatggggaattagatgaattacttctctttacatagttgtatattggaattgtgttgtaatgcttaaaattgaaagtgcatatcagactgatctcc

SEQ ID NO: 5398 - DNA, 1163 bp, Manihot esculenta
ccaataatgaaggaaaacagtgatgggtttgtcagagcggatcagattgatctcaaaagccttgatgagcaactcgagaggcatctcaataaggtatggactatggacaagaacaagagacccgatgatagtaatatcgctccactgcctactgctgctgtcaacgccaccaagactagtgcagctacgttcaagaaggacaggcaggaatgggagatcgacccttctaagctcatcatcaagagtgttattgcacgtggtaccttcggcaccgttcaccgtggcatctacgatggtcaggatgttgctgttaagctgcttgactggggtgaagagggtcacaggacagaagctgagattgcgtcgctaagggcagctttttcccaagaagttgctgtatggcataaacttgatcatcctaatgttactaagtttataggggcaacaatgggctcgtcagagttgcagatacaaactgaaaatggccacattggcatgccaagtaatatatgttgtgttgttgtggaatatcttgctggaggtgctttaaaatcataccttataaagaacagacgaaggaagctagcttttaaagttgttgtggagttggcacttgatcttgccagaggattgagttaccttcactctcagaagattgttcacagagatgtaaagacagaaaacatgttattggacaagacacgcactgtaaaaattgctgactttggagtcgcacgtgttgaggcttcaaatcctaatgatatgacaggggagacaggaacacttggatacatggctcctgaggttctcaatggcaatccttataataggaagtgtgatgtgtacagttttggtatctgtttatgggagatatattgctgtgacatgccatatcctgaccttagtttctccgaagtgacttctgctgtggtccgtcagaatttgagaccagagataccaaggtgctgcccaagctctctagcgaatgtaatgaaacgatgttgggatgctaaccctgacaagcgccctgaaatggatgaggtcgtctccatgttggaggcagttgacatatccaaaggtggaggtatgatacctcctgatcaacagggtggttgtctctgcttccgcaggtatcgaggaccttgaagaattacttcctttgg

SEQ ID NO: 5399 - DNA, 1653 bp, Vaccinium corymbosum
tgggttcgtgagggcagatcaaattgatctcaagagactcgacgagcagctcgagaggcacctcaaccgagcatggaccttggagaagaagcagcagcagcaccaacagcagctcgattccgagtccttcgccgccgcggctgccgccgttaagaggccgagagaggactgggaaatcgaccccaccaagctcatcatcaagggcgtcctcgcacgtggcactttcggcaccgtccaccgcggcatctacgacggccaagacgtcgccgttaaactgctagactggggggaagaggggcacaggacagaagcggaaatagcatcattgagggcagcgtttacgcaggaagttgcggtatggcataagcttgaccatcccaatgtaaccaagtttataggggcaacaatgggcgcttcaggcctgagcatacaaacagaaaacggtcaaatgggcatgccaagtaatctctgttgcgttgttgtagaatatcttccgggtggcgccctgaaatcttatctcataaagaacaggagaaagaagctggctttcaaagtagttgtacagatggcacttgatcttgccagagggttgagttacctccactctcagaagattgtccacagagatgtaaagacagagaatatgctcttagacaagacacgaacagtaaaaatagcagattttggggttgctcgcgttgaggcctcaaatcctaacgacatgactggggagactgggactctcggttacatggctcctgaggttttaaacggcaacccatataacaggaaatgtgacgtgtatagttttggaatctgtttgtgggagatatattgctgcgacatgccatacccagaccttagtttctcggaagtgacatcagccgtggtccgccagaatttgagaccggagataccaaggtgttgtccgagctctctggcaaatgtaatgaagcgatgctgggatgctaaccctgacaaaaggccagagatggacgaggtagtctcactgttggaggccatcgacacaacgaaaggcggaggtatgattcctcatgatcaggctcaaagttgtctctgcttccgcaagcaccgagggccttgaattgagctcttaaacgagtaaatcatacatttcaacgtccaaagatccatattggtacttctgaaggaaaaagaaatgggatattcggagctgacggtggaggttataggctgggggactctgctacatatctctttattggatactgtaactctgtaaggcttttctttcgtaatcttctacttcttttatttgatgttcttctgagttagtaaatatgtgtatttgattgaccggctccccacacatggactgtgaaaatcacacttaatattctagtagcaatacattcagattatgtgggtaacatctgggtcattgaaccctatatgatgtactacgaatcataatttctctctttttcggaaaataaattcaaaagactagcatgatgtccatcgttgcgtaaatttaggtcgtttccctgtacgataatatttttggtcgtacaacaccattgtagtcattttgtgctccggtaattgttgtcattctttagatctccaagattgttttctcatattgtaacaaagagtcttttaggaaac

SEQ ID NO: 5400 - DNA, 1229 bp, Malus domestica
accgtgaaaaaaaatgaaggagaagagcgacggcggcggaggcggaggcgggtatttgagggcggatcagatagatctgaagagcttggacgagcagctgcagcggcacctcagcagggcatgtacgatggagaagaacaagaagccggaggaagacgaagaggcagtggcggcgtcgaggagcaacactcccagaaggcaagagtgggagattgatccctccaagctcgtcgtcaagggcgctatagctcgtggcactttcggcgcggttcaccgtggcatgtacgacggccaagacgtcgccgttaaacttctagattggggagaagaggggcatagatcagatgctgaaatagcttcactaagagcagcttttactcaagaagttgctgtctggcataagcttgagcaccctaatgtaaccaagtttataggggctacaatgggatcatcggagctacacatacaaacagataatggccaagttggcatgccaagtaatgtttgttgtgttgttgttgaatattgtcctggcggtgcactgaaatcttacctcataaagaaccgcagaaggaagctggcattcaaactagttgtccaactggcattggatcttgcaagaggtttgtgctatcttcattcgaagaagattgttcacagagatgttaaaacagaaaacatgcttctggacaagacacgaactgtaaaaatagccgactttggggttgctcgtgttgaggcttcaaatcctaatgaaatgactggggaaactggaaccctcggttacatggctccagaggttctaaatggccacccatataacagaaaatgtgatgtgtacagtttcggaatctgcttgtgggaaatatactgttgtgacatgccgtatcctgatctcagcttctcggaagtgacatcagccgttgtccgccagaatctgaggccagagatacctcgttgttgcccaagtgctcttgcaaatgtgatgaagcgatgttgggacgctagccctgacaagcggcctgagatggacgaggtggtggccatgttggaggccattgacacatctaaaggtggaggtatgatccccggggaccagccgcagggttgtttctgtttcctcaagtaccgcggaccttgaaagatttgctcctcgtccggcaagcgagagacgcgaaaggaacgtgtccgttctggaaattcaatttgtattagattgaattgaatag

SEQ ID NO: 5401 - DNA, 1157 bp, Pennisetum glaucum
ccggagggaggactgggagattgaccccgccaagctcgtcgtcaagggcgtcatcgcccgcggcaccttcggcaccgtccaccgcggcatctacgacggccacgacgtcgcagtgaaattacttgattggggcgaggatggtcataggtcagaacaagatattgcagcattaagagcagcattttcaacagaggtctctgtttggcataagcttgaccatccaaatgtaactaagtttttaggagctataatgggtgcaagggatctgaatattcagacagaaaatgggcacatcggcatgccaactaatatctgctgtgttgttgtggagtatcttgctggaggtgcactaaaatcatttctgataaagaacagaagaaggaagttagcttttaaggttgttgtccaaattgctcttgaccttgctcgagggttaagctatcttcactcgaagaagattgtgcaccgtgatgtgaagactgaaaatatgcttcttgacaaaacaagaactgtgaaaattgctgattttggtgttgctcgccttgaagctgctaatcccagtgatatgaccggtgaaactggaacacttggttacatggcacctgaggttcttaatggtaatccttataacaggaaatgtgatgtttatagctttggaatttgtttatgggagatatactgctgtgacatgccatatccagatttgagcttctcagaggtcacgtctgctgttgttcgtcagaacttgaggcctgagataccacgctgctgtccaagttctttagcaaatgtgatgaagcgttgctgggatgcgaaccctgacaagcggcctgagatggccgaggttgtgtctatgatggaggcgatcgacacatcaaagggtggaggcatgcttcctgtcgatcagcgaccaggatgcctttcgtgcttccgtcagtacagaggtccgtgattgaggggctgttctggagctgtggtctgaagattgacctctagatcctgtgtatgtcgattgcatttgttttctgggaagcaaactggttaatgaagctagtgtgcttgtgatcccttgtttgaaaggcctctcgtatgtaaattctccgtccatcctttctgtaactctgtttatcgatgaatggaagaaaccggctcgctcg

SEQ ID NO: 5402 - DNA, 1340 bp, Populus trichocarpa
cgtcatcagtatcacaaatttagcatatccttataccgcccttgaaattctaaagaacaaaaccccacgcaggtccgcaggtagttacggtttgtctctgtcccggtttgcgcccgcacgcacttcaaagttttcttttggtctatctaattccagaaatagaagagagagatgaaggaccagaagagtgagagcgatggtgggtatgtgagagcagatcaaatagatctcaagagcttggacgagcaactgcaaaggcatttgagtagggcatggactatggaaaaaaacaaaaacaacaaagatggagatcaaggagaaggagatattgaagaaaccccaagactcgccaataacaataacagtaccaccatagcaagacaagaatgggagattgacccctccaagctcatcatcaaaagtgttatagctcgcggcacctttggcaccgttcaccgtggcatttatgatggccaagatgttgctgttaagcttctcgactggggggaggaaggccaccggtcagatgccgagatagcttctcttagagcagcttttacgcaagaagttgtcgtttggcacaagcttgatcatcccaacgtgactaagtttattggagctacaatcggctcatcagagttaaacatacaaacagagaatggtcacattggcatgccaagtaatatttgctgtgttgttgtcgaatattgccctgggggtgctttgaaatcttacctcataaagaattggagaaggaagcttgctttcaaagtggttattcaaatggcactagatcttgcacgagggttgagctatctccactcaaagaagattgtccatagagatgttaaaactgaaaacatgcttctggataagacacgtacagtgaagatagctgactttggagttgctcgccttgaggcatcaaatcctaatgaaatgaccggcgagaccggaacccttgggtacatggcaccagaggttctcaatggcaatccatataatagaaagtgtgatgtgtacagttttagtatctgtctgtgggagatatactgctgtgacatgccatatcccgatctcagcttctcagaagtgacatctgctgttgttcgacagaatctaaggccagaaattcctcgctgttgcccgagcgctcttggaaatgtaatgaagagatgctgggatgctaatccggacaaacggccagagatggaagaggttgtctccatgttagaggcaattgacacgtccaagggtggaggtatgattccttctgatcagcctcaaggttgtctctgttttcgcaggtatcgagggccgtgaaagacttcctccatgaa

SEQ ID NO: 5403 - DNA, 1130 bp, Prunus persica
tgaaaatgaaggagaagagtgagagtggcggtgggtatgtgagagcggatcagatagatctgaagagtttggacgaacagctccagaggcacctgaacagagcatggactatggagaagaacaagacgagagaggaagaggaagaggaagaggaagaagcagcatcaaggcagactgctgccacaaggcaagactgggagattgatccctccaaactcaccgtcaagggtgccatagctcgaggctcttttggtactgttcaccgtggcatttatgatggccaagatgttgctgttaaacttctagattggggagaagagggacatagatcagacgctgaaatagcttctctaagagcagcttttactcaagaagttgctgtctggcataagcttgaccaccctaatgtgaccaagtttataggggctacaatgggaacatcagagctacacatacaaacagataatggccaagttggcatgccaagtaacgtttgttgtgttgttgttgaatattgtcctggtggcgcactgaaatcttacctcataaagaaccgcagaaagaagcttgcattcaaactagtcgtccaactggcactagatcttgcacgaggtttgtgctatcttcattcgaagaagattgttcacagagatgttaaaacggaaaacatgcttctagacaagacacgaacagtaaagatagcggactttggggttgctcgtgttgaggcttcaaatcctaatgacatgactggcgagactggaacccttggttacatggctccagaggttctcaatggcaatccatataacaggaaatgtgatgtgtacagttttggtatctgcttgtgggaaatatactgctgtgacatgccgtatcctgatcttagcttctcggaagtgacatcagccgttgtccgccagaatctgaggcctgagatgcctcgttgttgcccaagctctcttgcaaatgtaatgaagcgatgttgggatgcaaaccctgacaagcggccggagatggatgaggtggtggccatgttggaggctattgacacatctaaaggtggaggtatgatccctggggatcagcctcagggctgtttctgtttccgcaggtaccgaggaccatga

SEQ ID NO: 5404 - DNA, 1212 bp, Manihot esculenta
cttttttgcaataatgaaggaaaacagtgatgggtttgtcagggcggatcagattgatctcaaaagtcttgatgagcaactcgagaggcatctcaataaggtgaggaccatggataagagcaagagacctgatgatgctcatctccctctagtggcttctgctgccgctgactccaccaagactagtatacctaccttcaaaaaggacaggcaggaatgggagatcgacccttctaagctcatcatcaagactgtcattgcacggggtaccttcggcaccgttcaccgtggcatctacgatggccaggatgttgccgttaagctgcttgactggggggaagagggccatcgaacagaagctgagattgcctcactgagggcagctttttcccaagaagttgctgtttggcataaacttgatcatcttaatgtcactaagtttataggggcaacaatgggctcagcagagctgcagatacaaactgaaaatggtcaaattggcatgccaagtaatatatgttgtgttgttgtggaatatctacctggaggtgctttaaaatcttaccttataaagaaccggcggaggaagctagccttcaaagtcgttgtggagttggcacttgatcttgccagagggttaagttatcttcactccgagaagattgttcacagagatgtaaagacagaaaacatgttattggacaagacgcgcactgtaaaaattgctgattttggagttgctcgtgttgaggcatctaatcctaatgatatgactggggagacaggaacactaggctacatggctcctgaggttctcaatggcaatccatataataggaagtgtgatgtgtacagttttggcatttgtttatgggagatatattgctgtgacatgccatatcccgaccttagtttctcagaagtgacttcagcagttgtccgtcagaatttgagaccagaggtaccaaggtgttgcccaagctctctagcgaatgtaatgaagaggtgctgggatgctaacccagacaagcgccctgaaatggatgaggttgtctccatgttggaagccattgacatatcaaaaggtgggggtatgatccctcttgatcaacaaggtggttgtctctgcttccgcaggtatcgtggaccttaaatcttcctctgggcagccaaaatgactagattgtgattattctgagctatggtggtcaa

SEQ ID NO: 5405 - DNA, 1455 bp, Populus trichocarpa
cgaagatttcttgtggtctatctgatattagaagtagaagaaagaaagagagatgaaggatcaaaagagtgaaagtggtggtgggtatgtgagagcagatcaaatagatctcaagagcttggacgaacaactgcaaaggcatttaagtagagcatggacggtggaaaagaacaaaagcaagaacgatggagatcaaggcgaaggagaaggagaaacgcaaagactgacccagaataataacagtacaaccataactagtcatgaatgggagattgacccctccaagctcatcatcaaaagtgttatagctcgtggcacctttggcaccgttcaccgtggcatttatgatggccaggatgttgctgttaaacttcttgattggggggaggaaggacaccgatcagaggccgaggtagcttctctgagagctgcttttacacaagaagttgccgtttggcacaagcttgatcatcctaacgtgactaagtttattggggctgcaattggctcatcagagttaaacatacaaacagagaatggtcacattggcatgccaagtaacatttgctgtgttgttgtcgaatattgccctgggggtgctttgaaatcttacctcataaagaataggagaaggaagcttgcttttaaagtggttgttcaattggcactagatcttgcacgagggttgagctatctccattctaagaagattgtccatagagatgtcaaaactgaaaatatgcttctggacaagacacgtacagtgaaattagctgacttcggggttgctcgcatcgaggcatcaaatcctaatgacatgactggcgagactggaacgcttgggtacatggcaccagaggttctcaatggcaatccgtacaacagaaagtgtgatgtgtacagttttggtatctgcctgtgggagatatactgctgtgacatgccatatcccgatcttagcttctcagaagtgacatctgctgttgtgcgacagaatctgaggccagaaattcctcgttgctgcccgagctctcttgcgaatataatgaagagatgctgggatgctaatccagacagacggccggagatggaggtggttgttttcatgttagaggcaattgacacgtccatgggtggaggtatgatccctcttgatcagcctcaaggttgtctctgttttcgcaggtaccgagggccgtgaaaaacttcgtccttgaagtaaacttcgtccaattcgtctcatgttctgttcaagacactggcttaaagagctgagggtagagtatgcggagactataggctaagaagaaccttgcgataccggtttctttacaggacaatggattctgttaagctttatttatgaaacttgaacgttagttcttgctctgtttttatgtttcttgatcgattgaacgttaatatgatggatgggcgggccctatacaccctttc

SEQ ID NO: 5406 - DNA, 1598 bp, Fragaria vesca
gtagtagtatttctactacttcttcatctagtctcggtgacaccattaatagacagaagcacgacacaagtatacagacacacttctctctagtctccacagaacacacataaaacaaaccaaaacagaaaccctttcaagtataagggtctgtctctgtgtttggatatcaatagcctgaaacaaaaatgaaggagaagaacgacaccggcggcggaggaggcggaggtgcgtatgtgagggcggaccagatagatctgaagagcttggacgagcagctgcagaagcatctgggcagggcttggactatggagaagaacaagaacagagaagagcaagaacaggaacaagaacgggaaacagaagcagctaggagggtgacggtggggcccaccaggaggcaggagtgggagattgatccttccaagctcaccgtcaagggagctatagccagaggcactttcggcaccgtccaccgcggcatttacgacggcttagacgtcgccgttaaacttctggattggggagaagagggccatagatctgatgctgaaatagcttctctaagagcagcttttactcaagaagttgctgtctggcataagcttgatcatcctaatgtaaccaagtttataggagcgacaatgggaacatcagagctcaacatacaaacagacaatggccaggttggcatgccaagtaatgtttgttgtgttgttgtcgagtattgtcctggtggtgcactgaaatcttacctcataaagaaccgcagaaagaagttggctttcaaagtagttgtccaactggcactagatcttgcacgaggtttaggctatcttcattcacagaagattgttcacagagatgttaaaacagaaaacatgcttctggacaagacacgtactgtgaaaatagctgactttggggttgctcgtgtggaggcctcaaatcctaatgacatgacaggcgagactggaacccttggttacatggctcctgaggttctcaatggcaacccatataataggaaatgcgatgtgtacagttttggcatatgcttgtgggaaatatactgctgcgacatgccgtatcctgatcttagtttctcggaggtgacatcagctgttgtccgccagaatctgaggcccgagatacctcgttgttgcccaagcgctcttgcgaatgttatgaagcgatgttgggatgctaaccctgacaagcggcccgagatggatgaggtggtagtaatgttggaggcagtcgacacaactaaaggtggaggtatgctccctcatgatcatcctcagggttgtctctgcttccgcaggtaccgaggaccctgaaagatcttctccttcattgtggtgcaagagaggttatggggcgtggaattattctgcaaattattgaattggatagatctgagtattaagaagagtcaagtgaatacaaattgtggaggctgtaggctaagaggagctctgcactatctgttgctttgttggactatagatttgtaaagcttttctttctttttgttaagttaatctcctgtctatcaatctatggaaatgcatgtaatttcacaagatgtttac

SEQ ID NO: 5407 - DNA, 1765 bp, Cicer arietinum
aaaatccatgtgcccacatggatgattgagagagagattcataaactgaagaaaaaacaacttttttatgtttatgtttatgtttcattagataaacaacaaccattatatttatgtcttcaccaaaacaaactgaacttgtagtatcaacaatactaatagaaaaagaagaagaaaaaacacaatgatccaccaatgaaaatttgctcaaaacatccaaagtttgaaacttttaatgattcaaagtagttttagtatcaaaaggagtagagggtattggtaatttttttttgttgagttttgtgttgaagagaaatgaagaagagtgagagtggtggttatgtgagagcagatcaaatagatctgaagagtttggatgaacaattacagaggcatcttagtagagcatggactatggagaagaagaataaagagaaagaagatgaaagtgaagttgaaggaaggtgttctaatactacaacaaatcatagacaagaatgggagattgatccttcaaaacttttaatcaaaactgtcattgctcgtggcacttttggcactgttcatcgtggtgtttatgatggtcaagatgttgctgttaagctccttgattggggtgaagaaggtcatagatcagatgctgaaatagcttcattgagagcagcttttacacaagaagttgctgtttggcacaaacttgaccatcctaatgtaaccaagtttattggtgcaacaatgggaacatcagacctacagatacaaacagaaactggtcatataggaatgccaagtaatctttgttgtgttgttgttgagtattgtcctggtggtgctttgaagtcatatctaattaaaaacagaagaaggaagctggcttttaaagttgttgttcaactagctcttgaccttgcaagagggttgagttatctccacatgaagaagattgtccatagagatgttaaaacagaaaatatgcttctggacaagacgcgaactttgaagatagctgatttcggagtagctcgtatcgaggcttcaaatcctcacgacatgactggtgaaactggaacccttggttacatggctcctgaggttctaaatggtagtgcatacaatagaaaatgtgatgtgtatagttttggcatatgcttatgggagatatactgctgtgacatgccatatcctgaccttagtttctcagaagttacatcagctgttgtaagacagaatctaaggccagagattccgcgatgttgtccaagttctctagcaaatgtgatgaaaagatgttgggatgctaatcctgataagaggcccgaaatggatgaagttgtcaccatgttggaagctattgacacttcaaagggtggaggtatgatccctctagatcaacctcaaagttgtttatgtttccgccggtatcgaggaccttgaaaagatttttaactatcaaatgaaagttcatcccagaaaagtgttcgttacacaatattttaaaaccagttggcatttccagaaacaatgaaaattggtatgtattttatttcattggaagaagaatagagaaagaaggaagacacatgaaagaaaatgtgagtgaaaggcatagttaatgaaatgcataatttttgtaaagctaatttgtacttttcattttcattccaaccatttttatattattgtctcttatgtataagttgtacactttatagtagcagcatcatggattgttccaacactaatatatcaaggttctgatggttcc

SEQ ID NO: 5408 - DNA, 1750 bp, Phalaenopsis aphrodite
aatgtgcgtcctcttctttttcatagttcgataaaaatatgaaataaaagctcgcatccattgaacgagaagtccgaactgctgcgctgaagatctcttctccaaaaggaaaaatcagaagagagaaagaacattgaatcagggagggcgtagaatctgtccatggagggtcacgattaatcgcaccaattaaaaaaaaaaaaactataaaaaacagcagttggtcctccgcaggcatcccatgtgctcacatggagcatagaagttggagcttacaggatttgcaggcgtttgggaacctaagaggcgacaccatgtgaggcaagaaggaagaactcgaagaagcgcgctgcatttcacgacgtcgatcccaattcatagaccaagttagagaagtcgatcatcgtctacacagaatatttggtgggagatgaaggaaggtggagacggaggaggagggtttgtccgtgcggatcagattgatctgcggagtcttgacgagcaattggaaaggcatatgagcagggcgttgactatggagaagaagatgaaaggggaagaggatgtgaaaaggaggagggagagagaggaatgggagatcgatccggctaagctcctcattaagggtctcatagctcgcggcactttcggcaccgttcatcgcggcgtttacgatggtcaggacgttgccgttaaattactggactggggagaagaaggtagcaggacagaagctgaaattgcttcactgcgagcagcatttactcaggaagtttctgtttggcataaactcgatcatccaaatgtaactaagttcataggcgctacattgggtgaggcagacctgaacatacaaactgaaaatggccagattggaatgtccactaacatttgctgtgttgttgttgagtacctccctgggggccccttaaaaacttatctcataaaaaatcataggagaaagctagctttcaaagttgtagtccaaatatctcttgatcttgcaagggggttgagttatcttcactcaaaaaagattgtgcacagagatgtaaagacagaaaatatgcttctggataggacaagagctttaaaaatcgctgattttggtgttgcgcgagttgaagcacaaaaccccaatgatatgactggagaaaccggaacccttggttatatggctccggaggttctaaatggaaatccttacaacagaaaatgtgatgtgtacagttttggcatttgcctgtgggagatatactgctgtgatatgccatatcctgacctcactttctctgagatcacatctgcagttgttcggcaaaatttgaggccggagataccaaggtgctgcccgaactcactagcaaatgtgatgaaacgatgctgggatgcgaaccctgacaggcggccggagatggatgatgtagtcgtcatgttggaagccattgacacatccaagggcggagggatgatccctattggtcagcaacaaggatgcctgccttgttttggcagctacaaaggcccctaaatttgctgtaatcaaaatgttttattgaaatccttgttgatattctgattgctgctgatgcttcgcagcgctcggtggccggaattgtatttatggagccaagccaatagcaattatgtaatacatgtgtttgacttctttcttgtctgaggatttacttttctgtgtcataattttttgtgttggtactgtttgttatgtggaggcgaggcgcacagg

SEQ ID NO: 5409 - DNA, 1733 bp, Mimulus guttatus
ggtaaaaggtctatggttcgagtccctcctcccctacttccccaacttgaattacttaaaaaaaatcatattttttttatgatatttaaattttttattttacaatttcgaacccccttggcaaaaatcctggatccgccactgcgcacatatatacacatttgtagaaggaaaatggagaaaagcagtagtaatgggttcgtgagagcagatcagatagatttgaaaagcttggacgagcagctcgagcgccacctcagcagaacttggactttggagaagaacaagatcaacaaggatccaaacgactcctccgccgccgccgtcgctgccgcaacccccgccgccgccgccgttgtacccaggaggcagaggcaggagtgggagattgacccatctaagctgatcgtcaagggcgtgctcgcgcgtggcacatttgggaccgtccaccgtggcgtttacgacggccaggatgttgccgttaaattgctcgactacggggaagacggccacagaacagaatctgaaatagcatctttaagagcagcttttactcaagaagttgccgtgtggcataaactcgatcaccctaatgtaacaaagtttataggagcaacaatggggtcgtcgggactaaatattcagacagaaacaggtcacataggcatgcctactaacatatgttgcgttatcgtggaatatctgccaggtggcgccttgaaatcttaccttataaagaacaggcgaaggaagcttgcgtttaaagtcgttgtgcagatggcactcgatcttgctagagggttaagttaccttcattccgagaaaattgtacacagagatgttaagacagagaatatgttgttggataagacgaggacggttaaaattgccgattttggagttgctcgtgttgaagcatctaatccgcacgacatgacgggggagactggaaccctaggttacatggcacccgaggttttaaatgggaatgcatacaaccgaaaatgcgatgtatatagctttggcatctgcctgtgggagatatattgttgtgatatgccgtatcctgatcttagtttctccgaggtgacatcagcagttgtccgccagaatttgaggcccgaaataccaagatgctgcccaagtgcacttgcgaatgtgatgaaacggtgttgggatgcaagcccggataaaaggcccgaaatggatgaggtggtttccttaatagaggcaatcgatacttcgaaaggtggtggaatgatccctgtcgaccaacaacaaggttgtctctgcttccggaagactcgtggcccgtaaaaaaaagaaactcgaaaaatggtaagaattagggtttctttgtctgaagattgaaatctcaattattgttatgcatagagaaaatctggagtatattatttatattatctcggatctcttgcatggtgtaaactgtaaagctttttttttagatatttttcttttttaaaaacttaatttagttattttatatttagcattcttgattcattttaattttatagtgtggtgtgggattgggatattactctatattagaccaatgtgacatgaaaattggactaattataaataaaaatgcagtgattggtcggaatatatgaagcgttcgattctgagatgtacggttgtaacttgtgatacgaatttggtttattttgttaataaatcgagcttttaatgaatgagtttcaatc

SEQ ID NO: 5410 - DNA, 1228 bp, Ambrosia trifida
taataacagcaacaataatgatggatttgtaagagcagatcagatagatctcaagagtctagatgaacaactcgagcgtcatcttaacagagtatggactatggaaaacaacaaaaagaagcagcccggaaatgacgtcaccaccaccatcaccaccgccttaagactgtcgcctaaacccttagcaattaaaagacaggactgggagatcgatccctctaaactcatcattaaaggtgttcttgctcgtggcacttttggcactgtccaccgtggcatctatgacggcgttgatgtcgccgtgaaactgctggactggggtgaagagggtcaccgttcggaggcggaaatacagtcgttaagggcggcgtttacgcaagaagtagtggtgtggcataagcttgatcatcctaatgtcactaagtttataggtgcaacaatgggttcttcagagctgcaggtgcaaaccgaaaatggtcaaattggattgcctagcaacatatgttgtgtcgtggtagaatatcttgccggaggtgctttgaagtcttacctaataaaaaaccgaaggaaaaaactgccttttaaagtagttgtccagattgcacttgatcttgcaagagggttaagttacctgcattcccaaaaaattgtacatagagacgtgaaaaccgaaaatatgctgttggacaaaaccagaacggttaaaattgctgattttggggttgctcgtgttgaagcctctaacccaaatgacatgactggtgaaactggcacccttggctatatggctcctgaggtactgaatgggaatccgtataatagaaagtgtgatgtgtacagttttggcatttgtttgtgggaaatctattgttgtgatatgccatacccagatcttagtttctcagaagtaacttccgcagtcgttcgtcagaatctaaggcctgagatacctagatgttgtccgagttctcttgctaatgtgatgaagcaatgttgggatgcaaatcccgacaagcggcctgaaatggatgaggttgttacaatgttggaggcgatcgatacaacaaaaggtggaggtatgattccgggtgatcaagctcaaggttgtctttgcttccggaggtatcgcgggccttaaagaagatatctatccaccttatgttgagaagattgtacattgctatttgaatgttgaaaattcgacccggttttgctacttcgaaaaaaa

SEQ ID NO: 5411 - DNA, 1774 bp, Vitis vinifera
ggaaaattcaaaaagaaaaaaaaggaaaataaataaggggtgagtgagtgaagggaagaagcagaccaaagagcagagagtgggtcagaaagacacgttatgtagaggcaaatccatgtgcccacatggtcgatgatgccattaccattactcccagatccttcaatccttacctacatctactcttcctctatcatcatcatcattgctttcttctctgctttttgatttgattcgattctcttcacacaacccagaagaggaaaaaaaatgaaggagagcagtgatgggtttgtgagggcagatcagattgatctcaagagcttggatgagcaactggagaagcatcttaacagagtatggaccatggacaagaacaagaagaaagaggatgactcctcctccgccgccgccgccatccccaccctcgccccctccaccaccgcctccaccaccgcccccaccaccgcccgacaagactgggagatcgacccctctaagctcatcatcaagaccgtcattgctcgtggcactttcggcactgtccaccgtggcgtttacgacggccaagatgttgccgttaaactgcttgattggggggaagagggtcacaggacagaagctgaaattgcttcactgagggcggcttttacgcaagaggtagccgtgtggcataagcttgaccatcctaatgtaacaaagtttataggggcgacgatgggctcagcggagctaaacatacaaacggagaatggtcatataggcatgccaagtaatatttgttgtgttgttgtggagtatcttccagggggtgccctgaaatcttatctcataaagaaccgaagaagaaagttggctttcaaagttgtcattcagctggcacttgatcttgcaagagggttgagttaccttcactctcagaagattgttcacagagatgtaaagacagagaacatgctattggacaagactcgaactgtaaagatagctgattttggagttgctcgggttgaggcttcaaatcctaatgacatgactggggagactgggacccttggttacatggctccagaggtcttaaatggaagcccatataacaggaaatgtgatgtgtatagttttggtatctgtttgtgggagatatattgctgtgacatgccatatcctgacctcagtttctcagaagtgacttcagctgtggttcgccagaatctgaggccagagataccaaggtgttgccctaattctttggcaaatgtaatgaagcgatgctgggatgctaaccctgacaaacgaccagagatggatgaggtggttgctatgatagaagccattgatacatcaagaggaggaggtatgcttcctgttgatcagcctcagggctgtttttgtttccgcaagtatcgaggtccttgaagaaaattattccctctaagaagatacaaaattgttatattaatatttcaagattggaaagatccaactgtttttatgatggggaaaattggtaattggaatttcaaagctgagaagatttggatggtgggtataggctgtggagcactgctacatctcgcccatgtaaagcttttcttttgtttttctccctcttttttctccaaattttttaggctttccaaattatgtgtatttgattgacttgccagttgggttatgaactggcctgcgatctctcttgtaagatcaccttttacatgctattaataaccattattattatgattataaagatgatttatactgctatctatat

SEQ ID NO: 5412 - DNA, 1307 bp, Arnica chamissonis
caaaatcaaaatcactcacaaaaccccaatttcactgccattttcggcgaacttgtatcaccgccgatccgacgagatgaaggagaacaacaacaacagcagcagcaataatgatggttttgtaagggcagatcagattgatctcaagagtttagatgaacagcttgagcgccatcttagcagagtatggaccatggaaaatagcaaaaagaagcagccggacacacaagcctccgccgccgccacggccacctccaccgcgaccttcagaccgttgtcatctaagtcccccgcaactaagaggcaggagtgggagatcgatccgtctaaccttatcatcaaaagtgttcttgctcgtggtacattcggcaccgtccaccgtggcatctacgacggcatagacgtcgccgtaaaactgctggactggggtgaagagggccaccggtcagaggcagaaatacaatcgttaagggcggcgttcacacaagaagtggtggtgtggcataagcttgatcatcctaatgtcactaagtttataggtgcaacaatgggttcttcagatctacatatacaaaccgaaaatggtcagattggaatgccaagcaacacatgttgtgtcgtggtagaatatcttcccgggggcactttgaagtcctacctaataaaaaacaggagaaaaaaactgccttttaaagtggttgtccaaattgcacttgatcttgcaagagggttaagttacctgcattcccaaaagattgtacacagagacgtgaagactgaaaacatgctgttggacaaaactagaaccgttaaaattgctgattttggggttgctcgtgttgaagcctctaacccaaacgacatgactggtgaaactgggacccttggctatatggcccccgaggtactgaatgggaacccgtataatagaaagtgtgatgtgtatagtttcggcatttgtttgtgggaaatatattgttgtgatatgccataccccgaccttagtttctcagaagtaacttctgctgtcgtccgacagaatctaaggcccgatatacctagatgttgcccgagttctctttctaatgtgatgaaacaatgctgggatgcaaatccagataagcggcccgaaatggatgaggttgttacaatgttggaggcgattgatacaacaagaggtggaggtatgatcccaggtgatcaagctcagggttgtctttgcttccgaacgtatcgtgggccttaaagagttctaccttgtgctgagaagattgtacattgttatttgaatgttgaaagatccgacc

SEQ ID NO: 5413 - DNA, 1464 bp, Ambrosia trifida
aacggtggatggtcgcctcactccctaccccaatttcactgcctgtttttgtggaacttgtatcatcaacaccaagatgaaagacgaagacaacaacaatagcaacaacaacaacaacaacaacaataacaatgatggttttgtaagagcagaccagatagatctcaaaagcttagatgaacagcttgaacgccacctaaccagagtatggaccatggaaaagaacaaaacaagacgccggactccgccgccaccaccaccaccaccgtccgaccacccaagaggcaggagtgggagatcgatccctctaaactcatcatcaaaagtgtccttgctcgtggtacatttggcaccgtccaccgtggtctctacgacggccttgacgtcgccgtcaaactgctggactggggggaggaggggcaccggtctgaggcggaaatacaagcgttacgggcggcgtttacacaagaagtagtagtgtggcataagcttgaccatcctaatgttactaagtttataggtgcaacaatgggttcttcggacctccaaatacaaactgaaaatggtcaaattgggatgccaagcaacatatgttgtgttgtggtagaatatctccccgggggtgctttgaagtcttacctaattaaaaccgcagaaaaagcttccttttaaagtagttatccaaattgcactcgatcttgcaagagggttaagttacctgcattcccaaaagattgtacacagagatgtgaagactgaaaacatgttattggacaaaaccagaaccgttaaaattgctgattttggggttgcacgtgttgaagcctcgaacccaaatgacatgaccggtgaaactggaacccttggctatatggcccctgaggtactgaatgggaacccgtataatagaaagtgtgatgtgtacagttttggcatttgtttgtgggaaatatactgttgcgacatgccgtaccctgaccttagtttctcggaagtaacttccgctgtcgttcgccagaatctaaggcctgacataccaaggtgttgcccgagttctctttctaatgttatgaacaatgttgggatgcaaatccagacaaacgacccgaaatggacgcagttgttacgatgctggagggaattgatacaacgaaaggcggaggtatgattccgggtgatcaagctcagggatgtctttgctttcgaaagtatcgcgggccttgaagacttgtaccgtgtgtttagaagatggtacaatgatatttgaatatctaaaggttttgctaagttgaaaaacaagtaaaaggaaatttgatagattccctaaagtgggaatgttttagatggtggatgggtgtgtagactgtagacttgtggtgttatgctacatgtttgaattatgtgaagctttatgtttttattcacttgttatgtttgataacgatattaaaacttaaaaaagaa

SEQ ID NO: 5414 - DNA, 1567 bp, Triphysaria pusilla
aatggagaaaatcagtgatggatttgtgagagcagatcagatcgatttgaagagcttagacgatcagctcgagcggcacttgagcagggcgtggactatggagaagaacaggaagaagggtttagacgatgatgacgattctatctccgccgccgccgtagcgccggtatctgccgcggcgaataccatcaggaggcagaagcaggattgggaaattgacccgtctaagctggttattaaaggtgtgattgcacgtggaaccttcgggactgtccatcgcggcgtttatgacggccaggatgttgccgttaaactgctggactggggcgaagagggccacaggacagaagccgaaatatcatcactaagggcagcttttactcaagaagttgtcgtgtggcataaacttgatcatcctaatgtaacaaagtttataggagcaacaatgggctctgcggagcttaacattcaaagcgaaaatggtcctattggcatgcccagtaatatatgttgtgttgttgtggaatatcttcccggaggtgccttgaaaaattacctcataaagaacaggagaaagaaactagcgtttaaagtagttatgcagatggcacttgatcttgctagagggttaagctaccttcattctcagaagattgttcacagagatgttaagacagaaaatatgcttttagacaagtcacgtacagttaaaatagctgattttggtgttgctcgggtcgaagcctcaaatcctcatgatatgacgggggagactgggactctcggttacatggctcccgaggttctcaacggcaatgcttacaacaggaaatgcgacgtgtacagttttggaatctgtttatgggaaatatattgttgtgacatgccatatcccgaccttagtttttccgaggtgacatcagctgttgttcgccagaacttgaggcccgaactacctagatgttgcccgagctccctagccaatgtgatgaaaagatgttgggatgccaaccatgataaacgacccgagatggacgaggttgttaccatgttagaagccatcgatacttcgaaaggtggaggcatgatcccgaatgatcagcaacaaggttgtctctgtttccgaaagcatcgcggcccgtgaaatacctcattatgtcgtcgtactaggttgtttctggtataatatacagatctcgattacgaggcaagaattgtttttggtagcagaggaaggatacaaggttgacaagtgtgtgcttcattctctccagcattatcaattaatttgataatcttttttatgtgcttatatcataataagattagtacaaaggtattatcttctcatttttaaagtgaaggttaatggctggatgttattagaataatataaggtttgtagaatgtgtgggtgtttctgtcttttttcaccataaaggcttaaagggttacaagtatggtggaaatcggaaagaatttccgattttcgacgaatccaatctgatatattctaatattgtacttatattttgtatcccagttccgaaaaaaaaaaaaaaaaaaa

SEQ ID NO: 5415 - DNA, 1554 bp, Lactuca sativa
accggctgagatatagagtaacccgttggtataaaaaggggggaaattaatcgccggaaaaacccaattgactcaattgaaaccaccgagtgtttttgcaagtgatcggaaaggatgaaggagaacaacaacaatgatggatttgtaagggcagatcagattgatctgaagagtttagatgaacagcttgagaggcatctcaacagagcatggactatggaaaagaacaagaaaaaacaaccagattttgaagactcggccaccgccgcctccgctgcttccgccgtcacactaccgtctaaggctactgcaactagtaaaagggagaggcaggagtgggagatcgacccttctaagctcctaatcaaaggtattcttgcacgtggtactttcggcaccgtacaccgtggcgtctacgacggcatcgacgtcgccgtgaaactgctggactggggggaagagggccacagaacagaagctgaaatacaatctttaagggcagcttttacacaagaagtagctgtatggcataaacttgatcatcctaatgtcacaaagttcataggtgcaacaatgggttcttcagagctaaatgtacaaactgaaaatggtcaaattggaatgccaagtaacatttgttgtgttgttgtggaatatcttcctggaggtgccttaaagaattaccttattaaaaacagaagaaagaagcttgctttcaaagtggttgttcaaatggcacttgatcttgcaagaggattaagctacctgcactctcaaaagattgtacacagagacgtgaaaactgaaaatatgttattggacaaaagtagaacaattaaaattgctgattttggagttgcacgtgttgaagcctcaaaccctaatgacatgacaggcgagaccggaactcttggctatatggcccccgaggttctcaacggtaacccctacaacaggaaatgcgacgtgtatagttttggcatatgtttatgggaaatttattgttgcgatatgccttatcctgaccttagtttctcagaagtcacctcagccgtcgttcgtcagaatctgaggccggaaataccgaggtgttgcccgagttctctttcgaatgtaatgaagaggtgttgggatgcaaaccctgacaagaggcctgagatggatgaagtggtgacgatgttggaagccattgacacctcaaaaggaggaggtatgatcccaggtgatcaaccacagggttgtttgtgtttccgtaagcatcgtgggccatgaaatttcaagaatttcatctgtttttttgggaagtttaagactaaagtaaggtaatttattagaaattggggagttcctaaaatgggaatatattagatgatgtgtctgtggtactggtactacatgtttcgtgctttggattatgtaaagtttttttcttttttaaattctttaaatagattacattacatcctatttaatgggtattattactatatttatttgtcttgtggcaactcatgtaggtttatcttttaggtaatgtgatttttttaactcaga

SEQ ID NO: 5416 - DNA, 1259 bp, Cichorium intybus
gattagacattagtgtacccgttggtataaaaggggggaaattaatcgccggaaaagcaaatttacaattgaaattgtttttgcgagtgatcagaaaggatgaaggagaacaacaacaatgatggatttgtaagggcagatcagattgatcttaagagcttagatgaacagcttgagaggatcttagcagggcatggactatggaaaagaacaagaaaaaacaaccagattttgaagactcggccaccgccgcctccgctgcttccgccgtcacactaccgtctaaagctactgcaactagtaaaagggagaggcaggagtgggagatcgacccgtctaagctcctaatcaaaggtattcttgcacgtggaactttcggcaccgtccaccgtggcgtgtatgacggcatcgacgtcgccgtcaaactgctggactggggcgaagagggccacagaacagaagccgaaatacaatctttaagggccgcttttacacaagaagtggctgtttggcataagcttgatcatcctaatgtcacaaagttcataggtgcaacaatgggttcttcagagctaaatgtacaaaccgaaaacggtcaaattggcatgccaagtaacatatgttgtgtggttgttgaatatcttcctggtggtgccttgaagaattaccttataaaaaacagaagaaagaagcttgctttcaaagtggttgttcaaatggcactcgatcttgcaagagggttaagttacctgcactctcagaagatcgtacacagggacgtgaaaactgaaaatatgttattggacaaaagtagaacaattaaaattgctgattttggagttgcacgtgttgaagcctcgaaccctaatgacatgacaggcgaaaccgggactcttggctacatggcccccgaggttctcaatggtaacccgtacaacagaaaatgcgacgtgtatagtttcggcatatgtttatgggaaatttattgttgcgatatgccgtatcctgaccttagtttctcagaagtcacctcagccgtcgttcgtcagaatttgaggccggaaataccgagatgttgtccgagttcacttgcgaatgtaatgaagagatgttgggatgcaaacccggataagcggcctgagatggatgaggtggtggtgatgttggaggctattgacaccacaaaaggtggaggtatgatccccggtgatcaaccacagggttgtttgtgtttccgtaagcatcggggcccgtgaaat

SEQ ID NO: 5417 - DNA, 1746 bp, Papaver somniferum
tcatgtgcccacatggatgatgatagagaaaagaaaagaactgctacaacatgaagtagtagtagtagcatagtaacagaaaagaccagtagaagagaacaaacccaaaccgaaaacttagtggtaaactctattctttttcggttgcatccaacaaaatagtagttactctttgtctttgttgtccttaaaccagaaaaatagaatcttgagttgattgagagagagagagagagtgagtgtttgtgggtttgagtgaaagagatgaaagaaaataatgatgggtttgtaagagcagatcaaatagatctgaaaagtttagatgaacaacttgaaagacatcttagtagagcatggactatggagaagcaaagagatggaacagctactggaggaaatgatagagctggccgggaagaatgggagatagatccagctaaacttattattaaaactgttattgctcgtggtacttttggtactgttcatagaggcatttatgatggccttgatgttgccgttaaactgcttgactggggagaagaaggccacagaacagaatctgaaattgcttcacttaggactgctttcacccaagaagttgttgtgtggcataaactagatcatcccaacgtgactaagtttattggggctacaatgggtaattcagggctgagcatacaaagtgacagcggtttcattgggatgccaagtaatatttgttgtgttgttgttgagtaccttcctggtggtgcgctcaaatcttacctcataaagaaccgcagaaagaagctgccttttaaagttgttgttcaactggctctagatcttgcgcgagggttgagttatcttcactcgaagaagattgtgcatagagatgtcaagacagagaatatgcttttggataagcagcgtacagtaaagatagctgactttggggttgctcgtgttgaggctcaaaaccctcatgatatgactggcgagacaggaactctgggttacatggctcctgaggtattaaatggcaacccgtacaataggaaatgtgatgtatacagcttcggtatatgcttgtgggagatatactgctgcgacatgccgtatcctgatttgagtttctcagaagtgacatcagccgtcgtccgtcagaatttgagaccagaagtacctcgttgttgtcctagtgctctatcaaacgtaatgaagaaatgctgggatgcaaatcctgacaagcggccagaaatggacgaggttgtaacgttgatagaagccatcgacacaacaaagggtggtggaatgatccctgctgatcaggctcagggttgtttatgttttcgcaaaacacgaggcccctgaaagaattattccttggagcaaaggcataacaaagtggcgtatggaaagctcaggaaataattgggatttgtatttaaggaaaaaaattgtgatgtcaaagtagagagaacttgatggattcatgctgaaagagagaaaagatctcttcaacatctcctaggatgatggtgtaaagctttttttgttttgttttgtttctttctgtgtttattgtgtattttcattgaagtgagtccagttctatgatgtaccggctggttctcccctattccgtaagattagcttctgtgttccattattattatgatgatggtctgaccatttttaagtaaaaagaactattttcattcctcggaatacattgattttctcttaactaaaaaaaaaaaa

SEQ ID NO: 5418 - DNA, 1343 bp, Zea mays
actgcgcgtgtgcgccactacaccaaccgtttggtccgccgttcggggattccttccgcactactacatagtagcacccgtgtggccgtgtccgagctacccacgcccccaacgccaagaacgtcgacgggcacgacggcatggcggcggcggacccggacaccgaagtgcaggcggagttcccacccctcgtccgccagtacaaaagcggccgcgtcgagcggttcttcaacctggccccgctcccggccggcaccgacccggccacgggcgtcgtgtccaaggacgtcgtcgtcgacccggccaccggcctctgggcgcgcctcttcctccccgccggcagccacgggaagaagctccccgtcgtcgtctactaccatggcggcgcctacgtgatcggctcggcggccgacccgatgacgcacggctacctcaacgcgctcgtcgccaaggccggcgtcctcgcggtcgcgctcgagtaccgcctcgcgccggagcacccgctcccggccgcctacgaggactcatgggagggactcaagtgggtggccacccacgcctccgcctccgccgccgcgggaggaggaccggccgccgagccgtggctaaccgagcacggcgacttctcccgcgtgttcctggccggggccagcgcgggggccaccatcgctcacttcgtagcagtccgtgccggtgagcagcacaagagcggcggcctcgggatgcggatcagggggctgctgatagtgcacccctacttcagcggcgcggcggacatcggcgacgaggggacgacggggaaggcgcgcaaggcgcgggccgacgcgttctggcggttcctgtgccctggcacccccgggctcgacgaccctctctccaacccgttctcggaggccgccggcgggagcgcggcgcgcgtcgccgccgagcgcgtgctcgtctgcgtcgccgagaaggacgacctcagggacaggggcgtctggtactacgagagcctcaaggccagcggctaccctggcgaggtggagctgctcgagtccatgggcgagggccacgtcttctactgcatgaacccgcgctgcgacagggcgcgggagatggaggagcgcgtcctcggcttcctgcgcaagtgagcgagcgacggagcgcgcgccttgctacgcgattgagatggaataatttcaccgtttccagatgtggaggcgtttgagcatgaggccatgagggtcttatttgtttgcttaagatcaattgattgaagtttcgaaatctatctcaccgcacttgtcatgtgtctaaatttaaaagaaatgaaaacgaacccataccgtctcccgaattgc

SEQ ID NO: 5419 - DNA, 1508 bp, Setaria italica
actcactcttccgcaccaaccgaacgatcgccactcgccccatgagcctcgctgcgcgcctgcgccactacaccaaccgtttggtccgcacgctccacccatctcggattcctcccccactacaaagcgccgcgcggccggcatcgcactcgcaccgacgccgggagcgagcggtgatggcggcggcggcggacccggacacggaggtgcaggcggacttcttcccgatggtccgccagtacaggagcggccgcgtggagaggttcatgaacatgcccccgctcccggccggcaccgacccggccacgggcgtcgcgtccaaggacgtcgtcctcgacccggccacgggcgtctgggcgcgcctcttcctcccgcccggcgtccccaagggcaagaagctccccgtcgtcgtctactaccacggcggcgcctacgtggtcggctccgcggccgacccgttcacgcacagctatctcaacgcgctcgtcgcggaggccggcgtcctcgcggtggcgcccgagtaccgcctcgcgccggagcacccgctcccggccgcctacgacgactcgtgggaggcgctcaggtgggtggcctcccacgccgcgggcggcaccgggccggagccgtggctcgccgagcacggcgacttctcccgcgtgttcctggccggggccagcgcggggggcaccatcgcgcacgtcgtggcggcgcgcgctggcgggcacggcgccggcgggctcgggatgcgcgtcaggggcctcctgatcgtgcacccctacttcagcggcgcggcggacatcggcgacgagggggcggcggggaaggagcgcaaggcgcgcgccgacgcgttctggcggttcctgtacccgggctcccccgggctcgacgacccgctgtccaacccgttctcggaggccgccggcgggagcgcggcgcgggtcgcggcggagcgcgtcctcgtctgcgtcgccgaggaggacgatctgcgcgacaggggcgtctggtactacgagaacctcaaggccagcggatacccgggcgaggtggagctgctcgagtccacgggcgagggccacgtcttctactgcatcaacccgaggtgcgacaaggcgagggagatgcaggagcgcgtcctgagtttcctacgcaagtgactgcgcgcccgtgtgagcagacaaccacgcgcacgcatgtgagatggaataattttactgcccgggaggcggccgtgtttgagcctggtgctcgtgtactctcatgcttccattgtctctcgaaaacattatgggtagcccccagtcggtgactctcatcgtattattgagatctgacgatcatggactcggcgtcttccctgtttcttcctccctcgcgaagtcgatgaggaatctcatcgtacaattgagatccagtgatcatcgagccatcgtcttcctccgtttcctcctttgctccttctccttcctcgagatgtagtatgggtcagcacatccgtacacatatgtttc

SEQ ID NO: 5420 - DNA, 507 bp, Triticum aestivum
aggcacaaacaaacaccgcggcgccggctcacagcttttgttaccctccagcatccgttttctcttttgccgtcgcgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatcgatcgatcgagtgtttgctgttcctcattctttttggatcatatatgtctccgacatgtgtatatatatgaataaaggtggttgatct

SEQ ID NO: 5421 - DNA, 507 bp, Triticum aestivum
aggcacaaacaaacaccgcggcgccggctcacagcttttgttaccctccagcatccgttttctcttttgccgtcgcgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatcgatcgatcgagtgtttgctgttcctcattctttttgtatcatatatgtctccgacatgtttatatatatgaataaagttggttgatct

SEQ ID NO: 5422 - DNA, 684 bp, Saccharum officinarum
cgtcttcccaccaatctctctcccaatccgctaaccgctcttgctgccccaatccgctcttgctgccagccaaagtagagagaagggcgagatgacggtggagaaggtggacgcggcgctggcggacttcgacgcccacttcgaccgcctcttcgcttccccggacgccgcctccgacggcaaggtgaagctgctgctcttcctggccgaccgcgagcctgactcctccctcacctggtgccccgactgcaacgtggcggagccggtgatctacgagcggctggaggaggcactgcagggcagggacgcggtgctcctgcgcgcctacgtcggggacaagcccacgtggcgcgacccggcgcacccgtggagggtggaccccaggttcgggctcaagggcgtgcccacgctgatccggtgggaggatggcgccgccgccgcacgcctcggcgacgacgaggcgcacctcaaggacaaggtcgacgccctcctctgcgctgctggcggcaactgacagatccggtttcccgttgggttttgagtagagcggacataacaatctgtaattcatgtatgtatgcccaaccaaaagctgggaaattgtgtgatgaagctaataaatcagttcatgtatgacgaaccagaagctgggaaatgcgtagtaataaagctagtaattcgata

SEQ ID NO: 5423 - DNA, 707 bp, Zea mays
agaaaggaatcacacggcacgccgtctcgtgtgcttcctaggtcattcggtcattccacttccaccaatctgtctcccaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacttggcgcgacccggcgcacccgtggagggtggaccccaggttcgggctcaagggcgtgccaacgctgatccgctgggaggatggcgccgccgccgcccgcctcggggacgacgaggcgcacctcaaggacaaggttgacgccctcctctgcgctggcggcaactgagtactgacagatctggtttcccgttcgggttccatctgcgtagagtggccataataacatgtactgtaattcagttcatctacatgccggaccagaagctggggaatcgtgtgaagcttaataattcagtttatctacatgccgaacc

SEQ ID NO: 5424 - DNA, 813 bp, Pennisetum glaucum
ggagaagcgggccccacccggcagcgcgcgagaggaccgagagaggaaacacggcagcggggaagataaaattcggctgcccaatctgccgtgattcctcgcaatctgcctcccaaactcgctcttactgctccaatctgctcgacaagccgaggaggcagtgcggcgagatgacggtggagaaggtggacgcgacgctggccgacttcgccgcccacttcgaccgcctcttcgcctcccccgacgcggcctccgacggcaagctgaagctgctgctcttcctggcggaccgcgagcccggctcctcccgctcctggtgccccgactgcaacgtggcggagccggtgatctacgagcggctggaggccctgcagggtagggacgcggtgctcctgcgcgcctacgtcggggacaagcccacgtggcgcgacccggcgcacccctggagggtggaccccaggttcgcgctcaagggcgtcccgacgctgattcggtgggagggcggcaccgccgccgcccggctcggggacgaggaggcacacctcaaggacaaggtcgacgcgctcctcggcgctggcggcaactgacgcgtccggtttgccgtcgggatcgatctgccgaatcgaccagagctgctgtattaatctgtagttgagttcatgtatgagcctatgaggaaccagagaggcttggaataataagataataattcgatggtgatgttatgctgtatatcttgttctacgtgtgattgattagtataggattgttctaaaattatcagaataaataatttctcgtattacataaaaa

SEQ ID NO: 5425 - DNA, 880 bp, Setaria italica
ggaggagaggggcccacccggcagcgtgagaaaagaccgggagaggaatcacgggcacgcgctcccgtaggcaacggaggagataaaattcggcggccgtcttcttccttctcctaatctgcctgccgtgcctccccaactcgctcttgctgctccaaatctgctcgacaagccgaaaaggcggcgcggcgagatgacggtgcagaaggtagacgcgacgctggccgacttcagcgcccacttcgaccgcctcatcgcctcccccgccgcggcctccgacggcaagctgaagctgctgctcttcctggcggaccgcgagcccggctcctccctcacctggtgccccgactgcaacgtggcggagccggtgatctacgagcggctggaggccctgcagggcagggacgcggtgctcctgcgcgcctacgtcggggacaagcccacgtggcgcgacccggcgcacccctggagggaggaccccaagtttgggatcaagggcgtcccgacgctgatccggtgggagaacggcggcgccgccgcccggctcggggacgaggaggcgcacctcaaggacaaggtcgacgcgctcctcggcgtcggcggcaactgacgcgtccggtttgccgtcgggatcgatctgccgaatcgagcagaggggctatactaatctgtagttgagttcatgtatgaggaaccagagagccagagagaagctgggaaataataattaagatataataattcgacggtgctgttatgctgtatcttgttctacgtttgatagaggagcaggattgttctacgattctcaggatgatttctcgtaagtctgcagaatcatttatactggtgtttggatctttagtccagcctaaatttc

SEQ ID NO: 5426 - DNA, 1491 bp, Zea mays
cgccgaatcctctcccggcaccgcaaccgctgttcctctgcgcggaacgcgcgcgcgccacagccgatcagccaccgcaggattcctcgtccaccgcgaccattcggcttctccccaatcccggcacggcggcacgggacctctccctctctctcccgctggcgggcgatggcctcctcctcctcctcacctgcgcccgccctggccggggaggcgctacgccagaaacgcatcctctccagcaagctctacctcgaggtcccgtcctccaaggcgccggtggtttactcgccggcatacgacatctccttcctcggccttgagaagctgcacccgtttgaatccgccaaatggggccgcatctgtaggtacctcaccagggaagggtacctcgacaagaaacagatggtggagccattggaagcctgcaaggaggatttgctagtggtgcacacggaggcgtatttgaacagtctcaaatgcagcttcagagtttcctccattgtagaggtccctcctgtgtcgcttgtccctaattggattgtgcacagaaagctactacaccccttccggaagcaggtgggtgggtccattttatcagccaaacttgcatttgagagaggttgggctattaatgttggtggaggatttcaccattgttcagcagatgaagggggtggattttgtgcatacgctgacatctctctctgcatccagtttgcttttgtccgtctaaatatctcaagtgtattgatcatagacctggatgcccaccaaggaaatggacacgaaaaagattttgctaatgatggaagggtttacattttagacatgtacaatgctggaatttatccctttgatttcactgctaagcaatacattgatcaaaaagttgaattagttagtgggtcaaaaacagatgaatacttggagcaacttgacaaagctctcgagatctgcaatagtagatttgagccccagttgattgtatacaatgctggaacagacatcctcgatggcgatccgttgggcagattgaaggtaagtcctgagggtgtggttaccagagacgagaaggtatttaggttcgcaaaagatcgaaacattcctttgctcatgctgacatcaggaggctacatgaagtcaagtgctcgagtaatagctgattcgatcatcaatctgtccaataaaaacttgataggattaggcagccagctgggttgagcaagaacttgtgacagtatgcttcttatcgggaagcaatatctcgtaagagcttattcgattaggagtggattaaagaggattaaattccttgatggtcaaaattgaatagaaagatatctaatcctactcaatccacatgcaatcgaacaaggtttaaaggtgtagtttttttttttttgtgaaggataacatgtatgccacaaaaatgttctgtacataacacgggatgtttgtgaatctatacaacgtcaattgttcagtgcg

SEQ ID NO: 5427 - DNA, 1269 bp, Setaria italica
ccccgctggcggcggatggcctcctcctccgcctcgccggcgccggcgccggccggggagtccctacggcagaaacgcatcctctccagcaagctctacctcgaagtcccctcgtccaaggcaccggtggtctactcgccggcctacgacatctccttcctcggcctcgagaagctgcacccgtttgattccgccaaatgggggcgcatctgcaggtacctcaccagggaagggcacctggagaagaaacaggtcgtggagccattggaagcctgcaaggaggatttgctagtggttcacacggaggcgtatcttaacagcctcaaatgcagcttcagagtcgcctccattgtggaggtccctcctgtgtcgcttgtccctaattggatcgtgcagaaaaagctactatacccattccggaagcaggttggtgggtccattttgtcagcgaaacttgcactcgagagaggatgggctattaatgttggtggaggatttcaccattgttcggcagaggaaggaggtggattttgtgcgtacgctgacatctctctgtgcatccagtttgcttttgtccgtctaaatatttcacgtttattgatcatagatctggatgctcaccaaggaaatggacatgaaaaagattttgctaatgatggaagggtttacattttggacatgtacaatgctggaatttatccctttgatttcactgctaagcaatacatcgatcaaaaagttgaattagctagcgggacaaaaacagatgaatacttggagctacttgataaggctctcgaggtctgcaaaagtaggtttcaaccccagttgattgtttacaatgctggaacagacatccttgatggtgatccattgggcagattgaagataagtcctgagggtgtaattaccagagatgagaaggtgtttagatttgcgaaagatcaaaacattccactgctcatgctgacgtcaggaggctacatgaagtcaagtgctcgagtaatcgccgattcgatcatcaatctcgccaataaaaacttgatagaactaggcagccagttgggttgagaaagaatatgttactggtgtttatcctaaagcacacatctcctgtatgtatatgacctctgaatagaagtgtatagtacttttatttttgtggaaaacatataagccacagaaaagttttgtacatagcacggggccttcttaaatcttgactatgtgaattcagatactcaatgcatataaagaatttcagaaaaa

SEQ ID NO: 5428 - DNA, 1475 bp, Panicum virgatum
ccggaaatggtgcagtgacgtcagcaccgaatcctcccgacgggactccccggcaccgcaaccgctgttcctctctctcccgcgtcacgcgcgcgccagccacagccgcggccaagattctccggcgggaggcgtaggccgcgcggcgcgccgcgacgattcggctcctcgcccaccccacacgcttccccgcctccctctcccgctggcctggcggcggatggccgcctcctcctcctcctcgccggcgccggccccggccggggagcccctgcgccagaaacgcatcctctccagcaagctctacctcgacgtgccctcctccaaggcgccggtggtctactcgccggcctacgacatctccttcctcgggctcgagaagctgcacccgtttgagtccgccaaatggggccgcatctgcaggtacctcacccgggaagggcacctggagaagaaaaagctcgtggagccgttggaagcctgcaaggaggatttgctagtggtgcacacggaggcgtatctgaacagcctcaaaagcagctacagagttgcctccattgtagaggtccctcctgtgtcgcttgtccctaactggatcgtgcataaaaagctactatacccgttccggaagcaggtgggtgggtccattctgtcagccaaacttgcacttgagagaggatggtccattaatgttggtggaggatttcaccattgttcggcagaggaagggggtggattttgtgtgtatgctgacatctctctctgcatccagtttgcttttgtccgtctaaacatttcaagtgtattgatcatagacctggatgcccaccaaggaaatgggcatgaaaaagattttgccaatgatggaagggtttacattttggacatgtacaatgctggaatttatcccttcgatttcactgctaagcaatacatcgatcaaaaagttgaattagttagcgggacaaaaacagatgaatacttggagctacttgacaatgcccttgaggtatccaaaagtagatttcagccccaattgattgtttacaatgctggaacagacatcctggatggtgatccattgggcaaattggagataagtcctgagggtgtggttgccagagatgaaaaggtgtttagattcgcgaaagatcaaaacattccactcctcatgctgacatcaggaggctacatgaagtcaagtgctcgagtaattgccgactcgatcatcaatctctcgaataaaaacttgatagaactaggcaaccagctgggttgagcaagaacttgtgattagtgtttatcgtaaagcacacatctccctgatgtatatgtcattgtgaataaaagtgtacagtacttttattgtgatggatgacatatatgccatagaaaaggtttgtagcataacatggggccttcttaaatcttcactatgtgaagtcaagtaatcaatccgtataaagcatttcagg

SEQ ID NO: 5429 - DNA, 1115 bp, Pennisetum glaucum
tcgaagttccctctcccaaggcgccggtggtctactcgccggcctacgacgtctccttcctcggcctcgagaagctgcacccgtttgattccgccaagtgggggcgcatctgcaggtacctcaccagggaagggcacctggagaagaaacgggtcgtagagccactggaagcctgcaaggaggatttgctagtggtccacacggaggcgtatcttaagagtctcaaatgcagcttcagagtcgcctccattgtggaggtccctccagtgtcacttgtccctaattggattgtgcagagaaaactactatacccgtttcggaagcaggttggtgggtccattttatcagcaaaacttgcacttgagagaggatgggccataaatgttggtgggggatttcaccattgttcggcagaggaaggaggtggattttgtgcgtacgctgacatctctctgtgcatccagtttgcttttgtccgtctaaatatttcaagtgtactgatcatagacctggatgctcaccaaggaaatggacatgaaaaagattttgctaacgatggaagggtttacattttggacatgtacaatgctggaatttatccctttgatttcactgctaagcaatacattgatcaaaaagttgaattagctagcgggacaaaaacagatgaatacttggagctacttgataaggatcttgaggtctgcaaaagtaggtttcaaccccaattgattgtttacaatgctggaacagacatccttgatggtgatccattgggcagattgaaaataagtcctgagggtgtagctaccagagatgagaaggtgtttcgatttgcgaaagatcaaaacattcccttgctcatgctgacgtcaggaggctacatgaagtcaagtgctcgagtaattgccgattcgatcatcaatctctccaataaaaacttgatagaactaggcagccagttgggttgagaaagaatgttactagtgtttatcctaaagtgtatagtacttttttttgttggacagtatataagccacagaaaaggtttgtacataacacaggaccttcataaatcttaactatgtgaagtcagatactcaatgcatataaag

SEQ ID NO: 5430 - DNA, 2395 bp, Oryza sativa
aattctgcaaattagcaagtagtgcatcgcaaatatcacatcaccgaattctcccgagctccggcgacgtggtcgcgcattcctcttctcgccggcagactcgccgccgtcctccgccgcccctctcgcggcgcagcgattcgtctccctcctccgcaaccgcgcccgagctcccccctcctccccgcatccggtggatggcctcttccgcgccgtccgcggcggcgggggcgaccccgccggaccccctccgccgcgaccgcatcctctccagcaagctctacctcgacgtcccgggctccaaggctccggtggtgtactcgccggcgtacgacatcgccttcctcgggatcgagaagctgcacccgttcgattcctccaaatggggccgcatatgcaagttcctcaccaaggaagggcacctggagaagaaccgagtggtggagccattggaagcgaccaaggacgatttgctggtggtgcactcggagtcgtacttgaacagcctcaagagcagcctgaaggttgcgtccattgtagagcttcctcctgtggcattcattcctaattggcttgtgcagcaaaagctactgtaccctttcaggaaacaggtgggtgggtcgattctatcggccaagcttgcacttgagagaggatgggccattaatgttggcggagggtttcaccattgttcggcagagcaagggggcgggttttgtgcatatgctgatatttctctctgcattcagtttgcttttgtccgtctaaatatttcaagagtgatgatcatagatctggatgcccaccaaggaaatggccatgaaaaggatttcgctaatgatggaagagtttacactttggatatgtacaatgctggaatatatccctatgatcatgttgctaagcggtatattgatcaaaaagtcgagctagttagtgggacaaagacagaagactacttggatcaacttgacaaggctcttaaggttgcagaaagtagatttcagcctcagttgattgtttacaatgctgggacagatatcctggatggcgatccattgggaagattgaagataagccctcagggcgtggtgatcagagatgagaaggtgttcaggtttgcaaaggatcaaagcatcccactactcatgttaacatcaggaggatacatgaagtcgagcgcccgagtgatcgccgactcgataatcaatctctcgaataaaaacttgatagagcttggtagccagcttggctgaacgagtgcttagcctgaatcgacagatcgcagatctactggatgtatatatcctgtctataagaggcttacactaatgtgataatggtattaatataagccacaaaaatcgttatcaactcacagagtcgcagttcaccttgtacataacccctgacttgatgtcccattctcagctatacagcctatactgttggcttaaatggttttccagctggatgctggctgaaattccaacttgactggacattgcttgggatgcctggtttatttcagaatttgacaaacctagctacatgtcagcatgtccattcaagaatcaagcggtagcaacttagcttccccctcaagatcatcagactggtcatagttttttgaatgcataaaaggagttctctgaaacttgaagaaagcctagtttgatgcagttgataattcaaatattcaattaactaacctggtatgacgaaaaaaagacaaaacaaaggggaaaaaaaacatctgtaaccaacagttaatgaataagctagctgagttacactatttcacatactgaatataactataggtaaattcctaacaaatcccctgaattctgaactcacactacgaaagcaaggtcctaagaaataaattaatcacctaaaagaagcaacaagagttacaagacagtgaaatgactgaagtgaaaaccgaaaccaccattgccaccaaacatagccatatcctcctgccttcttcagttagcctcacctcctccctgatccggtcaaaactggtgtgctctgcctctgcctacggcgatgtcggtggcggtggcgccaccggcggcggcggcgctgtcaccgcgccgtccacggccttcgccacggcttccttcagcgatgtctcgtcgcagacgtcgccggcctacagcaatgttttgacaagtacactcttgttaagcttcattagcaagtatttctgaccatgtgatgcatctaccttgtacttttcagtatggacaattagctgagatttccccacggtgactgaatttgttttgtatttgtaattctacatgtcattttgtcaatgccaaacaacagacaagtgatacagatgttaacttgaattgatcacatcaatcatgtttgccaa

SEQ ID NO: 5431 - DNA, 1421 bp, Brachypodium distachyon
aaactacgaggggctggtttgcaaagcgtacataaccgcaccggttctcccgagccccatctccatggttgttcctcggcagcgcgacccagcccagccccgacctacccagaggcgacctctcctcccggccggcgcccgtgatgtcatccccctccgcctcctccgcgtcgggtcccagcccggcagacctcctccgccacaatcgtatcctctccagcaagctttacctcgacgtcccaccgtccaaggttccggtgatttactcggtggcatacgacatcgccttcctcggaatcgagaagctgcacccgtttgattccgcaaaatggggccgcatatgcaagttcctcaccaaagaagggcacctggaaaagaaccgagtggtcgagccattggaggcttccaaggaagatttactggtggttcacacgcagtcatacctaaacagcctgaagaccagcttcagggttgccaccattatggaggttcctcctgtatcgcttattcctaattggctggtgcagcaaaagctactgttccccttccggaagcaggtgggtgggtccattttatcagccaaacttgcgcttgagagaggatgggccattaatgttggtggaggatttcaccattgttcggcagaggaagggggtggattttgtgcatatgctgatatttcactctgcattcagtttgcctttgaccgtttaaatatatcaagagtaatgatcatagatttggatgctcaccaaggaaacggtcatgaaaaggattttgccgatgatggaagggtttacattttggacatgtacaatgctggaatttatccctttgatcatgctgctaagcggtatattgatcaaaaagttgagttagttagtgggacaaaaacagacgactacttggatcagcttgaccaggctctcgaggttgcacaaacaagatttcagccccagttgattgtttacaatgctgggacagacatcctggatggtgatccattgggcagattggagataagtcctgagggtgtggtgaacagagatgagaaggtgtttaggttcgcagttgatcaaaacattccacttctcatgttgacatcaggaggctacatgaagtcgagcgcacgagtaatcgcagattcaattatcaatctctcacagaaggagttgatacaactaagtagccagctggactagataatctcccacaaaataacctgatgcaaccagctgggctaacacatgcgatcggagtgtcaccttaacgacacgtctactggatgtacatatcttgtgtataaggagtggtttacatttctacgatattcttgtcatcatatatatgctgcaagaggccttccttttaacagaggcccttccttttaagagggagtgaatgttcgctcattggtcttc

SEQ ID NO: 5432 - DNA, 1386 bp, Brachypodium distachyon
aaagcgtacataaccgcaccggttctcccgagccccatctccatggttgttcctcggcagcgcgacccagcccagccccgacctacccagaggcgacctctcctcccggccggcgcccgtgatgtcatccccctccgcctcctccgcgtcgggtcccagcccggcagacctcctccgccacaatcgtatcctctccagcaagctttacctcgacgtcccaccgtccaaggttccggtgatttactcggtggcatacgacatcgccttcctcggaatcgagaagctgcacccgtttgattccgcaaaatggggccgcatatgcaagttcctcaccaaagaagggcacctggaaaagaaccgagtggtcgagccattggaggcttccaaggaagatttactggtggttcacacgcagtcatacctaaacagcctgaagaccagcttcagggttgccaccattatggaggttcctcctgtatcgcttattcctaattggctggtgcagcaaaagctactgttccccttccggaagcaggtgggtgggtccattttatcagccaaacttgcgcttgagagaggatgggccattaatgttggtggaggatttcaccattgttcggcagaggaagggggtggattttgtgcatatgctgatatttcactctgcattcagtttgcctttgaccgtttaaatatatcaagagtaatgatcatagatttggatgctcaccaaggaaacggtcatgaaaaggattttgccgatgatggaagggtttacattttggacatgtacaatgctggaatttatccctttgatcatgctgctaagcggtatattgatcaaaaagttgagttagttagtgggacaaaaacagacgactacttggatcagcttgaccaggctctcgaggttgcacaaacaagatttcagccccagttgattgtttacaatgctgggacagacatcctggatggtgatccattgggcagattggagataagtcctgagggtgtggtgaacagagatgagaaggtgtttaggttcgcagttgatcaaaacattccacttctcatgttgacatcaggaggctacatgaagtcgagcgcacgagtaatcgcagattcaattatcaatctctcacagaaggagttgatacaactaagtagccagctggactagataatctcccacaaaataacctgatgcaaccagctgggctaacacatgcgatcggagtgtcaccttaacgacacgtctactggatgtacatatcttgtgtataaggagtggtttacatttctacgatattcttgtcatcatatatatgctgcaagaggccttccttttaacagaggcccttccttttaagagggagtgaatgttcg

SEQ ID NO: 5433 - DNA, 1652 bp, Secale cereale
tcccaacccagagcccgcgaccgcgagaccattcgcggcctctccatccccgcccgggccctctcgtccaggccggtggccgggatgtcctcgtcgtccgccgccgcctccgtgccgggggccacgccggcggacgctctccgccgcaaccgtatcctttccagcaagctctacttcgacgtgccgggctccaaggctccggtggtctactcgacggcgtacgacatcgccttcctcggaatcgagaagatgcacccgtttgattcctccaaatggggccgcatatgcaggttcctcaccagagaaggccacctggagaacaagcgagtggtggagccattggaggcttccaaggaagatctgctggtggttcacacggaggcatacttgaacagcctcaagagcagcttcagggtcgcagccattgtagaggttcctccgttaacgctcatgcccaattggctcgtgcagcaaaagctactgtaccccttccgaaaacaggtgggcgggtccattttatcggccaaacttgcacttgagagaggatgggccattaatgttggtggagggtttcaccattgttcggcggaggaagggggtgggttttgcgcatacgctgatattacgctctgcattcagtttgcctttgtccgtctaaatatttcaagagtaatgatcatagatctggatgctcaccaaggaaatggtcatgagaaggattttgctaatgatggaagggtttacattttggacatgtacaatgctggaatttatcccttggatcatgctgctaagcgatatattgatcagaaagtggaattagttagtggaacagaaacagatgattacttggatcagcttgacaaagctctgaaggtcgcccaaactagattccagccccaccttattatttataatgctgggacagacatcctggatggtgatccattgggcaacttgaagataagccctgaaggtgtggtgattagagatgagaaggtgttcagatttgcaaaagatcagaacattccacttgtcatgatgacatcaggaggctacatgaagtcgagcgcacgtgtaatcgcggattcgattacgaatctctcacagaaggacttgatacagctaggtagccagccagactaaacgaggagcctctgccacccacaaatgttcaacctgaagggcacatccacgggatgtatagtgtgtaagaagaggtttacagttctatcatattagcatgtatgaatcacaaaaagtcttgacaccttgtacatactgtcataaggcctttgtttccaagaagatcacgcaatagggaagctgagaacgccatgatgacaagagagacaacacctggagatcccagtggatccccatgtcaaactatacgagtctaagttgctattttttctcgtgggaccaataaatgctgcctaagagtttttcactgtaaaaacagatattaaaggttatcaagaaaggtatggtatgattgtttttagtaaaaccaaaaaaaaaaaaaaaaaataaaaaaaataaaacaacagacacaacacacacacacacacacacacacacacacacacacacacacacacacacatacgatagtagagacaacacacagtagacagacagagagagta

SEQ ID NO: 5434 - DNA, 1520 bp, Triticum aestivum
agggcgggaggtaataagcggcaacacaacgcaaactcccagcccagagcgagcccgcgagaccgaggcgaccatccccgcccccctctccatccccgcccgagccctctcgcccaggccggcggccgggatgtcctcgtcgtccgccgccgcctccgtgccgggggccacgccggcggacgccctccgccgcaaccgtatcatctccagcaagctctacttcgacgtgccgggctccaaggctccggtggtctactcgacggcgtacgacatcgccttcctcggaatcgagaagatgcacccgtttgattcctccaaatggggccgcatatgcaggttcctcaccaaagaaggccacctggagaagaagcgagtggtggagccattggaggcttccaaggaagatctgctggtggttcacacggaggcatacttgaacagcctcaagagcagcttcagggttgcagccattgtagaggttcctccattaacgctcatgcctaattggctcgtgcagcaaaggctactgtaccccttccggaaacaggtgggtgggtccattttatcagctaaacttgctcttgagagaggatgggcgattaatgtcggtggagggtttcaccattgttcggcagaggaagggggaggattttgtgcatatgctgatatttcgctctgcattcagtttgcgtttgtccgtctggatatttcaagagtaatgatcatagatctggatgctcaccaaggaaatggtcatgagaaggattttgctaatgatggaagggtttacattttggacatgtacaatgctggaatttatccgtttgatcatgctgctaagcgatatattgatcagaaagtcgagttagttagtgggacagaaacagatgattacttggatcagcttgacaaggctttgaaggtcgcccaaactagattccagccccagcttattatttataatgctgggacagacatcctggatggtgatccattgggcaacttgaagataagccctgaaggtgtggtgatcagagatgagaaggtgttcagatttgcaaaagatcagaacattccacttgtcatgatgacatcaggaggctacatgaagtcgagcgcacgtgtaatcgcagattcgattaccaatctctcacagaaggacttgatacagctaggtagccagccagactaaaagaggagcctctgccacccacaagcgttcaaactgaagggcacatccactggatgtatagtgtgtaagaagaggtttacagttctatcatatcagcatgtataaatcacaaaaagtcttgtcaccttgtacatactgtcataaggcctttgtttccaagaagattacgcaatagggaagctgagagcgccatgatgacaagagagataacacccggagatcgccgttgatccccatcatcaaactatactgtacgggtttcagttactcctattttctcgtgggaagccaataaatactgcttaaagagtttgcactgtatagatct

SEQ ID NO: 5435 - DNA, 1559 bp, Zea mays
acgttgggctcctacataacacgcgcccccgcttccactcggcgaccaccggtccaccgcgcatcgaacccccacttgtgccgattctgctgatccctcgccgacaacggccggagaatcgacaccatggccgctgcgcgccggggccgtggcgacggcgccaacggcgtcgtccgtccccgcccccgcgaccgcggcatcggcggcgggagcatggcggggcgcgtggccgtcctcgccttctgtgtcgcagggatctggtccgcctacatctaccagggcgtcctccaggagactctatcgacgaagcggttcgggccggatgcgcggcggttcgagcacctcgcgttcctcaacttcgcgcagaacgtcatctgcttcgtctggtccttcataatgattaagctgtggtcgggcgggagtagctccaatggcagcgcaccgatatggaagtactggggcgtcagcgtcaccaataccatcgggccgaccatggggatcgaggctctcaagtacatcagctacccggctcaggtgttggcaaaatcttctaagatgattcctgtaatgttgatgggaactcttctctatggtgtgaagtacacacttccagagtatttatgcacctttcttgttgccggcggtgtgtcctcctttgcgttgttgaagacaagctccaagacaattaagaagcttgccaaccctaatgcacctcttggttacacattgtgcttcctcaacttagcttttgatggatatactaactcgacccaagatttaataaagtcaaggtacccaaaaacaaacccatgggatataatgcttggcatgaacctctgggggaccatatataatgctgtaattatgtttgttgcgccattactattcagtaactggccatatgcaaatggttttgaggcattgagattttgccaggagaacccagaggtggcctgggacattttcctattctgcctatgtggcgccgtggggcagaacttcatcttcttaaccatcagccggtttggctctcttactaacacaacaatcactaccacccgtaaattcatgagcattgtggtttcatccgtcatcagtggcaatccattatctttgaagcaatggggtagtgttgtgatggtcttcttaggcctctctatccaaatatatctcaaatggaagagaaagaaaggcagagagcacaaggagtaagcttgattcttcaaccttttctgatttgtaacttcaattggacagatctcttgtgaggttgaccaggataacgttaatgcagtctgtttgaaattaggaacttttacatggattattatgagtgataccaagtgtgaggctgagctattggtaacagctctaatttatgttctagagggaggattcatgtgtttcacttaaatgttgatctcgtggatttgtcttatgctactagaagaaaatacccacctaaacaatataaggaatatacgaatagtccttaactcaggagcctaactcggtgaacatagcagtttttttcttacttgtggagcataaatttaact

SEQ ID NO: 5436 - DNA, 1803 bp, Setaria italica
ctctgacgcgcgcctccctccctccccacggttgcgcctgcgcccccatgtcgccactcctataacacgcgctcccgctttctcttcccggcgaccaccgcgcatcgaacgggattcgctgcgattctactgatcccttgccgtcaccggaccggcgaaccgacaccatggcctccgcgcgcaggggccgcggcggcggcggtgccaacggcgtcatccgcccccgcccccgcgaccgtggcgacgccgccggcggcggcgggagcatggcggggcgcgtggccgtcctcgccttctgcgtcgccgggatctggtccgcctacatctaccagggcgtcctccaggagactctgtcgacgaagcggttcgggccggaggcgcggcggttcgagcacctcgcgttcctcaacttcgcgcagaacgtcatgtgcttcgtctggtccttcataatgatcaagctgtggtcgggtgggagtagctccaccggccgtgcgccgctgtggaagtactggggcgtcagcgtcaccaacaccatcggaccgaccatggggatcgaggcgctcaagtacatcagctacccggctcaggtgttggccaaatcttctaagatgattccagtaatgttaatggggactctactctatggtgtgaagtacacatttccagagtatctttgcacctttcttgttgctggtggtgtatcatccttcgcattgttgaagacaagctccaagacaattaagaagcttgccaaccctaatgcaccccttggctatgcattgtgcttcctcaacttagcttttgatgggtatacaaactcaacccaggatttgataaaatcaagatttccaaagactaatccatgggatataatgcttggcatgaacctctggggaaccatatacaacgctctaattatgtttgtggcgccattgctgtttagtaattggccatatgcaaacggttttgaggcagtgaaattttgccaggaaaacccagaggtggcctgggacattttcttgttctgcctatgtggtgctgtggggcagaatttcatcttcctaaccatcagccgatttggctctcttactaacacaacaatcactaccacccgcaaattcatgagcatcgtggtttcatccgtcatcagcggcaacccactatctctgaagcaatggggtagtgttgtgatggtcttctctggcctctctatccaaatatttctcaaatggaagaaaaagaagggcagagagcacaaggagtaagctcgattcttgaacccattccaatttgtaactttgattggacaaatctgttgtcaggtttgatcgggacatagtcaatgtagcccattggaattagtaaagttttagatggattattatgagaatacttatggtaaattgcttagcgtgagcaatttgtaacggctggtagtttctgttctacagggaggagatgcaacaaattgtgttgcattgagagcaaagttgtacgatgaccattgtatttttgttctactctctcaaaagaaatctgtagaattaaatggcaatgtctagatttttgttcttgttgttcatttacctcaacggggagcagtaatgtctaggattttctgagatttaacttaaatttgaactaaatcacatgagttatttggatgaggagaattggtctgggaatgtttatgataaggatttgggtcagaatcttccaatcctagcaattttttgtcaccaggagatgttatgagaacattactcatgtttactcgtttacaatgtgtaatgcactcatatt

SEQ ID NO: 5437 - DNA, 2003 bp, Brachypodium distachyon
cgtccctcctctgacgcgcgctctccttgtccacggttgcacggcgcccaactcctataaccagcgcctccgcgagcaccatgccatcgccaccgattccccactcgccggcgaacggaaccataccgaaagcgccatggtgtccgtgcggaagggccgcggcgggggaggaggagtccgaagccgcccccgcgttgacggcggcggcagcctggcgtcgcgtgtggccgtgctggccttctgcgtcgccgggatctggtcggcctacatcacgcaaggcgtcctccaggaaacgctgtcgacgaagcggttcgggccagaggcccggcgattcgaccacctcgcgttcctcaatttcgcgcagaacgtcgtctgcttcgtctggtccttcataatgattaagctgtggtcgggtggtagcaatcctgccgggcgggcgccgctttcgaagtactggggcgtcagcatcaccaacaccatcggccctaccatggggatcgaggcgctaaagtacatcagctacccggctcaggtcctggcaaagtcttctaagatgattccagttatgctgatggggactctactctatggtgtcaagtatacacttccagagtacttctgcacctttcttgttgctgggggcgtgtcatcctttgcattgctgaagacaagctcaaagactatcaagaagcttgccaaccctaatgctcctcttggctacacattgtgcttcctcaacttagcttttgatggttataccaactcaacccaagatttaataaagtccaggtaccccaaaactaacccttgggatattatgcttggcatgaacctctgggggaccatatacaatacagtaattatgtttgtggcgccattactcttcagtaattggccatacgcaaatggttttgaggcagtgagattttgccagcagaacccggaggtggcctgggacattatcatgttctgcctatgtggtgccgtggggcaaaatttcatcttcctaaccatcagccgatttggctctcttactaacactaccatcactaccacccgtaagttcatgagcatcgtcatctcatctgttatcagtggcaacccactgtccttggagcaatggggaagtgttgtgatggtcttctctggcctctctctccaaatatatctcaaatggcagagaaaaaagggcagagaccacaaggaatgatctcaattcttataagctcgttctgatttgtaactttgattgcacacatttgttgtctagatatctgggcgaccattactgtagcccatcgaaattgtaggataaaggtttgcattgactaacatgtgcgaaatgtctggtaattgctatagtgtcgactatttaaaaattgctgggtagtctatattctactactgggggaagttgcaatgaattgtgttgcttcgagaggaagagtttatgtttgtgtcaaccccataggagctggccgacgccagacttctcctgtccatggaagagtgtcaaatctcttccagcaacgatgcacggtgtggccggtcttctcacacagtttgcacacttgcgtggacttggcggtgttgttggagtagccaccgccttgtccctgccgtgcttgctgttgattgttgttggagttgaagccacctccaccacgaccaccattgtagttgcctgcgttcccgcgtccacggccatcatctctgccgccaccgttcgaagatccaccacgccgtgcttgatgctggctggccgtggcataggtcgtgacagttccggattcgcgcatttagttgctgagattccggttggaggattttttttttaaaagagtatagatcacaaaatcgtgcgagtcatgctttggcaaatatggttagaactgagacttgcatgtctctttggctgagttccagtccgctgcatgtgggggagatggttctccaagattgtaatgattaattattaaatatatctatttttactcgaaaaa

SEQ ID NO: 5438 - DNA, 1407 bp, Brachypodium distachyon
ggcgcccaactcctataaccagcgcctccgcgagcaccatgccatcgccaccgattccccactcgccggcgaacggaaccataccgaaagcgccatggtgtccgtgcggaagggccgcggcgggggaggaggagtccgaagccgcccccgcgttgacggcggcggcagcctggcgtcgcgtgtggccgtgctggccttctgcgtcgccgggatctggtcggcctacatcacgcaaggcgtcctccaggaaacgctgtcgacgaagcggttcgggccagaggcccggcgattcgaccacctcgcgttcctcaatttcgcgcagaacgtcgtctgcttcgtctggtccttcataatgattaagctgtggtcgggtggtagcaatcctgccgggcgggcgccgctttcgaagtactggggcgtcagcatcaccaacaccatcggccctaccatggggatcgaggcgctaaagtacatcagctacccggctcaggtcctggcaaagtcttctaagatgattccagttatgctgatggggactctactctatggtgtcaagtatacacttccagagtacttctgcacctttcttgttgctgggggcgtgtcatcctttgcattgctgaagacaagctcaaagactatcaagaagcttgccaaccctaatgctcctcttggctacacattgtgcttcctcaacttagcttttgatggttataccaactcaacccaagatttaataaagtccaggtaccccaaaactaacccttgggatattatgcttggcatgaacctctgggggaccatatacaatacagtaattatgtttgtggcgccattactcttcagtaattggccatacgcaaatggttttgaggcagtgagattttgccagcagaacccggaggtggcctgggacattatcatgttctgcctatgtggtgccgtggggcaaaatttcatcttcctaaccatcagccgatttggctctcttactaacactaccatcactaccacccgtaagttcatgagcatcgtcatctcatctgttatcagtggcaacccactgtccttggagcaatggggaagtgttgtgatggtcttctctggcctctctctccaaatatatctcaaatggcagagaaaaaagggcagagaccacaaggaatgatctcaattcttataagctcgttctgatttgtaactttgattgcacacatttgttgtctagatatctgggcgaccattactgtagcccatcgaaattgtaggataaaggtttgcattgactaacatgtgcgaaatgtctggtaattgctatagtgtcgactatttaaaaattgctgggtagtctatattctactactgggggaagttgcaatgaattgtgttgcttcgagaggaagagtt

SEQ ID NO: 5439 - DNA, 1336 bp, Secale cereale
atggtgtccgcgcggaagggccagggccgcggaggcggggtccgaagccgcccccgcgtcgacggcgccggcggaagcggtagcctggcttcgcgcgtggccgtgctcgccttctgcgtcggcgggatctggtcgtcctacatcacccaggggatcctccaggagacgttatcgacgaagcgattcgggccggaggagcggcggttcgaccacctcgcgttcctcaacttcgcgcagaacgtcgtctgcttcgtctggtccttcataatgatcaagctgtggtcaggcggtagcagccctgccgggcgggcgccgcttctgaagtactggggcgtcagcatcaccaacaccatcggcccgaccatggggatcgaggcgctcaagtacatcagctacccggctcaggtcttggcaaaatcttctaagatgattccagttatgttgatgggaactctactctatggtgttaagtatacacttccagagtacttttgcaccttccttgttgccgggggcgtgtcatcctttgcattgttgaagacaagctcgaagactatcaagaagcttgctaaccctaatgctcctcttggctacggattgtgcttcctcaacttagcttttgatggctacactaattcgacccaagatttgataaagtctaggtaccccaagactaacccttgggatataatgcttggcatgaacctctggggaaccatatacaatactgtaattatgtttgtggcgccattgctgttcagtaactggccatatgcaaacggttttgaggcggtgagtttttgccgggagaacccagaggtggcctgggacattctcatgttctgcctatgtggagccgtgggtcagaatttcatcttcctaaccatcagccgatttggctctcttactaacactaccatcaccaccacccgcaagttcatgagcatcgtcatctcatcagttatcagcggtaacccactgtccatggagcaatggggaagtgttgtgatggtcttttctggcctctctctccaaatatatctcaaatggaagagaaagaagggcagagatcacaaggaatgaactaaattcttataagcacattttgatttgtagctttgattgcacacatttgttgtcgaaacatccgggagatcattaatgtagcccgttgaaatgataggaaagaggtttacatttacagaaaatgtgtgatatgtatggagtaattgctagtagtgttagctatttaaaaacggccgggtagtctattctactcgggatagcaatgaattgtgttgcttcaagagttgcatggtgagcaatacgataaatt

SEQ ID NO: 5440 - DNA, 1623 bp, Oryza sativa
cgccacgtcacccctctgacgcgcgcgaccccttctccttctccccagttgcgcccccgcttctataacacgcgcctccgccttcctccccgcggcaccgatctccctcccccctcgccggcggcgcaccgaccgaaccgaaccgcgccatggtcaccgcgcgcaagggccgcggaggcagaggccctccccgcccccgcgtcgtcgacggcggcggagggagcatggtgtcgcgcgtggccgtgctcgcattctgcgtcgccgggatctggtcggcgtacatcacccagggcgtcctccaggaaaccctgtcgacgaagcggttcgggccggaggcgcggcggttcgaccacctcgcgttcctcaacttcgcgcagaacgtcgtctgcttcgtctggtccttcataatgatcaagctgtggtcgagtggtgggagctcctccgctggccgcgcgccgctgcggaagtactggggcgtcagcatcaccaacactgtcggcccggccatggggatcgaggcgctcaagttcatcagctacccagctcaggtcctggcaaaatcttctaagatgattccagtaatgctgatgggaactatactgtatggtgtcaagtacacatttccggagtacatttgcacctttcttgttgctgggggtgtatcatcctttgcgttgttgaagacaagctccaagactatcaagaagcttgctaaccctaatgcgcctctgggctacacattgtgcttcctcaacttagcttttgatggttacaccaattcgacccaagatttgataaagtctaggtatccaaagactaatccatgggatataatgcttggcatgaatctctgggggaccatatacaatgctgtgattatgtttgttgctccattactattcagtaattggccttacgccaacggttttgaggcagtgagattttgccaggagaacccagaggtggcatgggacattctcctgttctgcctgtgtggtgccgtgggtcagaatttcatcttcctaaccatcagccgatttggctctcttactaacactaccatcaccaccacccgcaagttcatgagcattgtcatctcctccgtcatcagtggtaacccactctccttgaagcaatggggaagtgttgtgatggtcttttctggtctctctttacaaatctttctcaaatggaagagaaagaaggtcagagaccacaaggaatgagtttaatattttagctcattccaatttgtagcttcgattggacatgtttgttgttgggttatatgggagataattattgcagcccattactgattcaggagaagttttacatcgataaaaaactgagatgtatggtaatagctaaaaaaatgctggtagtttctgttctacaggaagtcaggaagaagatgcaatgaattgtattgcactgagtagtagaattgtatggcgccctgtatttttgttctctccctaaaggaatcgctaattatcaaaacgataattatgtttctgccactgatagtctgatacttcatacagtcacactacgataacttgtggagaaaactactgtacggatttggctgtttaagcagaagtatcaggttttgctctg

SEQ ID NO: 5441 - DNA, 1465 bp, Panicum virgatum
caaccccaccgcgcgcgccgctactctactgatcccttgacgtcgctgcggccggcgaaccgacaccatggcgtccgcgcgccggggccgcgtcggcggaggcgtcaacggcgtcgtacgcccccgacaccgcgacggcggcggcggcgggagcatggcggggcgcgtggccgtcctcgccttctgcgtcgccgggatctggtccgcctacatctaccagggcgtcctccaggagactctgtccacgaagcggttcgggccggaggcgcggcggttcgagcacctcgcgttcctcaacttcgcgcagaacgtcgtctgcttcgtctggtccttcataatgatcaagctgtggtcgggtgggagtagctctgctggccgtgcgccgctgtggaagtactggggcgtcagcgtcacaaacaccattgggccgaccatggggatcgaggcgctcaagtacatcagctacccggctcaggtgttggccaaatcctctaagatgattccagtgatgttgatggggactctactctatggtgtgaagtacacatttccagagtatctttgcacctttcttgtagctggtggtgtatcatccttcgcattgttgaagacaagctccaagacaattaagaagcttgcgaaccctaatgcaccccttggctatgcattgtgcttcctcaacttagcttttgacgggtacactaactcgacccaggatttaataaaatcaagatacccaaaaactaacccatgggacataatgctcggcatgaacctctgggggaccatatacaatgctgtaattatgtttgtcgcgccattgctgttcagtaattggccatatgccaacggttttgaggcagtgagattttgccaggagaacccagaggtggcctgggacattttcttgttctgcctatgtggtgctgtggggcagaatttcatcttcctaaccatcagccgattcggctctcttactaacacaacaatcactaccacccgcaaattcatgagcatcgtggtttcatctgtcatcagtggcaacccattatcaccaaagcaatggggtagtgttgtgatggtcttctctggcctctctatccaaatatatctcaaatggaagaaaaagaagggcagagagcacaaggagtaagctcaattcttgaacccgttccaatttgtaactttgattggacaaatctgttgtgaggttgaccgggacattgtcaatgtagcccattggaattaggaaagttttagatggattattatgataatacttatggcaaattgcttagcgtgagctatttgtaacggctggtagtttctgttctacagggaggagatgcaacaaattgtgttgcattgagagcaaagttgtatgatgaccagtgtatttttgttctactctctcaaaagaaataagtagaactaaatgacaacatctagatttatatttttgcag

SEQ ID NO: 5442 - DNA, 1249 bp, Leymus cinereus x Leymus triticoides
cgggactctgcgaccgatccccctcgccggcgaacagaaccacacaaacaaacgagccatggcgtccgcgcggaagggccagggccgcggaggcggggtccgaagccggccccgcgtcgacggcggcggcagcctggcttcgcgcgtggccgtgctcgccttctgcgtcggcgggatctggtcgtcctacatcacccagggcatcctccaggaaacgctatcgacgaagcgattcgggccggaggcgcggcggttcgaccacctcgcgttcctcaacttcgcccagaacgtggtctgcttcgtctggtccttcataatgatcaagctgtggtcgggtggtagcagtcctgccgggcgggcgccgcttctgaagtactggggcgtcagcatcaccaacaccatcggcccgaccatggggatcgaggcgctcaagtacatcagctacccggctcaggtcttggcaaaatcttctaagatgattccagttatgttgatgggaactctactctatggtgttaagtatacacttccagagtacttctgcaccttccttgttgccgggggcgtgtcatcctttgcattgttgaagacaagctcgaagactatcaagaagcttgctaaccctaatgctcctcttggctacggattgtgcttcctcaacttagcttttgatggctacactaactcgacccaagatttaataaagtccaggtaccccaagactaacccttgggatataatgcttggcatgaacctctggggaaccatatacaatactgtaattatgtttgtggcgcctttactgttcagtaattggccatatgcaaacggttttgaggcggtgagtttttgccgcgagaacccagaggtggcctgggacattctcatgttctgcctatgcggcgccgtgggtcagaatttcatcttcctaaccatcagccgatttggctctcttactaacactaccatcacaaccacccgcaagttcatgagcatcgtcgtctcatcagttatcggtggtaacccactgtccatggagcaatggggaagtgttgtgatggtcttttctggcctctctctccaaatatatctcaaatggaagagaaagaagggcagagatcacaaggaataaactaaattcttataagcacattttgatttgtagctttgattgcacgcatttgtggagatatccgggagatcattaatgtattaatgtagcccgttgaaatgataggaaagaagttta

SEQ ID NO: 5443 - DNA, 1351 bp, Triticum aestivum
cgatccccctcgccggcgaacacaaccgcacaaacgaacgcgccatggtgtccgcgcgcaagggccagggccgcggaggcggggtccgaggccctccccgcgtcgacggcggcggcggcagcctggcttcgcgcgtggccgtgctcgccttctgcgtcgccgggatctggtcgtcctacatcacccaggggatcctccaggagacgctatcgacgaagcgattcgggccggaggagcggcggttcgaccacctcgcgttcctcaacttcgcgcagaacgtcgtctgcttcgtctggtccttcataatgatcaagctgtggtcgggcggtagcagccctgccgggcgggcgccgcttctcaagtactggggcgtcagcatcaccaacaccatcggcccgaccatggggatcgaggcgctcaagtacatcagctacccggctcaggttttggcaaaatcttctaagatgattccagttatgttgatgggaactctactctatggtgttaagtatacacttccagagtacttttgcaccttccttgttgccgggggcgtctcatcctttgcattgttgaagacaagctcgaagactatcaagaagcttgctaaccctaatgctcctcttggctacggattgtgcttcctcaacttagcttttgatggctacactaattcgacccaagatttgataaagtccaggtaccccaagactaacccttgggatataatgcttggcatgaacctctggggaaccatatacaatactgtaattatgtttgtggcgccattactgttcagtaattggccatatgcaaacggttttgaggcggtgagtttttgccgcgagaacccagaggtagcctgggacattctcatgttctgcctatgtggcgctgtgggtcagaatttcatcttcctaaccatcagccgattcggctctcttactaacactaccatcaccaccacccgcaagttcatgagcatcgtcatctcatcagttatcagtggtaacccactgtccatggagcaatggggaagtgtcgtgatggtcttttctggcctctctctccaaatatatctcaaatggaagagaaagaagggcagagatcacaaggaatgaactcaattcttataagcacattttgatttgtagctttgattgcacacatttgttgtggagatatccgggagatcattaatgtaacccgttgaatgataggaaagaggtttacatttacagaaatgtgtgaaatgtatggtaattgctaatagtggtagctatttaaaaacggctgggtagtctattctactcaggggagttgcatcatgagcaatacgataaatcatgta

SEQ ID NO: 5444 - DNA, 1626 bp, Triticum aestivum
cgcccaactgctataacactcgcctcctctgacccccgggagcctgcgaccgatccccctcgccggcgaacacaaccgcacaaacgaacgcgccatggtgtccgcgcgcaagggccagggccgcggaggcggggtccgaggccctccccgcgtcgacggcggcggcggcagcctggcttcgcgcgtggccgtgctcgccttctgcgtcgccgggatctggtcgtcctacatcacccaggggatcctccaggagacgctatcgacgaagcgattcgggccggaggagcggcggttcgaccacctcgcgttcctcaacttcgcgcagaacgtcgtctgcttcgtctggtccttcataatgatcaagctgtggtcgggcggtagcagtcctgccgggcgggcgccgcttctcaagtactggggcgtcagcatcaccaacaccatcggcccgaccatggggatcgaggcgctcaagtacatcagctacccggctcaggtcttggcaaaatcttctaagatgattccagttatgttgatgggaactctactctatggtgttaagtatacacttccagagtacttttgcaccttccttgttgccgggggcgtgtcatcctttgcattgttgaagacaagctcgaagactatcaagaagcttgctaaccctaatgctcctcttggctacgggttgtgcttcctcaacttagcttttgatggctacactaattcgacccaagatttgataaagtccaggtaccccaagactaacccttgggatataatgcttggcatgaacctctggggaaccatatacaatactgtaattatgtttgtggcgccattactgttcagtaactggccatatgcaaacggttttgaggcggtgagtttttgccgcgagaacccagaggtagcctgggacattctcatgttctgcctatgcggcgctgtgggtcagaatttcatcttcctaaccatcagccgattcggctctcttactaacactaccatcaccaccacccgcaagttcatgagcatcgtcatctcatcagttatcagtggtaacccactgtccatggagcaatggggaagtgtcgtgatggtcttttctggcctctctctccaaatatatctcaaatggaagagaaagaagggcagagatcacaaggaatgaactcaattcttataagcacattttgatttgtagctttgattgcacacatttgttgtggagatatccgggagatcattaatgtagcccgttgaaatgataggaaagaggtttacatttacagaaatgtgtgaaatgtatggtaatcgctaatagtgttagctatttaaaaaccgctgggtagtctattctactcaggggagttgcatcatgagcaatacgataaatcatgtactcaaactttgtccatcttgctgagtaattaacaaaaaaatcatgtcattatttgtcatgaaaaatagttttatgatgtttcactaacgcacacatatattgtcaaatctgctatattggtactgagtacaaaaatgaccaaacggagacacagctccatggaggccttgatttacgtaaccttacaaaattacaaactatttctagcttaacaaaaattaact

SEQ ID NO: 5445 - DNA, 1355 bp, Hordeum vulgare
acccccgggagcgtgcaaccgatccccctcgccggcgaaggccacacgaacgaacgcgccatggtgtccgcgcggaagggccaaggccggggaggcggggtccgaagccgcccccgcgtcgacggcggcggcagcctggcttcgcgcgtggccgtgctcgccttctgcgtcggcgggatctggtcatcctacatcacccaggggatcctccaggagacgctatcgacgaagcgattcgggccagaggagcggcggttcgaccacctcgcgttcctcaacttcgcgcagaacgtggtctgcttcgtctggtccttcataatgatcaagctgtggtcgggtggtagcagtcctgccgggcgggcgcctcttctgaagtactggggcgtcagcatcaccaacaccatcggcccgaccatggggatcgaggcgctcaagtacatcagctacccggctcaggtcttggcaaaatcttctaagatgattccagttatgttgatgggaactctactctatggtgttaagtatacacttccagagtacttctgcaccttccttgttgccgggggcgtgtcatcctttgcattgttgaaaacaagctcgaagactatcaagaagcttgctaaccctaatgctcctcttggctacggattgtgcttcctcaacttagcttttgatggctacactaactcgacccaagatttaatcaagtcccggtaccccaagactaacccttgggatataatgcttggcatgaacctctggggaaccatatacaatactgtaattatgtttgtggcgcctttactgtttagtaactggccatacgcaaacggttttgaggcggtgagtttttgccgggagaacccagaggtggcctgggacattctcatgttctgcctatgcggtgccgtgggtcagaattttatcttcctaaccatcagccgattcggttctcttactaacactaccatcaccaccacccgcaagttcatgagcatcgtcatctcatcagttatcagtggtaacccactgtccatggagcaatggggaagtgttgtgatggtcttttctggcctctctctccaaatatatctcaaatggaagagaaagaagggcagagatcacaaggaatgaacttggttcttataagtacattttgatttgtagctttgattgcacacatttgttgtggagatatccgggagatcattaatgtagtccgttgaaattatagaaaagaggtttacatttacagaaaatgtgtgagatgcatggtaattgctgatagggttggctatttaaaaacggctgggtagtctattctactcagggtagcaatgaattgtgttgcttct

SEQ ID NO: 5446 - DNA, 1427 bp, Hordeum vulgare
gcgcccaactgctataacacttgccttctctgacccccgggagcgtgcaaccgatccccctcgccggcgaaggccacacgaacgaacgcgccatggtgtccgcgcggaagggccaaggccggggaggcggggtccgaagccgcccccgcgtcgacggcggcggcagcctggcttcgcgcgtggccgtgctcgccttctgcgtcggcgggatctggtcatcctacatcacccaggggatcctccaggagacgctatcgacgaagcgattcgggccagaggagcggcggttcgaccacctcgcgttcctcaacttcgcgcagaacgtggtctgcttcgtctggtccttcataatgatcaagctgtggtcgggtggtagcagtcctgccgggcgggcgcctcttctgaagtactggggcgtcagcatcaccaacaccatcggcccgaccatggggatcgaggcgctcaagtacatcagctacccggctcaggtcttggcaaaatcttctaagatgattccagttatgttgatgggaactctactctatggtgttaagtatacacttccagagtacttctgcaccttccttgttgccgggggcgtgtcatcctttgcattgttgaaaacaagctcgaagactatcaagaagcttgctaaccctaatgctcctcttggctacggattgtgcttcctcaacttagcttttgatggctacactaactcgacccaagatttaatcaagtcccggtaccccaagactaacccttgggatataatgcttggcatgaacctctggggaaccatatacaatactgtaattatgtttgtggcgcctttactgtttagtaactggccatacgcaaacggttttgaggcggtgagtttttgccgggagaacccagaggtggcctgggacattctcatgttctgcctatgcggtgccgtgggtcagaattttatcttcctaaccatcagccgattcggttctcttactaacactaccatcaccaccacccgcaagttcatgagcatcgtcatctcatcagttatcagtggtaacccactgtccatggagcaatggggaagtgttgtgatggtcttttctggcctctctctccaaatatatctcaaatggaagagaaagaagggcagagatcacaaggaatgaacttggttcttataagtacattttgatttgtagctttgattgcacacatttgttgtggagatatccgggagatcattaatgtagtccgttgaaattatagaaaagaggtttacatttacagaaaatgtgtgagatgcatggtaattgctgatagggttggctatttaaaaacggctgggtagtctattctactcagggtagcaatgaattgtgttgcttctactcgaactttcttcattgttgcaaagtatgatgttttac

SEQ ID NO: 5447 - DNA, 1323 bp, Avena sativa
gcgaacccaaccggaacgcgccatggtatccgcgcggaagggccgcggcggtggcggcgtaggcggaggccgaagccgcccccgtgttgacggcggcggcagcttggcctcgcgcgtggccgtgctcgccttctgcgtcgccgggatctgctcgtcctacatcacccagggcgtcctccaggaaacgctatcgacgaagcgattcgggccggaggcgcggcggttcgaccacctcgcgttcctcaacttcgcgcagaacgtggtctgcttcgtctggtccttcataatgattaagctatggtcgggtgggagtagccctgccgggcgggcgccgctttcgaagtactggggcgtcagcatcaccaacaccatcggcccaaccatggggatcgaggcgctcaagtacatcagctacccggctcaggtcttggcaaaatcttctaagatgattccagttatgttgatggggactctactctatggtgttaagtatacacttccagagtatttttgtaccttccttgttgctgggggcgtgtcatcctttgcattgttgaagacaagctcgaagactatcaagaagcttgctaaccctaatgctcctcttggctacgcactgtgcttcctcaatttagcttttgatggttacactaattcgacccaagatctaataaaatccaggtaccccaagactaacccttgggatataatgcttggtatgaacctctggggaaccatatacaatactgtaattatgtttgtggcgccattactgctcagcaattggccatacgcaaacggttttgaggcggtgaaattttgccaggagaatccagaggtggcctgggacattctcatgttctgcctatgcggtgctgtggggcaaaatttcatcttcctaaccatcagccgattcggttctcttactaacactaccatcactactacccgtaagttcatgagcatcgtcatctcatcagttatcagtggcaatccactatccttggagcaatggggaagtgtcgtgatggtcttctctggcctctctctccaaatatatctcaaatggaagagaaagaagggcagagaacacaaggaatgaactcaaatattttaaggacattttgatttgtagctttgattgcacacatttgttgtcgagatatttgggatatcatttatgcagcctgttgaaattataggaaataggtttaaattaacaaaatatgtgcaacatgtatggtaattgttatagtgttagctatttaaaaacgcctgggtggtctctgatctaccgggaaagattcaatgaatagtgttgct

SEQ ID NO: 5448 - DNA, 4327 bp, Brachypodium distachyon
tcgcctgtgggctccatggtgtccgtgcggaagggccgcggcggagtccgaagccgcccccgcgttgacggcggcggcagcctggcgtcgcgtgtggccgtgctcgccttctgcgtcgctgggatctggtcggcctacatcacgcaaggcgtcctccaggaaacgctgtcgacgaagcggttcgggccagaggcccggcgattcgaccacctcgcgttcctcaatttcgcgcagaacgttgtctgcttcgtctggtccttcataatgattaagctgtggtcgagcggtagcaatcctgccgggcgggtgccgctttccaagttctggggcgtcagcatcaccaacaccatcggccccaccatggggatcgaggcgctcaagtacatcagctacccggctcaggtcttggcaaagtcttctaagatgattccagttatgttgatggggactctactctatggtgttaagtatacacttccggagtacttttgcacctttcttgttgctgggggcgtgtcatcctttgcattgttgaagacaagctcgaagactatcaagaagcttgccaaccctaatgctcctcttggttacgcattgtgcttcctcaacttagcttttgatggttacaccaactccacccaagatttattaaagtccaggtaccccaaaactaacccttgggatattatgcttggcatgaacctctgggggaccatatacaatactgtaattatgtttgtggcgccattactactcagtaattggccatacgcaaacggttttgaggcggtgagattttgccagcagaacccggaggtggcctgggacattctcatgttctgcctgtgtggcgccatggggcagaatttcatcttcctaaccatcagccgattcggctctcttactaacactaccatcactaccacgcgtaaattcatgagcattgtcatctcatctgttatcagtggcaatccactgtccttggagcaatggggaagtgttgtgatggtcttctctggcctctctctccaaatatatctcaaatggcagaggaagaagggcagagaccacaaggaatgaactaaatttttataagcttgttctgatttgtaacttcgattgcacgcattttgctgcctagatatctgggtgaccattagacattactgtagcccgtcaaaattgtagtccctccgatccataataagtgtcgctggtttagtagctgacacttattatatattattgactcatgcatcttgagattactcagtccaaatagtcctgtgtgaagatgatgccgacaaattttgttcctgttggagcaaaatatattactccatatgcaattctgttccactaaacttggcagtatcttgtatgcagacctggaatccaggtgccaacagagataataatctttgctccctcttgtccctcttgtgtcttgtgtggagatgcttaggattactagtgaaacactagatgcctttttcgtcgagtagcccataccaatgcatccagctctttctaatcttgctgatctgacagcaggtctggatagaagcctagtacagcattatgtgtctaaagcaaaaaaatctggctgcggtaagcactagatacatacatcaaaatgaattttttttctgtgacatggtgttgttctaagaacaaaattacaggagcacgagaaattcaatgccatgatacggaatttacatagaagcaagcgggcggccggatcctcaggagaataggaagacgacgagcgggatcatcagcagcagcgccctgcgagcggcggccatggcgctgtcggcggcgtcgtacggggtgaaggcgctgccggggcccccgccgatgcccggcgtgaacgtcgacgacggcgggaccagggcggaaggcgcgctcgccgccggcgtcgtcgagttcgagcctcccgccatggaactgcaacattcaattcgcacgcgtcagtcagtcaaacaagctgctctgaactttctcagagaaacggcaaaacgccttgaagttgagatctgcgcgtgaaagaaagaaggaaggggaaattcaccttccggcgaagatgcactgcccggagcctgcaacgaagaagaatcagaaattcagaaccaattaattagagctagcggagcgaagaacagggatggggatagtttggtttgttactggggtcggtgggggtggtggtggcggtgccgtcgaagctgcaggtggcgccggtggcggcgttgcggtggtagtagtcgttgtaggcgtaggaagccagggccgggaggttgttctgcttgtagcagacgccgccgggctggatcgccgagcagtcggcccggcccggcccgcacgcgtagttgagcccgcgctgcagcgccgccgggtccgcgctctggatcgccacgcagaacagcccgccggcccccgccgccagcgaccgccgcttgcctgtttctgcttcttctgcctcagacgacaagctgcctgttaaacagaaaaccgtcagagaaaacggctgtgttctttgtcagaatctctcagctgctcaggtcagcttgagagattctgatccgttgtctaggaccaaaatctcatatgaaagagagaaatcgatcttgcgcagggtattgtttaacatgaagaatcaatccagtacatgagtacagaagtagctatttggatgagttgttgaggagcgaaaaggatggcaagcaattgcaagacacgatatgttgcactaaatgtcgtccacagcagttgttctccactttatggcgatgcgtttccatccaaggtctgactacactaggaatctgaataatgaagggagcgagacagaaagcaacgccgatgctactgaagctaaaagatgcagctacacaacacacgcgtatacctgacgcgtttgagaggatgacgaggagcagaagaagaaggctgcatccctgaaatcttctgcacaacatcctcgtaccactgccccagaccccgatcttcagcagtgtagtcctgcacgaaaacctgcccaaattcagagacgtagcatatgacatcgtgacagattaacatggaggcatgcatgcttctgatgctattcgaccatactgcatgctatataccgattaccgacatgattaagtacaagttcgaacttttgaaccaaactgcacattttttctcgcaacgtaataatgcacgcaacttcagttaagagacgcgttggatgaaattgagaggggtgatagtgaaacgcgctgtcgcggtaagaggtgccaagtttctaataatccgactctcgtatcgctgtcggaatttgagattttgtcggcacgggcttatttctgcgatgtgtctgatactgaatgtcaataatcttgatagggatttgcagacgtggaagcatactcgctggtaaattgtaatcggtcgattgaaaaatggagctagggcattggttggtgaaactgaaacatctaactacaagacgatggtatgggggaaaagattctcatccttggcaagagcacaaacatgatttgattccttacaaatttaaagcctttgctactaattagtaaacatgtaagtttgcagcatacatgtaaggtagatttaaaacaaaccaaaccaacggtgacagacaactaagttaaaattcacaagtttgtggactgaaatctgaacgagaaagaaaaccaagctccgtgaagcctaagctgaagcaagctggatcatgttgttcaaaacacctgctacagaggtattcgggataattagttaaagctatgtacccaaaagaaagaaatcatcagaagaaatccaaggattcgagaagaagttctatctaactagaagagaaaatcctgaaaaacaaaaggtattgactgtacgctgctgttctaatctaggcatcaagaacgaacaacagaaaacccctttctcacttccaacgaagaacagaacaggcaaatccttatccaacgaagagagacacgagagccgctagaagaagagagaatctagcagaatcatgcgtacgtacctcagccaccactgaattagtactacttggtgctaacagctgccaagaacaatccccttatcgccttttcgctatggatggaagctctgaaccctcgaatcctaaaaaaagaaagacgtagatatgaccctgccctgccttttatttgccaccaagtatgcatgtatgtatggaggccagtaattaggacttactgtcttcctccaaatcacacagataagaagaagcagcgcactccagtaattagtgttgacagacactgcgagg

SEQ ID NO: 5449 - DNA, 1261 bp, Brachypodium distachyon
atccttcgcctgtgggctccatggtgtccgtgcggaagggccgcggcggagtccgaagccgcccccgcgttgacggcggcggcagcctggcgtcgcgtgtggccgtgctcgccttctgcgtcgctgggatctggtcggcctacatcacgcaaggcgtcctccaggaaacgctgtcgacgaagcggttcgggccagaggcccggcgattcgaccacctcgcgttcctcaatttcgcgcagaacgttgtctgcttcgtctggtccttcataatgattaagctgtggtcgagcggtagcaatcctgccgggcgggtgccgctttccaagttctggggcgtcagcatcaccaacaccatcggccccaccatggggatcgaggcgctcaagtacatcagctacccggctcaggtcttggcaaagtcttctaagatgattccagttatgttgatggggactctactctatggtgttaagtatacacttccggagtacttttgcacctttcttgttgctgggggcgtgtcatcctttgcattgttgaagacaagctcgaagactatcaagaagcttgccaaccctaatgctcctcttggttacgcattgtgcttcctcaacttagcttttgatggttacaccaactccacccaagatttattaaagtccaggtaccccaaaactaacccttgggatattatgcttggcatgaacctctgggggaccatatacaatactgtaattatgtttgtggcgccattactactcagtaattggccatacgcaaacggttttgaggcggtgagattttgccagcagaacccggaggtggcctgggacattctcatgttctgcctgtgtggcgccatggggcagaatttcatcttcctaaccatcagccgattcggctctcttactaacactaccatcactaccacgcgtaaattcatgagcattgtcatctcatctgttatcagtggcaatccactgtccttggagcaatggggaagtgttgtgatggtcttctctggcctctctctccaaatatatctcaaatggcagaggaagaagggcagagaccacaaggaatgaactaaatttttataagcttgttctgatttgtaacttcgattgcacgcattttgctgcctagatatctgggtgaccattagacattactgtagcccgtcaaaattgtagtccctccgatccataataagtgtcgctggtttagtagctgacacttattatatattattgactcatgc

SEQ ID NO: 5450 - DNA, 1391 bp, Triticum aestivum
cgatccccctcgccggcgagcacaaccgcacaagcgaacgcgccatggtgtccgcgcgcaagggccagggccgcggaggcggggcccgaggccctccccgcgtcgacggcggcggcggcggcggcagcctggcttcgcgcgtggccgtgctcgccttctgcgtcgccgggatctggtcgtcctacatcacccagggcatcctccaggagacgctatcgacgaagcgattcgggccggaggagcggcggttcgaccacctcgcgttcctcaacttcgcgcagaacgtcgtctgcttcgtctggtccttcataatgatcaagctgtggtcgggcggtagcagtcctgccgggcgggcgccgcttctcaagtactggggcgtcagcatcaccaacaccatcggcccgaccatggggatcgaggcgctcaagtacatcagctacccggctcaggtcttggcgaaatcttctaagatgattccagttatgttgatgggaactctactctatggtgttaagtatacaattccagagtacttttgcaccttccttgttgctgggggcgtgtcatcctttgcattgttgaagacaagttcgaagactatcaagaagcttgctaaccctaatgctccgcttggctatgggttgtgcttcctcaacttagcttttgatggctacactaactcaacccaagatttaattaagtccaggttccccaagactaacccttgggatataatgcttggcatgaacctctggggaaccatatacaatactttaattatgtttgtggcgccattactgttcagtaactggccatacgcaaacggttttgaggctgtaagtttttgccgggagaacccagaggtggcctgggacattctcatgttctgcctatgcggcgccgtgggtcagaatttcatcttcctgaccatcagccgattcggctctcttactaacactacaatcaccaccacccgcaagttcatgagcatcgtcatctcatcagttatcagtggtaacccactgtccatggagcaatggggaagtgttgtgatggtcttttctggcctctctctccaaatatatctcaaatggaagagaaagaagggcagagatcacaaggaatgaactcaattcttataagcacattttgatttgtagctttgattgcgcacatttgttgtggagatatccgggagatcattaatgtagcccattgaaatgataggaaagaggtttacatttacaggaatgtttgaaatgtacggtaatcgctaatagtgttagctatttaaaaaccgctgggtagtctattctactcaggggagttgcatcatgagcaatacgataaatcatgtactcaaactttctccatctagctgagcaattagc

SEQ ID NO: 5451 - DNA, 1526 bp, Pennisetum glaucum
caccgcggcagcgcacacggccagcaccgccgccgccacggccagccgccgcaggcccatgactcctataacacgcgctcccgctccggcgaccaccgcgcatcgaacgggaccgagctgcgattccactgatcccttgtcgtcaccgggccggcgaaacgacaccatggcctccgcgcgccggggccgcggcggcggcggcggtgccaacggcgtcatccgcccccgccaccgcggcgacgccggcggcagcgggagcatggcggggcgcgtggctgtcctcgccttctgcgtcgccgggatctggtccgcctacatctaccagggcgtcctccaggagaccctgtcgacgaagcggttcgggccggcggcgcggcggttcgagcacctcgcgttcctcaacttcgcgcagaacgtcatgtgcttcgtctggtccttcataatgatcaagttgtggtcgggtgggagtagctctgccggtcgtgcaccgctgtgcaaatactggggtgtcagcgtcaccaacaccattgggccgaccatgggaattgaggcgctcaagtacatcagctacccagctcaggtgttggccaaatcttctaagatgattccagtaatgttaatggggactctactctatggtgtgaagtacacatttccagagtatctttgcacctttcttgttgctggtggtgtgtcatccttcgcattgttgaagacaagttccaagacaattaagaagcttgccaaccctaatgcacctcttggctatgcattgtgcttcctcaacttagcttttgatgggtatacaaactcaacccaggatttgataaaatcaagatttccgaagactaacccatgggatataatgcttggcatgaacctctgggggaccatatacaacgctgtaataatgtttgtggcgccattgctgtttagtagttggccatatgcaaacggttttgaggcagtgaaattttgccaggaaaacccagaggtggcctgggacattttcttgttctgcctatgtggtgctgtggggcagaatttcatcttcctaaccatcagccgatttggctctctcactaacacaacaatcactaccacccgcaaattcatgagcatcgttgtttcatcggtcattagcggcaacccattatctctgaagcaatggggtagtgttgtgatggtcttctctggcctctctatccaaatatttctcaaatggaagaaaaagaagggcagagagcacaaggagtaagctcaattcttgaacccatttcaatttgtaactttgagtggacaaatctgttgtcaggtttgatcggtacgacgtcaatgtagcccactggaattaggaaagttttaggtggattattatgagaatacttatggtaaattgcttagcgtgagctatttgtaacggctggtagtttctgttctacagggaggagatgcaacaaattgtgttgcatcgagagcaaagttgtatgatgacagtggggtgtttgaatccatgagttattttc

SEQ ID NO: 5452 - DNA, 1405 bp, Pseudoroegneria spicata
  misc_feature (52)..(52): n is a, c, g, or t
  misc_feature (327)..(327): n is a, c, g, or t
  misc_feature (351)..(351): n is a, c, g, or t
  misc_feature (776)..(776): n is a, c, g, or t
  misc_feature (873)..(873): n is a, c, g, or t
  misc_feature (891)..(891): n is a, c, g, or t
  misc_feature (895)..(895): n is a, c, g, or t
  misc_feature (1180)..(1180): n is a, c, g, or t
  misc_feature (1189)..(1189): n is a, c, g, or t
  misc_feature (1207)..(1207): n is a, c, g, or t
atccccctcgccggcgaacagaaccacaccaacgaacgcgccatggtgtccncgcggaagggccagggccgcggaggcggggtccgaagccggccccgcgtcgacagcggcggcggcagcctggcttcgcgcgtggccgtgctcgccttctgcgtcggcgggatctggtcgtcctacatcacccaggggatcctccaggagacgctatcgacgaagcgattcgggccggaggagcggcggttcgaccacctcgcgttcctcaacttcgcgcagaacgtcgtctgcttcgtctggtccttcataatgatcaagctgtggtcgggtggnagcagtcctgccgggcgggcgccncttctgaagtactggggcgtcagcatcaccaacaccatcggccctaccatggggatcgaggcgctcaagtacatcagctatccggctcaggtcttggcaaaatcttctaagatgattccggttatgttgatgggaactctactctatggtgttaagtatacaattccagagtacttttgcaccttccttgttgccgggggcgtgtcatcctttgcattgttgaagacaagctcgaagactatcaaaaagcttgctaaccctaatgctcctcttggctatggattgtgcttcctcaacttagcttttgatggctacactaactcaacccaagatttaataaagtccaggtaccccaaaactaatccttgggatataatgcttggcatgaacctctggggaaccatatacaatactgtaattatgtntgtggcgcctttactgtttagtaactggccatacgcaaacggttttgaggcggtgagtttttgccgggagaacccagaggtggcctgggacattctnatgttctgcctatgcggngccntgggtcagaatttcatcttcctaaccatcagccgattcggctctcttacaaacactacgatcaccaccacccgcaagttcatgagcatcgtcatctcatcagttatcagcggtaacccactgtccatggagcaatggggaagtgttgtgatggtcttttctggcctctctctccaaatatatctcaaatggaagagaaagaagggcagagatcacaaggaatgaactaaatttttataagcacattttgatttgtagctttgattgcacacatttgttgtcgaantatccgggngatcattaatgtagcccnttgaaatgataggaaagaggtttacatttacagaaatatgtgaaatgtatggtaattgctaatagtgtcagctatttaaaaacggctgggtagtctgttctactcaggggagcaaagagttgtgttgcttcaagaggaagagttgcatcgtgagcaatacgataaattatgtactcaaaactttctccaaaaaaaaaa

SEQ ID NO: 5453 - DNA, 1221 bp, Saccharum officinarum
accagggcgtcctccaggagacactatccacgaagcggttcgggccggaggcgcggcggttcgagcacctcgcgttcctcaacttcgcgcagaacgtcatctgcttcgtctggtccttcataatgattaagctatggtcaagcgggagtagctccgatggccgcgcgccgctatggaagtactggggcgtcagcatcaccaataccatcgggccgaccatggggatcgaggctctcaagtacatcagctatccggctcaggtgttggcaaaatcttctaagatgattcctgtaatgttgatgggaactcttctctatggtgtgaagtacacacttccagagtatttttgcacctttcttgttgctggcggtgtgtcctcctttgcattgttgaagacaagctccaagacaattaagaagcttgccaaccctaatgcacctcttggctatacattgtgcttcctcaacttagcttttgatgggtatactaactcgacccaagatttaataaagtcaaggtacccaaagacaaacccatgggacataatgcttggcatgaacctctgggggaccatatataatgctgtaattatgtttgttgcgccattactattcagtaattggccatatgcaaatggttttgaggcattgagattttgccaggagaacccagaggtggcctgggacattttcctgttctgcctatgtggcgccgtggggcagaacttcatctttttaaccatcagccggtttggctctcttactaacacaacaatcactaccacccgtaaattcatgagcattgtggtttcatccgtcatcagtggcaatccattatcattgaagcaatggggtagcgttgtgatggtcttcttaggcctctctatccaaatatatctcaaatggaagagaaagaagggcagggaccacaaggaataagcttgattcttgaacctgttccgatttgtaacttcaattggacagatctgttgtgaggttgaccaggataacgttaatgcactctgttgaaattaggagacttttacatggattattatgagcgatacctagtgaggctgtgagccattggtaacatctcgcagtttctgttctacagggaggagatgcagtaaattgtgttgcattgagggcaaagttgtatgatgaccagtgaatttttgttctactcgaaagtaaactgttgtagaattaaaattgcaac

SEQ ID NO: 5454 - DNA, 1742 bp, Zea mays
tttttagtttttttctgccctacatgtttatttttaactaactaaagatgatggacactttatgtgacagcgtatgctaacggatccggcgggccctgcaacggcgcggcagcaggataagaggacgcggcgcgcgcatccacaagcagcggaggagcccgaccacgccagtgagcccgcccgattcgccgtcgcggcggccacgtttcccctccaatggccaccagctccaccgccttgctgcaccttgtcataccggcctcccgccgccgccggcacttggtgcctcgggccgcacactccgagtccgccccgcccgccgcctccgtcgaccgccgccgcttcatcgcccacaccgccgccgcggccgccgtctcccctctcgtcttgccccgctggacccccgcggctcgcgcggacgaagcgccggcgctctccgagtgggagcgcatcttcctgcccatcgactccggcgtcgtcctcctcgacatcgccttcgtcccagacgacccctcccatggttttctccttggaacaagacagacaatactggagacgaaagacggcggcaacacctggttccctcgctccatcccttccgcagaggacgaagatttcaactacaggttcaactcggtaagcttcaagggcagagagggatggattatcggcaagcctgcaattctactgcacacctcagatgctggcgagagctgggaaagaatacccctgagtgcccaacttcctgggaacatggtttacataaaagctactggggagcagagcgcagagatggttaccgatgagggagcaatctatgttacctctaaccgtggatacaactggaaggctgccgtgcaggagaccgtttcagctactctgaacagaacagtttcaagtggcattagcggtgcaagctactacactgggactttcaacacggtgaacagatcggccgacgggcgctacgtggctgtgtccagccgagggaacttctatctgacgtgggagcccgggcagccgttctggcaaccccacaacagggcggtggcacggaggattcagaacatggggtggagagcggacggtggactttggctgctggtgcgcggtggtggcctcttcctcagcagaggaaccgggataactgaagattttgaggaggtgcaggtgcagagccgggggtttgggatcctggacgtgggctaccgctcgcaggaggaggcctgggctgctggtggcagcggcgtgctgctcaagaccacaaacggagggaagagctggatgcgcgacaaggctgccgacaacatcgccgccaatctctactccgtcaagttccttgatgacaggaaaggcttcgtgctgggcaacgacggcgtgttgcttcggtatcttggctgacattctatgtatatgtgtgtacagcgaacggcatgtgctgctgctactactactgtaaaaggctgcttactgtgcttgcgttctctcttctgcaacccaaattgagtgtaaagatgcatgtgctgcttgctaggaacttgaaaaccttgtatacccgtatctactatctatatatatgctaccttgttgcaaacaaccctcaaaccattgagaagctctccattctcaatgcctgggacaaatcattctactcaatctatttgcatttttctacgaagacccatattaacaaaggccatctttcagagccaataaaattccctgcatattgcaatcttgac

SEQ ID NO: 5455 - DNA, 1530 bp, Setaria italica
tgccacggcgagacgacgcccaggataagagaccggaacgcgcagccacaagcagagcagcctcgccgcggccacgtctcgcctcccatggccaccagctccgccgccaccgcctccctgcacctcctcctcccagcctcccgccgccgccgcctcctcgtccctcgggccacaacccactccaactccgaccccaccgccgtcgaccgccgccgtttcattgcccacactgccgccgcagccgccgttgcccctctcgtcctgcctcgatggactcctaccgcccgggcggacgacgcgccggcgctctccgagtgggagcgcgtcttcctgcccatcgaccccggcgtcgtactcctcgacatcgccttcgtcccagacgacccctcccacggtttcctccttgggactaggcagaccatactggagaccaaagatggtggaaacacctggttccctcgctccatcccttccgctgaggacgaagatttcaactacaggttcaactctgtaagcttcaagggcaaagaaggctggatcatcggcaagccagctattctgctgcacacctcaaatgctggagagagctgggaaagaatacctctcagtgcccaacttcctgggaacatggtttacataaaagctacgggggagcagagcgcggagatggttaccgacgaaggggcaatctatgttacttccaatcgcggctacaactggaaggctgccgtgcaggagactgtttcggctactctcaacagaacagtttcaagtggcattagcggtgcaagttactacactgggactttcaacacggtgaaccggtcacctgatggacgctacgtggctgtatccagcagagggaacttctatctgacatgggagcctgggcagccattttggcaaccacacaacagggcggtggcacggaggattcagaacatggggtggagagcagacggtgggctttggctgctggtgcgcggtggtggactcttcctcagcaaaggaactgggataactgaagactttgaggaggtgcaagtgcagagccgggggtttggaattcttgacgtcggctatcgctcgcaggatgaggcttgggctgctggtgggagcggcgtcctgctcaagaccacaaacggagggaagaactgggtgcgtgacaaggctgctgacaacatcgctgccaacctctactccgtcaaattccttgatgacaggaaaggctttgtgctcggcaacgacggcgtgttgcttcgatatcttggctgaaatgagctgccaaaatgctgcgagctcggtctcgatcgtgttagcctttttgtatatgatgatgacgatatatacttgatcgatgtacgtatgtatacaacgtgtaacggctttaatttgctaccactgtaaaaggagtatctcactcatgtggtcatgtgtaagcatcttggattagagatcgcttgatgcacttccagcaaaaagaagatgctttgttttaggaaaatgaaaggagatgcttttgtaccattg

SEQ ID NO: 5456 - DNA, 1400 bp, Panicum virgatum
gcctcgcctcgccgtcgcctcccatggccaccagctccaccgccaccgcctccctgcacctcctcctccccacctcccgccgccgacgcctccttgtccctcgggccgactgcaccgtcgaccgccgccgtttcattgcccacactgccgccgccgtcgcccctctcgtctcgctctcgccccccgtgtggactcctcctgcggctcgggcggacgaggcgccggcgctgtcccagtgggagcgcgtctacctgcccatcgaccccggcgtcgtactcctcgacatcgccttcgtccccgacgacccctcccacggctttctccttgggacaaggcagacgatactggagactaaagatggcggaaacacctggttccctcgctccatcccttccgctgaggacgaagatttcaactacaggttcaactcagtcagcttcaagggcaaagaaggctggatcatcggcaagcccgctattctgctccacacttcagatgctggagagagctgggaaagaatacctttgagtgcccaacttcctgggaacatggtttacataaaagctacgggggagcagagcgcggagatggttactgacgagggggcaatctatgttacttccaatcgcggctacaactggaaggctgccgtgcaagagactgtttcggctactctcaacagaacagtttcaagtggcattagtggtgcaagctactacactgggactttcaacacggtgaaccggtcacctgatggacgctatgttgctgtatccagcagagggaacttctatttgacatgggagcctgggcagccattttggcaaccacacaacagggcggtggcgcggcggattcagaacatggggtggagagcagatggcgggctttggctgctggtgcgcggtggtggactcttcctcagcaaaggaactgggataactgaagactttgaggaggtgcaagtgcagagccgggggtttgggattcttgatgtcggctatcgctcacaggatgaggcgtgggctgctggtgggagcggcgtcttgctcaagaccacaaatggagggaagagctgggtgcgtgacaaggctgccgacaacattgccgccaacctctactccgtcaagttccttgatgacagcaaaggcttcgtgcttggcaacgacggagtgttgcttcgatatcttagctgaaatcagctgccaaaatgctggcctttttgtatacgatgaagatacagtacgtgatcggtgtatacacatgtaacggcatttgttactactgtaaaaggaggttgctgctgattgtgtttgcattctcgcttgcgcaaaagagtgtaaagatgtacccgtgactattgtactacaaattatgaatgaaacagtaccattcccacc

SEQ ID NO: 5457 - DNA, 1623 bp, Oryza sativa
gcgaccctgacaagagagagaagcaaagataagaggccgaaacctgcagccacaagcaagcagcacggcctcccgcttccacgtctcatctgccatggccaccaccgcctccctccacctccacctccacctcctcctctcctcctcccgccgccgctgccgcctcctcgtcccccgtgcccacaccgattccatctccaccggccgacgccgcttcattgccgacaccgccaccgcctccgctgccgctgccgtgggtcccctcgtcctaccccggaccccgcttgcgcgtgccgaccagccgccgtcgctctccgagtgggagcgcgtcctcctccccatcgaccccggcgtcgtcctcctcgacatcgccttcgtccccgacgacccttcccacggttttcttcttgggacgagacagacgatattggaaacaaaaaatggaggaaacacatggttccctcgctccatcccgtccgccgaggatgaagatttcaactacaggttcaattctgtaagcttcatgggcaaagaaggatggattattggcaagcctgcaattttgttgcacacttctgatgctggagacagctgggaaagaatacccttgagtgcccagcttcctgggaacatggtttacataaaagctacaggtgagcaaagtgcagagatggtcaccgacgagggagcaatttatgttacttccaatcgagggtacaactggaaggccgctgtgcaagagactgtctcagccactcttaacagaacagtttcaagtggaattagcggagcgagttactacactggtactttcaacacagtgaaccggtcacctgatgggcgttatgttgctgtctccagccgtgggaacttctatctgacctgggaacctgggcagccattttggcagccacacaacagggcagtggcacgtagaatacagaatatgggatggagagcagatggtggcctttggcttctagtgcgcggtggtggactctttctgagtaaaggaagtggaataactgaagactttgaggaagcgtcagtgcaaagccgggggtttggaattcttgatgttggctaccgctcaaaggatgaagcatgggccgccggtggaagtggtgtcctgctaaaaacaacaaatggcgggaagacctgggtgcgcgacaaagctgctgataacatcgcagccaatctctactctgtaaagttccttggtgacaacaaaggatacgtgcttgggaacgacggcgtcttgcttcgatatgttggctgacgtgcaaagtgcttcagtttgcctgtatcgtccttagacttttttgtacgtaatatgaacctacacttgtttacacggtcaggtatctatctatgtacctactgcaaaaggctgctgattcgtgttgaattcatccacaaaagagtgtaaattcttgtctgtaactgtagcgactgttccaatatgtgaactgcacatccacatgtaatatctgatatatataaaatggagcttgtaaagtgagaaggattcagatattgcggcctttgcaactcatgggagtgcccaaatgccacttctgttggaacagtacagtgatatatagagttgaattgccaaaaaaa

SEQ ID NO: 5458 - DNA, 1602 bp, Brachypodium distachyon
gcaaagcaaacgcgcggcttcccgggaaacaccaacgcctctgaaaagctctgctgcttccatccatccatggcgaccgccgccgccgcgctccacctcctcctcccaaactcatcgcgccgccgctgccgcctcctggtcccgcgcgcctcctcctcttcctcttcgtcgccgacgcgccgcggcctcattgccgacaccgccacggcggcggccgccatggccgccgcgcctctgctcccctggaccccggcggcgcgcgcggaggatctgtcggagtggcagcgcgtgaagctccccatcgaccccggcgtcgtgctcctcgacatcgccttcgtccccgacgacccctcccacggattccttctggggacgaggcagacgatactggagacgaaagacggcggcaacagctggttcccgcgctccatcccttccgcggaggacgaggacttcaactacaggttcaactccgtcagcttcatgggcaaagagggatggatcgtcggcaagccggccatattgctgcacaccaaggatgcaggggagagttgggagaggatccccttgagcgcacagcttccaggcgacatggtttacatccaagctaccggggagcagagtgcggagatggtgaccgacgagggagccatctatgttacttctaaccggggatacaactggaaggctgctgtgcaggagactgtctcagccactctcaacagaacagtttcgagcggcattagcggtgcgagttactataccgggactttcaacacggtaaaccgctcacctgatggccgctatgtcgccgtctccagccgtgggaacttctacttgacctgggagcctgggcagctgtattggcaaccgcacaatagggccgtggcacgacggatacagaacatgggatggagggcagatggcggtctctggcttctggtgcgcggcggtggactcttcctcagtaaaggaaccgggattactgaagagtttgaggaagcatcagtgcaaagccgggggtttggaatccttgatgtgggctaccgttcaaaggatgaggcatgggctgcaggtgggagcggcgtcctgctgaaaacaatgaacggcggcaagtcctgggtgcgtgacaaggccgccgataacatccccgggaatctctactccgtaaagttcgtcggtgacaaccaaggattcgtgctggggaacgatggcgtcttgctccgatacgttggatgaagtaacggaattcgctgcggttattcaaatccttttttgtacgtaacgataattcatatatatacctactatacgcgcacacacgtgaaaggctgctgctgatttgtttctcagcattctttcttctgcaagagagtgtaaatcttctgaccaattgtcatcagcatccaacagaactatgtgagcacatttatgtatctgaatctgatgctctgaagctcgtgaattgcatgcgaatgagttgataggcgtcagaggtctcaagaatgctaatttgaacttgaaattctcgatttataaatgattgtgagtttaaacttgaaattcttcatgtttgaacttgaaattctacctttaagtcat

SEQ ID NO: 5459 - DNA, 1506 bp, Brachypodium distachyon
gctgcttccatccatccatggcgaccgccgccgccgcgctccacctcctcctcccaaactcatcgcgccgccgctgccgcctcctggtcccgcgcgcctcctcctcttcctcttcgtcgccgacgcgccgcggcctcattgccgacaccgccacggcggcggccgccatggccgccgcgcctctgctcccctggaccccggcggcgcgcgcggaggatctgtcggagtggcagcgcgtgaagctccccatcgaccccggcgtcgtgctcctcgacatcgccttcgtccccgacgacccctcccacggattccttctggggacgaggcagacgatactggagacgaaagacggcggcaacagctggttcccgcgctccatcccttccgcggaggacgaggacttcaactacaggttcaactccgtcagcttcatgggcaaagagggatggatcgtcggcaagccggccatattgctgcacaccaaggatgcaggggagagttgggagaggatccccttgagcgcacagcttccaggcgacatggtttacatccaagctaccggggagcagagtgcggagatggtgaccgacgagggagccatctatgttacttctaaccggggatacaactggaaggctgctgtgcaggagactgtctcagccactctcaacagaacagtttcgagcggcattagcggtgcgagttactataccgggactttcaacacggtaaaccgctcacctgatggccgctatgtcgccgtctccagccgtgggaacttctacttgacctgggagcctgggcagctgtattggcaaccgcacaatagggccgtggcacgacggatacagaacatgggatggagggcagatggcggtctctggcttctggtgcgcggcggtggactcttcctcagtaaaggaaccgggattactgaagagtttgaggaagcatcagtgcaaagccgggggtttggaatccttgatgtgggctaccgttcaaaggatgaggcatgggctgcaggtgggagcggcgtcctgctgaaaacaatgaacggcggcaagtcctgggtgcgtgacaaggccgccgataacatccccgggaatctctactccgtaaagttcgtcggtgacaaccaaggattcgtgctggggaacgatggcgtcttgctccgatacgttggatgaagtaacggaattcgctgcggttattcaaatccttttttgtacgtaacgataattcatatatatacctactatacgcgcacacacgtgaaaggctgctgctgatttgtttctcagcattctttcttctgcaagagagtgtaaatcttctgaccaattgtcatcagcatccaacagaactatgtgagcacatttatgtatctgaatctgatgctctgaagctcgtgaattgcatgcgaatgagttgataggcgtcagaggtctcaagaatgctaatttgaacttgaaattctcgatttataaatgattgtgagtttaaact

SEQ ID NO: 5460 - DNA, 1450 bp, Hordeum vulgare
cagccacagacagcagcagcccagcttcctgttcccgttcccgttcccgttcccgccatggccaccgccaccgccgcgctccacctcctcctccccacccgccgccggggccgcctcctcgtcccccgcgcgtgccaggccgactcctccaccaccacgtctcgccggggcctcattgccgacgccgccaccgcggccgtggccgccgccgccgcgccgctgcttcttccccgcatccccgcggcgcgcgcggaggacctgtccgagtgggagcgcgtcgggctccccatcgaccccggcgtcgtcctgctcgacatcgccttcgtccccgacgacccctcccacgggttcctcctggggacgaggcagacgatcctggagaccaaggacggcggccgcacctggttcccgcgctccatcccgtcggccgaggacgaggacttcaactacaggttcaactccgtcagcttcagcggcaaggaggggtggatcgtcggaaagccggccatcctgctgcacaccaaggacgccggcgacagctgggagaggatcccgctaagcgctcagctcccaggggacatggtgtacatccaggctaccggggagcagagcgcggagatggtgaccgacgagggagccatctacgtgacctccaaccgcggctacaactggaaggccgccgtgcaggagaccgtctcggccactctcaacagaacagtttcaagcggcattagcggtgcgagttactacaccggcactttcaacacggtgaaccgctcgcctgacggcagctatgtcgccgtctctagccgcggcaacttcttcttgacatgggagcctgggcagctatattggcaaccgcacaacagggctgtggcgcggcggatacagaacatgggatggagagcagatggtggtctctggctcctcgtgcgcggcggtggactcttcctcagtaaaggaacagggatagttgaagactttgaggaagcgtcggtacaaagccgggggtttggaattctggacgtgggctaccgctcaaaggatgaggcgtgggcagccggtgggagcggcgtcctgctgaaaacaaccaatggcggcaagacctgggtgcgcgacagggctgccgataacatccctgggaacctctactccgtaaagttcattggggacaaccaaggttttgtgctcgggaacgacggcgtcttgctccgatacgttggctgaagtagcggaaaaaaccacggctatgcaaaccctttttgtatgtaatgatccatatatagacgcacatgtgaaaggctgctgattgtcccaacgttctttcttctgcaagagagtgtaaatcttacctgtcttttactgttatttgaccgacgattgcttcaaatattcagaggcatacggtacagtactaagtgagcacacacatttgtgtgtctgatgctga

SEQ ID NO: 5461 - DNA, 1563 bp, Triticum aestivum
ctagcataggtgactatagaactgtttctacccagggcaggctggtaccggtccggcatacagggatatcgtcgacccacgcgtccggacagcagcagcacaccttctcgccgttcccgccatggccaccgccaccgccgcgctccacctcctcctccccacccgccgccggggccgcctcctcgtcccccgcgcctgccaggccgactcctccgccaccacgtcccgccgcggcctcattgccgacaccgccaccgcggccgtggtcgccgccgccgcgccgctgctgctgccccggctccccgcggcgcgcgcggaggacctgtccgagtgggagcgcgtcggcctccccatcgaccccggcgtcgtcctgctcgacatcgccttcgtccccgacgacccctcccacgggttcctcctggggacgaggcagacgatcctggagaccaaggacggcgggcgcacctggttcccgcgctccatcccgtcggcggaggacgaggacttcaactacaggttcaactccgtcagcttcagcggcaaggaggggtggatcgtcggcaagccggccatcctgctgcacaccaaggacgccggcgacagctgggagaggatcccgctcagcgcccagctcccaggggacatggtgtacatccaggctaccggggagcagagcgcggagatggtgaccgacgagggagccatctacgtgacctccaaccgcggctacaactggaaggccgccgtgcaggagaccgtctcggccactctcaacagaacagtttcaagcggcattagcggtgcgagttactacaccggcactttcaacacggtgaaccgctcgcctgacggcagctacgtcgctgtctccagccgcggcaacttcttcttgacatgggagcctgggcagctatattggcaaccgcacaacagggctgtggcgcggcggatacagaacatgggatggagagcagatggtgggctctggctcctcgtgcgcggcggtggactcttcctcagtaaaggaacagggatagttgaggactttgaggaagcgtcggtgcaaagccgggggtttgggattctggacgtgggctaccgctcaaaggatgaggcatgggctgccggtgggagtggcgtcctgctgaaaacaaccaacggcggcaagacctgggtgcgcgacagggccgccgataacatccccggcaacctctactccgtaaagttcattggagacaaccaagggtttgtgctcgggaacgacggcgtcttgctccgatatgttggctgaagtagagggaaaaaaccacggctatctaaaccctttttgtatgtaatgatccatatatagacgcacatgtgaaaggctgctgattgtcccgacgttctttcttctgcaagagagtgtaaatcttatctgtctattactgttatttgaccgacgattgtttcaaacattcaaaggcatacagtacagtacgacgtgagcacatgcatttatgcatgtatctgatgctgatatatatgcgatgaattttgtgaggtgcaaaaaaaaaaaaaaaa

SEQ ID NO: 5462 - DNA, 1416 bp, Leymus cinereus x Leymus triticoides
  misc_feature (825)..(825): n is a, c, g, or t
gttcccgccatggccaccgccaccgccgcgctccacctcctcctcccaacccgccaccggggacgcctcctggccccgcgcgcgtgccaggctgacaacaccacgtctcgccgcggcctcattgccgacacggccaccgcgaccgtcgcggctgccgccgcgcctctgctgctgccccggatccccgcggcgcgcgcggaggacctgtcggagtgggaacgcgtcgggctccccatcgaccccggcgtcgtcctgctcgacatcgccttcgtccccgacgacccctcccacggattcctcctgggaacgaggcagacgatcctggagaccaaggacggcgggaggacctggttcccgcgctccatcccgtcggcggaggatgaggacttcaactacaggttcaactccgtcagcttcagcggcaaggagggatggatcgtcggcaagccggccatcctgctgcacaccaaggacgccggcgacagctgggagaggatcccgctcagcgcccagctccccggcgacatggtctacatccaggctaccggggagcagagcgcggagatggtgaccgacgagggagccatctacgtgacctccaaccgcggctacaactggaaggccgccgtgcaggagaccgtctcggccactctcaacagaacagtttcaagcggcattagcggtgcgagttactacaccggcactttcaacacggtgaaccgctcacctgacggcagctacgtcgctgtctccagccgcgggaacttcttcttgacatgggagcctgggcagctatattggcaaccgcacaacagggctgtggcncggcggatacagaacatgggatggagagcagatggtgggctctggctcctcgtgcgcggcggtggactcttcctcagtaaaggaacagggatagttgaggacttcgaggaagcgtcagtgcaaagccgggggtttggaattctggacgtgggctaccgctcaaaggatgaagcgtgggctgccggtggtagcggcgtcctgctgaaaacaaccaatggcggcaagacctgggtgcgtgacagggccgccgataacatccccgggaacctctactccgtaaagttcattggagacaaccaagggtttgtgctcgggaacgacggcgtcttactccgatatgttggctgaagtagcggaaaaaaacacggctatctaaaccctttttgtatgtaatgatccatatatagatacacatgtgaaaggctgctgattgtcccaacgttctttcttctgcaagagagtgtaaatcttatctgtctattactgttatttgaccgacgattgtttccaacgttcaaaggcatacagtactacgtgagcacatacatttatgtatctgatgctgatatgctatggattttgtgaagtgca

SEQ ID NO: 5463 - DNA, 1454 bp, Leymus cinereus x Leymus triticoides
gcacagcttcctgttcccgccatggccaccgccatcgccgccctccgcctcctcctgccctcctcctcatcctcgcgccgccggggacacctcctcgtcccgcacgcgtgccaggccgactcctcatcctcctccaccacgtctcgccgcggcctcattgcggacacggccaccgcggccgtcgccgccgccgccgcgcctctgctgctgccccggctccccgcggcgcgcgcggaggacctgtcggagtgggagcgcgtcgggctccccatcgaccccggcgtcgtcctgctcgacatcgccttcgtccccgacgacccgtcccacgggttcctcctggggacgaggcagacgatcctggagaccaaggacggcgggaggacctggttcccgcgctccatcccgtcggcggaggacgaggacttcaactacagattcaactccgtcagcttcagcggcaaggagggatggatcgtcggcaagccggccatcctgctgcacaccaaggacgccggcgacagctgggagaggatcccgctcagcgcccagctccccggcgacatggtctacatccaggctaccggggagcagagcgcggagatggtgaccgacgagggagccatttacgtgacctccaaccgcggctacaactggaaggccgccgtgcaggagaccgtctcggccactctcaacagaacagtttcaagcggcattagcggtgcgagttactacaccggcactttcaacacggtgaaccgctcacctgacggcagctacgtcgctgtctccagccgcgggaacttcttcttgacatgggagcctgggcagctatattggcaaccacacaacagggctgtcgcccggcggatacaaaacatgggatggagagcagatggtgggctctggctcctcgtgcgcggcggtggactcttcctcagtaaaggaacagggatagttgaggactttgaggaagcgtcagtgcaaagccgggggtttggaattctggacgtgggctaccgctcaaaggatgaggcatgggctgccggtggtagcggtgtcctgctgaaaacaaccaacggcggcaagacctgggtgcgcgacagggccgccgataacatccccgggaacctctactccgtaaagttcattggcgacaaccaagggttcgtgctcgggaacgacggcgtcttgctccgatacgttggctgaagtggcaggaatcgccacggctatctaaaccctttttgtacgtaatgatccatatatacacgacatgtgtgaaaggcggctgagttatctgtccctgacaatctttcttctgcaaaagagtgtacatgttcgactgatgattgtttccaaacattcaaagacaccactacatgtatgtatctgatgctgttatgctatgaattttgtaaagtgcaaatgaactgtagacatcaatactgccacta

SEQ ID NO: 5464 - DNA, 1381 bp, Avena sativa
cccacccgccgcctccgcctcctcgtcccgcgcgcctgctcctcgtcttctcccacacgccgcggcctcattgccacctcggccgtcgccgcggccgccgccccgctgctcctccccggccgcacccccgcggcgctggccgctgagcccctgtccgagtgggagcgcgtgggcctccccatcgacccgggcgtcgtgctgctcgacatcgccttcgtccccgacgacccctcccacggattcctcctggggacgcggcagacgatcctggagaccaaggacggcggcagcagctggttcccgcgctccatcccgtccgccgaggacgaggacttcaactacaggttcaactccgtcagcttcagcggcaaggagggatggatcgtcggcaagccagccatcctgctacacaccaaggacgcaggagacagctgggagcgaataccgctcagcgcacagctaccaggggacatggtctacatccaggccaccggcgagcagagcgcggagatggtcaccgacgagggggccatctacgtcacctccaaccgcggctacaactggaaggccgccgtgcaggagaccgtctccgccactctcaacagaacagtttcgagcggcattagcggtgcgagttactataccggcactttcaacaccgtaaaccgctcgcctgacggacgctacgttgctgtctccagccgtgggaacttctacttgacatgggagcctgggcagctgtactggcagccacacaacagggctgtggcgcggcggatacagaacatgggatggagagctgatggtggtctctggctccttgtgcgaggcggtgggctcttcctcagcaaaggaaccgggatagttgaagactttgaggaagcgtcggtgcagagccgggggtttggaattctcgacgtgggataccgctcaaaggatgaggcgtgggctgccggtgggagcggcgtcctgctgaaaacaaccaacggcgggaaatcctgggtgcgcgacaaggccgccgacaacatccccgggaacctctactccgtaaagttcattggtgacaaccaaggtttcgtgctcgggaacgatggcgtcttgctccgttatgttggctgaagttgcaggaataatcaccacggctatctaaatccctttttgtatgtaataataatgagattcatatgtataccccccatgtcaaaggctgctaactgtcccaaacattccttctcatactacacaagagtgcaagtcttccctgtctgtctgtctgtctgttacgtacagtacttgactgatgatggttgtttactacttttgtgtacctgaatctgtttttggctagtagtagtatgaatgaagcttcttgtaaaagatg

SEQ ID NO: 5465 - DNA, 1381 bp, Pseudoroegneria spicata
  misc_feature (6)..(10): n is a, c, g, or t
cgcgcnnnnnctcctcctccccacccgccgccgaggacgcctcctcgccccccgcgcgtgccaggccgactccgccaccacgtctcgccgcggcctcattgccgacaccgccaccgcggccgtcgcggcggcagccgcgccgctgctgctgccacggctccccgcggcgcgcgcggaggacctgtccgagtgggagcgcgtcgggctccccatcgaccccggcgtcgtccttctcgacatcgccttcgtccccgacgacccctcccacggattcctcctggggacgaggcagacgatcctggagaccaaggacggcgggcgcacctggttcccgcgctccatcccgtcggcggaggacgaggacttcaactacaggttcaactccgtcagcttcagcggcaaggagggatggatcgtcggcaagcccgcaatcctgctgcacaccaaggacgccggcgacagctgggagaggatcccgctcagcgcccagctcccgggcgacatggtgtacatccaggctaccggggagcagagcgcggagatggtgaccgacgagggagccatctatgtgacctcaaaccgcggatacaactggaaggccgctgtgcaggagaccgtctcggccactctcaacagaacagtttcaagtggcattagtggtgccagttactacaccggcactttcaacacggtgaaccgctcacctgacggcagctacgtcgctgtctccagtcgcgggaacttcttcttgacatgggagcctgggcagctatattggcaaccgcacaacagggctgtggcgcggcggatacagaacatgggatggagagcagatggcgggctctggctcctcgtgcgcggcggtggactcttcctcagtaaaggaacagggatagttgaggacttcgaggaagcgtcagtgcaaagccgggggtttggaatcctggatgtgggctaccgctcaaaggatgaggcatgggctgccggtgggagcggcgtcctgctgaaaacaaccaacggtggcaagacctgggtgcgcgacagggccgcagataacatcccgggcaacctatactccgtaaagttcattggcgacaaccaagggttcgtgctcgggaacgacggcgtcttgctccgatatgttggctgaagtagcagaaaaaaccacggctatctaaacccttttttgtatgtaatgatccatatatagacgcacatgtgaaaggctgctgattgtcccaacgtacgttcttctgcaagagagtgtaaatcttacctgtctattactggtatttgaccgatgattgtttcaaaggagtacgacgtgagcacatacatttgtgtatctgatgctgatatgctatggattttgtgaactgca

SEQ ID NO: 5466 - DNA, 1748 bp, Vitis vinifera
tctgtccacatgtataggaaggggacagacacgcttcaaaccgcgaagcgaagccgttgagggagcatcattcatttggataagtgagtgagaaggaagaagaagcacgatggcgactctgcaactaagcgattactgcaatccagtagtcgcactgaaaccttcgctcaagtctttcttcatcaaaactgaccatcgcaactgctgtggggcctcgcgagttcgcgtcgtccccagagcgtgtctccagaaaccgtcgctcactcggcgacacttgctggcggagaccgccgcaatctccgtcgctccccttatcttaggaattgagccaccggccaagtccgaagaaccgcttctttccgagtgggaaagagtttaccttcccatcgaccccggcgttgttcttctcgacatcgcttttgttcccgacgacttgagtcacggttttctgctgggaactaggcagacaattatggagacaaaagatggaggaaacacttgggttccacgatcaataccctcggctgaagatgaagatttcaactacagatttaattcaattagtttcaaagggaaggaggggtggattgttggaaaaccttcaattctgttgtatacttctgatgctggagaaagctgggaaagaatacccttaagtgcccaacttcctggagatatagtatatataaaggcaacaggagagaagagtgcagagatggtaacagatgaaggtgcaatttatgttacttcaaacagaggctacaattggagggcagctgttcaggagactgtctcagctactcttaatagaacagtttctagtggtattagtggtgcaagttactatacaggcactttcaatactgtaaatcgatccccagatggaagctatgttgctgtttcaagtcgtggtaacttctacctcacttgggagcctgggcagccatactggcaaccccataacagggcagttgcaagaagaatccaaaacatgggatggagagctgatggtggcctttggcttcttgtacgtggtgggggactttatctcagcaaaggcacagggatttcggaggactttgaagagattccagtacaaagtcggggttttggcattcttgacgttggataccgttcaaaggaagaggcttgggcagctgggggcagtggggttctgttgagaaccacaaatggtggcaagacatggacccgtgataaagcagctgacaatattgctgcaaatctctattcagtaaagtttatagatgacacaaaggggtttgtgctaggaaatgatggagttttgcttcggtttcttggataaagtaataatttacaacatggtttgtcaatgaggcttgcaattttgtactgcttaaccacggtatgatgtgccattgtttgatgctgtaaaaactggcctaaatttcattgaaattattatattgtaattactatgtaactattttattcataaaaattactcggttcatgttgaggaattatccttaccaccaaattcatacggaaaactgttacccaaaacaagatgggcattataatttactggactagtgatggattgcaactattcagtacacattttggctatacgtttgaatcttgaaaattttggaaagttaaggaaaatgaaaagcatgaaggaaaggaaagaaagattggaagaaaatgaaaagcaggtttaagttcaacaaattaaatctttaaagaatttatttcaaaataaa

SEQ ID NO: 5467 - DNA, 1425 bp, Vigna unguiculata
ggccttctctacattcttcgcgaaccttccctcggaatcgaagcctcgttgtcaaagcctcttcttcttcttccgacgacatttcccggagcaggagacgcttcctcgccgaaaccgccgcaatatcggtttcgcttcctcactttccggcgagggccgaagacacgctttcggagtgggagagagtgtacctccctatcgaccccggcgtcgtgcttctcgacatcgcttttgtccccgacgaccccaaccacggttttcttctcgggacgaggcaaacaattctggagacgaaggacggaggaaacacttgggctgcgcgttcgattccctctgccgaagatgaagatttcaactatcgctttaattctatcagtttcaaggggaaggaagggtggatagttggaaaacctgcgattctgttgtacactgctgatgctggagaaagctgggagaggatacctctcagtgctgaacttcctggggatatggtgtacataaaagcgactggtgagaagagtgcagagatggtcactgacgaaggtgcaatatacgttactgctaacaggggttacaactggagagctgctgttcaggaaactgtgtcggctactcttaacagaacagtttctagtggtattagtggtgcaagctattacactgggactttcaatactgtcaatcgctctccagatggaaggtatgttgcagtctcaagtcggggcaacttctacttaacctgggagcctggtcagccgttctggcagccacataatagagcagtggccagaagaatacagaacatgggatggagagctgatggtggtctttggcttcttgttcgtggaggtggtctttatctcagcaagggcacagggttaactgaagaatttgaggaggttcctgttcaaagccgaggttttggcattcttgatgttggatatcgttcaacggatgaggcttgggcagcaggaggaagtggtattcttttgagaactactaatggtggccagtcatggatccgtgacaaagctgctgacaacattgctgcaaatttatactcagtgaagttcattgatgacaaaaaaggatttgtattggggaatgacggagtcttgcttcgctaccttggatagagttataattcaacatggtttgttgcctcgattgcaattttgtagcagattacatatccatgattaacattcattactctggagagagctatgggatcaaatcgactcttgctgttgtgctaaacaaaaaatgtgaggaagtataggaacaaactatattactgtaaagagagttatgttatgtcaatgtaaaattgtaatggcatgttattatcacattaaaattaaattttataatgcatatatgttgtacggcaaaagtaaagtattgcaaaagcacttcttcggc

SEQ ID NO: 5468 - DNA, 1426 bp, Vigna unguiculata
ggccttctctacattcttcgcgaaccttccctcggaatcgaagcctcgttgtcaaagcctcttcttcttcttccgacgacatttcccggagcaggagacgcttcctcgccgaaaccgccgcaatatcggtttcgcttcctcactttccggcgagggccgaagacacgctttcggagtgggagagagtgtacctccctatcgaccccggcgtcgtgcttctcgacatcgcttttgtccccgacgaccccaaccacggttttcttctcgggacgaggcaaacaattctggagacgaaggacggaggaaacacttgggctgcgcgttcgattccctctgccgaagatgaagatttcaactatcgctttaattctatcagtttcaaggggaaggaagggtggatagttggaaaacctgcgattctgttgtacactgctgatgctggagaaagctgggagaggatacctctcagtgctgaacttcctggggatatggtgtacataaaagcgactggtgagaagagtgcagagatggtcactgacgaaggtgcaatatacgttactgctaacaggggttacaactggagagctgctgttcaggaaactgtgtcggctactcttaacagaacagtttctagtggtattagtggtgcaagctattacactgggactttcaatactgtcaatcgctctccagatggaaggtatgttgcagtctcaagtcggggcaacttctacttaacctgggagcctggtcagccgttctggcagccacataatagagcagtggccagaagaatacagaacatgggatggagagctgatggtggtctttggcttcttgttcgtggaggtggtctttatctcagcaagggcacagggttaactgaagaatttgaggaggttcctgttcaaagccgaggttttggcattcttgatgttggatatcgttcaacggatgaggcttgggcagcaggaggaagtggtattcttttgagaactactaatggtggccagtcatggatccgtgacaaagctgctgacaacattgctgcaaatttatactcagtgaagttcattgatgacaaaaaaggatttgtattggggaatgacggagtcttgcttcgctaccttggatagagttataattcaacatggtttgttgcctcgattgcaattttgtagcagattacatatccatgattaacattcattactctggagagagctatgggatcaaatcgactcttgctgttgtgctaaacaaaaaatgtgaggaagtataggaacaaactatattactgtaaagagagttatgttatgtcaatgtaaaattgtaatggcatgttattatcacattaaaattaaattttataatgcatatatgttgtacggcaaaagtaaagtattgcaaaagcacttcttcggca

SEQ ID NO: 5469 - DNA, 2369 bp, Aristolochia fimbriata
gagagacacgagagagagatagagagagtagagggagagaaatttcgagagaggaagagggacagcaatggcgtcaatgtcgacgctgcagctcaccggttcgagttcccttcttctgaaaccttctttgcgtcaatttctagtaaggagaagcggacatttggggaggtctcaatcacgattcattccttctgcctgtcttcagaacgcctctgtgaaccgaagaaggttcattgcggatacggctgctgtttcggtctctctcgcatctctcactgccctcgaacagccggcgaggtcggatgaaggtctatctgaatgggagcgagtttatttacccattgatccgggtgttgtacttctcgacattgcgtttgttccggatgacatgaagcatggcttccttttggggacgcggcaaacgattttggagacaaaagatggtggtaccacctgggttccacgttcaataccgtcagcagaggaggaagacttcaactaccggtttaattccattagcttcatgggtaaggaaggatggatagttgggaaacctgcaattttgttgcatacctcggatgctggagaaagctgggaaagaatacccttaagtgctgaacttcctggtgatatggtttatataaaagcaacaggtgaaaagagtgcagaaatggtaactgatgaaggagcaatttatgttacatcaaataaaggatacaactggagagctgctgttcaagaaactgtttcagctactctcaatcgcacagtttctagtggtatcagtggtgcaagctactacacaggaacatttaatacagtaaatcgctctcctgatggcagctatgttgctgtctcaagccgtggaaacttctatctgacttggcaacctgggcaggcattctggcaaccacataacagagcagtggcacgaagaattcagaatatgggatggagagctgatggtggtctctggcttctcgtccgaggtggtgggctttatctgagcaaaggcactggtatatcagaaaattttgaagaaattcctgtccaaagtcgaggttttggcattcttgatgttggatatcgttcgaaggatgaagcttgggcagccggaggcagcggaattttgctgagaacaactaacgggggaaagacttggttgcgtgacaaagctgctgataatatagctgcaaatctttactcagtaaagttcatagatgataacaaaggttttgttctagggaacgatggcgtcttgctacggtaccttggttgatgaagatcttccttttttatgaaattccagcgtcctttatctatgtaattactttgtatcttatgattgttggagcgtacgatttcttctttttttccctgaatggagatgtattttattgaaatatttagtccatattgttaaaaatgctgtgatatttgacatctggtcaaacccccttgacaaagaattccttgatgctaaatggggtagacaactctcgtgtaagaatatgtttcaatatacactcccagcaatttttaaaagatttcattgctctaaggcctgaatattttcatggtttttgaaacctgggtacggcaaaaagggcacctggttacagcagaagagcacctgtgacacataacgtgcccacaaggaacaatagagacattaacttcagcactaagacagatccgacaagaccatgcagcctttgctgcatcagcttcttttgttgcggtctcggctttctcctgttcgagcaaaagtgctgtctgtgtttccttaagctgttcttgtagggatagagttgtatgaagcaaagtctgcttctcagcatccatattgatcccagctgcagaaagcatgtcacggactgcttgtaccagttcctctgaagatactcgcccatactgtagttctttagcggacttggataatacttggctacttcccacacattttgccacttgcatgttattctgactctccatatgtgtttgaccaccatcaggcaaattggatgtcgacactacctcagcagatgaaatgctcctgaatgagaaaacctgagaagaaagaagagcctgcatctctccagggccaatttccacccgaaatctgtaaagtgcttgacttgcagatggcctcacatcttccggaatgcagccgtatttcaacttctctccttccttttctaaacgccatgccactatttctcctctataaaatggtcgtaggggatgaaactgcacctggagagcatcttgtggcagtatttccttccccaccaagcctgctctccctccaaccccaatttcatgagctccagcagatcttagttttagagtattgaggatatcttctt

SEQ ID NO: 5470 - DNA, 1700 bp, Cajanus cajan
aaaaaaataaaaatagtaaggttagagttggaagcgtatgatccactgagtgaagatgaagaagtgaagcggcttgaaatcacccgcgaagccgttaggataaggcagagagagaaaaggaaaacaaaagaagcaatggcgactctgcaattcaccttcaccgactcaacctcctccttcaggtcttctttaccttcctcgcgagcttcctctcgaagccgaacccgaagcctcattgtcaaagcctcttctatcgacttctccagaaccagaagacgcttcatcgccgaaaccgccgcaatctccgtctcgctccctcacttcgcgccggccagagccgaagaagcgctttccgagtgggagagagtttacctccctatcgaccccggcgtcgtgcttctcgacatcgcttttgtccccgacgaccccaaccacggttttcttctcgggacgagacaaaccattctggagacgaaagatggaggaaacacttgggctccgcgttcgattccctctgccgaagacgaggatttcaattaccgcttcaattctattagcttcaaagggaaggaaggttggatagttggaaaacctgcgattcttttgtacactgctgattctggagaaagttgggagaggattcctctcagtgctgaacttccgggggatatggtgtacataaaggcgactggtgagaagagtgcagagatggtgactgacgaaggtgcgatatatgtcactgctaacagaggttacaactggagggctgctgtccaggaaactgtgtcagctactcttaacagaacagtttctagtggtattagtggtgcaagttattacactgggactttcaatactgtcaatcgctctccagatggaaggtatgttgcagtctcaagtaggggcaacttctacttaacctgggagcctggtcagccattctggcagcctcataatagagcagttgccagaagaatccagaacatgggatggagagctgatggtggtctgtggcttcttgttcgtggaggcggtctttatctcagcaagggcacagggttaactgaagaatttgaggaggttcctgttcaaagccgaggttttggtattcttgatgtgggatatcgttcatcggaggaggcttgggcagcaggaggaagtggtattctcttgagaactactaatggtggcaagtcatggatccgtgacaaagctgctgacaacattgctgcaaatttatactcagtgaagttccttgatgacaagaagggatttgtattggggaatgatggagtcttgcttcgctaccttggatagagttgtaattcgacatggtttgttgcctcgtttgcaattttgtagcagattacatatccatgcttaacattcattaatgtggagagagctatgggatcgaatcgactccttgctgttatgctaaaaaaatgtgaggaagtatagacacaaaccttactactgtaaagagagcaatattatgtcaatgtaaaattgtaattgccagggttactattatattaaaattccattttatgctgcatgtgttcattatgttgtactgcaaaagcagggtactgtaaaagtgcctatataaaagagtttaccatacgagatattatatcataagcgcttatttctataagcttatttgcatttagatgcatactttaaaaaacactagc

SEQ ID NO: 5471 - DNA, 1799 bp, Gossypium raimondii
gaaactgcccgcgtagccgttgataccaccattcggataagaaaaaaccaacaaaaaagaaaaaagctaagccaagagaaagagagctgcaacactgaattaacaatggcgatgatgacgcccaatcttcaagccactgattgctccaaccttataccttccttaacttctctcttccctcctcgccttctccaccgccccttatcgctaccccactcccgtttcatctccaaagcttctctccaccacccttcttccccttcttcttcttcttcgccgccgtcactcgtcaaccggagacaaatcatttcccaaacggcgtcgctttctctgtccctcgcaactctctcgtctctcccattgccagctaagtccgaggaagttttgtcggaatgggaaagagtctaccttcccatcgatcccggtgttgtccttctagacatcgcctttgtccctgatgacttaaaccatggatttttgctggggacgaggcagactattttggagacaaaagatgggggaaatacatggactcaacgttcaattccttcagctgaggatgaagatttcaactataggtttaactctattagcttcaaaggcaaagaaggttggattgttggtaaacctgcaattttgttatacacttcagatgctggagaaagctgggaaagaattccattaagtgctcaacttcctggtgatatggtatatataaaagcaactggtgaaaagagtgcagaaatggtgactgaccaaggagcaatatatgttacatcaaacaggggctataactggagagctgctgttcaagagaccgtctcagctactctgaatagaacagtttctagtggtattagtggggcaagttattacaccggaacttttaacactgtgaaccgctctccggatggacgatatgtggctgtctcaagccgtggtaacttttatcttacatgggagcctggacagccattctggcagccacataatagagcaattgcaagaagaatacagaacatgggatggagggctgatggtggtctttggcttcttgtccgtggaggagggctttttcttagcaaaggcacagggatatctgaagattttgaagaagttcctgtacaaagtcgtggctttggcattcttgacgttggctatcgatcagaggaagaggcttgggcagcagggggcagtggggttttgttgagaactaccaatggtgggaagaattggacccgtgacaaggcagctgataatattgctgctaatctatactcagtgaagtttattaatgacaagaagggatttgtgctgggtaatgatggcgtcttgctccggtatcttggataaagctgttatcctttcatgatgtccaacaatgcttgcaattttgtatagctgatgtaaactactttcctggtggtgatatttgagaggggaaaaaaattccattaatgtgattatgttattcctttgcttttctttttggtcaatgtgattatatattttactcttccattaggttcctgcaaatgttttgctaaatggaaaagaagcaaaatgtttatacctgtcaaagtgaaaattcatatatgtgcatggatatcagtttgtgatataatcctctaaattcatgaaatagttaataagaaagttaaacatactcgtatagataacatgactgttaacagtaaaagtaccatagaggttcatgtattaggacttagatcgtattttaccccgatttattaaaaaaataaacaaattagtccttgtacattaaatcaaaaagtaaa

SEQ ID NO: 5472 - DNA, 1589 bp, Gossypium hirsutum
aagccaagagaaagagagctgcaacactgaattaacaatggcgatgatgacgcccaatcttcaagccactgattgctccaaccttataccttcattaacttctctcttccctcctcgccttctccaccgccccttatcgctaccccactcccgtttcatctccaaagcttctctccaccacccttcttccccttcttcttcttcttcgccgccgtcactcgtcaaccggagacaaatcatttcccaaacggcgtcgctttctctgtccctcgcaactctctcgtctctcccattgccagctaagtccgaggaagttttgtcggaatgggaaagagtctaccttcccatcgatcccggtgttgtccttctagacatcgcctttgtccctgatgacttaaaccatggatttttgctggggacgaggcagactattttggagacaaaagatgggggaaatacatggactcaacgttcaattccttcagctgaggatgaagacttcaactataggtttaactctattagcttcaaaggcaaagaaggttggattgttggtaaacctgcaattttgttatacacttcagatgctggagaaagctgggaaagaattccattaagtgctcaacttcctggtgatatggtatatataaaagcaactggtgaaaagagtgcagaaatggtgactgaccaaggagcaatatatgttacatcaaacaggggctataactggagagctgctgttcaagagaccgtctcagctactctgaatagaacagtttctagtggtattagtggggcaagttattacaccggaacttttaacactgtgaaccgctctccggatggacgatatgtggctgtctcaagccgtggtaacttttatcttacatgggagcctggacagccattctggcaaccacataatagagcaattgcaagaagaatacagaacatgggatggagggctgatggtggtctttggcttcttgtccgtggaggagggctttttcttagcaaaggcacagggatatctgaagattttgaagaagttcctgtacaaagtcgtggctttggcattcttgacgttggctatcgatcagaggaagaggcttgggcagcagggggcagtggggttttgttgagaactaccaatggtgggaagaattggacccgtgacaaggcagctgataatattgctgctaatctatactcagtgaagtttattaatgacaagaagggatttgtgctgggtaatgacggcgtcttgctccggtatcttggataaagctgttatccattcatgatgtccgacaatgcttgcaattttgtatagctgatgtaaactactttcctggtggtgatatttgagaggggaaaaaaattccattaatgtgattatgttattcctttgcttttctttttggtcaatgtgattatatattttactcttccattaggttcctgcaaatgttttgctaaatggaaaagaaacaaaatgttatacctgtcaaagtgaaaattcatatatgtgcatggatatcagtttgtgatataatcctctaaattcatgaaatagttaataagaaagt

SEQ ID NO: 5473 - DNA, 1389 bp, Triticum aestivum
ccacccgccgccggggccgcctgctcgccccccgcgcctgccaggccgactcctccaccaccacgtcccgccgcggcctcattgccgacaccgccaccgcggccgtggtcgccgccgccgcgccgctgctgctgccccggctccccgcggcgcgcgcggaggacctgtccgagtgggagcgcgtcggcctccccatcgaccccggcgtcgtcctgctcgacatcgccttcgtccccgacgacccctcccacggattcctcctggggacgaggcagacgatcctggagaccaaggacggcgggcgcacctggttcccgcgctccatcccgtcggcggaggacgaggacttcaactacaggttcaactccgtcagcttcagcggcaaggaggggtggatcgtcggcaagccggccatcctgctgcacaccaaggacgccggcgacagctgggagaggatcccgctcagcgcccagcttccaggggacatggtgtacatccaggctaccggggagcagagcgcggagatggtgaccgacgagggagccatctacgtgacctccaaccgcggctacaactggaaggccgccgtgcaggagaccgtctcggccactctcaacagaacagtttcaagcggcattagcggtgcgagttactacaccggcactttcaacacggtgaaccgctcgcctgacggcagctacgtcgctgtctccagccgcggcaacttcttcttgacatgggagcctgggcagctatattggcaaccgcacaacagggctgtggcgcggcggatacagaacatgggatggagagcagatggtgggctctggctcctcgtgcgcggcggtggactcttcctcagtaaaggaacagggatagttgaggactttgaggaagcgtcggtgcaaagccgggggtttggaattctggacgtgggctaccgctcaaaggatgaggcatgggctgccggtgggagtggcgtcctgctgaaaacaaccaacggcggcaagacctgggtgcgcgacagggccgcagataacatccccggcaacctctactccgtaaagttcattggagacaaccaagggtttgtgctcgggaacgacggcgtcttgctccgatatgttggctgaagtgagggaaaaaaccacggctatctaaaccctttttgtatgtaagaatgatccatatatagacgcacatgtgaaaggctgctgattgtcccgacgttctttcttgtgcaagagagtgtaaatcttatctgtctattactgttatttgaccgacgattgtttcaaacattcaaaggcatacagtacagtacgacgtgagcacatgcatttatgcatgtatctgatgctgatatatatgcgatgaatttcgtgaggt

SEQ ID NO: 5474 - DNA, 1470 bp, Solanum melongena
caaccaacaaatagaatagaatggcatcatcatctttctcaaactccattttcactcttgtcaagcctacaactacttttcttccccacgacttcccgccgaggttgcctctatgcagagcagctaacatcaaccggagacagttaatcgctgagactgctgctgccattgcccttcctccattacttggactaagcctctctcctctccctgccaaagctgacgaagcccctctctctgaatgggaaagggtttttcttcctattgaccctggcgtcgtacttctcgatattgccttcgttcccgatgaccccaaccacggttttcttctggggactaggcaaactattttggaaacaaaggatggaggaaccacttgggtaccaagatcaatagcctctgctgaagaggaagattttaattataggtttaattctattagttttaaaggcaaagaaggatggattattggaaaaccggcaatcttgttgcatacttctgatgctggtgaaacctgggagcggatacctttgagttcccaacttcctggtgacatggtttatatcaaggcaactggagaacaaagtgcagaaatggtaactgatgaaggtgcaatatatattacatcaaacaagggatacaactggagagctgctattcaagaaactgtctctgctactcttaatagaacagtttctagtggcattagtggtgccagttactatacaggcactttcagtactgttaatcgctctcctgatggacgttatgtagcagtgtcaagccgtggcaacttctacctgacctgggagccagggcaggcatactggcaaccacataacagagccgtggcgagaagaatccaaagcatgggctggagggctgatggtggtctttggctacttgtgcgtggtggagggctataccttagcaagggcacagggttaacagaggactttgaagaagtttcagtacaaagccgtggttttggcattcttgatgttggctaccgctcacaggatgaggcctgggctgctggtggcagcgggattttgttgaagaccaccaatggtggcaagacatggattcgtgacaaagcagctgataatattgctgcaaatctttattcagtgaagtttatcaatgacaatcaggggtttgtactggggaatgacggtgtcttactaaagtatcttggatagatacaatcattaaataatggtactttggggtttcaactcacttgcaatttttctttactagaggttaaaacatattattcatctcgtgtttgtgcaggcaattttggaagcaaatacttgaaactgaactactgtaatttaatttatacacgttcaattctttgctgattatcaccagatcgaagggaagtgttcatagggcttgaggttttagattatctacttaagactcacgcattataatgaagataacgttttgaattgtgtt

SEQ ID NO: 5475 - DNA, 1725 bp, Arachis hypogaea
atagtagggaatgtaaatctcctttaaatcacccgcgaagccgttgcaggataagtaagagagagaaaatctagagagagaaacctcgaagcttctttcaatggcgactctgcgtttcactgactgctccaacctcacctccaccttcttcaggccttccttaccctctctctccgccgcaaagtctcgccattcccaaaaccctcagaatcggaacaccagcaccagcagctgcaccttcgttcccagagcgtctcttcagccgcaccaggacgatcaattctctctctcccggagacgcttcatcgccgacactgccgccgtctcgctctcgattccacagctcgttggatttgaacaggctgcgaggtcggaggaagcgctgtcggagtgggagagagtttacctccctatcgatcccggtgtcgtactccttgacattgcgtttgttcccgatgatcccaaccacggtttccttttggggactaggcaaaccattatggagacaaaagatggtggaaacacttgggctccccgttcgataccctctgcagaggatgaagattttaactatagatttaattccatcagcttcaaagggaaggaagggtggatagttggaaagcctgcaattctattatatacttctgatgctggagaaagttgggaaaggataccacttagtgctcaacttccaggggatatggtatatataaaggcaaccggtgaaaagagtgcagagatggtgactgacgaaggtgcaatctacgttacatcaaacagaggctacaattggaaggctgctgttcaggaaactgtgtcagctactcttaatcgaacagtctctagtggtattagtggtgcaagttattacaccgggacgttcaatactgtcaatcgctctccagatgggaggtatgttgcagtctcaagtcgtggcaacttctatctaacatgggaacctggtcagccattctggcagccacataatagagcagttgccagaagaatccagaacatgggatggagagctgatggtggtctgtggcttcttgttcgtggtggtggcctttatctcagcaagggcacagggttgaccgaagaatttgaggaggttccagttcaaagccgaggttttggcattcttgatgtggggtatcgatcacaggaggaggcttgggcagcaggtggaagtggtattctgttgagaactactaatggtggcaagtcatggatccgtgacaaagctgctgacaacattgctgcaaatttatactcagtgaagttccttgatgacaagaagggatttgtattggggaatgatggagtcttgcttcgctaccttggatgaagctgcaactcaacatggtttgtcaactggattgcaattttgtagctgattacatatccatgcttagtattcattatctgtggatagagctttgggatcaaatcgactccctggtgttgtgccgaaaaatttgaggagatatagaaaaaaacaaacatcacaacttgtgaagaaagctgtattatgtaatctgaaattgtaattgccatgtatgtaactttcacattaaaatgcaattttatgctgcgttgttgtactcaagcagaatgcatgttccaatggaataggttatgctagtggacattgaagttgtgcatattaacatcaacaaataatcgtccctataatataattacgagagattactccttcct

SEQ ID NO: 5476 - DNA, 1524 bp, Glycine max
ggaagcatatgatccactgattccactcagtgaattatgaagtgatctgaaatcacccgcgaagccgttaggataaggcaaagagagagaaacaaagcggcttccaatggcgactctgcggctcaccttctccgactcaaccaccttgttcaggccttctctaccttccacgcgaaccttctctcgaaaccgaagcctcattgtcaaagcctcttcttctgaagacgatttctccagaagcagcagaagacgcttcatcgccgaaaccgccgcactctcggtctcgctccctcagttaacggcgcgttctgaagacgcgctttcggagtgggagagagtgtacctccctatcgaccccggcgtcgtgcttctcgacatcgcttttgtccccgacgaccccaaccacggttttcttctcgggacgaggcaaaccattctggagacgaaagatggaggaaacacttgggctccgcgttcgattccttctgctgaagacgaagatttcaactatcgattcaattctatcagcttcaaagggaaggaagggtggattgtcggaaaaccttcgattctgttgtacacttccgatgccggagacagttgggagaggatacctctcagtgctgaacttccaggggatatggtgtacataaaggcgaccggtgagaagagtgcggagatggtgaccgacgaaggtgcaatatatgttactgcaaacagaggttacaactggagggctgctgtccaggaaactgtgtcagctactcttaacagaacagtttctagtggtattagtggtgcaagctactacactggaactttcaatactgtcaatcgctctccagatggaaggtatgttgcagtctcaagtcggggaaacttctacttaacctgggagcctggtcagccattctggcagccacataatagagcagttgccagaagaatccagaacatgggatggagagctgatggtggtctgtggcttcttgttcgtggaggtggtctttatctcagcaagggcaaagggttaactgaagaatttgaggaggttcctgttcaaagccggggttttggcattcttgatgttggatatcgttcaacggatgaggcttgggcagcaggaggaagtggtattctcttgagaactactaatggtggcaagtcatggatccgtgacaaagctgccgacaacattgctgcgaatttatactcagtgaagttcattgatgagaagaagggatttgtattggggaatgatggagtcttgctccgctaccttggatagagttgtaatacaacatggtttgttgcctcaaatgcaattttgtagcagattacatatccatgctttacattcattactgtggagaagcctatgggatcaaattgactccttgctgttgggctaaaaaaatgcgaggaagtataacaaacttcactactgtaaagagagttatattatgtcaatgtaaaattgtaattgccacgttactattatattaaaattcaattttatgctgc

SEQ ID NO: 5477 - DNA, 938 bp, Saccharum officinarum
tcctctcccctccaatggcgaccgccatttcctctctagtaactcctccggccctccaccgccgccgcctgagccctgcctccgtctccgtatccacccctatccgcatctccttccgggccgccgcggtgcctcaggcgtggcgccggggcttggcgttgcgggtgtccgcctcctcggcggtgctcgaggcgccagaggtggtggcggcgcggaagctctacgtcgggaatatccccaggaccgtcaccaatgacgagctccgcgacatgttcgctgcgcacggcaccgtcgagcgggccgaggttatgtacgacaagtataccaaccgcagccgacgattcgggtttgtcacgatgagcactgcagaagaagccaatgctgcagttgaggctctcaatgggaccgaggttggtgatcgaaaaattaaagtgaatgtcacagagagcttcttaccgaacattgaccgatcggcaccagaattggagcctgtatttgtggatagtcagtataaggtttatgttggtaatcttgcaaagactgtaacaacggaagttcttaaaaaattcttctctgaaaaggggaagatcctcagcgccacagtctcccacattccggggacctcgaaatcaaaggggtatggctttgtcacattctcttccgaggaagaagttgaagctgctgttgctactttcaataacgcggaattggaaggacaacccattcgtgtgaatagagcttagattagcagaaatttgcaggagcactagagggggaatatcttggcaaatacatgtagtacgagggatacttggagagtagattttgataacaaagtgatcaagaccttcaatgtgatttcgatatatcaaacaattttcgtaccataacaatgtatgtgaaggattttgcttgttcatacgattacagtttttctt

SEQ ID NO: 5478 - DNA, 1083 bp, Setaria italica
ttgctctaaacaccaaaccctctcgcgacaacggataaggcttttctgcctcgcctcctcccttcccaatcgctcgctcctctcctctcttcttcctccccgacaatggcgaccgccatttcctctctgattacccctccggccctccatctccgatgccggagccctgcctcggcctccgtctccgtctccgcccccgcccgcctctccttccgtgccgccgcggcgccgcaggcctggcgccgggggttggcgctgcgggtggccgcctcctcggcggtgctcgaggcgccggcggaggtggcggcgcggaagctctacgtcgggaacatcccccggaccgtcaccaacgacgagctccgcgacatgttcgccgcgcacggcaccgtcgagcgggccgaggttatgtatgacaagtacaccaatcggagccggcggtttggatttgtcacgatgagcaccgtggaggaggccaatgctgcaattgaggctctcaatgagactgaggttggtggtagaaaaattaaagtgaacgtcacagagagcttcttaccgaacattgatcgatcagcaccagaaccggagcctgtatttgtggatagtcagtacaaggtttatgttggtaatcttgcgaagactgtgacaacggaagttcttaaaaatttcttcgctgaaaaggggcagatactcagtgccacggtttcccacattcctgggacttcaaaatccaagggatacggcttcgtcaccttctcttccgaggaagaagttgaagctgctgttgctactttcaataacgcggaattggaaggacaacccattcgtgtgaatagagcttagattagcagaaatttgcatgaccattgaaggtggggggcatgtctcggtgaatacatgtagaatgagagatacttggaggctagattttgataaaaaagtgttcaagaccttcaatgtaatttcaatccatcaaacagttttcgtatgataacagtacatgtgaagagtttttcttgtcaaagtcattgttcatatgattgcatttggaccttttatttttacatcgcttctatttagttacac

SEQ ID NO: 5479 - DNA, 1142 bp, Zea mays
accaaacccactcgcaacaacggataacgctctcttccttcggctcctcccctctcgctcctatcctctcccctccaatggcgaccgccatttcctctctagtaactcctccgaccctccaccgccgctgcctgggccctgcctgcgtctccgtctccgtgtgcacccctatccgcatctccttccggcccgccgccgcgcctcaggtgtcgcgccggggctcggcgctgcgggtgtccgcctcctcggcggtgctcgaggcgccagaggcggtggcggcgcggaagctctacgtggggaatatccccaggaccgttacaaacgacgagctccgcgacatgttcgctgcgcacggcaccgtcgagcgggccgaggttatgtacgacaagtatacgaatcgcagccggcggtttgggtttgtcacgatgagcacagcggaagaggccaatgctgcagttgaggctctcaatgggactgaggttggtgatagaaaaattaaagtgaacgtcacagagagcttcttaccgaacattgaccgatcagcaccagaaccagaggctctgtttgtagatagtcagtacaaggtttatgttggtaatcttgcgaagactgtaacaaccgaagttcttaaaaacttcttctccgaaaaggggaatatcctcagtgcaacagtctcccacattccggggacctccaagtcaaaggggtatggctttgtcacattctcttctgaggaagaagttgaagctgctgttgctactttcaataacgcggaattggaaggacaactcattcgtgtgaatagagcttagattagcagaaatttgcaggggcaccggaggagggggaatatcttggcgaatacatgtagtaggagggatgttttgaggctagattttgataacaaagtgatcaagaccttcaatgtgatttcgatatgtcatacaatttttgtaccataacagtatatttttcttaacggcacttctaaatgataacataaaggcagtatggtttcagttatatagtatgtttgtttatttgaaacgaattctacaccatgtacattccaacattaatgttgtcagttcaatccctgactttgtcaaattagcttggggagcgatgtctgtaaggaaaat

SEQ ID NO: 5480 - DNA, 1003 bp, Panicum virgatum
gcaaaacaccaaacccactcgcgacaacggataacgctcttctccctcacctcgctcctctcctctccccttccctccccgccaatggcgaccgccatttcctccctgattacccctccggccctccacctccgctgccggagtacttcttcggcctccgtctctgtatccgcccgcctctccttacgtgccgtggcggcgccgcaggcccggggccgtgggttggcgctgcgggtagccgcctcctcggcgttgctcgaggcgccggcggaggtggcggcgcggaagctctacgtcgggaacatcccccggaccgtcaccaacgacgagctccgcgacatgtttgctgcgcacggcaccgtcgagcgggcagaggttatgtacgacaagtacacaaatcggagccggcgctttggatttgtcaccatgagcactgctgaagaggccaatgctgcaattgaggctcttaacgggactgaggttggtggtagaaaaattaaagtgaatgtcacagagagtttcttgccaaacattgatcgatcagcaccagaaccagagcctgtatttgtagatagtcagtacaaggtttatgttggtaaccttgcgaagactgtgacaacagaagttcttaaaaacttcttctctgaaaagggccagatcctcagcgccacggtttcccacattcctgggacttcaaaatccaagggatacggcttcgtcaccttctcttccgaggaagaagttgaagctgctgttgctactttcaataatgcggaattggaaggacaacccattcgtgtgaatagagcttagattagcaggaatttgcaggagcaccgaaggcagggggaatatctcggcgaatacatgtagaatgagggatacttggaggttagattttgataacagtgatcaagaccttcaatgtaatttcgatctgtcaaacaattttcgtaccataacagtgtatgtgaaggattttgtttgtcaaagtcattgttca

SEQ ID NO: 5481 - DNA, 1216 bp, Brachypodium distachyon
ttttgccatgagcagcgggccagcagcagtggagaggtttcgttttatctgcaagcaccggaatccggataacgttcttcctccgcttcgctccccccttcctgcagctccaatggcgaccaccgtttcctctctagtagcccctcactccctccaccgccgctgcttccggatccccgcttccgcctccgcctccacccgcctctcattccgcgccgcgccgccggccgtcgcggcggcgcgggcggggcgccgggcggcggtgcgcgtgcttgcctcctcagcggtgttggaggcgcccgaggagctggcgacgcggaagctctacgtggggaacatccccaggacggtcaccaacgacgagctccgcgccatgttcgccgaccacggcaccgtcctgcgggctgacgttatgtatgacaagtacagtggtcggagccggcgcttcgggtttgtcaccatgagctcggtggaggaggccaatgctgccattgagagcctgaatgagactgaggttggaggtcgaaaaattaaagtgaatgtgacagagagcttcctaccaaacattgatccatctgcacctgaaccggaacctgcgtttgttgacagccagtacaaggtttatgttggcaatcttgcaaagacagtgacgactgaagtgctcaagaacttcttctctgaaaagggggaggtcctcagtgcaacggtatcacgaattccgggaacaccaaagtcaaagggatatggttttgtgactttctcttcggaggaagaagtcgaagctgcggtttctactttcaataacacggaattggaaggacaacccatccgtgtgaatagagcataggaatctcacatctggcagatatttcgtgctggaggcaaagggaatgtcttggcgaacaccttgtagatggaggggaactttgagattagattttataacgaagtttaaaaggccttcgatgtgttttcactctggcactaaacattgttttgtgtaatagcagcatatggaaagattttgattgcgaaactcctggcacgttgtttaccatcatgtctaaacgactgcacaaaggcagcatggtttttcacttggttgttaattcttcttttcgtttaaatcaaattgtgtgcttgccagcaatactgttttgttggtttattttggacaccactgaacacctcttgtcgcgacaaaagtagagcgggg

SEQ ID NO: 5482 - DNA, 1191 bp, Brachypodium distachyon
gcagtggagaggtttcgttttatctgcaagcaccggaatccggataacgttcttcctccgcttcgctccccccttcctgcagctccaatggcgaccaccgtttcctctctagtagcccctcactccctccaccgccgctgcttccggatccccgcttccgcctccgcctccacccgcctctcattccgcgccgcgccgccggccgtcgcggcggcgcgggcggggcgccgggcggcggtgcgcgtgcttgcctcctcagcggtgttggaggcgcccgaggagctggcgacgcggaagctctacgtggggaacatccccaggacggtcaccaacgacgagctccgcgccatgttcgccgaccacggcaccgtcctgcgggctgacgttatgtatgacaagtacagtggtcggagccggcgcttcgggtttgtcaccatgagctcggtggaggaggccaatgctgccattgagagcctgaatgagactgaggttggaggtcgaaaaattaaagtgaatgtgacagagagcttcctaccaaacattgatccatctgcacctgaaccggaacctgcgtttgttgacagccagtacaaggtttatgttggcaatcttgcaaagacagtgacgactgaagtgctcaagaacttcttctctgaaaagggggaggtcctcagtgcaacggtatcacgaattccgggaacaccaaagtcaaagggatatggttttgtgactttctcttcggaggaagaagtcgaagctgcggtttctactttcaataacacggaattggaaggacaacccatccgtgtgaatagagcataggaatctcacatctggcagatatttcgtgctggaggcaaagggaatgtcttggcgaacaccttgtagatggaggggaactttgagattagattttataacgaagtttaaaaggccttcgatgtgttttcactctggcactaaacattgttttgtgtaatagcagcatatggaaagattttgattgcgaaactcctggcacgttgtttaccatcatgtctaaacgactgcacaaaggcagcatggtttttcacttggttgttaattcttcttttcgtttaaatcaaattgtgtgcttgccagcaatactgttttgttggtttattttggacaccactgaacacctcttgtcgcgacaaaagtagagcgggg

SEQ ID NO: 5483 - DNA, 1099 bp, Triticum aestivum
ccacgcgtccgccacaccggaatccggataacgttcttcccttgcctcctccctcctcgcttcgccaccccattcctcccctcacccgtgtcctctccagccactctagctccaatggcgaccaccatctcctctctagcggcccctccctccctccaccgccgctgctgccggagccccgcatccgcctcgacccccgcccgcgtgtcattccgcgccgcgcccccggccggcgcggcggcgcgggcgaggcgccgggcggcggtgaaggtgctcgcctcctccgcggtgatggaggcgcccgaggagctggccacgcggaagctctacgtggggaacatccccaggaccgtcaccaacgacgagctgtcggccatgttcgccgcacacggcaccgtcgtgcgggccgaggttatgtatgacaagtatagtggtcggagccggcgattcgggtttgtcacgatgagcacggcggaggaggtcgctgccgccattgagagcctgaatgacaccgaggttggaggtagaaaaattaaagtgaatgtgacagagagcttcttaccaaacattgatacatctgcaccggaatcggaaccttcatttgtggacagccagtacaaggtttatgttggcaatcttgcaaagaaagtgacaacggaagtgctcaagaacttcttctctgaaaaaggggaggtcctcagtgccacggtatcccgaattccgggaactccaaagtccaagggatatggttttgtcacgttttcttcagaggaagaagtggaagctgcggtttctactttcaacaatgcagaattggaaggacaaaccatccgtgtgaatagagcataggcatagcagaaatttcacattggagtcaaggggagaatatcttggagaacacctgtagacgaggggaagtttgagactagattttataacaaagttttaaaggcctttgatgtaatttcactctggctctaagcaattttttgtataataacaacaaatggaagaattttgattgtcaagcccgttgttcatatgaagcagctgttgtttaccagcatttctaaatgattgctcatgagcagcatggttt

SEQ ID NO: 5484 - DNA, 1105 bp, Triticum aestivum
tcgcttcgccaccccattcctcccctcacccgtgtcctctccagccgctccagctccaatggcgaccaccatctcctctctagcggccccacccgccctccaccgccgatgctgccggagccccgcatctgcctcgacccccgcccgcgtgtcattccgcgccgtgctgccggccggcgcggcggcgcgggcgaggcgccgggcggcggtgaaggtgctcgcctcctccgcggtgatggaggcgcccgaggagctggccacgcggaagctctacgtggggaacatccccaggaccgtcaccaacgacgagctgtcggccatgttcgccgcacacggcaccgtcgtgcgggccgaggttatgtatgacaagtatagtggtcggagccggcgattcgggtttgtcacgatgagcacggcggaggaggtcgctgccgccattgagagcctgaatgacaccgaggttggaggtagaaaaattaaagtgaatgtgacagagagcttcttaccaaacattgatacatctgcaccggaatcggaaccttcatttgtggacagccagtacaaggtttatgttggcaatcttgcaaagaaagtgacaacggaagtgctcaagaacttcttctctgaaaaaggggaggtcctcagtgccacggtatcccgaattccgggaactccaaagtccaagggatatggttttgtcacgttttcttcagaggaagaagtggaagctgcggtttctactttcaacaatgcagaattggaaggacaaaccatccgtgtgaatagagcataggcatagcagaaatttcacattggagtcaaggggagaatatcttggagaacacctgtagacgaggggaagtttgagactagattttataacaaagttttaaaggcctttgatgtaatttcactctggctctaagcaattttttgtataataacaacaaatggaagaattttgattgtcaagcccgttgttcatatgaagcagctgttgtttaccagcatttctaaatgattgctcatgggcagcatggtttattcactttgttgttgatgtttcttttcttcacttgcatcaaattgtatgctttcagcaaga

SEQ ID NO: 5485 - DNA, 2225 bp, Zea mays
aagatctttcccaaaattccagtggaatccgcacagcggagcgctgcctgagtccgtccccgttgcttgggtgcctgtgccggacgcccgcagtcccaccgtcccaactctcaaccccagcgcagcagcctgcaccacaccagaaaccacaccaccacgctcaccgccgtgagcccgtgacccccacgtccccccacactacggcacgtcggcaccagcttaactcccggtccgcggcgacacctcaccatcgcgcgcgcacacacacgagcgtgcgccgctccctgttcctcgtgacccccctccccgcctcccctctctctctcacacacacacacacaagtcggtgctgcagcagcagcagtcgcagtccagccgtgagctcttgccgtgcgagcgattcaccgcagggcgcacgggaatccaatcaaatcccccaggaaggtagccccgcggccgcccgttcctcgctccgccccgcgccgacgcttctccccgatcccgatctgtgcgcccgcatcctgcgtgggatggaggcggcgccgcggcggcagcagcaggaggaggaggggtgcccgtgcggcgggcccgaggccgcggaccacttcgagcggctccacgacgcggtgctgctcgacgtcctcaaccgcatcggcgacgtcaaggcgctcggccgctgcgccctcgtctcgcgccgcttccacgcgctcgtgccgctcgtcgactccgtcttcgtccgcgtcgactgcgtcatccccgacgacccaccctcttcctcctccgcgggcgccgcaccgggctccccgccgcaccaggcgccggcgccaaccgcgcgcgggcgcggcgcgctcgcgcgcgtcgcgcgcgccctgctcggcggcgtcgctaggcccatccacgcgctcggccagatcctctcctccgccgcggcgaccgtctcccggcgctccgagccacttcccgcttccccgccgcccgcgcccgttgcggacgtctcccaccactcgccctccgaggtgctccgctccttcagggagctgcggcgccttcacatcgagctgcccacgggcgagctcggcattgacgacggcgtgctccttaagtggaaggccgacttcggctccaccctcggcagctgcgtgatcctcggcgcctcgtcggtctcgtccaaatcgccggcagggtccgctcaggcggaaactgctgcggccgacagcgcggccgccgctcccgataccggtagggagactgaagagccggggagcctgcctgattctctctacacaaatggagggcttaagctccgcgttgtctggaccatcagctccctgattgccgcgtcggcgaggcattacttgctgcacccgattatctgtaatcacggaacgcttgagagcttggacctgacagatgccgacgggcaaggggtgctcaccatggacaagaggcagctgcaggaactgcgggtgcggcccgtctctccatcagggagctcgcaccgcacactcatgccggcactcagtatgcgtctgcactacgcaccactcattgaactgcctgggggaacgctgctgaaaggtgcaacactagtggcgatcagaccaagcgaggatgccttgagggagggccaaggggttgcaggtcctgctggtacatgctggatttcagaggcctttgaggagccatatcggactgcggcaaaggtgctcctcaagagaagggcatattgccttgaaatgaactcgttctgagcaccagggattcacttccacagagttctacccatctgacaggatgggggaagtgagatgcccttcggttaatatatgggaattcatcattcagtgcaaaaattggaccaactctccccatcattaatttatctgatctcggtgaagagatgacttcgtgtacctgtacctttagggttgtaattacagatacgtatttgtgctggactactacacgcggaacggaatgctatttggccgattcccacagagtgtcccatgaagagaagccgtatcacttgagcgtttgagcgtgacgctcctgggccaagctggcattatacttcttttctcaaaggaagcaccagagatttcgtttttagcagggcctttttgcttaaatcttaccgagtcatgctcctagcactgcaatactgcgtcaatttatactcattgttataaaaaaattatagactcgaatataatgtccctttt

SEQ ID NO: 5486 - DNA, 1763 bp, Zea mays
atgccaccacaccaccgcgctgccgtgaccctggacctggagcctgacccggaccctcaactacgggcctacggcaccagctactcgccataccagcagtacagccgtgagcttgtgccgtgccgtcggccgtcccgtgcagactaccagcgagcgatccaccgcaagggaatccaatcaaatcccccagcaagtcagccccgccccgcgccgacgcctctccccgatcccgatctgtgtgcctggctgcctgcaacctccgtgggatggaggcggcgcggcagcagcaggaggagtgcccgtgcggcggggccgaggccgctgaccagttcgagcggctccacgacgcggtgctgctcgacgtcctcaatcgcatcggcgacgtcaaggcgctcggccgctgcgccctcgtctcgcgccgcttccatgcgctcgtgccgctcgtcgactccgtcttcgtccgcgtcgactgcgtcatccctgacgacccgccgccctcgtcctcctcttccgccgcaccaggcacctcgccgcggcaggcgccagccccggccgcgcgcgggcgcggcgcgctcgcgcacatcgcgcgcgtcctgctcggcggcatcgccaggcccatccacgcgctcggccagatcctctcccccgccgccgcggccgtctcccggcgctccgaggcactgcccgcttccccgcgcgcgcccgtcgcggacgtctctcaccactccccctccgaggtgctccgctccttcaaggagctgcggcgccttcacatcgagctgcccacgggcgagctcggcattgacgacggtgtgctccttaagtggaaggccgacttcggctccaccctcgtcagctgcgtcatcctcggcgcctcgtcgatctcgtccaagccgccgacagggtacactcaggcggaatcggaaactgctgcggccgccactcccgataccagtcgggagactgaagagccggggagcctacctgattctctttatacaaatggagggctcaagcttcgcgttgtctggaccatcagctccctgattgccgcgtcggcgaggcattacttgctgcagccgattatctgtaatcacgaattgctggagagcttggacctgacagatgctgacgggcaaggggtgctcaccatggacaagaggcagctgcaggaactgcgggtgcggcccgtctttccgtcagggagctcgcaccgcaccctcatgccggctctcagtatgcgtctgcactacgcaccgctcattgagctgcctgggggaacgctgctgaagggtgcgacactagtggcgatcaaaccaagcgaagatgccttgagggagggccaaggggccggggctgcaggtcctgttggtacatgctggatttcagaggcctttgaggagccatatcggactgcggcaaaggtgcttctcaagagaagggcatattgtcttgaaatgaactcgttctgagcacctagggggtttacttccacagagttctacccttctgacaggatggtgggaagtgggacgccgttcagctaatacaggggaatttattattcagagcagaaattggacgaagatacatctatttccccatctgttgtatctgatttcggtgaaatggtgacttcgtgtacctgtaactttagggctataattacagatatgtatttgtgctggactactacacgcggaatggaatgttatttgggccgatttccgcagtagtgtgaactgttccaaaagactttgggg

SEQ ID NO: 5487 - DNA, 2055 bp, Setaria italica
accacgggtaccagcttaactcccagtccccggctgacacctcatcgtccgcacgcgcacccctcacccagtcacccccacacgagagccgatcccccgattacccgtgaccccctctcctctctcgcacttgcaggagtccagccgtgagccgtgccgtgccgactaccaggctccaggctaccagccagcaatccgccgcaggggaatctaatcggagtccccgaggcagccccgcggccgaccggctctccgcccctcgccgcgccgcaccgacgactctctcagtccggatcccgatctgcgtggccgcgtgggtgagcggatggaggcggggcggcagcagcaggaggaggcggaggagggttgcccgtgcggcggggcggaggccgaggccggggaccagttcgaccggctccacgacgcggtgctgctcgacgtcctcaaccgcatcggcgacgtcaaggcgctgggccgctgcgccctcgtctcgcgccgcttccacgcgctcgtcccgctcgtcgactccgtcttcgtccgcgtcgactgcgtcatccccgacgacccgccgcaccccgcgcccccggcacccggctccccgcagcaccagcagcagcagcaccaggcgccggccgcgcgagggcgcggcgcgctcgcgcacatcgcgcgcgtcctgctcggcggcatcgccaggcccatccacgcgctcggccagatcctctcccccgccgccgcggccgtctcccgccgctccgagccgcagcccgcctccccgcccgcgcccgccgcggacgtctcccaccattcgccctccgaggtgctccgctccttcaaggagctccgccgcctccacatcgagctgccctcgggcgagctcggcatcgacgaaggcgtgctcctcaagtggaaggccgatttcggctccaccctcggcagctgcgtcatcctcggggcctcgtcggtctcgtccaagacgacgtcgccgtctgctcagcccgaaactgacgccgccgacagcacggacacctcacccgatcccaacagggagactgaagacctggggagcgtgcctgagtcgctctataccaatggaggcctcaagcttcgcgtcgtctggaccatcagctcgctgattgctgcgtcggcgaggcattacttgctgcagccgataatttctaatcacgcaacgctggagagtttgaacctcactgacgctgacggacagggggagctcaccatggacaagaggcagcttcaggagctgagggtgcggcccgtctcggcgtcagcaagctcgcatcgcacgctcatgccggcgctcagcatgcgactgcactacgcgccgctcatcgagctgcctgggggaatgctgctgaagggtgccacgctggtggcgatcagaccaagcgaagatgccttgaggggggagggtcaaggggttgggactgctggttctgtcggtacatgttgggtttcagaggcctttgaggagccatatcgaactgcagcaaaggtgcttctcaagagaaggccgtattgccttgaaatgaactcgttctgagcatcacggattcagttccagagagttccacccttatggcaggactgtgggatgctttttggatgaatataggagtatttatcattcagtgcaagaatcggacaaagacgcctcccatccgttgattattccagcgtagtggtgactttgcgtacctgtaagtatatatacatgtttgcgttgggttactacaggctggaatgccattggagtcgaatctacagcaaagcaatatgaagggaagccatgcaatgtgcctcacttgagcttggtgctcctaggccaagctgacattatactttcctcaaggaagccccgaagattttgttatttagcaagcagcaccttttttttttgcttaaatctttgaggggtcatgctcctggcactgtatcaaatatagactaatataccgtccttttcggaaaagttagccctgctgtccgtttctaggcgttatgtgcgcgagactacctttcatcctagctgaattt

SEQ ID NO: 5488 - DNA, 1499 bp, Setaria italica
tgaccccctctcctctctcgcacttgcaggagtccagccgtgagccgtgccgtgccgactaccaggctccaggctaccagccagcaatccgccgcaggggaatctaatcggagtccccgaggcagccccgcggccgaccggctctccgcccctcgccgcgccgcaccgacgactctctcagtccggatcccgatctgcgtggccgcgtgggtgagcggatggaggcggggcggcagcagcaggaggaggcggaggagggttgcccgtgcggcggggcggaggccgaggccggggaccagttcgaccggctccacgacgcggtgctgctcgacgtcctcaaccgcatcggcgacgtcaaggcgctgggccgctgcgccctcgtctcgcgccgcttccacgcgctcgtcccgctcgtcgactccgtcttcgtccgcgtcgactgcgtcatccccgacgacccgccgcaccccgcgcccccggcacccggctccccgcagcaccagcagcagcagcaccaggcgccggccgcgcgagggcgcggcgcgctcgcgcacatcgcgcgcgtcctgctcggcggcatcgccaggcccatccacgcgctcggccagatcctctcccccgccgccgcggccgtctcccgccgctccgagccgcagcccgcctccccgcccgcgcccgccgcggacgtctcccaccattcgccctccgaggtgctccgctccttcaaggagctccgccgcctccacatcgagctgccctcgggcgagctcggcatcgacgaaggcgtgctcctcaagtggaaggccgatttcggctccaccctcggcagctgcgtcatcctcggggcctcgtcggtctcgtccaagacgacgtcgccgtctgctcagcccgaaactgacgccgccgacagcacggacacctcacccgatcccaacagggagactgaagacctggggagcgtgcctgagtcgctctataccaatggaggcctcaagcttcgcgtcgtctggaccatcagctcgctgattgctgcgtcggcgaggcattacttgctgcagccgataatttctaatcacgcaacgctggagagtttgaacctcactgacgctgacggacagggggagctcaccatggacaagaggcagcttcaggagctgagggtgcggcccgtctcggcgtcagcaagctcgcatcgcacgctcatgccggcgctcagcatgcgactgcactacgcgccgctcatcgagctgcctgggggaatgctgctgaagggtgccacgctggtggcgatcagaccaagcgaagatgccttgaggggggagggtcaaggggttgggactgctggttctgtcggtacatgttgggtttcagaggcctttgaggagccatatcgaactgcagcaaaggtgcttctcaagagaaggccgtattgccttgaaatgaactcgttctgagcatcacggattcagttccagagagttccacccttatggcaggta

SEQ ID NO: 5489 - DNA, 1335 bp, Saccharum officinarum
cgactcgactcgattcatccgttcggttcccctccccgttccactaccctcgagaagcttccgccctcccctcccgcgccgccgacggcagggccgcggaaaccctagccaccgccggccctccgcgcaccacgtgccccgccgccgccgacactgacgaagcgatcggatctcgagaccgtcaggagccacgacggaggactgggagtaaagagaaatggatgccgatgatagctccaagagaagtcgcccagttcgtcgtgctgtgaagaagctcaggttcaaaccaaaggtgcctccacagaagccaaagaaactgagtgcacaaaagccacagcaagaagaccctaagccaattgatgaagagttgatgaagatattgaggactcgccaagtggctgcaaaaagttcaccaaatacaaaagatgagcgcccaacacagaataccccctcgacaccaccttctgcagatgctgttagcttgtcaccagcacaattcggagtgcaaaaacaaaatcaattgccactccaaattcctagatccttccctgttcctgttaattcaggaatgttttacaaagaagatagtgatgacgacgacgacgataatggtagtgacaatgttgagttgcaggagactcagccagattcaattgaatgtgaagctttaacacgtccagcagaggagcttgatttgcttcagcaacaaggtagcaaagaaagaatgttcctcttccagctcccaaaatctcttcctttgcccaaaaggtcgtccagtaccagtatagttgaaagacaaggaaaggccactggcaaggaggtgaaggaaggatccaacttgcagcagctgcctcagggttatttgggcaaaatgctggtatacaagagcggcaagatcaaaatgaagctaggagatatcatgtttgatgtgagcccaggagcagaaactaggatggtgcaacatgtagtagctctgaacactcgagacaaacattgttgcttacttggggagattgagaatcggcatgttattgtgactcccgatgttgattctttgttgaacaagtagagattaggttgttatctgtagcaactgtagcagctttgtcacatattgtgtgtagacttgtaggtagttagctacgcagggttgggctacatctgtagcaactgtatcagccttgtcaaatggtgtataggattttagttgtgcagtgttgtgtacgttttactgtgattgtactactatgttagttttagaactgcccagttgatgaatgtttgtaataattgacattggaccttagtggtattggaagaaaataaatcacatcg

SEQ ID NO: 5490 - DNA, 1238 bp, Saccharum officinarum
cagtgacccccgccgccgcctccgcctctttttccaacgcctccgcctacccccaccaccaccaccaccatctccggcggtccgcgtagcccgcgcagatggccacggcggccacggcgtccgcgacggcggcgacccgcttcacgctcctagcgggcgcgggcctccgcagccgcatcagccgccaccccaccgccgtgcggttccagcgccagcgggggctcaccaccaccgcgctcctaaagaccgccgacctcctgcccaaggcgcagggccagcctgagacgctcgactaccgcgtgttcctcgtcgacggcgggggccggaaggtgtcgccgtggcacgacgtcccgctgcgcgccggggacggggtgttccacttcgtcgtcgagatccccaaggagagcagcgccaagatggaggtcgccaccgacgaggccttcacgcccatcaagcaggacaccaagaagggcaaccttcgatactacccgtacaacattaattggaactatgggttacttcctcaaacatgggaggacccgacttctgcaaattctgatgttgaaggagcatttggggataatgatcctgttgatgttgttgagataggtgaaagacgtgccaatatcggggatgttcttaaggttaaaccattggcagctttagcaatgattgatgagggggagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacagatttggtctcggcaacaagcccgcaagcaaggaatatgccctgaaggtcattgaagagaccaacgaatcatgggagaaattggtaaagaggaatattcccgctggagagctctcgttagcctaatcttggcccatgggaagccaccacattctttgaactgctttcataagcatgtcgttttgtatgctgtcaccatgcttcttcgtttgcattccaaacctttttacgaactgtttaacaaaaataatcttgtcggaagaataatgattctggtgcgagcttatcagaagggcaaggaatgtttcttaagtaatggtcatgttttccaaacacagaaacgtgtaatttatgaagttggaacactattgaactgagcaaaagccgtttgaggtcgtt

SEQ ID NO: 5491 - DNA, 1281 bp, Setaria italica
ccccgagctaatccttggcctcgtcatccgcagcccccactcctcagtggccaccgccgccgcctcctttttccaactcctccttcctccaccaccaccgtacccggcggcccccggagcccgcgcagatggcgaccgcggccacggcgtccgcgaccgcggcgacccgctttacgctcctagcgggcgccggcctccgcagccgcgccgcccgcctccccactgccgtgcggttccagcgccagcgggggctcaccaccaccgcgctcctcaagaccgccgacctccgccccaaggagcagggccagcccgagacgctcgactaccgcgtgttcctcgtcgacggcgggggccggaaggtgtcgccgtggcacgacgtgccgctgcgcgccggggacggggtgttccacttcatcgtcgagatccccaaggagagcagcgccaagatggaggtcgccaccgacgaggccttcacgcccatcaagcaggacaccaagaagggcaacctccgatactacccgtacaatattaattggaactatggattgttgcctcaaacatgggaggacccgacttctgcaaattctgatgtggaaggagcattcggagataatgatcctgttgatgttgttgagataggtgaaagacgtgccaatattggggatgttcttaaggttaaaccattggcagctctagcaatgatagatgagggggagcttgactggaaaattgtggccatttctttggacgaccccaaagcatctcttgtgaatgatgtggatgatgttgagaagcattttccggggacactgactgccatcagagactggttcagagactacaagataccagatggaaagcctgccaatagatttggtctcggcaacaagcccgcaagcaaggaatatgctctgaaggtcattcaggaaaccaacgaatcatgggagaaattggtgaagaggaatatccctgctggagagctctcactagcctaatcttctttggtccatgggaagccacaacattctttgaactgcattcttcttaagcatgtcgttttgtatgctgtaagcatgcttcttcatttgcagacctttttgcgaaccgtttaacaggaataatcttgtcgagtgaataatgattctggagcgagttctccataatgcaacgctggagaggaattattcttgagcgactgaatattattgcgtgtatcactctctccctcaaaaactgaaaaataaataaagataagaagcatgttttccaaaatggaaactc

SEQ ID NO: 5492 - DNA, 1199 bp, Panicum virgatum
aatccttggcctcgtcatccggagccccgagtcccagtggccgccgccgcctcatcctcctttttccaactccgcctccaccagccccctatccccggcggaccccggagcccgtgcagatggcgaccgtggcgacggcgtccgccacggcggcgacccgcttcacgctcctagctggcgccggcctccgcagccgtgccagccgcctccccaccgccgtgcggttccagcgccagcgggggctcaccaccaccgcgctcctcaagaccgccgacctccggcccaaggagcagggccagcccgagacgctcgactaccgcgtcttcctcgtcgacggcgggggccggaagttgtcgccgtggcacgacgtgccgctgcgcgccggggacggcgcgttccacttcatcgtcgagatccccaaggagagcagcgctaagatggaggtcgccaccgacgaggccttcacgcccatcaagcaggacaccaagaagggcaacctccgatactacccgtacaatattaattggaactatggattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgagggggagctcgactggaaaattgtggccatttctttggatgacccaaaagcatctcttgttaatgatgtggatgatgttgagaagcattttccggggacactgactgccatcagagactggttcagagactacaagataccagatggaaagcctgccaacagatttggtctcggcaacaagcccacaagcaaggaatatgcgctgaaggtcattgaggaaactaacgaatcatgggagaaattggtgaagaggaatatccctgctggagagctctcactagcctaatctcgaggccatgagaagccacaacattctttgaaccgcgtttttcttgatcatgtcgttttgtatgctgtaactatgtaagcatgcttcttcattttgcagacgttttttcgaactgtgtaacaggaataatcttgtcgggtgaataatgattctggagcgagtttttactagaatggcaatgtttgcgatgaatgtttctttttagcaacc

SEQ ID NO: 5493 - DNA, 1107 bp, Panicum virgatum
cgccgcctcatcctcctttttccaactccgcctccaccagtcccctatccccggcggaccgcgcagatggcgaccgcggcgacggcgtccgccacggcggcgacccgcttcacgctcctagcgggcgccggcctccgcgcccgcgccggccgcctccccaccgccgtgcggttccagcgccagcgggggctcaccaccaccgcgctcctgaagaccgccgacctccgccccaaggagcagggccagcccgagacgctcgactaccgcgtgttcctcgtcgacggcgggggccgcaaggtgtcgccgtggcacgacgtgccgctgcgcgccggggacggggcgttccacttcatcgtcgagatccccaaggagagcagcgccaagatggaggtcgccaccgacgaggccttcacgccaatcaagcaggacaccaagaagggcaacctccgatactacccgtacaatattaattggaactatggattatttcctcaaacatgggaagacccgactactgcaaattctgatgttgaaggagcattcggagataatgaccctgttgatgttgttgagataggtgaaagacgtgccaatattggggatgtccttaaggttaaaccattggcagctttagcaatgattgatgaaggggagctcgactggaaaattgtggccatttctttggatgaccccaaagcatctcttgttaatgatgtggatgatgttgagaagcattttccggggacactgactgccatcagagactggttcagagactacaagataccagatggaaagcctgctaacagatttggtctcggcaacaagcccacaagcaaggaatatgctctgaaggtcattgaggaaaccaacgaatcatgggagaaattggtgaagaggaatatccctgctggagagctctcactagcctaatcttgagtccatgagaggccacaacattctttgaaccgtgtttttcttgatgatgtcgttttgtatgctgtaactctgtaagcgtgtttcttcattttgcagatgtttttgcgaactgtgtaacaggaataatcttgtcgggttaataatgattctggagcgagtttactagaa

SEQ ID NO: 5494 - DNA, 1165 bp, Pennisetum glaucum
gcgaatccttcttggccttcgtcatccgcagtccccactccccagtggccgccgccgcctcctcctcctcccttttccaactcctccctcccttcctccaccaccacccgtacccggcggcccccggagcccgtgcagatggcgaccgcggccacggcgtccgcgaccgcggcgacccgcttcacgctcctagcgggtgccggcctccgcagccgccgcgtcgcccgcttccccaccgccgtgcggttccagcgccagcgggggctcaccaccaccgcgctcctcaagaccgtcgacctccgccccaaggagcagggccagcccgagacgctcgagtaccgcgtgttcctcgaggacggcggcggccggaaggtgtcgccgtggcacgacgtgccgctgcgcgccggggacggggtgttccacttcatcgtcgagatccccaaggagagcagcgccaagatggaggtcgccaccgacgaggccttcacgcccatcaagcaggacaccaagaagggcaacctccgatactacccgtataatattaattggaactatggattattgcctcaaacatgggaggacccgactactgcaaattctgaggtggaaggagcattcggtgataacgatcctgttgatgttgttgagataggcgaaagacgtgccaatatcggggatgttcttaaggttaaaccattggcagccctagcaatgattgatgagggggagcttgactggaaaattgtggccatttctttggacgaccccaaagcatctcttgtgaatgatgtggatgatgttgagaagcattttccggggacactgactgccatcagagactggttcagagactacaagataccagatggaaagcctgccaacagatttggtctcggcaacaagcctgcaagcaaggaatatgctctaaaggtcattgaggaaaccaacgaatcatgggagaaattagtgaagaggaatgtcccagctggagagctctcactagcctaatctttggtccatgggaagccacaacattctttgaactgcattcttcttaagcatgttgttttgtatgctgtaagcatgcttcttcatttgcaaacctttttgcgaaccgtttaacaggaataatcttgtcgggtgaataatgatgctgtactattta

SEQ ID NO: 5495 - DNA, 1810 bp, Oryza sativa
ccgcacttgtctgcgactgcgaccacatcacgggggtgggcccacctggtcaggctagctaccacgcgagccgcaagtacccatcgcctcgtcatccggagagactagctcccactttccagtctcccgccgccgccgccgctgttcactccgcaccaactccgacgatcccccggcgagctctcgacgatggcgacggcggcgacggcgtcggctacggcggccacccgcttcacgcggctggcgggggtcgggctccggcgcacggcccgcctccccacggccgtgcggttccagcgccgggtgctcgccaccaccgcgctcctcaggaccgccgagctccggcccaaggagcagggcctgcccgagacgctcgactaccgcgtgttcctcgtcgacggcgggggccgcaaggtgtcgccgtggcacgacgtgcccctgcgcgcaggcgacggggtgttccacttcgtcgtggagatccccaaggagagcagcgccaagatggaggtcgccaccgacgagtcattcacccccatcaagcaggacaccaagaagggcaacctccgatactacccgtacaacattaattggaattatggattatttccccaaacatgggaggacccaactcttgcaaacaccgatgtcgaaggagcatttggggataatgatcctgttgatgttgttgagattggtgaaagacgtgctaacattggagatgttcttaaggtaaaaccgttggcagctttagcaatgattgatgagggtgagcttgactggaaaattgtggctatttctttggatgatcctaaagcatctcttgtgaatgatgtggatgatgttgagaagcattttccgggaacattgactgccatcagagactggttcagggactacaagataccagacggtaagcctgcaaacagatttggtctgggcaacaaacccacaagcaaggaatatgctctgaaggtcatagaagaaaccaacgaatcatgggagaaattggtgaaaaggaatatccctgctggagagctctcactagcctaatcttgtccatgagaagccatcagattcttttggtcatttacctaagcatgttgttttcataagctataagcatgctgcttcttgcgaactctttggtgacctgtgtgcaacaggaacagcttgtggagtgaataaggctttctgagctagtttttctaagggaattgggtgttcttgagcagcgattgtgtttggaacaagctttacaaagtgaacaatcagtttagaagttgaatgataagcaaatatagtttcaacattgtaatcattaaccaagatggcctaattgttttttaccacaccatgtagtaaatatcgaaatgctgaccccttacacttgaaaatgcactaatatgacagatacagaagttagcatacgatttacaaacaggttaagccactaaatcattttcacatctaaatctgacgggagaacggccaaagcaaccgttatgaacctaaattatttgatacagtcgaaaatgagttccacttgattcttggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtaccctggcctcgtcaatcatcaaccgagtacaatgcttcgaccagccaatacaaaaggcattgcagatatatgtacccagacccagctctatctaaaccaccatcttgtacctgc

SEQ ID NO: 5496 - DNA, 1154 bp, Hordeum vulgare
ccactttccagtccgcagtgaccgccgccgccgccacctccacccgctcctcaccaacccccggcgacaccccgaatggcgacggcggtcacggcgtccgccaccgcggcgactcgcttcacgcgcctggcgggcgtcggcctccggcgcagcagctaccgcccccgcaccgccgtccgcttccagcggccgggactcaccaccaccgcgctcctcaggcccaccgagctcaagccaaaggaccagggccagcccgagacgctcgattaccgcgtcttcctcatcgacggcggcggccgcaaggtgtccccgtggcacgacgtgccgctccgcgccggggacggggcgttccacttcatcgtggagatccccaaggagagcagcgccaagatggaggtcgccaccgacgaggcctacactcccatcaagcaggacaccaagaagggcaacctccgttactacccctacaacatcaactggaactatgggttacttccccagacatgggaagacccgacagctgcaaatgctgatgttgaaggagcacttggagacaatgatcctgttgatgttgtcgagattggtgaaagacgggccaatattggggatgttcttagggtgaaaccattggcagctttagcgatgattgacgaaggagagcttgactggaaaattgtggccatttctttggacgatcccaaagcatctcttgtgaatgatgtagatgatgtcgaggagcattttccgggaacgttgactgcaatcagagactggttcagagactacaagatcccagacgggaagcccgccaacagattcggcttgggcgacaagcccacaagcaaggaatatgccctgaaggtgatagaggaaaccaacgagtcatgggagaaattggtgaagaggaaaatcccggcgggagagctctcgctagcctagtagcctttcataggccccatgagaagccgacgacacattctttcagtgacatacccataagtgtgctgctcttttgtgacacataactatgaccatgcttcttcatctgcaaaacattccgtgtacctgttaaaacaggaaataatgattgaataatcaatctggtggcgcgaataaggatttcctgagccaagttttttcacaatgaaaccgaa

SEQ ID NO: 5497 - DNA, 1297 bp, Hordeum vulgare
gggtagggcccacctagcatagcccgtagccaccaccacgcaaaatccgcaaaaagtttcatcgcctcgtcatccgcagctccactttccagtccgcagtgaccgccgccgccgccacctccacccgctcctcaccaacccccggcgacaccccgaatggcgacggcggtcacggcgtccgccaccgcggcgactcgcttcacgcgcctggcgggcgtcggcctccggcgcagcagctaccgcccccgcaccgccgtccgcttccagcggccgggactcaccaccaccgcgctcctcaggcccaccgagctcaagccaaaggaccagggccagcccgagacgctcgattaccgcgtcttcctcatcgacggcggcggccgcaaggtgtccccgtggcacgacgtgccgctccgcgccggggacggggcgttccacttcatcgtggagatccccaaggagagcagcgccaagatggaggtcgccaccgacgaggcctacactcccatcaagcaggacaccaagaagggcaacctccgttactacccctacaacatcaactggaactatgggttacttccccagacatgggaagacccgacagctgcaaatgctgatgttgaaggagcacttggagacaatgatcctgttgatgttgtcgagattggtgaaagacgggccaatattggggatgttcttagggtgaaaccattggcagctttagcgatgattgacgaaggagagcttgactggaaaattgtggccatttctttggacgatcccaaagcatctcttgtgaatgatgtagatgatgtcgaggagcattttccgggaacgttgactgcaatcagagactggttcagagactacaagatcccagacgggaagcccgccaacagattcggcttgggcgacaagcccacaagcaaggaatatgccctgaaggtgatagaggaaaccaacgagtcatgggagaaattggtgaagaggaaaatcccggcgggagagctctcgctagcctagtagcctttcataggccccatgagaagccgacgacacattctttcagtgacatacccataagtgtgctgctcttttgtgacacataactatgaccatgcttcttcatctgcaaaacattccgtgtacctgttaaaacaggaaataatgattgaataatcaatctggtggcgcgaataaggatttcctgagccaagttttttcacaatgaaaccgaatgaatgctctctggtccagttattaattactcctagtgtcaaatgagaagatgcatttgccg

SEQ ID NO: 5498 - DNA, 1127 bp, Pseudoroegneria spicata
  misc_feature (48)..(48): n is a, c, g, or t
  misc_feature (1033)..(1033): n is a, c, g, or t
  misc_feature (1072)..(1072): n is a, c, g, or t
  misc_feature (1101)..(1101): n is a, c, g, or t
ccgttgctgtcggccgtctccacccgctcctcacctaccccggcggcnacccccaggaacatcccgaatggcgacggcggtcacggcgtccgcgacggcagcgacccgcttcacgcgcctggcctgcgtcggcctccggcgcagcagctgccgcccccgcaccgccgtgcgcttccagcgcccggggctcaccaccaccgcgctcctcaggcccaccgagctcaagcccaaggaccagggccagcccgagacgctcgactaccgcgtcttcctcgtcgacggcgccgaccgcaaggtgtccccgtggcacgacgtgccgctccgcgctggggacggagctttccacttcatcgtggagatccccaaggagagcagcgccaagatggaggtcgccaccgacgaggccttcacgcccatcaagcaggacaccaagaagggcaacctccgttactacccgtacaacatcaactggaactacgggttacttccccagacatgggaggacccgacagctgcaaatgctgatgttgaaggagcacttggagacaatgatcctgttgatgttgtcgagattggtgaaagacgggccaatattggggatgttcttagagtgaaaccattggcagctttagcgatgattgacgagggagagcttgactggaaaattgtggccatctctctggatgatcccaaagcatctcttgtgaatgatgtagatgatgttgaggagcattttccgggaacattgactgctatcagagactggttcagagactacaagataccagacggaaagcccgccaacagattcggcctcggcaacaagcccacaagcaaggaatatgccctgaaggtgatagaagaaaccaacgagtcatgggagaaattggtgaagaggaaaatccctgcgggagagctctcgctagcctagccttttataggcccatgagaagccaacaacacattctttcagtgacatacctcctaagcgtgctgctcttttgtgatatatacctatgaacatgcggaaatncaattcggctcctagcacgtgctcctgcctatggaaaangaattttgaaatgtcaaaaaaattggganaaatttttttggtgatctttgtcaca

SEQ ID NO: 5499 - DNA, 1137 bp, Avena sativa
ctcccacccacccccagggccaccgcgaatggcgacggcggtcacggcgtccgcgacggcggcgacccgcttcacgcgtcttgcgggcgccggcctcctgcgcagcagctgccgcctccgcaccgccgtccgcttccagcgcccggggctcaccaccaccgcgctcctcaggcccaccgagctcaagcccaaggaccagggccagcctgagacgctcgactaccgcgtcttcctcgtcgacggcggcggccgcaagatttccccgtggcacgacgtgccgctccgcgcaggggacggggtgttccacttcatcgtggagatccccaaagagagcagcgctaagatggaggtcgccaccgacgaggcctttacgcccatcaagcaggacaccaagaagggcaacctccgttactacccgtacaacatcaactggaactatgggttacttccccaaacatgggaggacccaactgctgcaaatgctgacgttgaaggagcacttggagacaatgatcctgtcgatgttgttgagattggtgaaagacgagctaatatcggcgatgtacttagggtgaaaccattggcagctttggcaatgattgacgagggagagcttgactggaaaatcgtggccatttctttggatgatcccaaagcatctcttgtgaatgatgtagatgatgtcgaggagcattttccgggaacattgactgctatcagagactggttcagagactacaagataccagacggtaagcctgccaacagatttggcctcggcaacaagcccacaagcaaggcgtatgcgctgaaggtcattgaagaaaccaatgaatcatgggagaaattggtgaagaggaagattcctgctggagagctctcactagcctaaggccttaggtctcatgagatgccaacacattctttcagcgtgctgtttttatgtggtatatgcattgcttctttcatctggggaaactcttttgggaacctgctgcgttgtaacaggaataatctggtggagtgaataaaggatttccgagcaagtctttcagaaggaaaccaaaccgaatgttcttttgtcctgggaagcttgaaaaatggagctgggataacgtggctgagccttatctttct

SEQ ID NO: 5500 - DNA, 1208 bp, Triticum aestivum
tccactttccagtccgcagtgaccgccgccgccgccacctccacccgctcctcacctaccccggcggcgaccccccaggtacaccccgaatggcgacggcggtcacggcgtccgccaccgcggcgacccgcttcacgcgcctggcgggcgtcgccctccggcgcagcagctgccgcccccgcaccgccgtgcgcttccagcgcccggggctcaccaccaccgcgctcctcaggcccaccgagctcaagcccaaggaccagggccagcccgagacgctcgactaccgcgtcttcctcgtcgacggcgccgaccgcaaggtgtccccgtggcacgacgtgccgctccgcgccggggacggggcgttccacttcatcgtggagatccccaaggagagcagcgccaagatggaggtcgccaccgacgaggcctacacgcccatcaagcaggacaccaagaagggcaaccttcgttactacccgtacaacatcaactggaactacgggttacttccccagacatgggaggacccgacagctgcaaatgctgatgttgaaggagcacttggagacaatgatcctgttgatgttgtcgagattggtgaaagacgggccaatattggggatgttcttagggtgaaaccattggcagctttagcaatgattgacgagggagagcttgactggaaaattgtggccatctctctggatgatcccaaagcatctcttgtgaatgatgtagatgatgtcgaggagcattttccgggaacattgactgcaatcagagactggttcagagactacaagataccagacggaaagcccgccaacagattcggcctcggcaacaagcccacaagcaaggaatatgccctgaaggtgatagaagaaaccaacgagtcatgggagaaattggtgaagaggaaaatcccggcgggagagctctcgctagcctagccttttataggcccatgagaagccaacaacacattctttcagtgacatacctcctaatcgtgccgctcttttgtgatatatacctatgaacatgcttttcttcatctgcagaacatttcgcgtacctgtgtgtaacaacaggaataaatgaataatctggtggagcgaataaggatttctgagcaagtttttcgcagtgaaactgaatgccttttcgtccggttaaataacacgcagctccgcaaaaaaaaaaaa

SEQ ID NO: 5501 - DNA, 1378 bp, Triticum aestivum
agggcccacctagcatagcccgtagccaccacgcaaaatccgcaaaaagtttcatcgcctcgtcatccgcagctccactttccagtccgcagtgaccgccgccgccgccacctccacccgctcctcacctaccccggcggcgaccccccagggacaccccgaatggcgacggcggtcacggcgtccgccaccgcggcgacccgcttcacgcgcctggcgggcgtcgccctccggcgcagcagctgccgcccccgcaccgccgtgcgcttccagcgcccggggctcaccaccaccgcgctcctcaggcccaccgagctcaagcccaaggaccagggccagcccgagacgctcgactaccgcgtcttcctcgtcgacggcgccgaccgcaaggtgtccccgtggcacgacgtgccgctccgcgccggggacggggcgttccacttcatcgtggagatccccaaggagagcagcgccaagatggaggtcgccaccgacgaggcctacacgcccatcaagcaggacaccaagaagggcaaccttcgttactacccgtacaacatcaactggaactacgggttacttccccagacatgggaggacccgacagctgcaaatgctgatgttgaaggagcacttggagacaatgatcctgttgatgttgtcgagattggtgaaagacgggccaatattggggatgttcttagggtgaaaccattggcagctttagcaatgattgacgagggagagcttgactggaaaattgtggccatctctctggatgatcccaaagcatctcttgtgaatgatgtagatgatgtcgaggagcattttccgggaacattgactgcaatcagagactggttcagagactacaagataccagacggaaagcccgccaacagattcggcctcggcaacaagcccacaagcaaggaatatgccctgaaggtgatagaagaaaccaacgagtcatgggagaaattggtgaagaggaaaatcccggcgggagagctctcgctagcctagccttttataggcccatgagaagccaacaacacattctttcagtgacatacctcctaagcgtgccgctcttttgtgatatatacctatgaacatgcttctcttcatctgcagaacatttcgcgtacctgtgtgtaacaacaggaataaatgaataatctagtggagcgaataaggatttctgagcaagtttttcgcaatgaaactgaatgctcttttgtccagttaattaattaatacgcagatccgcagaaaatgggtcgaaatggatcatcttcctgggaacttggaaagttgggctaggctgggagagtgcgtggctacgaaatgagaagatgccgaactttatgatgcc

SEQ ID NO: 5502 - DNA, 1363 bp, Brachypodium distachyon
cggggctcgggtcgcgcctacagggcccagctaagcctagccgcaagaattgctcgcctcgtcatcctcaagctccactttccagtctgcaagtgacagccgccgccttcgtcttcctccacccgctcccgcaccaaccccgacgaccctccttcctagtccccagggccaccgcggatggcgacggcggtcacggcttccgcgacggcggcgacccgcttcacgcgcctgtcgggcgtcggcctcctccggcgcggcggccgctgccgcctccccaccgccgtccgcttccagcgcccgggactcaccaccaccgcgctcctcagacccaccgagctcaagcccaaggacctgggccagcccgagacgctcgactaccgcgtgttcctcgtcgacggcgccggccgcaaggtgtccccctggcacgacgtgccgctccgcgccggggacggggtgttccacttcatcgtggagatccccaaggagagcagcgccaagatggaggtcgccaccgacgaggccttcacccccatcaagcaggacaccaagaagggcaacctccgttactacccgtacaacatcaactggaactacgggttacttccccaaacatgggaggacccgactgctgcgaacgctgatgttgaaggagctcttggagacaatgatcctgttgatgttgttgagattggtgaaagaagagctaatattggggatgttcttagagtgaaaccattggcagctttagcaatgattgacgagggagagcttgactggaaaattgtggccatttcgatggatgaccccaaggcatcccttgtgaatgatgtagatgatgttgagaagcattttccgggaacattgactgcaatccgagactggttcagagactacaagataccagatggaaagcctgccaacagatttggccttggcaacaagcccacaagcaaggaatatgctctgaaggtgatacaagaaaccaacgaatcatgggagaaattggtaaaaaggaacatccccgccggagagctctcgctagcctaaccataggtccatgagaagccaacaattctttcggctatgtacttaagcatgctgtttttatgtgatatatatcagcatacttcttcgtctgcacaaccttttcatggacctgggtgtaacaggaataatctcgtcgagtcaataaggatttgatttctgagcaagcttttcagaaaggaaaaatgaatgttcgtaagcaaccatcttgtgtgagttcttggacatgaactattcgtctggggagctggaaaggtttggctgagaaaacctagttgcatgacgagaaaataagtttatgtgtctgctgtgaaaaaaa

SEQ ID NO: 5503 - DNA, 1203 bp, Brachypodium distachyon
cgcctcgtcatcctcaagctccactttccagtctgcaagtgacagccgccgccttcgtcttcctccacccgctcccgcaccaaccccgacgaccctccttcctagtccccagggccaccgcggatggcgacggcggtcacggcttccgcgacggcggcgacccgcttcacgcgcctgtcgggcgtcggcctcctccggcgcggcggccgctgccgcctccccaccgccgtccgcttccagcgcccgggactcaccaccaccgcgctcctcagacccaccgagctcaagcccaaggacctgggccagcccgagacgctcgactaccgcgtgttcctcgtcgacggcgccggccgcaaggtgtccccctggcacgacgtgccgctccgcgccggggacggggtgttccacttcatcgtggagatccccaaggagagcagcgccaagatggaggtcgccaccgacgaggccttcacccccatcaagcaggacaccaagaagggcaacctccgttactacccgtacaacatcaactggaactacgggttacttccccaaacatgggaggacccgactgctgcgaacgctgatgttgaaggagctcttggagacaatgatcctgttgatgttgttgagattggtgaaagaagagctaatattggggatgttcttagagtgaaaccattggcagctttagcaatgattgacgagggagagcttgactggaaaattgtggccatttcgatggatgaccccaaggcatcccttgtgaatgatgtagatgatgttgagaagcattttccgggaacattgactgcaatccgagactggttcagagactacaagataccagatggaaagcctgccaacagatttggccttggcaacaagcccacaagcaaggaatatgctctgaaggtgatacaagaaaccaacgaatcatgggagaaattggtaaaaaggaacatccccgccggagagctctcgctagcctaaccataggtccatgagaagccaacaattctttcggctatgtacttaagcatgctgtttttatgtgatatatatcagcatacttcttcgtctgcacaaccttttcatggacctgggtgtaacaggaataatctcgtcgagtcaataaggatttgatttctgagcaagcttttcagaaaggaaaaatgaatgttcgtaagcaaccatcttgtg

SEQ ID NO: 5504 - DNA, 978 bp, Cenchrus ciliaris
ctccgcagccgcgccgcccgcttccccaccgccgtgcggttccagcgccagcgggggctcaccaccaccgcgctcctcaagaccgtcgacctccgcacccccgagcagggacagccccagacgctcgagtaccgcgtgttcctcgaagacggtgggggccggaaggtgtcgccgtggcacgacgtgccgctgcgcgccggggacggggtgttccacttcatcgtcgagatccccaaggagagcagcgccaagatggaggtcgccaccgacgaggccttcacgcccatcaagcaggacaccaagaagggcaacctccgatactacccgtacaatattaattggaactatggattattgcttcaaacatgggaggacccgactactgcaaattctgatgtggaaggagcatttggagataatgatcctgttgatgttgttgagataggcgaaagacgtgccaatattggggaggttcttaaggttaaaccattggcagctctagcaatgatagatgagggggagcttgactggaaaattgtggccatttctttggacgaccccaaagcatctctggtgaatgatgtggatgatgttgagaagcattttccggggacactgactgccatcagagactggttcagagactacaagataccagatggaaagcctgccaacagatttggtctcggaaacaagcccgcaagcaaggaatatgctctgaaggtcattgaggaaaccaacgaatcatgggagaaactagtcaagagaaacgtccctgctggagagctctcactagcctaatatttggtccatggaaagccacaacattctttgaactgcattcttctttcttaagcatgtcgttttgtatgctgtaagcatgtcgttttgtatgctgtaagcatgcttctttatttgcagacctttttgcgaaccgtgtaacaggaataagtgaataatgatgctgtacctttttta

SEQ ID NO: 5505 - DNA, 907 bp, Zea mays
ctcgctctccatccaccttctctcttgttcgctagctagctcatctcgccctgccggacgtggttcctgccttggcatatgcatagccacctggcctgcagcggctgcaagcgtctcgtccagtaccgccggggagccgccggcgtccgctgcccaagctgcgacgctttcacggccgccgccaacccatcagggccgccggagatgtctgagctggtgtgcggcggctgcttcaccatgttggtgcactcccgcggcgccgccaacgtgcgctgcccgcactgcggcaggctcaactccacgagatcagggaaccagatgggccacctgtcgtgcgggcaatgccggaccaccctggcgtacccgccgggcgccaccaccgtcggctgcccgacatgccgcaacgtcaatccggtcagggatgctcgggcggcgccgcagacggtgctggtggagaatcccaggacgctagacgagaagggcaagctggtgagcaatgtcgccgtcggcgtcgcctcgtggaaaagatgaccagcaggcggacggcggaccaagcagacccctccttcccgcgtgctaatcatcgtcccaggggttcgcctacaactagcagaccgaactcttcgtggacttgctactactactactaccgtcgtcgtcagcgattaacggcagctgatgatgtgaaatcaagtgtgttttaaagcttgatgctatataatacatatgttttaaaagtgatcgaattagctagctgttgagcagcagcagcaaaagatctgcagcaacaacccaaaaaaaatttgtaaatacgctagcctgcccggcggtcgtcgtctgtgggcttcctttgatttgatccaaaaaggaatggaagggagcgaagcgcgttgtctcctggaatccc

SEQ ID NO: 5506 - DNA, 1005 bp, Setaria italica
atgagaagattcgatggagggagagaggggtcgggccagggggaggaattggaggaggaggaggaaggccggcgcgggaattcggccatatccgaaaggcatcccgtcccacgcgacgcatcgcacgcccatccactcatcatccccgcgccgacctccacaagccttctcctccatctcatcactctcatctctctcacgcccagcttcgttctcaatctcgttggcagagctcagttgaaagttaaaactagctcaagtttgcctagtcgggtccggagataccaattcaattcttggggctcttgccttggtatgcaggaccagctgatctgcagcggctgcaagcgtgtccttgagtaccggagaggagccaccggcgtctgctgtccaggctgcaacactttcaccgccgccaatccatcaggatcggagatgtctgaactcgtctgcggcggctgcttcaccatgctcgtgtacaaccgcggcgccgccaacattcgctgcccgcactgcggcagggtgaactcgacaagatcagcgaaccagattggccacctgtcatgcgggcattgccggactactctggcatacccaccgggagcctcaaccgtcggatgcccaacatgtcgctgtgttaatcctgtcagggatgctcggccccagacggttctggtggagaatcctaagacgctggatgaaaagggcaaactggtgagcaatgtcgccgttggcgtcacctcgtggaaaagatgaccaagctaaaacttctccgcggcaccagcatcccgaggatctactgattaaaccctcggtgatgaacatgtataactattatcatcgaattaatgtaaaatcaagtgtgttttgaagcttgataaaaaattgtaacagttgaacggcaaaagatctgaaaatgtaaatatgatggccgtgtgcgctagcctatgtactccaagccaaaaaggaatggaaaggagcgaggcattgtgtcctgagaatttt

SEQ ID NO: 5507 - DNA, 878 bp, Vigna unguiculata
gttgttgactttcttcttatgatgaagtctctctcagttcaatcttctaccttctgtagtttttcttcacatgaaactggaacaaaccctagatatttgcccatcaagtcatcaaattttctctgctgttcttccaagcctcgaaattcgagtggatttttgtgtctgagcactcaaaatgacggcttcagagaaaactctggtgaagttggtggcggagatgcagtgataattgtggatcatggttcgcgtcgaaaagagtccaatttgatgcttaatgagtttgtggagatgtttaagtataaaactggttatgagatagtggagcctgctcacatggaattagcagagccatcaataagagatgcttttcaatcttgcgttcaacaaggtgcaaatcgcattattgttagtcccttttttctctctcctggaaggcattggagtcaggatattccttccttaagcgctgaggcagcaaaggaacacccagatgtgtcgtacattgtaactgcacccctcggattacatgaactacttgtggatgttgtgaacgatagaatcaagcactgcataaagcatgtggctggagatgcagatgagtgttcagtctgtgcaggaactggaaaatgcagactctattagtttctgaaactatgattcttttgaatactgtttctgtgctagatgagcctgggaagcaaggaatctgtaaattgagttgcaattgttctgagtttgtgaattcagtgagtttatgtggattctagtaggtcaaaaattgcagttccaagagctactgcttcccaaatgtagtgaagttgaatatgattaatatagttcgatgaaataatttgcaatggcaaattatcaattat

SEQ ID NO: 5508 - DNA, 1354 bp, Cajanus cajan
tgaaaattaaaaaaagaaaaaaaaaatttgaacggtgagagaatgaagcgaagaagcttcgagtcgcgtccacaacatctgttagccacgaacgaaggcctccgccacacgccgacggcgttccacctccgcagtccgcaaagcaggacttgcattttcttatatcaattggtggaaactatttgtttttggttagagttggataggaacagagcataaaacaactatagtaccccgtctctcttggaagtagtagaactgttgttggctttctcgtgatcaatggtgccgatgaagtctctctcacttcattctcatgccttgtcaagtttttccgtaagtgaaattggaacaaacccaagatgggcgcccttcaagtcctcaaattttctctgttgttcctccaagcctcaaagtttaagcagatttgtgtgtctgagtagtcaaaacggtggctttagagaaaactctggtgaagttggtcgtggagatgcagtgataattgtggatcatggttcgcgtcgtaaagagtccaatctcttgcttaatgactttgtggagatgtttaagcataaaactgggtatgagattgtggagcctgctcatatggaattagcagaaccatcaataagtgatgcttttcaatcttgtgttaaacaaggtgcaaaccgtgttattatcagtcccttttttctctctcctggaaggcattggaatcaggatattccttccttaagtgcagaggcagcgaaggagcacccaggtgtgtcgtacattgtaactgcaccccttgggttacatgagctacttgtgaatgttgtgaatgataggatcaaacattgcttaaagcatgtagctggagatgcagaagagtgttcagtttgtgctgggactggaaaatgcaggctctattaatgtgtgaagttaggttgttttgaatgctgttcctacaaggtagatgaggctgaaagttaaaggaatctgtaaattgagttgcaactgttctgaagttgtgatttcagattgtatattatggactcttgttgatcaaattttgctgtcaccagtggcacatgaaattgatcgttcaaccagattcttctcgtttgtgagcaaatgtattcttattcactatgccatgcttcccaaatgtggttaagttgaatttgtttaacaaaataatttgcaatgacaaattatcgtttatgcagatcatgttgtaacgatatgttatatttaatatttattctgatgcacttaaacttggtctcttcattggtccatcatgactttgaggagttttttttcttcctccaagttgtatcagtatttaacattaatgtaaaggtttctc

SEQ ID NO: 5509 - DNA, 895 bp, Vigna unguiculata
gttgttgactttcttcttatgatgaagtctctctcagttcaatcttctaccttctgtagtttttcttcacatgaaactggaacaaaccctagatatttgcccatcaagtcatcaaattttctctgctgttcttccaagcctcgaaattcgagtggatttttgtgtctgagcactcaaaatgacggcttcagagaaaactctggtgaagttggtggcggagatgcagtgataattgtggatcatggttcgcgtcgaaaagagtccaatttgatgcttaatgagtttgtggagatgtttaagtataaaactggttatgagatagtggagcctgctcacatggaattagcagagccatcaataagagatgcttttcaatcttgcgttcaacaaggtgcaaatcgcattattgttagtcccttttttctctctcctggaaggcattggagtcaggatattccttccttaagcgctgaggcagcaaaggaacacccagatgtgtcgtacattgtaactgcacccctcggattacatgaactacttgtggatgttgtgaacgatagaatcaagcactgcataaagcatgtggctggagatgcagatgagtgttcagtctgtgcaggaactggaaaatgcagactctattagtttctgaaactatgattcttttgaatactgtttctgtgctagatgagcctgggaagcaaggaatctgtaaattgagttgcaattgttctgagtttgtgaattcagtgagtttatgtggattctagtaggtcaaaaattgcagttccaagagctactgcttcccaaatgtagtgaagttgaatatgattaatatagttcgatgaaataatttgcaatggcaaattatcaattatcaataaaaagaaaaaaa

SEQ ID NO: 5510 - DNA, 1319 bp, Phaseolus coccineus
aatagagtggataatatagatcttagatttcagaagaagaaaaaactttctctatttttgtgttatctttggagcttttgtttccttggcgtcgtctctcgaaagagccaccgccggaatattcgccggcgacctccgccaccgtcagatgctgacttaaagtgctgcctttgactacaaggtttccaagctgcaggttttccatgaatgttgaagccagtctccttggtgtggcacggctgttggcagtggtcaaggtttagttcgtgttagttggtgtcctacatgcttggtctctgtcaccagtgactattcacagtttgtggagtgttgttgactttcttgtgatcatccatcctgatgaagtctctctctgttcaatctcataccttctatagtttttcttcatgtgaaactggaacaaaacctagatgtctgcccttcaagtcatcaaattctctctgctgttcttccaagtctcggaatttaagtggatttttgtgtctgagcgctcaaaatggcagctttagagaaaactctggtgaagtcggtcacggagatgcagtgataattgtggatcatggttcgcgtcgcaaagagtccaatttcatgcttaacgactttgtgaagatgtttaagtataaaactggttatgagatagtggagcctgctcatatggaattagctgaaccatcaataagagatgcttttcaatcttgcgttcaacaaggtgcaaatcgcattattgttagtcccttctttctctctcctggaaggcattggagtcaggatattccttctttaagtgctgaggcagcgaaggaacacccagatgtgtcttacattgtaactgcacccctcggactacatgaactacttgtggatgttgtgaatgatagaatcaagcattgcataaagcatgtgtctggagatgcagatgagtgttcagtttgtgcagggactggaaaatgcaggctctattagtttctgaaactatattgttttgaattctgtttctgaggtatatgaggctggaagcaagaatctgtaaattgcaattcttctgaagttgtgaattcagtgaggttgtttaatatagtgtccaaatttgccaatgacccattaggtcgattgttcaatggttgctcaagcacattcttcttgtttgaaagcaaatttgttcttatcaaccatgccatgcttcccaaatgttaagttgaatatgtataatatagttcgatgaaataatttgcaatggcaaattatcaattatgcagatcaagtttcaacattatgttataccatttattctgatgtca

SEQ ID NO: 5511 - DNA, 1700 bp, Glycine max
gttggaaggaacccgacacaactttacacagtttacacagatctgttcctttttgacactgtcaacagaactatcctttcattcactgccgccagtgatgataacttgaagaaagaatcagatatggagggtgatcttcaaagggctctatctttgcgcctaaatcgtagaggagaccgaagtaatcaaagtcctgctaaagattttgaggtgggcttcttttcttcagggagggtacctcaggattaccccatgaagattgtttggaaaaaagggtttgttcggttggttcttgtagcagggatcttgtggatgttattaattcttcttgcattattgttccatatatggtcttgtcaaacttccgtctcctttttatcagctatgtgtaacaaagatagcaaggttttcaacatgttagacaatatgggacttgtatcaaaacctcacagatgtccaattcctctttccaatgaccctgataaaatagttatcccaactggaagaactcccaacgaaactgtcaaaaatctgtcatatgttatggaagatgaggttccacatagtgaagctcagtcatctcctctatttggaggccatccaagttggaaacaaagggaggaaagttttaaactaaagtcaaatatgaaggtgcattgtggattcatccaaggtggtggtgctgaaatgaatcgtgtagacatcaaatatgtcaagaaatgcaaatttgttgttgcatctggaatttttgatggctatgatttacctcatcaaccatcaaatataagccttcgctcaaaggagcttttttgcttccttatggttgtggatgaggtatctctaaaattcatgagggaaaatggtacggtcaaagaagacagagctggtggaaaatgggtgggaatatggagacttgttcttcttaagcatcctccttatgatgaaccaagaaggaatgggaaggttcccaaaattttaacccacaggttgttccctcaagcacagtatagcatttggattgatggtaaaatggagctgatagtagatccattgctaatccttgagagatacctgtggcgaggcaagcatacgtttgccattgctcaacacaagcatcaccgtaagcgaaagcgatatgctcgaccccttattgatctccacatgaaaatctattattatgagggaatgaagccatggagctcaaataaaaagaccaatagtgatgtaccagagggagccgtcatcattcgggaacacactgccataaataacttatttagctgcttgtggttcaatgaggttcacctcttcactcccagagatcaactgagttttggctatgttgcatacagattgggggacgcgttcaaattcttcatgtttctcaactgtgaatacaattcactgtttgtgttgcaccctcacacaagagagcactcttctcccatagaatgggttaaacagttggatgaacttaagaaaggcaatttaaaagaaagtaggggaggactaggcttgtttaccccttatcctggggatcttgattctgttgttctgccaaatgtaacaagaacatcaaaagcaggctgacattttgtttattgtttaacatattcattttgtcatgtatttttttttccaagaatttcttgatctttattttgcttaatcttaatgaaagtaaagataaggctcttcaa

SEQ ID NO: 5512 - DNA, 2192 bp, Cajanus cajan
ttccgtacaacccattccaaattggaaattgcccccattctcctagtttgggccttctgttcttcctcaatcggttcacagtaaaaagataataataataataataataataataatagaaataaaagcttaaaaaaaaaaataattggagcttccatgatcctatgatgatcccagatgagtgttgaggagaaaacaaaggatacagagggatctgtttcagtttgaaacttgaacatctcttcgttacattcttatcttagttttagtttcatctcttttgttgttggaaggaacccaacacaacacaacattacagtacgcagatctgttcctttttgtcactgtcaacagacccatcccttctttcaccaccgtcagtgatgatgacttgaagaaagaatcagatatggagggtggtgatcttcaaaaatctctgtctttgcgcctaaatcgtagaggagaccgaagtaatcaaagtcagctttctaaagattttgaggagggtttatttccttcagggagggtaccccaagattaccccatgaagattgtttggaagaaaggttttgttcggttggttcttgtagcagggatcttgtggatgttattaattcttcttgcattgttgttccatatatggtcatgtcaaacttctgtctcctttttatcagctatgtgtaacaaagatagcaaggtttacaccatgttagacactatgggacttgtatcaaaacctcacagatgtccaattcctgtttccaatgatcctgataaaatagttatcccaactggaagaacttccaacgaaattgtcaaaaatctttcttacgttatggaagatgaggttccacatgatggatctcagtcatctcctctgtttggaggtcatccaagttggaaacaacgggaggaaagtttcaaactaaattcaaatatgaaggtgcattgtggttttatccatggtggtggtgctgaaatggatcccgtagacatcaaatatgtcaagaaatgcaaatttgtagttgcgtctggcatttttgatggctatgatttacctcaccaaccatcaaatataagccttcgctcagagaaacttttttgctttcttatggtggtagatgaggtgtctctgaaattcatgagggaaaatggtactgtcaaagaagacagtgctggtggacagtgggtgggaatatggcgacttgttcttcttaagcatcctccttatgatgaaccaagaaggaatgggaaggttcctaaaattttaacccaccggttgtttcctcaagcacagtatagtatttggattgatggtaaaatggagctgattgtagatccattgcaaatgcttgagagatacctgtggcgagggaagcatacatttgccattgctcaacacaagcatcaccgtagtatatatgaggaggctgattcaaacaagaggcgtaagcgatatgctcgaccccttattgatctccacatgaaaatctactattatgagggaatgcagccatggaattcaaataaaaagactattagtgatgtgccagaaggagccgttatcattcgggaacataccaacatgaatgacttatttagctgcttgtggttcaatgaggttcacctcttcacacccagagatcaactgagttttgggtatgttgcttacagattgggggactctttcaaattcttcatgtttcccaactgtgaatacaattcactgtttgtgttgcaccctcacacaagagagcactcgtctcccatagaatgggttaaacagatcgatcaacttaagaatagtaatttaaaagaaagtaggggaggactaggcttgtttaccccatatcctggggatcttgattctgttgttctgccaaatgtaacaagaacatcaaaagcaggttgacattttgtttattgttttaacatattcattgtgatgtattttttttctcaagaatttcttgatgtttattttgcttgatcttaatgaaagtacagataaagttattcaaatttatttttagggtttagaagtaaagcgcctttttgtccttcctcgagccttggatacacaagtgatgagttgtatgataatagtaatagtatggtagaacacgaaatatttgttattccttttaaggctgtggatacatttgcattctcttcatctaatacttcactaa

SEQ ID NO: 5513 - DNA, 1954 bp, Phaseolus coccineus
attcaagattattgccataaccctcttatttttgggctcctgaatgaatttacagttaaaggggggaaaataaaataaaacaagagattctgaagcttccatgatcctatgatgaccccagatgagtgttgaggagaaaacaaaggatagatagagggagatctgtttcagtttgaaacttcaacatctcttcattacattcttagtttctcttcaccttctttcttgttggaagcaacccaatacaacattacacttttcacacagatctgtttcttcttgtcactgtcaacaaaaccatcccttcttctgccagggatgataacttgaagagagaaacagatatggaggatgatcttcagaggtctcgatctctgcgcctaagtcgtagaggagaccgaagtaatcaaaatcctgctaaagatgttgatgtgactttattttcttccgggagggtatctcaagattaccccacgaagattgtttggaagaaagggtttgttcgattggttcttgtagtcgggatcttgtggatgttattaattcttcttgcattattatttcatatatggtcatgtcaaacttctgtctcctttttatcagctatgtgtaacaaagatagcaaggtttataccatgttagacaccatgggacttgtatcaaaagattcaaaccctcacagatgtccgattcctctttccaatgaccctgataaaatagatatccctactggaagaactcccaatgaaattgtcaaaaatttgtcgtatattatgaaagatgagattccaagtaatagagatcaatcatctcctttgtttggaggccatccaagttggaaacagagggaggaaagtttcaaactaaagtcaaatatgaaggtgcattgtggatttatccgaggtggtggtgctgaaatggagcttgtggatatcaaatatgtcaagaaatgcaaatttgttgttgcatctggcatctttgatggctatgatttaccacatgaaccatcaaatataagcttcagttcaaagaagcttttttgctttcttatggtagtggatgaggtatctctgaaattcatgaggaaaaatggtactgtcaaagaagacagtgctggtggaaaatgggtgggaatatggcggattattcttcttaagaatcctccctatgatgaaccaagaaggaatgggaaggttcctaaaatattaacccacaggttgttccctgaagcgcagtatagtatttggattgatggtaaaatggagttgatagttgatccattgctaatccttgagagatacctgtggcgagggaagcatacgtttgccattgctcaacacaagcatcaccgaagcatatatgaggaggctgatgcaaacaagaggcgaaagcgatatgctcgaccccttattgatctccacatgaaaatctactattatgagggaatgaaaccatggagttcaaataaaaagaccattagtgatgtaccagagtggccattacggccgggaacatactgccatgagtaacttatttagctgcttgtggttcaatgaggttcacctcttcacaccaagagatcaacttagttttgggtatactgcgttcagattgggggattcattcaaatatttcatgtttcccaattgtgaatacaattcactgtttgtgttgcaccctcacacgagagagcactcttctcccatagagtgggttaaagacttgaataaactaaagaatagcaaattaagagaaagtaggggagggctaggcttgtttaccccttatcctggggatcttgattctgttgttcttccaaatgtaacaagaacatcaaaagcaggctgatatttttgtttattgttttaacatattcatttgttatgtatttgtataaattaatttcagttttgggacaagttaatttcaattgttctttttacttttatctgtt

SEQ ID NO: 5514 - DNA, 1817 bp, Medicago truncatula
aaggcgatctgtttctttcacttcaatcactcttggagcttcactttcacttcttccaacattcaatttcagtttttttcgtcatctcttctttcgttcgaatccaacaccatatttaccggatccgggtcacgttccaccgttatcaccactcaccgccgccgcgtaccagatcgataaaataatcagccagaaaagtgatgataatttgaaaaatttgaatcaaatatggagggtgatcttcaaaagtcactatctttgcgcctaaatcgtagaggagaccgaactaatcaaaatcctcaagctaaagggagggtaccccaagattaccctatgagtatgaagattgtttggaagaaaggatttgttcgattggttcttgtaggaggcatcttgtggatgttgttaattcttgttgcattgttgtttcatatatggtcgtgtcaatcttctgtctcctttttatcagtcatgtgtaacaaagatagcaaggtttactccatgttagacacttatggacttgtaccaaaacttcacagatgcccgattcctcttttcgatgaccctgataaaatagttatccctactcgaagaacttccgacaaaattgtcaaaaatttatcatattttaccgaagatgagattccaaatgatagttcccagtcatctcctctttttggaggccatctaagttggaaacagagggaggagagtttcaaactgaagtcgaatatgaaggtacactgtggatttatccaaggtggcggtgctgaaatggatcctatagacattaaatatgttaagaaatgcaaatttgttgttgcatctggcatttttgacggttatgatatacctcaccaaccatcaaatataagccttcggtcaaagaaacttttttgctttcttatggtggttgatgaggtatctctgaaattcatgagggaaaatactactgtggaagaagacagtgctggtggaaaatgggtgggaatttggcgacttgttcttcttaagaatcaaccttatgatgaaccaagaaggaatgggaaggttcctaaaataataacacacaggttgtttcctcaagcacaatatagtatatggatcgatggtaaaatggagctggtagttgatccattgcttatccttgagagatacctatggcgagggaagcatacatttgccattgctcaacataagcatcaccgtagtatatatgaggaggctgatgcaaacaagaggcgaaagcgatatgcacgaccccttattgatcttcacatgaaaatatactattacgaggggatgaaaccatggagttcaaataaaaagactaatagcgatgtcccagagggagcgattatcattcgagaacatacagcggtgaataacttgtttagctgtttgtggtttaatgaggttcacctcttcacaccgagagatcaactgagttttggctatgttgcgtacagattaggggagtcatttgagtttttcatgtttccaaactgtgaatacaattcattgtttgtgttgcaccctcacacaagagagcactcttctccaatagaatgggttaaacagttggatcaacttaaaaagaatagtaatttaaaagaaagtaggggaggattaggcttgtttaccccttatcctggggatcttaagtcagttgttctgccacaaataacaagaacatcaaaagcaggatgacatctttgtttattttgttttaacatatattcattttatgtattttttatttcaagaatttcttgattctaattaatgaaaagtaaagatgaagctcgtcaagctta

SEQ ID NO: 5515 - DNA, 1486 bp, Cicer arietinum
gtgggattatttcttcagggagggtaccgcaagattatcccatgaaaattgtttggaagaaagggtttgttcgattggttcttgttggagggatcttgtggatgttgttaattcttattgcattattgttccatatatggtcttgtcaatcttctgtctcctttttatcagccatgtgtaacaaagagagcaaggtttacaccatgttagacactatgggacttgtaacaaaacctcacagatgtccgattcctgtttccaataaccctgataaaatagttatccctaccggaagaacttccgacaaaattgtcaaaaaattattgtatgttaccgaagatgagattccaaataatagttctcagtcatctcctctttttggaggccatctaagttggaaacaaagagaggagagtttcaaactgaagtcaaatatgaaggtgcactgtggatttatccaaggtggcggcgctgaaatggatcccgtagacattaaatatgttaagaaatgccaatttgttgttgcatctggtattttcgatggctatgatctacctcatcaaccatcaaatataagcattcgctcaaagaaacttttttgctttcttatggtggtggatgaggtatctctgaagttcatgagggaaaatggtactgtcaaagaagacaatgctggtggcaaatgggtgggaatttggcgacttgttcttcttaagaaccaaccttatgatgaaccaaggaggaatgggaaggttcctaaaataataacacacaggttgtttcctcaagcacagtatagtatatggattgatggtaaaatggagctcatagttgatcctttacttatccttgagagatacctatggcgagggaagcatacatttgccattgcgcaacataagcatcaccgtagtatatacgaggaggctgatgcaaacaagaggcgaaagcgatatgcacggcccttaattgatctccacatgaaaatatattattacgaggggatgaaaccatggagttcaaataaaaatactattagcgatgtcccagagggagccattatcattcgggaacatacggccgtgaacaacttgtttagttgcttgtggtttaacgaggttcacctcttcacaccaagagatcaactgagtttcggctatgttgcgtacagattaggagacgcgttcaagttcttcatgtttcccaactgtgaatacaattcactgtttgtgttgcaccctcacacaagagagcactcttctcccatagaatgggttaaaaagatagatgaacttaaggatagcaatttaaaagaaagtaggggtggattaggcttgtttacgccttatcccgcggatcttaattcagttgttctgccacaaataacaagaacatcaaaagcaggatgacattttgtttattactttaacatatttattttatgtattttattctaaggatttgttgatcctaattaatgaaagta

SEQ ID NO: 5516 - DNA, 1769 bp, Glycine max
acagcttcatttgtaaatggcaatgagctcaattcatacgttgtacgcttcttccttccgtttgtgtttcccaaattcatcaccacaatttaagcctctgaatgccattcctctcggaggaacaaaactctacaacaacaacaacgttaaatttcccagagaaagaacaaggaccagagcaacccttgatgatgttgaaacagaccaactttcctcaaccccacttgttgagaatgacaaagccaaaaaggatgtagatgaaagtgtgaaagtgttaaaagatgcagctaagacaagaaaggtagcagcagaggatattctttctgcactgtctatcattgagaaagcaaaagttgatccttctgccttttttgagacccttggtggaaaggaatccccagggaggacctggatgctaatttttactgctgagaaacaattgaaaggtggtcgatattttcctctcacagctgttcagaggtttgatgctgctgcaaagaggatcgaaaatggagtatatcttggacccattggacagttaacatttgaaggcagactttcatttaaaaagagaatactggctttcgtttttgagaacattcgaataaaagttggacctttgcaacctctagagatcagtctagggaaaaaggaagacaaggaaccaagtaccaaggatcctttcttcatctggttttatgttgatgaggaaatagctgttgctcgaggccggagtggaggaactgcattttggtgtcggtgccgtcgtgtcaataactgattgtttttaactttcgttccttttctacttctgacttttgatggaaagatacatgtatatatgtaaacatttaagttcagttggtggtaaacatatttgcacttgtttgcataaattccagtaacttaaatatgcaattcaaattgaagtttgtgtttcacgataattctactattgtggaggtcatcctgacttttcctattttatcatggtcgtcaaaccttttcttgttaaagaagacagtagcatggatgattggatttattctttctgatgcataggatctttatgtacagacaaccaatgtgttccggctctcaatcaaagaaacgaggaataaaagagtttgcaattcatcatcaattttcatttatacttttgtcaattgatttataatttccttgaaggtgtttagatgcttgattatgttctgaccatctgattatccaatttcaccaatattttttatgagatgagctttgttcctaggagtctttaaatcaagttttgcacataattcatacattttggtacaagtcgattcatgtttgaacaaactttgatcaacattttatgaatcataccaataatctatagattctaattcttcagcacttcacaacttttcctatttacagggaatgaaaggatatttctctcgacgactatttattacttgtttatgtacttcaccaattaaggagaggaattctaacaaatatcgatttttgaatttttttatgcaagttttattaattaatgatgtgaccaaaggtaaatttacacaataataataataataataaaacaatgtattgataagatttatcgtccaaccaaatcaacaaatatgcagacaggacgaaaataaaaacaaagataaaaaaatggaaatgaggttgatgggaccttgtagagctaatctacccctttatcgttgaaataccatatgtcctatatacgactcagaaattttattggcttttac

SEQ ID NO: 5517 - DNA, 1021 bp, Cajanus cajan
gggacagaagtgtaagatattattatagcttcatttgcaaatggcaatgagctcaattcatatgttgcacgtttcttccttccatttgtgtttcccaaattcatcaaactttgaagtatcgaagttctcaccacaatttaagcctctgaatgccattcctctcagaggagcaaaacactgcattgttaaatttcctagagaaagaacgagaaccagagcaacccttgatgatgttgaaacagaccaactttcctcaaccccacttgttgagaacgagaaacccgataaggaagtagaggaaagtgtgaaagtgttaaaaaatgcagctaagacaaggaaggtagcagcagaggaggttctttctgcactgtctatcattgagaaggcaaaactagatccttctggctttcttgaaacccttgggggaaaggaatcccctgggaggacctggatgctaatttttactgccgagaaacaattgaaaggtggtcgatattttcctctcacagctattcagaggtttgatgctgctgcaaagaggatcgaaaatggagtatatcttggacccattggacagttaacatttgaaggcagactttcatggaaaaagagaatactggcttttgtttttgagaaccttcgaataaaagttggacctttgaatcctctacaaatcagtctaggaaaaaaggaagacaaggaaccgagtaccaaggatccatttttcatctggttttatgttgatgaggaaatagctgttgctcgaggacggagtggaggaactgcattttggtgtcgatgtcgtcgtgtcagtaactgattctttctaactttcttccgtttctacttctaactttgaatggaaagagtcatgtatatatgtaagcactgaagtttagttggacgtaaacatgtttgtacttgtattctgtatagttatttgcataaattccaggaaactaaaatataattcggatcgaagtttgtgatgtgtttcacgatattactaccgtttggtcat

SEQ ID NO: 5518 - DNA, 802 bp, Vigna unguiculata
ggatcgaactcaattcacatgttgtacgtttcttccttcagtctgtgtttcctgaattcatctccctttcaactttcaaagctctcacaacaatttaaacctctgaattccattcctctcagtggaagaaaacaacactgcaagattgttcgatttcccagagaaagaataaggaccagagcaaccattgatgatgttgaaacagaccaactttcctcaacacctattgttgagaatgagaaagccataaaggatgtagaggatagtgtgaaagtgttaaaagatgcagctaagacaagaaaggttgcagcagaggaggttctttctgcactgtctatcattgagaaagcaaaaattgatccttctgttttttttgaaacccttggtggcaataaatctcctgggaggacctggatgctgatttttactgccgagaaaaaattaaaaggtggtcggtattttcctctcacagcagttcagaggtttgatgccactgcaaagaggatcgaaaatggagtatatcttggacccattggacagttaacatttgaaggcagactttcatggaaaaagagaatactggcttttgtttttgagaacatacgagtaaaagttggaccttttcagcctctacagatcagtctaggaaaaaaggaagatagggaaccggacaccaaggatcctttcttcatctggttttatgttgatgaggaaattgcggttgctcgaggccggagtggaggaactgcattctggtgcccgtgtcgtcgtgtcaataactgattctaactttctttctttt

SEQ ID NO: 5519 - DNA, 802 bp, Vigna unguiculata
  misc_feature (112)..(112): n is a, c, g, or t
  misc_feature (130)..(130): n is a, c, g, or t
  misc_feature (142)..(142): n is a, c, g, or t
  misc_feature (144)..(144): n is a, c, g, or t
ggatcgaactcaattcacatgttgtacgtttcttccttcagtctgtgtttcctgaattcatctccctttcaactttcaaagctctcacaacaatttaaacctctgaattccnttcctctcagtggaaganaacaacactgcnanattgttcgatttcccagagaaagaataaggaccagagcaaccattgatgatgttgaaacagaccaactttcctcaacacctattgttgagaatgagaaagccataaaggatgtagaggatagtgtgaaagtgttaaaagatgcagctaagacaagaaaggttgcagcagaggaggttctttctgcactgtctatcattgagaaagcaaaaattgatccttctgttttttttgaaacccttggtggcaataaatctcctgggaggacctggatgctgatttttactgccgagaaaaaattaaaaggtggtcggtattttcctctcacagcagttcagaggtttgatgccactgcaaagaggatcgaaaatggagtatatcttggacccattggacagttaacatttgaaggcagactttcatggaaaaagagaatactggcttttgtttttgagaacatacgagtaaaagttggaccttttcagcctctacagatcagtctaggaaaaaaggaagatagggaaccggacaccaaggatcctttcttcatctggttttatgttgatgaggaaattgcggttgctcgaggccggagtggaggaactgcattctggtgcccgtgtcgtcgtgtcaataactgattctaactttctttctttt

SEQ ID NO: 5520 - DNA, 1170 bp, Phaseolus coccineus
agaagtgtgagacatgttattatagcatcacttgcaattgtaaatggcaacgaactcaatgcacatgttgtatgtttcttccttcagtttgtgtttcccgaattcatcttcctttcaactttcaaagctctcaccacaatttaaacctctgaattccactcctctcagtggaagaaaacactgcaaagttgttagatttcccagagaaagaacaagaaccagagcaacccttgatgatgttgaaacagaccaactttcctcaacaccccttgttgagaatgagaaagccaaaaaggatgtagatgaaagtgtgaaagtgttaaaagatgcagctaagacaagaaaggttgcagcagaggatgttctttctgcactgtctatcattgagaaagcaaaacttgatccttctggcttttttgaaacccttggtggcaataaatctcctgggaggacctggatgctggtttttactgctgagaaaaaattaagtggtggtcggtattttcctctcacagcagttcagaggtttgatgccactgcaaagaggatcgagaatggagtatatcttggacccattggacagttaacatttgaaggcagactttcatggaaaaagagaatactggcttttgtttttgagaacataagagtaaaacttggaccctttcaacctctagagatcagtctaggaaaaaaggaagacagggaaccagataccaaggatcctttcttcatctggttttatgttgatgaggaaattgcagttgctcgaggcaggagtgggggaactgcattctggtgtcggtgtagtcgtgtcaataactgattctttctaactttctttctttttaacttctgactttggatggaaagattcatgtatatatgtaagcatttaacttcagttggaggtaaacataactgtactgtacttgtattttgtttagttatattgaagtttttgtttcatgatactactgatgttggggcatttgtgaagaaagcattattcaacaactaaaacaagaaaaaaggaatttgagaagtaagagaataggaggaaaaggaagattcaccaatcaccaggtctggttacagaattgaataggttcatctgaattgtatgctacagaatgtgttttattcaaagaattctgctgtattttgtca

SEQ ID NO: 5521 - DNA, 1245 bp, Phaseolus coccineus
aaggaggtgattttttgacctacaggagaagctacgtcggaggaagaagaatgagggtgtgaggtttgattaaataaaagaatattattgataattgggtgcagatgaagtgaatgagaaaggtgaatagttgtttgaggaagaagtagaagaaaacggttttccttgtccgtttgaggaagcggcacaggtttttgtgtttcggcgtgggaagaacgcttcttctgatacaattgcatatgcagcgattaaggagttctgtgttttcggccaccaaccttaagaaaaagtatctcaattcacgggctgccattcaagacacttttttttctaccaaggatacatttgagagacatcgtgtggtgttcactgttggaacttccattgcttccgttgccactgcttggttcggttactccttgcgccatttacatgacaccaaagtagatcaaaggcttcaatccattgaaaatgctgtcaaaagcaattccaatctccaacatgccgaaatcaaagacattgtcgcaggttccggaggttgtagcattcctgcttgtgttgccactgctggaacctccctggttatcgggtatgccttaggatggagaggtggaatctggtatgcaactaagaagttcagaaaggagcaaatgaaaatgctaggacagattacacctagaagatggcaattgcttgggaagataaaacctaaagggttgcaattccaattccttagaagaaaccttacaagattcaaagtgtctgatactgtactacaaacatctgaatcaagtataaaggatgcagctatcacacatgttactggaaaatccaattagtatactactataaaatgattctttaagaaacaatattgttgagatggctgcagataccggattacgcattcaattagataaaaggagtagcaacgtggtttataaccaattatcatcaaattttgcactgatgttttattttgggcagcagctgctcattctttagcttcataaattcttcatccttcatgttagaagtgctttagaaacttgtgttctattttgattgttgaatttataaaggaggaaatacacatactttagtttttgtggctggcaaatagaactctctatattggaggaaatacagattaaatttgtgttgtgtagggaatgaacaagttcttaatagtgtaattttactgacaattttttaccaatataatataattcaagagtgatataa

SEQ ID NO: 5522 - DNA, 935 bp, Vigna unguiculata
aacgagcactggttttgtgatttggcgtgggaagaacgcttcttctcatagcatcgcatatgcagcgattaaggagttctgtgttttcggcgcccaaccttaagagaaagtatctcaattcacgggctgcgattgaagacacttttttttccaccaaggatacgtttgagagacatcgcgtcgtcttcactgttggaacttccattgcttccgttgccactgcttggttaggttacaccttgcgccatttacatgacaccaaagtggatcaaagacttcaatccattgaaaatgctatgaaaagcaattccaatctccatcataccgaaatcaaagacattgtcgcaggttcaggagggtgtagcattcctgcttgtgttgccaccgctggaacgtccttgattatcgggtatgccttaggatggagaggtggaagctggtatgcaactaagaagttcagaaaggagcaaatgaaaatgctaggacagattacacctagaagatggcaattgcttgggaagataaaacctaaagggttgcaattccaattccttagaaggaaccttacaaaattcaaattgtcggatagtgccatgaaaacatctgaatcaagtataaaggatgcagctaccacacatgttactggaaaatccaattagtatactactataaaatggttctttaagcaacaatattgattgagatggctccagataccagattaggcattcaattagatgaaaatattagcaacgtggttataatcaattatcatcaaattttgcactgataatttattttggcctgcagctgctcacccttagcttcataaattcttcatccttcatgcaaaaattgttttagaaacttgtgtcctatttgattgttaaatttataatcgaggaaatacccattctttaaaaaaaaaaaaaaaa

SEQ ID NO: 5523 - DNA, 924 bp, Vigna unguiculata
gggaaacgagcactggttttgtgatttggcgtgggaagaacgcttcttctcatagcatcgcatatgcagcgattaaggagttctgtgttttcggcgcccaaccttaagagaaagtatctcaattcacgggctgcgattgaagacacttttttttccaccaaggatacgtttgagagacatcgcgtcgtcttcactgttggaacttccattgcttccgttgccactgcttggttaggttacaccttgcgccatttacatgacaccaaagtggatcaaagacttcaatccattgaaaatgctatgaaaagcaattccaatctccatcataccgaaatcaaagacattgtcgcaggttcaggagggtgtagcattcctgcttgtgttgccaccgctggaacgtccttgattatcgggtatgccttaggatggagaggtggaagctggtatgcaactaagaagttcagaaaggagcaaatgaaaatgctaggacagattacacctagaagatggcaattgcttgggaagataaaacctaaagggttgcaattccaattccttagaaggaaccttacaaaattcaaattgtcggatagtgccatgaaaacatctgaatcaagtataaaggatgcagctaccacacatgttactggaaaatccaattagtatactactataaaatggttctttaagcaacaatattgattgagatggctccagataccagattaggcattcaattagatgaaaatattagcaacgtggttataatcaattatcatcaaattttgcactgataatttattttggcctgcagctgctcacccttagcttcataaattcttcatccttcatgcaaaaattgttttagaaacttgtgtcctatttgattgttaaatttataatcgaggaaatacccattcttta

SEQ ID NO: 5524 - DNA, 1002 bp, Cajanus cajan
agtgggaagaaaaaagggcatggggaggtttgattatagagggagatgattgaagggtgaagaagtgatatgatatgatatgatatgcagcgattaaggggttcagtgttgtcggctcccaaccttaggaagaagtatctcaattcatgggctgccatccaagatacctatttttccacaaaagataccttcgagagacatcgcgtcgtcttcaccgtcggaacttccctcgcttccgttgccactgcttggttcggctattccttgcgccatttgcatgataccaaagtcgatcaaaggcttcaatccattgaaaatgctatgaagaaccattccactctccaacattccgaactcaaagacattgtcgcaggctccggaggttgttctattcctttttgtgtcgccactgccggaacttccttgattatcgggtatggcttaggatggagaggtggaggctggtatgcagctaagaagttcagaaaggagcaaatgaaattgctaggacagattactcctagaagatggcaattgcttgggaagataaaacctagagggttgcaatttcagttccttagaagaaaatttacgagatccaaagtgtctgatactgccctgaaaacatctgaaacaagtataaaggatgcatctaccacacatattgctggaaaatcccattagtatactacttctacaaaatggttcttttaagctccaatattgatagagatggctgcagatactggattgggcattcaattagatacagaacaacaacatagttattaccaattatcatcaatttttgcactgatatttatattattttggcctgcagttgctcgcccttatagcttcataaattcttcatccttcatgtgaggactgctttaagaacttgtgtttttattttgattgttaaatttataatggaggaaatacacatcctttaattttgggggctggtaaatggatcactctcttttcacttttggttaa

SEQ ID NO: 5525 - DNA, 1269 bp, Phaseolus coccineus
gttatgagtgagggccataatcccttatccattatcactaccttaatctttgatgagattgccgagagtgagaactgaagagcaatggcttcagtagcttcatcttcatccttttccacaaggcatcttctgcgttcccccacacctctgttaggcagaagaagatgcagacccaattttctgagtatggtcactcgctcctgtctcgatgacagttccgctctccttcatgcagcggaatacactgtggataattacgtaaaaagtggcatggttgtgggattggggtctggtcatgcttctggtatggccattcagcatttgggtcgccagcttcgtactggtaatttgaaggatatagttgggattcccatgtctgttgcaagtgcaagtgaagcagcaaaggctgggattccattggatacctaccaagaaagttctcaaattgattttgcatttgatgatgctgatgctatagaagaaggaacacttgttgctatcattgggcgccggaaattgcaaggtggggaatccataatccaggagaaatctataataaatgcctccaataaacttgtgttcattatcgaagaaaaccagtacaaaggtggtctggaaggttctattccagttttaattcagtctcccaactggatggcaactgctgaagagattgatgatatgtttttgggtgatgctgaggtctggagaagaccatccatgggacaagcaggtccgttaggaggtgacttcccagtagttaccagggaagggcacaacattcttgatgttatctttacatctcccatagaaaaccttgctgaagtagcaaaaagccttggtaaagttgatggtgttgtggaccatggtgttgtatctaaaattccatgcacagtggtaattgcttctcaaaatgggctgaacattttggacaaattgacagcagatatagtgggctagatacagtactaatagctctgcttcttaccttcctctctttttcatctcaccccaaatatttattatgcaacaagattaatcagtaattgtatcactaactatcaaaggaagctgagggttacatgtgctgtgttatatatacatgatactattgttttggtttgtattttccattcccaaatggttccatagtaagggtgaggctggagaaattaactggtctccaactacaacataaattgttattccaatctttttttttatatatatggataatcaatagaactcttattctcttttacataataa

SEQ ID NO: 5526 - DNA, 1080 bp, Lotus japonicus
aggttgaacagcaatggcttcagctgcttcatcttcttcgttttccacaaggcttcttctgcattcacccacaactctactgggcagaagaagaagaaggtccaatgttctgaggatggtgactcgctcatgtctcgatgacagctctgctctgctccgagcagctcaatacactgtggatacatatgtgaaaagtggcatggttgtaggattggggtctggtcatgcttctggtatggccattcagcatttgggtcgccagcttcgtacgggtaacttgaaggatattgttgggactcccatgtctatttcaagtgcaagtgaggcagccaaggctgggattccattggatacctaccaagacagttctcaaattgatttggcatttgatgatgctgatgttatagaagaagggacacttgttggtatcattgggcgccggaaattgcaaggtgaagaatccataatccaggagaagtccatactaaatgcttccaataaacttgtgttcattatcgaagaaaaccagtacaaacgtggtctggaaggttctattccagttttaattcagtctatcaactggatggcaactgctgaagagattgatgatatgtttctcggtgatgctgaggtctggagaagaccgtctattggacaagctggtccacttggaggtaatttcccactagtcaccagagaaggacataatgttcttgatgttatctttacatctccaatagtaagccttgctgaagtagcaaaaagcctgaacaaagttgatggtgttgtggaccatggtgtcatatctaaaataccatgcacggtggtaattgcttctcagaaggagctgaacattttggacaaattgacagcagacatagtgggctagccttcagttcttatagctgtcacatgcaaatgaatgtaaatgcagttgttctatttttttcttcatgttttcttttggaaaaagctcctctaaagtaagtttgaatatgtagaatgagcatgtaacctttaacatggactgacttgcacgcttctaaagatacatataaagcattgcaaattgcaatcctc

SEQ ID NO: 5527 - DNA, 1635 bp, Vigna unguiculata
gaagagcaatggcttcagtagcttcatcttcatccttttccacaaggcatcttctgtgttccccaacacctctgttaggcagaagaagatgcagacccaattttctgaggatgctcactcgttcctgtctcgatgacagttctgctctccttcaagcagcggaatacactgtgaatacatacgtaaaaagtggcatggttgtaggattggggtctggtcatgcttctggtatggccattcagcatttgggtcgccagcttcgtactggtaatttgaaggatatagttgggattcccatgtctgttgcaagtgcaagtgaagcagcaaaggctgggattccattggatacctaccaagaaagttctaaaattgattttgcatttgatgatgctgatgttatagaagaaggaacacttgttgctatcattgggcgccggaaattgcaaagtggggaatctataatccaggagaaatctataataaatgcctccaataaatttgtgttcattattgaagaaaaccagtacaaaggtggtctggaaggttctattccagttttaattcagtctctcaactggatggcaactgctgaagagattgatgacatgtttttgggtgatgctgaggtctggagaagaccaacgatggggcaagcaggtccgttaggaggtgactttccagtagtcaccagggaagggcacaacattcttgatgttatctttacatctccaatagaaaaccttgctgaagtagcaaaaagccttggtaaagttgatggtgttgtggaccatggtgttgtatctaaaattccgttagttttctctctcaacttttataatcttttaaataagtagatgagaatcatgcgggttgaactttaagataaggtatagataggacatataaaacatcaaatgattcactcttataatttcatttccctttctgagcctgtcagtaatcaatgaaagagaagtgtttgacatgcgcttcaaataaagttacaaactcgtttgttgttttcttcaacaaaagtggtgcaaagggtataagtttttaataaacttcagttcagagctgtagtttttgctttaggtgcaccaactttagtccaatgagtaagatgtaatcatggtcaacatcttagtcaccaaattattattgcattggttctgttctgtcagtattcttcttcctagacaacagaagcattggaaaatggtttgcttgaaaatatgaactcagttatttctattgttatgatgggatgcagatgcacagtggtaattgcttctcagaatgggctgaacattttggacaaattgacagcagatatagtgggttagatacagtactaataaccctgtttcttaccttcctctctttttcatctcgccacaaatatttatcatgcaagaagattaatgagttgttatgattatatcactaactatcaaaggaagctgagggttacatgtgctgtattatatatgcatgaaattgttgttttggtttgtattttccattcccaaatggttccatagatgaggctggagagattattaactagtctccagtcacaacataagttgttattccaatcgatattgttttttgacaaaaaaaaagaaaaaa

SEQ ID NO: 5528 - DNA, 1220 bp, Phaseolus coccineus
  misc_feature (616)..(616): n is a, c, g, or t
  misc_feature (654)..(654): n is a, c, g, or t
  misc_feature (666)..(666): n is a, c, g, or t
  misc_feature (678)..(678): n is a, c, g, or t
  misc_feature (717)..(717): n is a, c, g, or t
  misc_feature (724)..(724): n is a, c, g, or t
  misc_feature (737)..(737): n is a, c, g, or t
  misc_feature (745)..(745): n is a, c, g, or t
  misc_feature (749)..(749): n is a, c, g, or t
  misc_feature (814)..(814): n is a, c, g, or t
gttatgagtgagggccataatcccttatccattatcactaccttaatctttgatgagattgccgagagtgagaactgaagagcaatggcttcagtagcttcatcttcatccttttccacaaggcatcttctgcgttcccccacacctctgttaggcagaagaagatgcagacccaattttctgagtatggtcactcgctcctgtctcgatgacagttccgctctccttcatgcagcggaatacactgtggataattacgtaaaaagtggcatggttgtgggattggggtctggtcatgcttctggtatggccattcagcatttgggtcgccagcttcgtactggtaatttgaaggatatagttgggattcccatgtctgttgcaagtgcaagtgaagcagcaaaggctggattccattggatacctaccaagaaagttctcaaattgattttgcatttgatgatgctgatgctatagaagaaggaacacttgttgctatcattgggcgccggaaattgcaaggtggggaatccataatccaggagaaatctataataaatgcctccaataaacttgtgttcattatcgaagaaaaccagtacaaagcccaactggntggcaactgctgaagagattgatgatatgtttttgggngatgctgaggtntggagaagaccntccatgggacaagcaggtccgttaggaggtgacttcccngtagttnccagggaagggcncaacattnttgntgttatctttacatctcccatagaaaaccttgctgaagtagcaaaaagccttggtaaagttgatngtgttgtggaccatggtgttgtatctaaaattccatgcacagtggtaattgcttctcaaaatgggctgaacattttggacaaattgacagcagatatagtgggctagatacagtactaatagctctgcttcttaccttcctctctttttcatctcaccccaaatatttattatgcaacaagattaatcagtaatttaactaactatcaaaggaagctgagggttacatgtgctgtgttatatatacatgatactattgttttggtttgtattttccattcccaaatggttccatagtaagggtgaggctggagaaattaactggtctccaactacaacataaattgttattccaatcttttttttttatatttttgggtaatcaatagaacttttttttttttttt

SEQ ID NO: 5529 - DNA, 1137 bp, Cicer arietinum
cccgggctgcaggattcgaattcaaagaaatgaatgaaataattagtgacaattgaacctcaatatcaatggcttccatagcttcattttcatcgctttccacatggcttcttctccattcatccacagctccattggatggaagaaggaaaacaatcacaccgaattttgtgaggatgcccactcgctcctgtctcgatgatacttcttctctcctccgagctgctcaatacactgtggatacatacgtgaaaagtggcatgattgtaggattgggatctggtcatgcttctgatatggccattcagcatttgggtcttcagcttcgtcgtggtaatttgaaggacattgtagggattcccatgtctgttgcaagtgcaagtgaagcagcaaaggctgggattccattggatacctaccaaggcagttctcaaattgattttgcatttaatgatgctgatgctattgaagaagggacatttgttgctatcattggtcgccggaaattgctaagtgaggaatccataatccaggagaagtccatactgaatgctgctgataaactagtgttcattatcgaagaaaaccagtacaaaggtggtctggaaggttctattccagttttaattcagtctctcaattggttggcaactgctgaagagattgatgatatgtttcttggcgatgccgaggtatggagaagaccaggtattgggcaagcaggtccactaggaggtgacttcccactagtcacaagagaaggacataatgttcttgatgttatcttcacatctccaatagcaagccttgctgaagtagcgaaaatcttcgataaagttgatggtgttgtggatcatggtgtcatatctaaaatcccatgcacagtggtaattgcttctccgaatggattgaacattttggacaaattgactgcagatatagtgagttaggcacttaagcttcatttcttatagctctgctttgcggatgaatgtaaatgagtttgtccttcttttccctcattttcttttctttttctgttatgtgcttcaaggccaaatatttgctattgtagctatatttatttatttagggattaaggctaagaaaatgagaaaatatgactggatcaactat

SEQ ID NO: 5530 - DNA, 1157 bp, Glycine max
tgagataagagcacacgtttaacaaaatgctattctctatttctcatcactttaatcacgcactatcagtacaacaactcactcactaagctaaacaatttcatcaagcctgccatggcttcctcgtgtgcttcctctgccattgcagctgttgccatctccacaccaagttcccagaagaatggatcactcttgggaagcacaaaagcttcttttcttagtgggaggaaactgaaggtgaacagttttacagcaccagttggagcacgatccagcactacagtgtgtgcagttgctgagcctgataggcctctgtggttcccaggcagcacccctcctccatggctagatggcagtttgccaggagattttggctttgatcccctaggtcttggatctgatcctgagagcctgagatggaatgtccaagcagagcttgtgcactgcagatgggccatgttgggagctgctggcattttcatcccagaattcctcacaaagattggtatcctgaacaccccttcatggtacactgctggagagttggagtacttcacagacactaccacactcttcgtagttgagctctttttcattggttgggccgagggtagaaggtgggctgatatcatcaagccaggctgtgtcaacactgaccctatctttcccaacaacaagctcacaggaactgatgttgggtacccaggtgggctttggtttgatccacttggctggggaagtggttctcctgagaagatcaaggagttgagaacaaaggagatcaagaatgggaggttggccatgttggctgtgatgggggcatggttccagcacatttacactggcactggtcctattgacaacctctttgctcaccttgcagatcctggtcatgctactatttttgctgctttcactcccaagtgagaagggttggaacaactctatgattgcaagccttggagaaacattgggaaacttgtttaactaagttgtaaggcttaaatgtctttaggggggagtttttatgttggtgaaagcttgtaaaatggtacttctattgtcatgcacagattgattattcaatgtacaaatacctatttaagtttagatgcatttaatgtaaattcaggaagtaatcacagtttttgcatgga

SEQ ID NO: 5531 - DNA, 1260 bp, Cajanus cajan
aaccacatacatcagcacaacaactcactaagctaaatcacttcatctatctctccaggtgaaagcctgtcatggcttcgtcatgtgcttcctctgccattgcagctgttgccatctccaccccaagttcccagaagaatggttcactcttgggaaccacaaaagcttcttttcttagtgggaggaaactgaaggtgagcaattttacagcaccagttggaacacgatccagcactacagtgtgtgcagttgctgaccctgataggcctctgtggttcccaggcagcacccctcctccatggctagatggcagtttgccaggagattttgggtttgatcctctcggtcttggatctgaccctgagagcctgagatggaacgttcaagcagagcttgtgcactgcagatgggccatgttgggagctgctggcatattcatcccagaattcctgacaaagattggtatcctgaacaccccttcatggtacactgctggagagttggagtacttcacagacaccaccacactcttcgtagttgagctctttttcattgggtgggctgagggtagaagatgggctgacatcatcaagccaggctgtgtcaacactgaccccatctttcccaacaacaagctcacaggaactgatgttgggtacccaggtgggctttggtttgacccacttggctggggaagtggttctcctgagaagatcaaggagttgagaacaaaggagatcaagaatgggaggttggccatgttggctgtcatgggggcatggttccagcacatttacactggcactggtcctattgacaacctctttgctcaccttgcagatcctggccatgctactatttttgctgctttcactcccaagtgagaagggttggaacaactttaagattgcaagccttggagaaaccctggaaaaactgtttgactaagtagtaaggcttaaatgtctttagaagggagtgtttatgttggtgaaagcttgtaaaatggctacttctattgtcatgcacagattcatgattcaatgtacaaatacctatttaagtttagatgcactgaatgtaaattcaggaagtaatcacattttttgcatggatgataggactgcaataatatcggatggtaactagcacaggggatactagatggtccttgttaacctgctcttaatcgataataacttaacagagaaaatacacagaaaaatctgagaaaattaagcatatgatattatctttatc

SEQ ID NO: 5532 - DNA, 1240 bp, Vigna unguiculata
caaagcctgccatggcttcctcctgtgcttcctctgccattgcagctgttgcaatctccaccccaagttcaaaaaatggatcactgttgggaaccgcaaaagcttcttttctcagtggaaggaaactgaagatgaacagtttcacagcaccggttggagcacgatccagcactacagtgtgtgcagttgctgaccctgataggcctctgtggttcccaggaagcacccctcctccatggctagatggcagtttgcctggagattttggttttgatcctctcggtcttggatctgatcctgagagcttgagatggaatgttcaggcagagcttgtgcactgcagatgggccatgttgggtgctgctggaattttcatcccagaattcctcacaaagattggtatccttaacaccccttcatggtacactgctggagagttggagtacttcacagacaccaccacactgttcatagttgagctctttttcattgggtgggctgagggtagaagatgggctgacatcatcaaaccaggctgtgtcaacactgaccccatctttcccaacaacaagctcacaggaactgatgttgggtacccaggtgggctttggtttgatccactgggctggggaagtggctctcccgagaagatcaaggagttgagaacaaaggagatcaagaatgggaggttggccatgttggctgtgatgggtgcatggttccagcacatatacactggcactggtcctattgacaacctctttgctcaccttgcagatccaggccatgctactatttttgctgctttcactcccaagtgagaagggttggaacaactctgtgattgcaagccatggaggaacattggcaaatctgtttaactaagttgtaaggcttaaatgtgtttaaggaggagaatttatgtgggtgaaagcttgtaaaatggctacttctattatcatgcacagattgatgattcaatgtacaaatacctatttaagtttagatgcattcagtgtaaattcaggaagtaatcacaatttttgcatgcatgataggactgcaacactatgtgatgataactcgcacaggggatattagatggtcctgaaagcctacttaatcttcattcacgtttcctaaaattcaatgctcttaatcgattcagagaaaacggaccgaaaaatatgtaaaaagtaagcatataatttcatttttatcttataaaaaaaaaaaaaaa

SEQ ID NO: 5533 - DNA, 1215 bp, Vigna unguiculata
atggcttcctcctgtgcttcctctgccattgcagctgttgcaatctccaccccaagttcaaaaaatggatcactgttgggaaccgcaaaagcttcttttctcagtggaaggaaactgaagatgaacagtttcacagcaccggttggagcacgatccagcactacagtgtgtgcagttgctgaccctgataggcctctgtggttcccaggaagcacccctcctccatggctagatggcagtttgcctggagattttggttttgatcctctcggtcttggatctgatcctgagagcttgagatggaatgttcaggcagagcttgtgcactgcagatgggccatgttgggtgctgctggaattttcatcccagaattcctcacaaagattggtatccttaacaccccttcatggtacactgctggagagttggagtacttcacagacaccaccacactgttcatagttgagctctttttcattgggtgggctgagggtagaagatgggctgacatcatcaaaccaggctgtgtcaacactgaccccatctttcccaacaacaagctcacaggaactgatgttgggtacccaggtgggctttggtttgatccactgggctggggaagtggctctcccgagaagatcaaggagttgagaacaaaggagatcaagaatgggaggttggccatgttggctgtgatgggtgcatggttccagcacatatacactggcactggtcctattgacaacctctttgctcaccttgcagatccaggccatgctactatttttgctgctttcactcccaagtgagaagggttggaacaactctgtgattgcaagccatggaggaacattggcaaatctgtttaactaagttgtaaggcttaaatgtgtttaaggaggagaatttatgtgggtgaaagcttgtaaaatggctacttctattatcatgcacagattgatgattcaatgtacaaatacctatttaagtttagatgcattcagtgtaaattcaggaagtaatcacaatttttgcatgcatgataggactgcaacactatgtgatgataactcgcacaggggatattagatggtcctgaaagcctacttaatcttcattcacgtttcctaaaattcaatgctcttaatcgattcagagaaaacggaccgaaaaatatgtaaaaagtaagcatataatttcatttttatcttata

SEQ ID NO: 5534 - DNA, 1303 bp, Phaseolus coccineus
cacataacaaaattgcattctcttcccactcatcatttaatcacgcacacacacatccccacaacacagcaaatcactaagctaacacttcatctctcttggtgaaagccttccatggcttcctcctgtgcttcctctgccattgcagctgttgccatctccaccccaagttcaaaaaatggatcactcttgggaaccgcaaaagcttcttttctgagtgggaggaaactgaaggtgaacagtttcacagcaccagttggagcacgatcgagcactacagtgtgtgcagttgctgatcctgataggcctctgtggttcccaggaagcactcctcctccatggctagatggcagtttgccaggggattttggctttgatcctctcggtctttcatctgatcctgagagcttgagatggaatgttcaggcagagcttgtgcactgcagatgggccatgttgggtgctgctggcattttcatcccagaattcctcacaaagattggtgtccttaacaccccttcatggtacactgctggagagttggagtacttcacagacactaccacactcttcgtagttgagctctttttcattgggtgggctgagggtagaagatgggctgacatcatcaagccaggctctgtcaacactgaccccatctttcccaacaacaagctcacaggaaccgatgttgggtacccaggtgggctttggtttgatccacttggctggggaagtggttctccagagaagctcaaggagttgagaacaaaggagatcaagaatgggaggttggccatgttggctgtgatgggtgcatggttccagcacatatacactggcactggtcctattgacaacctctttgctcaccttgcagatccaggccatgctactatttttgctgctttcactcccaagtgagaagggttggaacaactctatgattgcaagccatggagaaacattggcaaacctgttttaactaagttgtaaggcttaaatgtctttagggggagtgtttatgtcggtgaaagcttgtaaaatggctacttctataatgatgcacagattgatgtttcagtgtacaaatacctatttaagtttagatgcatttaatgtaaattcaggaagtaatcacaatttttgcatgcatgctaggactgcaacacaatctgatggtaactagcacgaacaggggacattagatggtggtagcctgctgaaaatcaatgctcttaatcgattatatttatctcataaccacacagagaaaatgcactgaaaaatatgtgaaaattaa

SEQ ID NO: 5535 - DNA, 1111 bp, Phaseolus coccineus
cgcacacacacatccccacaacacagcaaatcactaagctaacacttcatctctcttggtgaaagccttccatggcttcctcctgtgcttcctctgccattgcagctgttgccatctccaccccaagttcaaaaaatggatcactcttgggaaccgcaaaagcttcttttctgagtgggaggaaactgaaggtgaacagtttcacagcaccagttggagcacgatcgagcactacagtgtgtgcagttgctgatcctgataggcctctgtggttcccaggaagcactcctcctccatggctagatggcagtttgccaggggattttggctttgatcctctcggtctttcatctgatcctgagagcttgagatggaatgttcaggcagagcttgtgcactgcagatgggccatgttgggtgctgctggcattttcatcccagaattcctcacaaagattggtgtccttaacaccccttcatggtacactgctggagagttggagtacttcacagacactaccacactcttcgtagttgagctctttttcattgggtgggctgagggtagaagatgggctgacatcatcaagccaggctctgtcaacactgaccccatctttcccaacaacaagctcacaggaaccgatgttgggtacccaggtgggctttggtttgatccacttggctggggaagtggttctccagagaagctcaaggagttgagaacaaaggagatcaagaatgggaggttggccatgttggctgtgatgggtgcatggttccagcacatatacactggcactggtcctattgacaacctctttgctcaccttgcagatccaggccatgctactatttttgctgctttcactcccaagtgagaagggttggaacaactctatgattgcaagccatggagaaacattggcaaacctgttttaactaagttgtaaggcttaaatgtctttagggggagtgtttatgtcggtgaaagcttgtaaaatggctacttctataatgatgcacagattgatgtttcagtgtacaaatacctatttaagtttagatgcatttaatgtaaattcaggaagtaatcacaatttttgcatgc

SEQ ID NO: 5536 - DNA, 1244 bp, Arachis hypogaea
gcatatagtaaccaaaaataattacaataataattgcattttccttttcttttcctcagtcatcaactaagctgggttcctcagccatggcttctgcttgtgcttcctctgccattgcagctgttgccatctcttccccaagttctcagaagaatggatcacagttgggaaccacaaaagcttcatttcttagtggaaggaagcttaagttgaacaacttcacagcaccaactactggagctagatccagcaccacagtgtgtgtagcagctgatcctgataggcccctttggttccccggcagcactcctccgccttggctcgatggcagtctccccggagactttggatttgatcctctaggacttggatctgacccagagagcctaagatggaatgttcaagcagagcttgtgcactgcagatgggctatgttaggcgccgccggcatcttcatcccggaattcctaaccaagattgggatcctaaacacaccttcatggtatactgctggggagcaagagtacttcacagacaccaccacactcttcatagttgagctcatcttcatcggctgggccgagggacgaagatgggctgatatcatcaagccaggctgtgttaacactgaccctatcttccctaacaacaagctcaccggaactgatgtagggtatcccggcggcctatggtttgaccctctcggatggggaagcggttcacctgagaagatcaaggagttgagaacaaaggagatcaagaatggaaggttggccatgttggctgtcatgggagcatggttccagcacatttacaccggcaccggccctatcgacaacctctttgcacaccttgctgatcctggccatgctactgttttcgctgctttcacccccaagtgagaatgttaaggacaattgtgagtgagattgtgcaagcctgtaatgagaaacattgatgaaacatggttttgtaactaatgtggctacttctatatcaatgtcatgcacagattgataattgaatgtacaaattcttattttagattcaagaagtaaccacaatttttgcatagattataggactgcaattatatcctaagttattattcaccactaaagaatatagcatacgctcacacatgaaaatgcttttgctctattatttgcaaagtatattgtggtcccaaaaaatataaaacaaaaaataaaattaacattttttcatttactatagcttaagag

SEQ ID NO: 5537 - DNA, 1199 bp, Lotus japonicus
ttcgatcacaaacacacatcagcaaaaaaactcactaagccacaccgtattactgtctctcgaggtgaaggcctttcatggcttcagcgtgtgcttcctctgccattgcaactcttgcaatctctaccccaagctcccagaagaatggatcacccttgggaactacaaaagctttccttagtggaaggaagctgaaggtgaacacctttacagcaccagttggggcaagatccaccactacagtgtgtgcagcagctgaacctgataggcctctgtggttcccaggaagcacccctcctccatggcttgatggcagtctcccaggagattttgggtttgatcctcttggtctttcatctgatccggagagcctgagatggaatgtccaagcagagcttgtccactgcagatgggcaatgttgggtgctgctggcattttcatcccagaatttctaacaaagattggtatcctgaacaccccttcatggtacactgctggagagcaggagtatttcacagacaccaccaccctcttcatagttgagctcattttcattggctgggctgagggtagaaggtgggctgacatcctcaagccaggctctgtcaacactgaccctatcttccccaacaacaagctcacaggaacagatgttgggtacccaggtgggctttggtttgacccacttggttggggaagtggttctcctcagaagctcaaggagttgagaacaaaggagatcaagaatgggagactagccatgttggctgtgatgggtgcttggttccagcacatttacactggcactggtcctattgacaacctctttgcccaccttgctgatcctggccatgccactgtttttgctgctttcactcccaagtgagaagggttggaacaactctaagattgcaagccttggagaaacaatgttgaacctgttttactatgttgtaagggtttgatgtttttagggaggagtgtttatgttgatgaaaagttgtaaactggcttcttctatgtcatgcacagatggattgttcaatgtacaaatacctatttaagtttagatggtttggaaaatgtaaatccagggagaaatcacatttttgcatggatgataggaatgctataattatctgatggtaactagcgcaggggatactagatgccttgttatataacctgttaaattttc

SEQ ID NO: 5538 - DNA, 1173 bp, Cajanus cajan
aactaatcatcaaatcagagagagcagcctcccatggcttccgcctgtgcttcctccgccattgcatctgctgccatctctacaccaagctcccagaagaatggatcaagcttgggaaccccaaaagcttcttttcttagtgggaggaaattgaggatgaacaaatacacaacagcagttggaggacgatccagcactacagtgtgtgcagtagctgaccctgacaggcctctctggttcccaggcagcacccctcctccatggcttgatggcactctccctggagactttggctttgaccctcttggccttggatctgatccggagagtctgagatggaatgttcaagcagagctagtgcactgcagatgggcaatgttgggggctgcagggattttcattccagaattcctaacaaagataggcatcttgaacaccccctcatggtacacagctggagaacttgagtacttcacagacaccacaaccctcttcgtagttgagctctttttcattgggtgggccgagggcagaagatgggccgacataataaagcccgggtgtgtgaacactgaccccatctttcccaacaacaagctcacaggaaccgatgttgggtacccaggtgggctttggtttgacccactcggatggggaagtggttctcccgagaagataaaggagttgagaactaaggagataaagaatgggagattggccatgttggctgtgatgggtgcttggttccagcacatatacaccggcactggtcctattgacaacctctttgcccaccttgctgatcctggccatgctaccatttttgctgccttcacccccaagtgaccttgcctgcgtgggagaacatgtttaatttgacccaagtaatagatcagctcaaatgtctttatgtctctagaaatcttgtattatgcatgcttattattacttctatgtcatatatgcacagaaccataatccaacttgccgacacctaattaagttttagatgtgccatgaatgtaagttcaggtaataatcacgtttgtggatgacgtcgagtatatttcatctttcacggcataatctcacaaaaatggtcatgtttaatttctttattatttatacttttcttttacattaaaggctactaataaaaattatgatttaact

SEQ ID NO: 5539 - DNA, 1084 bp, Cyamopsis tetragonoloba
gagggcctgtcatggcttccgcttgtgcttcctctgccattgcagctgttgccatctctaccccaagttcccagaagaatggatcaagtttgggaaccccaaaagcttgttttctgagtggaaggaaattgagggtgaacaagcaaacagcatcagtaggagtgagatctagcagtacagtgtgtgcagtagctgacccagacaggcctctgtggttcccaggcagcacccctcctccatggcttgatggcagtctccctggtgactttggctttgatcctcttggtcttgggtctgatccagagagtctgagatggaatgttcaggcagagctagtgcactgcagatgggcaatgttgggagctgctggaattttcattcctgaattcctgacgaagattggtatcttaaacacaccatcatggtacacagctggagaactggaatacttcacagacacaactaccctcttcgtaattgaactcattttaattggctgggctgagggtagaaggtgggctgacataataaagcccgggagtgtcaacactgaccctatctttcccaacaacaagctcacagggacagatgttgggtacccaggtgggctttggtttgaccctcttggatggggaagtggttctcctgagaagatcaaggagttgagaactaaggagattaagaatggaagattggccatgttggctgtaatgggtgcttggttccagcatatatacactggcactggacctattgataacctctttgctcaccttgcagatcctggtcatgctaccatttttgctgctttcacccccaagtgaaaagggtaagaagagttctggatgaggttgcaaaagcctgggagaaacatgaacatgtttgactcaagtaatagagctcatgtgtcttaggtgaggagtgtttgtaaggagaaattaaagcttgtaatgtgactcctatgtcgtgcacagaatgataattcatcgtacaaaaaattatttaagctctagatgtcatgaatgtaagttcagttgagaatcacgtttgtgcataaatgataaccagcttagaagatgttaat

SEQ ID NO: 5540 - DNA, 1245 bp, Phaseolus coccineus
atcaacaattttgcttttctttaccattgatcatcaaacatatacccagaagcagaatcattaaaaatttattgttttgaatcaagggtgaatggcttccgcttgtgcctcttctgccattgctgctgtttccatctccacgccaagttcccagaagaatggatcagccttgggaactcccaaagcttcttttcttggtggaaggaaattgagggtgaacaaatacacagcagcagttggaggacgatccagcactacagtgtgtgcagtagccgagcccgacaggcccctatggtttcctggcagcacacctcctccatggcttgatggcactctccctggagactttggctttgaccctcttggtcttggatctgatcctgagagtctgaggtggaatgttcaggcagagatagtgcactgcagatgggcaatgttgggtgctgctgggattttcattccagagtttctgacaaagattggtgtcttaaacactccctcatggtactcagctggagaacaggaatacttcacagacaccactaccctcttcattgttgagctctttttcattgggtgggctgagggtagaagatgggctgacataatcaagccagggtgtgtcaacactgaccccatctttcccaacaacaagctcacaggaactgatgttggttacccaggtgggctttggtttgacccccttggatggggaagtggctctccccagaagatcaaggagttgagaactaaggagatcaagaatggtagattggccatgttggctgtgatgggtgcatggttccagcatatatatactggcactggtcctattgacaacctctttgcccacctttcagatcctggccatgctaccatttttgctgctttcacccccaagtgaaaagggctgaagatcaacaatggaacctgggagaggagaacatgtttgacagaagtaatagagataaaatatcttaggagaggagtgtttatgtctgtagaatgcttgtaatatggctacttctatatatatgcacagaatgataatccaacttgccgacaactattcaagttttagatgccatggatgcgtttaaaatctgagagaagtgttcacatttcatcacttataaacttttctctttagttcatctttagttcatcaaaggctagtcataacaattagaaattagcctgctacattcctgatcatgcagtattctaaaatacttcctccaaaaa

SEQ ID NO: 5541 - DNA, 1136 bp, Phaseolus coccineus
tggccggggggagtcatcaaacatatacccagaagcagaatcattaaaaatttattgttttgaatcaagggtgaatggcttccgcttgtgcctcttctgccattgctgctgtttccatctccacgccaagttcccagaagaatggatcagccttgggaactcccaaagcttcttttcttggtggaaggaaattgagggtgaacaaatacacagcagcagttggaggacgatccagcactacagtgtgtgcagtagccgagcccgacaggcccctatggtttcctggcagcacacctcctccatggcttgatggcactctccctggagactttggctttgaccctcttggtcttggatctgatcctgagagtctgaggtggaatgttcaggcagagatagtgcactgcagatgggcaatgttgggtgctgctgggattttcattccagagtttctgacaaagattggtgtcttaaacactccctcatggtactcagctggagaacaggaatacttcacagacaccactaccctcttcattgttgagctctttttcattgggtgggctgagggtagaagatgggctgacataatcaagccagggtgtgtcaacactgaccccatctttcccaacaacaagctcacaggaactgatgttggttacccaggtgggctttggtttgacccccttggatggggaagtggctctccccagaagatcaaggagttgagaactaaggagatcaagaatggtagattggccatgttggctgtgatgggtgcatggttccagcatatatatactggcactggtcctattgacaacctctttgcccacctttcagatcctggccatgctaccatttttgctgctttcacccccaagtgaaaagggctgaagatcaacaatggaacctgggagaggagaacatgtttgacagaagtaatagagataaaatatcttaggagaggagtgtttatgtctgtagaatgcttgtaatatggctacttctatatatatgcacagaatgataatccaacttgccgacaactattcaagttttagatgccatggatgcgtttaaaatctgagagaagtgttcacatttcatcacttataaacttttctctttagttc

SEQ ID NO: 5542 - DNA, 1083 bp, Vigna unguiculata
cagaaacacacagagactcactcagtgaataattattcattattctgaatcaagggtgaatggcttctgcttgtgcctcctctgccattgctgctgtttccatctccacgccaagttcccagaagaatggatcagtgttgggaaccccaaaagcttcttttcttggtggaaggaaattgagggtgaagaaatacacagcagcagttggaggaggatccagcactacagtgtgtgctgtagcagaccctgacaggccgctatggtttccaggcagcactcctcctccatggcttgatggcagtctccccggagactttggctttgaccctcttggtcttggatctgatccggagagtctgagatggaatgttcaggcagagctagttcactgtagatgggcaatgttgggtgctgctgggattttcattccagaatttctgacaaagatcggtgtcttaaacaccccttcatggtactcagctggagaacaagaatacttcacagacaccactaccctcttcattgttgaactgtttttcattggttgggctgagggtagaaggtgggctgacataatcaagccagggtgtgtgaacactgaccccatctttcccaacaacaagctcacaggaaccgatgttggttacccaggtgggctttggtttgaccctcttggatggggaactggttctcccgagaagctcaaggaattgagaactaaggagatcaagaatgggagattggccatgttggctgtcatgggtgcatggttccagcacatatacaccggcactggtcctatcgacaacctctttgctcaccttgcagatcctggccatgctaccatttttgctgctttcacccctaagtgatgaagatcaacaatagatcctgggagaacaacatgtttgacctaagtaatagagagatcgaatgaatgtcttaggagaggagtgtttatttatgtctgtagaaagctttgtaatatggcaacttctactacatatatgcacagaatcataatccaacttgccgacacctatttaagttttagattacatgaatgcgttttgataatattaa

SEQ ID NO: 5543 - DNA, 1139 bp, Vigna unguiculata
cagaaacacacagagactcactcagtgaataattattcattattctgaatcaagggtgaatggcttctgcttgtgcctcctctgccattgctgctgtttccatctccacgccaagttcccagaagaatggatcagtgttgggaaccccaaaagcttcttttcttggtggaaggaaattgagggtgaagaaatacacagcagcagttggaggaggatccagcactacagtgtgtgctgtagcagaccctgacaggccgctatggtttccaggcagcactcctcctccatggcttgatggcagtctccccggagactttggctttgaccctcttggtcttggatctgatccggagagtctgagatggaatgttcaggcagagctagttcactgtagatgggcaatgttgggtgctgctgggattttcattccagaatttctgacaaagatcggtgtcttaaacaccccttcatggtactcagctggagaacaagaatacttcacagacaccactaccctcttcattgttgaactgtttttcattggttgggctgagggtagaaggtgggctgacataatcaagccagggtgtgtgaacactgaccccatctttcccaacaacaagctcacaggaaccgatgttggttacccaggtgggctttggtttgaccctcttggatggggaactggttctcccgagaagctcaaggaattgagaactaaggagatcaagaatgggagattggccatgttggctgtcatgggtgcatggttccagcacatatacaccggcactggtcctatcgacaacctctttgctcaccttgcagatcctggccatgctaccatttttgctgctttcacccctaagtgatgaagatcaacaatagatcctgggagaacaacatgtttgacctaagtaatagagagatcgaatgaatgtcttaggagaggagtgtttatttatgtctgtagaaagctttgtaatatggcaacttctactacatatatgcacagaatcataatccaacttgccgacacctatttaagttttagattacatgaatgcgttttgataatattaacatttgtgcgtaagatgataatattccacgtcgagcatttcatcattcacgacaga

SEQ ID NO: 5544 - DNA, 1272 bp, Medicago truncatula
tccttaaggataagaaacattgcatacattaacaaaattagcatattttctttcatattcaccaaccaatcattctcataaccaaaactcacaaaacttactcacttttatcccttgagggcaagaacagtatcatggcttctgcttgtgcttcttctgccattgcagctgttgccatctctccaagttctcagaagaatggatcacccatgggaacctcaaaagcttttcttggaaggaaactgaaggtgaacagcaacattgcagcaccagttagagtgagatctaccacaacagtgtgtgcagcagctgagcctgatagacctttgtggttcccaggaagcacccctcctccatggctagatggcagtctcccaggagattttggttttgatcctcttggactttcctctgatccagagagtctgaaatggaatgttcaagccgagcttgtgcactgcagatgggcaatgttgggagcagcaggaattttcatcccagaattcctaacaaagattggtatcttgaacacaccttcatggtacactgctggagagcaagagtatttcacagacaccaccacactcttcatagttgagctcattttcatcggttgggccgagggtagaaggtgggctgacatcctcaatccaggttgtgtcaacactgaccctatctttccaaacaacaagctcacaggaactgatgtaggatacccgggtggactttggtttgatccacttggttggggaagtggttctcctcagaagcttaaggagttgagaacaaaggaaattaagaatgggagattggctatgttggctgtgatgggagcttggttccagcacatttacaccggcactggtcctattgataacctttttgctcaccttgctgatcctggtcatgctactattttcgctgctttcactcccaagtgagaagagctaggaaggacaactatgaggttgtaagccttgaagaaacaatggtgaacctgttttactaagtagtaaggcttacatgtttttttagggaggagtgtttatgttggtgaaaggttgtaaaatggctacctactacttctatgtgatgcacaggttgatggttcaatgtataaatacctctttaagtttagatgttttgaatgtaaatccaggaagtaactagttacgtttttgcatggatgatataaaggactgaaataacatctaatgggaaactaatatagggaataatagattgtattataacctgctaaatcttcattca

SEQ ID NO: 5545 - DNA, 1197 bp, Medicago truncatula
attcaccaaccaatcattctcataaccaaaactcactaaacttactcacttttatcccttgagggcaagaacagtatcatggcttctgcttgtgcttcttctgccattgcagctgttgccatctctccaagttctcagaagaatggatcacccatgggaacctcaaaagcttttcttggaaggaaattgaaggtgaacagcaacactgcagcaccagttagagtgagatctaccacaacagtgtgtgcagcagctgagcctgatagacctttgtggttcccaggaagcacccctcctccatggctagatggcagtctcccaggagattttggttttgatcctcttggactttcatctgatccagagagtctgaaatggaatgttcaagccgagcttgtgcactgcagatgggcaatgttgggagcagcaggaattttcatcccagaattcctaacaaagattggtatcttgaacacaccttcatggtacactgctggagagcaagagtatttcacagacaccaccacactcttcatagttgagctcattttcatcggttgggccgagggtagaaggtgggctgacatcctcaatccaggttgtgtcaacactgaccctatctttccaaacaacaagctcacaggaactgatgtaggatacccgggtggactttggtttgatccacttggttggggaagtggttctcctcagaagcttaaggagttgagaacaaaggaaattaagaatgggagattggctatgttggctgtgatgggagcttggttccagcacatttacaccggcactggtcctattgataacctttttgctcaccttgctgatcctggtcatgctactattttcgctgctttcactcccaagtgagaagagctaggaaggacaactatgaggttgtaagccttgaagaaacaatggtgaacctgttttactaagtagtaaggcttacatgtttttttagggaggagtgtttatgttggtgaaaggttgtaaaatggctacctactacttctatgtgatgcacaggttgatggttcaatgtataaatacctctttaagtttagatgttttgaatgtaaatccaggaagtaactagttacgtttttgcatggatgatataaaggactgaaataacatctaatgggaaactaatatagggaataatagattgtattataa

SEQ ID NO: 5546 - DNA, 1132 bp, Cicer arietinum
gattctacatgccacatggcaacactccatctaataccaaattcacattcctatcctttaagataagaaacatttgcatacattaataaaatttgcacattttctttctcattcaccatccaaataattcacatcaacacaaactcactaagcttagtcactttatcccttgagggcaaaggcatctatcatggcttctgcttgtgcttcttctgccattgcagctattgccatctctaccccaagttctcagaagaatggatcagccttaggaatcacaaaagcttttcttgggaggaaactgaaggtgaacaacaacacatcagttagagtaagatctgctgccacaacaaagtgtgcagtagctgagcctgataggcctatttggttcccaggaagcacacctcctgcatggcttgatggcagtctccctggagattttgggtttgatcctcttggtcttggatctgatccagagagcctaagatggaatgttcaagcagagctagttcactgcagatgggcaatgttaggtgcagctggaattttcattccagaattcctaacaaagattggtatcttgaacacaccatcatggtacactgctggagagcaagagtatttcacagacaccaccacactcttcataattgaactccttttcattggttgggctgagggtagaagatgggctgacataatcaatcctggttgtgtcaacactgaccctatctttccaaacaacaagctcacaggaactgatgtgggctacccaggtgggctttggtttgacccacttggttggggaagtggttctcctaaaaaacttaaggagttgagaacaaaggaaattaagaatggaagattggctatgttggctgtgatgggagcttggttccagcatatatacacaggcactggtcctattgataacctctttgctcaccttgctgatcctggacatgctactatttttgctgctttcactccgaaatgagaagggctaggacaaccttggagaaacaaattgtgaacatgttttactaagtagtaaggcatacatgttattttaggaggagtgtttatgttggtggaaggttgtaaaatggttacctacttctatgtcatgcac

SEQ ID NO: 5547 - DNA, 1158 bp, Trifolium pratense
cacaaactcactaaacttaaccacttttatcccttgaggacaaaggctagtgtcatggcttctgcttgtgcttcttctgccattgcagctgttgccatctctactccaagttcccagaagaatggatcatctttgggagcctcaaaagctttttttgggaggaaactgagggtgaacaacaacacatcagcaccacttagagtaaggtctaccacaacagtgtgtgcagcagctgagcctgatagacctttgtggttcccaggaagcgtccctcctccatggcttgatggcagtctcccaggagattttggatttgatcctcttggactttcatctgatccagagagtctgagatggaatgttcaagcagagcttgtacactgcagatgggcaatgttaggtgcagcaggaattttcattccagaattcctaacaaagattggtatcttgaacacaccttcatggtacactgctggagagcaagagtatttcacagacacaactacactcttcatagttgagctcattttcatcggttgggccgagggtaggagatgggctgatatcctcaaaccaggttctgtcaacactgaccctatctttccaaacaacaagctcacaggaactgatgtagggtaccctggtggactttggtttgatccacttggttggggaagtggttctcctcagaagcttaaggagttgagaactaaggaaattaagaatggaagattggctatgttggctgttatgggagcttggttccagcacatttacactggcactggtcctattgataacctctttgctcatcttgctgatcctggtcacgctactattttcgctgcattcactcccaagtgagaagggcaaggacaacttagagattgtaagccttggaggaacaaatgatgaacatgttttactaagttgtaaggcttacattacatgttgtttagggaaaagtgtttatgttggtgaaaggttgtaaaatggctacctacttcaatgttatgcacaggttgatggttcaatgtataaatacctattttataagtttagatgccttgaatgtaaatccaggaagtaagtaactaattacatttttgcatggaaaatatgtggaaaattaagcacatggtttcattaataaaaaaa

SEQ ID NO: 5548 - DNA, 1059 bp, Manihot esculenta
acactccatttcaacaccccccacaaactcattcaacaacaaaaatggcttctgcttgtgcttcttctgccattgcagctgttgccatttctcccagttcccagaagagtggatctatagtgggggctacaaaggcttctttccttagtgggaagaaattgagattgagaaactacacatcacctgtagcttcaagatctgttacagtttgtgctgcagctgaccctgatagacccctgtggttcccaggcagcacccctcctccatggctcgatggcagtctaccaggagactttggctttgatcccttgggtcttggatctgatcctgaaaccctgagatggaatgtacaagcagagcttgtgcactgcagatgggcaatgttgggcgctgctggtattttcatcccagaatttctaaccaagattggcatcttaaacaccccatcatggtatgatgctggaaaactggaatacttcactgatacaactacccttttcattattgagctcatatttatcggatgggccgaggggagaagatgggcagatattctaaagccagggtgtgttaacacagaccctatcttccccaacaacaagctcactggaactgatgtgggttacccaggagggctatggtttgatcctcttggatggggatctggttctcctgagaagatcaaggaattgaggacaaaggagatcaagaatgggagattggctatgttggctgtgatgggtgcttggttccaacacatctacacaggcactggtccaattgacaacctctttgctcaccttgctgatcctggtcatgccaccatttttgctgctttcacaccaaagtgaagaatccagagagaatgccaagcaaaaggcttgaaagatttgtacttgtggaatgaaaaacctttgtgtcattagaagttgaaatggctgtgtttatgatagctttctcatagaaatgaccttgcagtgtacaaaaatttttagcttaaatcttcatgaatatattttagctgtcaagaaaatcacaaatgcattctgggatttgatc

SEQ ID NO: 5549 - DNA, 1294 bp, Populus trichocarpa
gaggtagagtggtagagatgcttgatatcagattctgcatgccacatggcaatcaagtagccaattagacattatttctcctatccttcaagataagcccctgcatacattaacagatttgcaaaccacctccatataccattcaaacacagcacaaacgcttcggaagaaaatcttttggccacaaaaatggcttctgtttgtgcttcttctgccattgcagctgtttccatctcttcttccagttcccagaagactgggttcctcgttgggtcaacaaaggcttcttttcttagtgggaagaaattgagactgaaaaagtacacagcaccaactgcagctcgatcagttacggtttgtgttgcagctgaccctgatagacccctctggttcccaggtagcacccctcctccatggcttgatggaagcctccctggagactttggtttcgatcctctaggtcttggatctgatcctgaaactctgagatggaatgtgcaagcagaacttgttcactgcagatgggcaatgctaggtgctgctggtattttcatcccagaattcctaacaaagattggcatcctaaacaccccctcatggtacactgctggagaacttgaatacttcactgacaccaccacactcttcattgttgagttgttctttattggctgggctgaagggaggagatgggcagatattctcaagccagggtgtgttaacactgatcctatcttcccaaacaacaagctcactggtactgatgttggttacccaggtgggctatggtttgacccacttggatggggaagtggttctcctgagaagatcaaggaattgaggacaaaggagatcaagaatggaagattggctatgttggctgtcatgggtgcttggttccaacacatttacactggcactggtcctatcgacaacctctttgctcaccttgcagatcctggtcatgccaccgttttttctgctttcacccccaagtgaggaacactggtgaacatgcttgcctaatcaaggaaggagcttgaaatatttgtatttgtcgatgcaacctttgtatcatcactagaacttgtaatgtctctgatcgttatgatttctcatagagtgctgttgctatgtacaaaaaccacccattgaacttagatgtcaccgatatatttgagctagtaacgaaagttgcccagaaacgcaaccatcatgtaccacatgaaacttcagagctcgtcatcggcaggctctcactcactgctcatccatcaaattttttattattatt

SEQ ID NO: 5550 - DNA, 1029 bp, Manihot esculenta
atactcattccaatacagcacaaactcattgaagaaagaattggacaaatatggcttctgtttgtgcttcttctgccattgcagctgttgctatctcctctcccagttcccagaagactggatccatagtaggagcaacaaaggcttcttttcttaatggaaagaaattgagactgagaaaccacacatcgccggttgcttcacgatcggttacagtatgtgttgcagctgagccagatagacccctctggttcccaggcagcacccctccaccctggctcgacggaagcctcccaggagactttggctttgatcccttgggtcttggttctgatcctgaaaccctgagatggaatgtacaggcagagcttgtgcattgcagatgggcaatgttgggtgctgctggtattttcattccagaattcctaaccaagattggcatcctaaacaccccatcatggtacgatgctggaaaactggaatacttcactgacacaacaaccctgttcattattgagctcatcttcatcggctgggccgaggggaggagatgggcagatattctcaagccagggtgtgtcaacacagaccccatcttccccaacaacaagctcaccgggactgatgttggttacccaggtgggctatggtttgatcctcttggatggggatctggttcccctgaaaagatcaaggaattgaggacaaaggagatcaagaatgggagattggccatgttggctgtgatgggtgcttggttccaacacatttacacaggaactggccccattgacaacctctttgctcatcttgctgatcctggtcatgccaccatttttgctgctttcacacccaagtgaagaagccgaagggagtgccaaggcttgaaagatctgtactgtggaaagaaaaaccttcgactcattagaatttgtaatgcctatgtttatgatggctctctcatggaatgcttgtgcagtgtacaaaaattttaaatcagatgcccatgaatatattttagctggtgac

SEQ ID NO: 5551 - DNA, 1233 bp, Platanus occidentalis
agcccccaacaacacagaaaatttgcttctgctaaaatggcgtctgtttgtgcttcttctgctattgcagctgtagccatctcctcttccagttctcagaagagtggatctgttgtgggagcaacaaaggcttctttccttggagggagaaaactgagacagaagaagtttacagcaccatcaggaccacgatcccaagccgtgtgcgctgctgctgaccctgatcggccactctggttcccaggcagcacccctcccccatggctcgatggcagtcttccaggagattttgggttcgaccctcttggtcttggatctgatccagagagcctgagatggaaccagcaagcagagcttgtgcactgcagatgggcaatgttaggtgctgctggtatcttcatccctgaattccttacaaagattgggattctgaataccccttcatggtatactgctggagaactagagtatttcacagacaaaacaaccctctttgtagtcgagctcatcttcattggttgggccgaagggagaagatgggctgacatcctcaaacccgggtgtgtgaacaccgatccgatcttcccaaacaacaagctaaccgggactgatgttggctaccctggtggtctctggttcgaccctctcggttgggggtctggttctcctgaaaagatcaaggagttgaggacaaaggaaataaagaatgggaggttggccatgttagcggtaatgggtgcatggttccaagccatctacacaggcactggacccattgacaacctcttcgcccaccttgcagaccctggtcatgccaccatttttgctgctttcactcccaagtgaagaaagcttggaatatcatcaattgagatttgatatcatgtggtcagaaatattggtgtaagtctttatgtgaagtagggagttgagaaggccgtggtaccaaaggatgtctgtatcattttaacttgtattatcttctgttagtgtcatccattgtacgcccatgcagtgtacaaatacctctaccagcatgttcctataagtagaacgtttaggcctttaacaggtaggtgtaaaaatttgttgctacaagtcacccttatgtggtaaaacagcctcttgaaatcgaccatatggaaatataatcaaggtcactttggatggtgaatgcatcttgcaatcttcaacttccatctcatggaactaataataaggaattaacaaaag

SEQ ID NO: 5552 - DNA, 1291 bp, Humulus lupulus
acatgtctttagccattgccctcttagactgatcacaccaaatcagactcactctcacacaaacacatcgtaaccagttctgtgggcacaagtatggcctccgcttgtgcgtcttctgccattgccgccgttgccatttcttcccccagctcccagaagagcgtgacaagtttgggggtcaccaaaggtagttttcttggcggaaggaaactaagagtgaaaagcttgaccgccccaatcaggtctagatcatcgtcagctactgtgtgcgccgcagctgaccccgacagacccttgtggttccccggcagcgtcccccctccatggctcgatggcagccttccaggagactttggctttgaccctcttggtctttcatcggaccctgatagtctgaggtggaacgtgcaagccgagctggtacactgccgatgggcaatgttgggagctgctggtattttcattccagaattcttaacaaagattggcattctcaacactccatcgtggtacacagcaggagaacaagagtacttcactgacacaactacccttttcattgttgagctcatctttattggttgggccgagggaaggcgttgggccgatatcctcaagcccggttgtgtcaacactgacccaatcttccctaacaacaagctcactggcaccgatgtgggctaccctggtgggctctggttcgacccactgggatggggcagtggttcccctgagaagctcaaggagttgaggaccaaggagatcaagaatggaagattggctatgttggctgttatgggtgcttggttccaacacatctacactggcactggcccaattgataacctctttgctcaccttgctgatcctggtcacgccaccgtttttgctgcctttacacccaagtgagggtgaagctagggagggatggtatgctaacaatggtggtgggtttggatcaaatgataatgaggaaattaggtgcggttgagatgaagatgatcatgtcatgatgtgtagtgttgtttcacttgttctaagggaatatttaattgcctggatggaacttgagtttgcctccgtacgtatattttgttctatagaattaatgatctagcaatgtacaaaatgttcctttgaaactttttgattaagatttcatgaacataaagtcagctagtattcaaattcgtcgaatatgatcgttgctttgcgatacccttttatgcgattaaagacttttgttgctaccatattcgttaaagcccataaatatatagtggatcttata

SEQ ID NO: 5553 - DNA, 1089 bp, Glycine max
atcatacatcaaacatatacacaaaagagcactgaccaaaccattttattttatttttgaatcaagggtgagggccttccatggcttccgcttgtgcttcctctgcaattacagctgttgccatctctacgccgagttccgggcagaagaatggatcaggaggttgttttcttagtggaaggaaattgagggtgaaaaaggagagagcagcaattggaggacgatcgatgggcactacagtgtgcgcagttgctgagcctgacagacctctatggttcccaggcagcacccctcctccatggcttgatggcactctacctggagacttcggctttgaccctcttggtcttggatctgacccggagagtctgagatggaatgttcaggcagagctagtgcactgcagatgggcaatgttgggtgctgctggcattttcattccagaattcctaacaaagattggtgtcttgaacactccttcatggtactcagctggagagctggaatacttcacggacactactaccctcttcatagttgagctctttttcattggctgggccgagggtagaagatgggctgacataatcaagccaggctgtgtcaacactgaccccatctttcccaacaacaagctcaccggaaccgatgtgggttaccctggtggcctttggtttgacccccttggttggggaaccggttctcctcagaagatcaaggacttgagaactaaggagatcaagaatggcagactggccatgcttgctgtcatgggtgcatggttccagcacatctacactgccaccggtcctattgacaacctctttgcccaccttgcagatcctggccatgctaccatttttgctgctttcacccctaagtgaaaaggctaagatcaacaatcagattaccagctgtttgggatgagaggagtgtttatatatgtctgtagaaattaagcttgtaatatggctacttctatgtcatatatgcacataatatcataatccaacgtgccgacacctatttaagttttagatgccatgaatgtaagttcaggtaataatcccatttgtgcataagatcata

SEQ ID NO: 5554 - DNA, 1373 bp, Ricinus communis
gaggaactattaggccccagtaatggtagttgatatttagatatatgaagctcaaggcaaagaatatgagccaccaatttgtgattattccaactggacaaaggaagtggaggtagagaagtgggatttcagattctgtaagccacatggcagccaattagccaattagacaaatttttctcctatcctttcagataagccccttcttacatcaacaaatttgcttccatatcaccctccatacatcaccctgacacagcacaaactcaattcaacaacccaaaaaagaatattggccagaatggcttccgtttgtgcttcttctgcaattgcagctgttgccatctcttctcccagttcccaaattaatggatccacagtaggggcaactaaggcttctttccttagtgggaagagattgacagtgagaaagcacacatcacctgttgttgcctcgagatctgttacagtttgtgctgttgctgatcctgatagacctctatggtttcctggcagcacccctcctccttggctcgatggcagccttcctggagactttggatttgatcccttgggtcttggatctgaccctgaaacactcagatggaatgtacaagcagagctagtgcattgcagatgggcaatgttgggtgctgctggtattttcattccagagttcctgacaaagattggtatcctaaacaccccgtcatggtatgacgctggaaaattggaatacttcaccgatacaacaaccctcttcattattgagctgatctttattggctgggctgagggaagaagatgggcagatatcctcaagccaggatgtgtcaacactgaccctatcttccccaacaacaggctcactggaactgatgttggttacccaggtgggctatggtttgacccacttggatggggaagtggttcaccggaaaagatcaaggaattgaggacaaaagagatcaagaatggtagattggctatgttggctgtaatgggtgcttggttccaacacatctacactggaactggccctattgacaacctctttgcccaccttgctgatcctggtcatgccaccgtttttgctgctttctcccccaagtgaagaactcaagagtgagacactcgaaggagcttgaaaagatttgtatttgtcgaaagaacgtcctatgtatcattagaagttgtaatgcctgtgttaatggttttgtcacagaattgctcgcccttgcaatgtacaaagttttttaacttagatgctcgtgaaatatatattagctggtaagcaaagctgtcctgcaaaaacacaccattattgtggttctgatgaaaaatttttaagtggcaaattaccaagattcctc

SEQ ID NO: 5555 - DNA, 1172 bp, Platanus occidentalis
agcacacacacaattttcttttcctgaaatggcgtctgtttgtgcttcttctgctattgcagctgtttccatttcctcttccagttctcagaagagtggatctgttgtgggagcaacaaaggcatctttccttggagggagaaagctgagacagaagcaatttacagcaccagcaggagcaagatcattttccgtctgcgccgctgcggccgatcctgatcggcctctttggttcccgggcagcacccctcctccatggcttgatggcagccttccaggagattttgggttcgatcctcttggccttggatctgatccagagagcctgagatggaaccagcaagcagagcttgtgcactgcaggtgggcaatgttgggtgctgcaggtatcttcatcccagaattcctaacaaagattgggattctgaacaccccttcatggtacaccgctggagaacaagagtacttcacagacacaacaaccctcttcattgtcgagctcattttcattggctgggccgaggggagaagatgggctgacatcatcaagcccgggtgcgtgaacactgacccgatcttccctaacaacaagctcaccgggaccgatgttggttaccctggcgggctctggttcgacccgctaggctgggggactggttctcccgaaaagctcaaggagttgaggactaaggaaattaagaacgggagattggccatgttggcggtaatgggggcatggttccaagccatctacacaggcactggacccattgacaacctcttcgctcatcttgctgaccctggccatgccaccatttttgctgctttcacccccaagtgaagaaagcatggaagattactgactgagattgttatgtggagaaatcttggtgtaaatcttatgtgagggtaggagttgaaaaggctgtgatttcaaaggatgtctgtagcatgtaaacttgtattgccttctgttcatgtcatctatattgtgctcatgcagtgtacaaatacctctaccagtatgtttccttctaagtctaatgggcctttaacaagtaggttagaaaattcttgcctcaagttctcccttgtgctgtaaaataaaaccccaaagattcctccatagtttcaccttatgtagactcgatctcatgcaaataaattcagtt

SEQ ID NO: 5556 - DNA, 1098 bp, Populus trichocarpa
gcaacccacctccataagccattcaaacacagcacaaactgattggaagatagtcttttggcaaaaacaaaatggctgctgtttgtgcttcttctgccattgcagccgtttccatctcttcttccagttcccagaagactggatcccttgtcgggtcaacaaaggcttcttttcttaggggggagaaattaagactgaggacgtacacatcaccaaccgcagctcgatcagttacagtttgtgttgcagctgaccctgatagacccctctggttcccaggcagcacccctcctccatggcttgatggcagcctccccggagactttggctttgatcctctaggtcttggatctgatcctgaaactctaagatggaatgtgcaagcagaacttgttcactgtagatgggcaatgttaggtgctgctggtattttcatcccagaattcctaacaaagattggcatcctaaacaccccgtcctggtacagtgctggagaagttgaatacttcactgacaccaccacactcttcattgttgagttattctttattggctgggccgagggaagaagatgggctgatattctcaagccagggtgcgttaacactgatcctatcttccctaacaacaaactcactggtacagatgttggttacccaggtgggctatggtttgacccacttggatggggcagtggctctcctgagaagatcaaggaattgaggacaaaggagatcaagaatggaagattggctatgttggctgtgatgggtgcttggttccaacacatttacactggcaccggtcctattgacaacctctttgctcacctagcagatcctggtcatgccaccgtttttgctgcttttacccccaagtgagaaacgctggcgagcatgcttccctaaggaaggagcttaaagaaatgtatttgtcgatagagcctttgtatcattattagaacttgtaatgtctgataactacgatttttcatagagtgctgttgcaatgtacaaaaaccaccccttgaacttagatgtcaccgatatatttgagctagtaacaaaagttgcccagaaaagcaaccgttacgaacca

SEQ ID NO: 5557 - DNA, 1170 bp, Juglans hindsii x Juglans regia
gcacgtttttgcttcccgtacgtacataaatcaaacacgcagcgcctatactaactgaagaaaatcttggctgaaagcctaaaatggcttctgcttgtgcttcctctgtcattgcagctgtcgccatctcttcccccagttcccaaaagactggatcagcattgggtgcaacaaaagcttgtttccttggtgggaggaaattaagagtgagaaacaatacggcacccagaggaacacgatcactctcggtgtgtgctgctgctgctgaccctgataggcctctctggttcccaggcagcacccctcctccatggctcgacggcagcctccctggagactttggttttgatcctctgggtctttcatctgatcccgagagcctaagatggaacgtacaatccgagcttgtgcactgcagatgggcaatgttaggcgctgcgggtatttttattccagagttactaacaaagattggaatcctgaacaccccatcttggtacactgctggagagctggaatacttcactgacacaaccactctcttcatcatcgagctgatcttgatcggctgggccgagggaagacgctgggcagacatcatcaagccagggtctgtaaacacagaccccatcttcccaaacaacaagctcacagggacagacgttggctatcctggaggactttggttcgatccacttgggtggggatccggttctcctgagaagatcaaggagttaaggacaaaagaaatcaagaacgggaggttggcaatgttggctgtgatgggtgcgtggttccaacacatttacactggcacaggccccattgacaacctctttgcccaccttgctgatcctggtcacgccactgtttttgctgctttcacccccaagtgaggaagaaagctgtacatgactgcaagtgtgagacagacaaggagtgatcgatttttacctacgtaggtggcttaaaagacgtgcgctttcagaaggaatgtttgtatcagtggaacttgtgttgtgtttgatcatgtcttcctacagaatgctcatgcaatgtactgcaatgtacaattgcctctttaaaattagaattgctgaatattagttcggacagattacagtaatgaaatttgcttcaagaattatctaacgtaaatgaggtttttcg

SEQ ID NO: 5558 - DNA, 1754 bp, Gossypium raimondii
tcattttacatttattacatataaaaatcattaaatttaatagatataaaaacaattttaaatacatatgattgaatgaaaaattatatatacatttatgtcaaatcaaaattttagaatatatccatagcaaaatttaagaatgctttacaaattcgatattaaaaatataaacaaagattagacagagtgtacagggccctttgacctgctgccaggcaatgccattgatatttttggttttggatatgtgagccacacaacacatgtaaggtgaaccaccaacttgagaatttaatccgaataagcagaagaagtggatacgaatgggcttcatatcagattctgcttgacacatggcaactcattagccgattccatatctattttcctatcttttaagataagccccttaatacattaactgatcaaccccaatctcattcaagcacaaaatttgacccaaaatggcctctgtttgtgcttcttcggctattgcagctgttgccatctcatcccccagttcccagaagactggatcagtagtggggacaacaaaggcttctttcctttcagggaagaaacttagatctgtgagaaagtacacaaaaccagctgccggaccaacatttccagtgtgcgccgccgccgaccccgacagacccctttggttcccaggcagcactcctcctccatggctggatggcagtctccctggtgactttggtttcgatcctctcggtcttggttctgaccctgagacattgagatggaacgtacaagcagagctggtgcactgcagatgggcaatgttgggagctgctggtattttcatcccagagttcttaaccaagattgggattttaaacactccatcgtggtactcagctggaacagaggaatacttcactgacaccacaactctcttcatcgttgagcttatttttatcggctgggctgaagggagaagatgggctgacattctcaagccagggtgtgtaaacaccgaccccatcttccctaacaacaagctcaccgggactgatgttggatacccaggtggcctgtggtttgaccctcttgggtggggaagtggttcgcctgagaagatcaaggagctgaggaccaaagagatcaagaatggccgattggctatgttggcagtgatgggtgcatggttccaacatatctacaccggcactgggcccattgacaacctctttgcccacctcgccgatcctggtcatgccaccatttttgctgctttcacccccaagtgagcattaggagggggaaccctaacagccatgaaaatgttggagaaacatcgatggtcatcatacatacacctttttacctaatcagcaaggagatggaaatatgtgtatggggatgctttcattgtaatgcctctgttgagtgttgtacaaatacctttatgaaattagacgcaatgaatatttattaaggttaaccaacatttattagcttttagtccgaatatgatataaaaatgaaattgacatgaatatacaaacatgccaaattttatatattatgaaaaaagttttgtagagtagaaatgtaatctgtagaagccccaaaattgttgcaaaatccatatatagatcaggctaattgcccaaaggaaaagatgaaactagtttatttgcaatcaccaatgttctgctcttggaataatcttagtgaagccacctgctcaatttaactgcttgaaatctcagttacttcgg

SEQ ID NO: 5559 - DNA, 1308 bp, Gossypium hirsutum
cccaatctcattcaaggcacaaaatttgacccaaaatggcctctgtttgtgcttcttcggctattgcagctgttgccatctcatcccccagttcccagaagactggatcagtagtggggacaacaaaggcttctttcctttcagggaagaaacttagatctgtgagaaagtacacaaaaccagctgccggaccaacatttccagtgtgcgccgccgccgaccccgacagacccctttggttcccgggcagcactcctcctccatggctggatggcagtctccctggtgactttggtttcgatcctctcggtcttggttctgaccctgagacattgagatggaacgtacaagcagagctggtgcactgcagatgggcaatgttgggagctgctggtattttcatcccagagttcttaaccaagattgggattttaaacactccatcgtggtactcagctggaacagaggaatacttcactgacaccacaactctcttcatcgttgagcttatttttatcggctgggctgaagggagaagatgggctgacattctcaagccagggtgtgtaaacaccgaccccatcttccctaacaacaagctcaccgggactgatgttggatacccaggtggcctgtggtttgaccctcttgggtggggaagtggttcgcctgagaagatcaaggagctgaggaccaaagagatcaagaatggccgattggctatgttggcagtgatgggtgcatggttccaacatatctacaccggcactgggcccattgacaacctctttgcccacctcgccgatcctggtcatgccaccatttttgctgctttcacccccaagtgagcattaggagggggaaccctaacagccatgaaaatgttggagaaacatcgatggtcatcatacatacacctttttacctaatcagcaaggagatggaaatatgtgtatggggatgctttcattgtaatgcctctgttgagtgttgtacaaatacctttatgaaattagacgcaatgaatatttattaaggttaaccaacatttattagcttttagtccgaatatgatataaaaatgaaattgacatgaatatacaaacatgccaaattttatatattatgaaaaaagttttgtagagtagaaatgtaatctgtagaagccccaaaattgttgcaaaatccatatatagatcaggctaattgcccaaaggaaaagatgaaactagtttatttgcaatcaccaatgttctgctcttggaataatcttagtgaagccacctactcaatttaactgcttgaaaa

SEQ ID NO: 5560 - DNA, 1286 bp, Sesamum indicum
cacacacccccacaacacacatcaaacacttgtgagaatcagtcgacatggcctctgcctgtgcttcatcaaccattgctgctgctgctgttgccttctcctctccaagctcccagaaaagtggatcaattgttggagcaactaaggcttctttctttggaggaagaaagttgagagtaagcaagtttgcggccccgtctggcacaagatcggtcaccgtctgtgctgcagccgatcccgacagaccactgtggttccccgggagcacccctcccccatggcttgatggcagccttccaggagacttcggctttgatcctcttggcctaggatctgacccggagagcttgaaatggaaccagcaagcggagcttgtgcactgcagatgggccatgttaggtgctgcgggcattttcatccccgagtttctcaccaagattggcattctaaacaccccttcatggtacactgccggtgaactagagtactttaccgacacaacaacgctcttcatcattgagttgattctcattggctgggctgagggaagaagatgggccgacatcatcaagcctggatgtgtgaataccgatcccatcttccccaacaacaagctcaccggaacagatgttggataccctggtgggctatggttcgacccactcggatggggctccggatcgccagaaaaggttaaggagttgagaacaaaggagatcaagaatggacgattggcaatgttggcggtgatgggagcatggttccaacacatctacactggaacaggacccattgacaacctctttgctcaccttgctgatcctggtcatgccaccatcttcgctgctttcagccccaagtgagagaagcaacagagctgcttttaacagaactgttggagaaacacctttagccatcattgtggggaagaggaatagattctcagtgtgtttttccaattcttgttgtattttcagatatgtattgctacatctttataagctgtagaaaaagagcttatgcagtgtacaaatacttccaagagatcctaacaccgtaaatacacttcctttccatccttgaatcttaggtttatttatcaaggcagaaaacatcataagggagcatacaagatgcacaactagttaaactacaattaatattacagaagaacataaaatatagaaacaatacaatcaccaacagtggaccgttttaaagcaagaagcatcaagttgacaaaaaggttatacaatcaccaatatggaatgttttaaagcaaggga

SEQ ID NO: 5561 - DNA, 1085 bp, Catharanthus roseus
ctccaatattcaaactaaccttacatcattcaactaaacaaaaaaaatttgtcgaaatggcctctgcctgtgcttcctcaaccattgcagcagttgccttctcttcttcccccagttctcagaagaatggatctattgttggggcaactaaagcttcttttctaggagggagaaaagttagagtaagcaaatttaccagtgctccagcaggaggaagatcagtcactgtttgtgctgcagctgatcctgataggcccctatggttccctggtagcacccctcctccatggcttgatggcagcctccctggagacttcggttttgatcctctaggacttggatcagaccctgagaccttgagatggaatgtgcaggcagagcttgtacattgcagatgggcaatgttgggtgctgcaggcattttcatcccagaattcttgacaaagattggcatcctcaacacaccttcttggtacactgctggtgaacaagaatacttcactgatactaccaccctcttcgtcgttgagctggttcttatcggttgggctgagggaagacgatgggctgacatccttaagcctggaagcgtgaacaccgatcccatcttcccaaacaacaagctaactggtaccgatgttggctacccaggtggcttgtggtttgatccactcggttggggaagcggttctcctgagaaaatcaaggaattaaggacaaaagaaatcaagaatggaagattggcaatgttggctgttatgggagcatggttccaacacatctacaccggtaccggaccaattgataacctctttgctcaccttgctgatcccggccacgccaccgtatttgctgctttcacctcaaagtgatagaagaaaagtaaagtggattggaatcaagaattgagaatactggagaacatcatggggagaatttttaactgtgtgttttccaggtgatgaagtatcattgaaatcttgtattaccagtgtctatgtctgctgctgtagagaaaaaactaattcattgtacaaatacctcaggcaattccccagcattactatgagcctagtttctcatga

SEQ ID NO: 5562 - DNA, 1285 bp, Cannabis sativa
gacacacgggggtggaatgtgaaccaccagattgagattattccagactcttttacacaccaacacaccgtaacttgttctgggcacaactatggcctccgcttgtgcttcttctgccattgctgccgttgccatttcctcccctagctcccagaagagtgtgacaagtttgggggtcagcaaaggtagttttcttggaggaaggaaactaagggtgaaaagctttacagccccaaccaggtctaactcatcgtcggctactgtgtgcgccgcagctgaccccgacagacccttgtggttccccggaagcgttccccctccatggctcgatggcagccttccaggagactttggatttgaccctcttggtctttcatcggaccctgatagtctaaagtggaaccaacaagcagagctggttcactgccgatgggcaatgttgggagctgctggtattttcattccagaattcttaacaaagattggtattctcaacacaccatcatggtacacagcaggagaacaagagtactttactgacacaactacccttttcattgttgagctcatctttattggttgggccgagggaagacgttgggccgatattctaaagcccggttgtgtcaacactgacccaatcttccctaacaacaaactcactggaaccgatgtgggctaccctggtgggctctggttcgacccacttggatggggaagtggttcccctgaaaaaatcaaggagttgagaactaaggagatcaagaatggaaggttggctatgttggctgttatgggtgcttggttccaacacatctacactggtactggcccaattgacaacctctttgctcaccttgctgatcctggtcacgccaccgttttcgctgcttttacacccaagtgaggttgaagcttgggaaggatggtatgctaacaacggtggtatatttggatcaaatgataacgaagagaagaagaaaatggtgttgagatggaagatcatgtcatcatgtgtaatgttgtttcacttgttctaagggaatatttaattggctcgatagaacttgcattttcctccgtacgtacgtatattttgttctatagaattaatgatctggcattgtacaaaatgttcctttgaaactttttgattaagatttcatgaacataaagtcagctagtattcaaattcgtcgactatgatatcgttgctttgttagtaattgctacctcctttagatattatatcaaggctttttacgttgttacacattgcgttaaa

SEQ ID NO: 5563 - DNA, 1092 bp, Castanea mollissima
cgcaacaccaattctttgaagaaaatcttggccgatagcctacaatggcttctgtttgtgcttcttctgccattgcagccgtggccatctcttcccccagttcccagaagaatagatctatattgggaggaacaaaagcttctttcctaagtggggggaaactgagagtggtgagaaaatatacagcacccaacgcaaaacggtcagtttcggtgtgtgctgtagctgaccctgacaggcccctctggttcccaggaagcgtccctcctccatggcttgatggcagcctccctggagactttggttttgatcctctgggtcttggatctgatcctgagaccctgagatggaatgtacaatcagagcttgtgcactgcagatgggcaatgttaggtgctgcaggtattttcattccagagttcctaacaaagattggtatcttgaacaccccttcatggtacactgctggagagttggaatacttcactgacacaaccaccctcttcgttatcgagatgatcttaatcggctgggccgagggaagacggtgggcagacatcctcaagccagggtccgtaaacacagaccccatcttccccaacaacaagctcacagggacagacgttggttatcctggagggctttggttcgacccacttggatggggaagtggttctcctgagaaaatcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgctttcacccccaagtgagaaagcaaggaagaatgctgtctttgattagaagcgtgtgagagatattgggtgaacatattgacccataagaaggccgcttagtagatgtgtattttcagaaaggaatgcttgtttaattgaaacttgtattgtctttgtatgtcttctacagaatgttaatccaatgtacaaatacctcttttaatttagatgcagggaatataagttcaggtagtaattaatgagattcgcc

SEQ ID NO: 5564 - DNA, 1168 bp, Cleome gynandra
tttcttcctttcccttcaccaaaggtccaacaatggcttctctttgtgcttcttccgccattgctgctatctcttccccaagttctcagaagagcggatccattgtgggttcaacgaaatcagctttcttgggtgggaagaaactgagactgaagaagtacgaagctccagtggctgctcgctccgtgacgtattgtgccgctgcggatcccgatagacctctctggttccccggaagcacccctcctccgtggctcgacggcagcctccccggtgacttcggattcgatcccctaggtcttggatccgaccctgagagcctaagatggaaccaacaagcggagctggttcactgccggtgggccatgctgggggctgccgggatattcataccggagttcctaacaaagatcggaatcttgaacacgccgtcgtggtacactgcaggggaacaagagtacttcacggacacgaccacgctcttcatcgtggagctcatctttatcggatgggcggagggtcgtagatgggcagacataatcaagcccggttgcgtcaacaccgacccgattttcccaaacaacaagcttacgggtacggatgtggggtacccaggtgggctttggtttgacccgttggggtggggctcgggcaacccagctaagatcaaggaactccggaccaaagagatcaagaacgggaggttggctatgttggccgtgatgggcgcatggttccaacacatctacacgggaaccggtcctattgacaaccttttcgctcaccttgccgaccctggtcacgccactgtcttcgcggctttcacgcccaagtgagaagagaatgagctgattgggtataaatgttgttgatgcgatgttgtacaaatacggtttttgggacttcaatgtattaatgatcaaatgaaaattagataaatctgtcgataaatcgccatcaataatgcttctaaactaagattaatttgttaatttgcaaatgtgatatgatgtatggattattctaaaaaaattgagcaactggagccaacatatcggctaattggacgcaaagtaagaccatgtattattatatagttccactaatacataaacttttggggccaatgtctagttttaattaacactcaacttggccaattattcgt

SEQ ID NO: 5565 - DNA, 1241 bp, Gossypium hirsutum
atcagattctgcttgacacatggcaactcattagccgattccatatctattttcctatcttttaagataagccccttaatacattaactgatcaaccccaatctcattcaagcacaaaatttgacccaaaatggcctctgtttgtgcttcttcggctattgcagctgttgccatctcatcccccagttcccagaagactggatcagtagtggggacaacaaaggcttctttccttacagggaagaaacttagatctgtgagaaagtacacaaaaccagctgccggaccaacatttccagtgtgcgccgccgccgaccccgacagacccctttggttcccaggcagcactcctcctccatggctggatggcagtctccctggtgactttggtttcgatcctctcggtcttgggtctgaccctgagacattgagatggaacgtacaagcagagctggttcactgcagatgggcaatgttgggagctgctggtattttcatcccagagttcttaaccaagattgggattttaaacactccatcgtggtactcagctggaacagaggaatacttcactgacaccacaactctcttcatcgttgagcttatttttatcggctgggctgaagggagaagatgggctgacattctcaagccagggtgtgtaaacacagaccccatcttccctaacaacaagctcaccgggactgatgttggatacccaggtggcctgtggtttgaccctcttggctggggaagtggttcgcctgagaagatcaaggagctgaggacgaaagagatcaagaatggccgattggctatgttggcagtgatgggtgcatggttccaacatatctacaccggcactgggcccattgacaacctctttgcccaccttgccgatcctggtcatgccaccatttttgctgctttcacccccaagtgaaacactaggaggggggaaccctaacagccatgaaaatgttggagaaaaatcgatggtcgtcatacgtacacctttttacctaatcagcaaggagatggaaagatgtgtttggggatgcttgtatcagtagatcattgtaatgcctctgttgagtgttgtacaaatacctttatgaaattagaagcaatgaatatttattaaggttaaccaacatttattagcttttagtcccaatataatataaaaatgaaattgacatgaatatacaaacatgccaaattttatatattatgaaaaa

SEQ ID NO: 5566 - DNA, 1062 bp, Quercus alba
aacgcagagtacatggggacaccaatcaagcgcaacaccaattctttgaagaaaatcttggccgatagcctaaaatggcttctgtttgtgcttcttctgccattgcagccgtggccatctcttcccccagttcccagaagaatggatctatattgggaggaacaaaagcttctttcctaagtgggggaaaactgagagtggtgagaaaatatacagcacccaacgcaaaacgttcagtttcggtgtgtgctgtagctgaccctgataggcccctctggttcccaggaagcgtccctcctccatggcttgatggaagcctcccaggagactttggttttgatcctctgggtcttggatctgatccagagaccctgagatggaatgtacaatcagagattgtgcactgcagatgggcaatgttaggtgctgcaggtattttcattccagagttcctaacaaagattggtatcttgaacaccccttcatggtactctgctggagagttggaatacttcactgacacaaccaccctcttcattatcgagctaatcttaatcggctgggccgagggaagacggtgggcagacatcctcaagccagggtccgtaaacacggaccccatcttccccaacaacaagctcacagggacagacgttggttatcctggaggactttggttcgacccacttggatggggaagtggttctcccgagaaagtcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgctttcacccccaagtgagaaagcaaggaagaatgctgtctatgattagaagtgtgggagagacattggatgaacatgttgacctaagaaggccgcttagaatgtgtattttcagaaaggaatgcttgtttaattgaaacttgtattgtctttgtatgtcttctacagaatgttaatccaatgtacaaatacc

SEQ ID NO: 5567 - DNA, 1271 bp, Quercus alba
atggggaccaagtcctgatttttccaagtaagcctaagaactggaggttgagggtgttgatatcagattctgcatgccacatggcatcccagtatccaattacaacttcactctcctatcctttaagataagcccctgcttacattaacacattttcatgtattttgttcccatacaccaatcaagcgcaacaccaattctttgaagaaaatcttggccgatagcctaaaatggcttctgtttgtgcttcttctgccattgcagccgtggccatctcttcccccagttcccagaagaatggatctatattgggaggaacaaaagcttctttcctaagtggggggaaactgagagtggtgagaaaatatacagcacccaacgcaaaacgttcagtttcggtgtgtgctgtagctgaccctgataggcccctctggttcccaggaagcgtccctcctccatggcttgatggaagcctcccaggagactttggttttgatcctctgggtcttggatctgatccagagaccctgagatggaatgtacaatcagagattgtgcactgcagatgggcaatgttaggtgctgcaggtattttcattccagagttcctaacaaagattggtatcttgaacaccccttcatggtactctgctggagagttggaatacttcactgacacaaccaccctcttcattatcgagctaatcttaatcggctgggccgagggaagacggtgggcagacatcctcaagccagggtccgtaaacacggaccccatcttccccaacaacaagctcacagggacagacgttggttatcctggaggactttggttcgacccacttggatggggaagtggttctcccgagaaagtcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgctttcacccccaagtgagaaagcaaggaagaatgctgtctatgattagaagtgtgggagagacattggatgaacatgttgacctaagaaggccgcttagaatgtgtattttcagaaaggaatgcttgtttaattgaaacttgtattgtctttgtatgtcttctacagaatgttaatccaatgtacaaatacctcttttaatttagatgccgtgaatataagttcaggtagtaattaatgagattt

SEQ ID NO: 5568 - DNA, 1093 bp, Quercus alba
gttcccatacaccaatcaagcgcaacaccaattctttgaagaaaatcttggccgatagcctaaaatggcttctgtttgtgcttcttctgccattgcagccgtggccatctcttcccccagttcccagaagaatggatctatattgggaggaacaaaagcttctttcctaagtggggggaaactgagagtggtgagaaaatatacagcacccaacgcaaaacgttcagtttcggtgtgtgctgtagctgaccctgataggcccctctggttcccaggaagcgtccctcctccatggcttgatggaagcctcccaggagactttggttttgatcctctgggtcttggatctgatccagagaccctgagatggaatgtacaatcagagattgtgcactgcagatgggcaatgttaggtgctgcaggtattttcattccagagttcctaacaaagattggtatcttgaacaccccttcatggtactctgctggagagttggaatacttcactgacacaaccaccctcttcattatcgagctaatcttaatcggctgggccgagggaagacggtgggcagacatcctcaagccagggtccgtaaacacggaccccatcttccccaacaacaagctcacagggacagacgttggttatcctggaggactttggttcgacccacttggatggggaagtggttctcccgagaaagtcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgctttcacccccaagtgagaaagcaaggaagaatgctgtctatgattagaagtgtgggagagacattggatgaacatgttgacctaagaaggccgcttagaatgtgtattttcagaaaggaatgcttgtttaattgaaacttgtattgtctttgtatgtcttctacagaatgttaatccaatgtacaaatacctcttttaatttagatgccgtgaatataagttcaggtagtaa

SEQ ID NO: 5569 - DNA, 1128 bp, Quercus alba
attttgttcccatacaccaatcaagcgcaacaccaattctttgaagaaaatcttggccgatagcctaaaatggcttctgtttgtgcttcttctgccattgcagccgtggccatctcttcccccagttcccagaagaatggatctatattgggaggaacaaaagcttctttcctaagtgggggaaaactgagagtggtgagaaaatatacagcacccaacgcaaaacgttcagtttcggtgtgtgctgtagctgaccctgataggcccctctggttcccaggaagcgtccctcctccatggcttgatggaagcctcccaggagactttggttttgatcctctgggtcttggatctgatccagagaccctgagatggaatgtacaatcagagattgtgcactgcagatgggcaatgttaggtgctgcaggtattttcattccagagttcctaacaaagattggtatcttgaacaccccttcatggtactctgctggagagttggaatacttcactgacacaaccaccctcttcattatcgagctaatcttaatcggctgggccgagggaagacggtgggcagacatcctcaagccagggtccgtaaacacggaccccatcttccccaacaacaagctcacagggacagacgttggttatcctggaggactttggttcgacccacttggatggggaagtggttctcccgagaaagtcaaggagttgagaacaaaagagattaagaatgggaggctggctatgttggctgtgatgggtgcatggttccaacacatttacacaggcacaggccccattgacaacctctttgcccaccttgctgatcctggtcatgccaccgtttttgctgctttcacccccaagtgagaaagcaaggaagaatgctgtctatgattagaagtgtgggagagacattggatgaacatgttgacctaagaaggccgcttagaatgtgtattttcagaaaggaatgcttgtttaattgaaacttgtattgtctttgtatgtcttctacagaatgttaatccaatgtacaaatacctcttttaatttagatgccgtgaatataagttcaggtagtaattaatgagatttgccaatggaattatataa

SEQ ID NO: 5570 - DNA, 1013 bp, Carica papaya
atctcttcacttccatccaacactctctcaacaatggcttctctctgtgcttcttcgcctttcgcagccatctcttcccccagctcgcagaagaatggatcggttgttggagcaccaaaagcctctttcctgagcggtaagaaattgagaagtgtgcggaagtacacggcgccacaagctcaaactagctcagttacagtctgtgcagttgcagacccagagagacccctctggtttcccggcagcacacctcctccatggctcgacggaagcctccctggagatttcggattcgaccctcttggtcttggatctgatccggacagtttgaggtggaatcagcaagcggaaatagttcattgcagatgggcaatgttgggtgcagctgggattttcatcccagaatttctaacaaagattggaattctcaacaccccatcttggtatactgctggagaacaagagtactttacagacaccactaccttgttcatagttgagttgatattcatcggatgggcagagggtagacggtgggctgatataatcaagccaggctgtgtaaacaccgatcccatcttcccaaacaacaagcttaccggcaccgacgttgggtacccaggtggcctctggtttgacccactgggttgggggtctggctcgccggagaaggtgaaggaactcagaaccaaggagatcaaaaatggaagattagccatgttggctgtcatgggtgcttggttccaacatatttacactggtactggacccattgacaacctctttgctcatcttgctgatcctggtcatgccaccatttttgctgcttttactcccaagtgatggatgatggatgagatagaaagaaaggtagtaatttgttggtgtggtggaaatttgtatgttaattttatcaacttatgttgttgaatagaatgatgttcagctctgtacaaatttctcttttcaacataattaattaatatataaatagtgacgccaattttactctc

SEQ ID NO: 5571 - DNA, 1140 bp, Tripterygium wilfordii
tttaacagattttgcctcttctcctctcccattacctgcacaaaccaagaaaacagggaaaaaaaaaatggcttctgtttgtgcttcttctgccattgcagctgttgctgtctcttctcccagctcccaaaagagtggatccattgtgggggcaacaaagaccgcattccttggtggaaagaaactgagatcagggaagaaatatacagcacctgttgcaagatcatctgttgctgtatgtgcagtagcagagagtgagaggcctctctggttcccaggcagcactcctcctccatggcttgatggcagtctccctggagactttggttttgatcctcttggactttcatctgatcctgacagcctaagatggaacgttcaatcagaaattgtccactgcagatgggcaatgttgggtgctgctgggattttcattccagaattcctaacaaagattggcatcctaaacactccttcatggtacacagctggagaacaggaatacttcactgacaccaccactcttttcattgttgagctgatctttattgggtgggcagagggaagaagatgggctgacattatcaaaccagggtgtgtcaacactgacccaattttccccaacaacaagcttactgggactgatgttgggtacccaggtgggttgtggtttgacccacttggatggggaagtggatcccctgagaaagtgaaggaattgaggacaaaggagatcaagaatgggagattggctatgttggctgtgatgggtgcttggttccaacacatctacactggcactggacctattgacaacctctttgctcaccttgctgatcccggtcatgccaccgtttttgcagctttcactcccaagtgagaaggcaataagagtgggacggacattgatgaagatatttaccaagagaggagcttggaagatttgtgtgctcggaaagagcctttgtattactagaacttctaatgaccatgtttgtgtcttttatggaatgttcatgcaatgtacaaatacctcttctttaactttaggtgctaagtatacataatatgattagtagcaagaattgttctaaaagcattggcattcggaaaaattgaaattagtagcactaatacaga

SEQ ID NO: 5572 - DNA, 740 bp, Cajanus cajan
agttcccagaagaatggttcactcttgggaaccacaaaagcttcttttcttagtgggaggaaactgaaggtgagcaattttacagcaccagttggaacacgatccagcactacagtgtgtgcagttgctgaccctgataggcctctgtggttcccaggcagcacccctcctccatggctagatggcagtttgccaggagattttgggtttgatcctctcggtaggatctgaccctgagagcctgagatggaacgttcaagcagagcttgtgcactgcagatgggccatgttgggagctgctggcatattcatcccagaattcctgacaaagattggtatcctgaacaccccttcatggtacactgctggagagttggagtacttcacagacaccaccacactcttcgtagttgagctctttttcattgggtgggctgagggtagaagatgggctgacatcatcaagccaggctgtgtcaacactgaccccatctttcccaacaacaagctcacaggaactgatgttgggtacccaggtgggctttggtttgacccacttggctggggaagtggttctcctgagaagatcaaggagttgagaacaaaggagatcaagaatgggaggttggccatgttggctgtcatgggggcatggttccagcacatttacactggcactggtcctattgacaacctctttgctcaccttgcagatcctggccatgctactatttttgctg

SEQ ID NO: 5573 - DNA, 1225 bp, Eucalyptus grandis
tatgtcctaggattttcaaatcccctctccacctctcgcgaaatagtcgaaagagaatggcttcggtgtgcgcttcctcagccattgcggccgtggccatctcctctccgagtggccaaaagaatggatcctccttcctgaccggcaaaaggttgcgcgtgagcaagtacaccgcgccggctgcagccgccggaagattggccaccgtctgcgcggtggctgatcctgataggcccctctggttcccaggaagcactcctcctccgtggctcgacggcagcctcccaggagacttcggcttcgatcctcttggcctcgggtctgatcctgagagcttgagatggaaccaacaagcggagctggtccactgcagatgggccatgctcggagccgccggcattttcatccctgagttcctcacgaagattggcatcctcaacactccctcgtggtacaccgccggggagcaagagtacttcaccgacaccaccaccctcttcatcattgagctcattttcatcggctgggccgagggccggagatgggctgacatcatcaagcccgggtgcgtcaacaccgaccccatcttccccaacaacaagctcacaggaaccgacgtcgggtaccctggcgggctctggttcgatccacttgggtggggctccggctcgcccgagaagatcaaggagttgaggaccaaggagatcaagaacgggaggctggccatgttggctgttatgggagcttggttccaacacatctacaccggcactggcccgattgataacctctttgctcacctcgctgatccgggtcatgctacggtttttgctgctttcacacccaagtgaggaagaactcaagagataacggatcgagattgaattgggcggatgaatttaaaatccttttgcaaagaattgagaggatgagagaggtgtgattatgtaaaggaagattgtgtaattgagaaagagaacttgtactggctctcctgctctagtctatagaagggctgtgcaatgtacaaatacctctttgatgaagttaggatttgacattgatgcttggatggtagtgaaaactccctacgcatggtgctgcactttgctcttggacatgatataggttcctgtcaacagattaaatggactccgtctgcaatatttcgaagatttcataaagaaaaatctatgcatattcttgtttcaatgggaattgaaaa

SEQ ID NO: 5574 - DNA, 1060 bp, Trigonella foenum-graecum
ctgccattgcagctgttgccatctctccaagttcccagaagaatggatcacccatgggaacctcaaaagcttttattggaaggaaactgaaggtgaacagtaacacagcagcaccagttagagtgaggtctacaacaacagtgtgcacagtagctgagcctgatagacctctgtggttcccaggaagcacccctcctccatggcttgatggcagtctcccaggagattttggatttgatcctcttggactttcatctgatccagagagtctgaaatggaacgttcaagcagagctcgtgcactgcagatgggcaatgttgggagcagcaggaattttcatcccagaattcctcactaagatcggtatcttgaacacaccttcatggtacactgctggagagcaagagtatttcacagacactacaacactcttcatagttgagctccttttcatcggttgggccgagggtagaagatgggccgacatcctcaatccaggttgtgtcaacactgaccctatctttcccaacaacaagctcacaggaactgatgtagggtaccctggtggactttggtttgatccacttggttggggaagtggttctcctcagaagcttaaggagttgagaacaaaggaaattaagaatgggagattggctatgttggctgtgatgggagcttggttccagcacatttacactggcactggtcctattgataacctctttgctcaccttgctgatcctggtcatgctactattttcgctgctttcactcccaagtgagacgtgctaggaaagacaactatgagattgtaagccttgaagaaacaatggtgaatatgttttactaagtagtataaggcttacctgtttgttttagggaggagtgtttgtgttggtgaaaggttgtaaaatggctacctactacttctatgtgatgcacaggttgatggttcaatgtataaatacctttttataagtttagatgccttcaatgtaaatccaggaagtaactagttacatttttgcatggatgatataaaggactgaaataacat

SEQ ID NO: 5575 - DNA, 1048 bp, Euonymus alatus
cccattacctgcacaaaccaagaaaacaaaaaaaataggcttctgtttgtgcttcttctgccattgcagctgttgctgtctcttctcccagctcccagaagagtggatccattgttggggcaacaaagactgcattccttagtggaaagaaactgagatcagtgaagaaatgcacagcaccagttgcaagatcatcggctgctgtatgtgcagtagcggaccctgataggcctatctggttcccaggcagcactccacctccatggcttgatggcactctccctggggactttggttttgatcctcttggacttggatctgatcctgacaccctaagatggaacgttcaatcagaacttgtgcactgcagatgggcaatgttgggtgctgctgggattttcattcctgaattcctaacaaagattggaatcttaaacactccttcgtggtacacagctggagaacaggagtacttcactgacaccaccactctcttcattgttgagatgatctttattgggtgggcagagggaagaagatgggctgacattatcaaaccagggtgcgtcaacactgacccaatcttccccaacaacaagcttactggtactgatgttgggtacccaggggggttatggtttgacccacttggatggggaagtggatctcctgagaaattaaaggagttgaggaccaaggaaatcaagaatggaagattggccatgttggctgtgatgggtgcatggttccaacacatttacactggcactggacctattgacaacctctttgctcaccttgctgatccgggccatgccaccgtttttgctgctttcactcccaagtgagaagagaaggcaataatgagagtagggtggacattgatgaagatatttaccaagaaaggagcttgaaagatgcgtgtcttcagaaagagccttaatataattgtatcagtagaacttctaatgtccctgtttatgtcttttatggaatattcatgcattgtacaaatacctcttctttaattttagatgctaagtaagta

SEQ ID NO: 5576 - DNA, 1122 bp, Solanum lycopersicum
aaataccacaaaatctcattgtccttggtatctctcataatcacaaacacaagagtgaagaatttgcccacatggcctcagcttgtgcttcatccaccattgctgctgttgctttttcttctccaagttcgaggagaaatggatcaattgtaggaacaacaaaagcttcattccttggaggaagaagattgagagtaagcaaatacagtactacacctacagcacgaagtgcaactacagtgtgcgttgctgcagaccctgacagacccctctggttccctggcagcaccccacctccatggcttgatggcagccttcccggagacttcggtttcgatcctcttggcctagcatctgatccagagagcttgagatggaaccaacaggcagaacttgtacactgcagatgggcaatgttgggagctgcaggaattttcattccagaattactcacaaaaattggaatacttaacacaccttcatggtacactgctggtgaacaagaatatttcacggacacaacgactctcttcatcgttgaattggtacttattggttgggctgagggaagaagatgggcagatatcatcaagcctggatgcgttaacacggatccaatcttccctaacaacaagctcacggggacagacgttggttatccaggaggtttatggtttgatcccttgggttggggttcgggttcacctgcaaagataaaggagttgaggacaaaggagattaagaacggtagacttgctatgttagccgttatgggtgcatggttccaacacatttacactggaacaggccctattgataacctatttgctcacctagctgatcctggtcatgccactatttttgctgcattcagtcccaagtgagaagcagaagcagaacaccttttgttgtaatgatgtgtaaaagtaacatttgaagtagatttgtgcaaagaaaaactttaatgtttcttttgccactcaatgtagtatacctacatttggtttgcccttctgtagaaaaagactcagtgtacaaatacctttgagaattcgtgtcagatcaaaaaaatctatttatatatgttcgtcccattttcgtattagagaagatttaatttta

SEQ ID NO: 5577 - DNA, 1118 bp, Gossypium hirsutum
ccccacctcattgtaggcaaaatggcctctgtttgtgcttcttctgccattgcagccgttgccatctcatcccccagttcccagaggagtggatcagtagtgaggacaacaaaggcttctttccttacagggaagaaacttcgatcagtcaaaaagtacacaaaaccagcagcagcccgaacagttccggtgtgtgcagtggctgaccccgaccgacctctttggttcccaggcagtactcctcctccatggctcgatggcagcctccctggagacttcggttttgatcctctaggccttggatcagaccctgagaccttgagatggaacgtacaggcagagctcgtccattgcagatgggcaatgttaggagccgctgggattttcatcccagagttcctaaccaaaattggcattttaaacactccatcatggtactctgctggaaccgaggaatacttcactgacaccaccaccctcttcatcgttgagcttattttcatcgggtgggcagaagggagaagatgggctgacattctcaagcctgggtgcgtaaacaccgaccccatcttccctaacaacaagctcacgggcaccgatgttgggtaccctggtgggctgtggttcgatcctcttggttggggaactggctcccctgagaagatcaaggaattgaggactaaagagatcaagaatggtcgattggctatgttggcggtaatgggtgcttggttccaacacatctatactggcactggacccattgacaaccttttcgaccacctcgccgatcctggtcacgccaccatttttgctgctttcactcccaagtgagacaggattaagagacaacctttaagagcgattaaaatgttgggatgacaatgatgatcataccattccatacgttggaagaagagcggaagacttgtaatgttgtgggggaatgtttgtattagtagaaactgtaatgcctctgtttgtattgtagatgttatagtgatgtacaaatatttatgtggaattagatgcaatgaattttatttattcaggttaatcaacatttatgaaatccaaagcccaacaaatgctggtaaataaatcagcttttctttcct

SEQ ID NO: 5578 - DNA, 1083 bp, Pteridium aquilinum
aaaaaaattgacccaaaatggcctctgtttgtgcttcttctgctattgcagctgttgccatctcatcccccagttcccagaagactggatcagtcgtgggggcaacaaaggcttcttttcttagtgggaagaaattgagatcagcgagaaagtacagtgcagcaccagctggagcacgaccagttgccgtgtgtgcagcagcagaccccaacagacctctgtggttcccgggcagcactcctccaccatggcttgatggcagcctccctggagactttggttttgatcctctaggtcttggatctgaccctgagaccttgagatggaacgtgcaagcagagcttgtgcattgcagatgggcaatgttgggggctgcaggaattttcatcccagagttcctaacaaagattggcattttaaacactccttcatggtactcagctggaacagaggagtacttcactgaccccacaaccctcttcatagttgagcttcttttcatcggctgggcagaagggagaagatgggctgacatcctcaagccaggctgtgtaaacaccgaccccatcttccccaacaacaagctcacggggactgatgttgggtacccaggtggcctgtggtttgatcctcttggctggggaagtggttctcctgagaagatcaaggagttaagaacaaaagagatcaagaatggtagattggctatgttggctgtgatgggtgcatggttccaacacatctacactggtactggacctattgacaacctatttgcccaccttgccgatcctggccatgctaccgtttttgctgctttcacccccaagtgagaaacaacaagggagaaccccaacagcaattaaaatgttggagaaacattgatggtcatatctttgcctaattagcagggcgatggaaagatgtgtacttttgtggggaatgtttttatcagtagaagtttgtattgcctctgcttgtcttctatagatgctcaagtgatgtacaaatacctctgtgaaattagatgccatgaatatttattcaggttaattaaacaaaaagaaaaagtaaccgactgcg

SEQ ID NO: 5579 - DNA, 1018 bp, Tripterygium wilfordii
tggcttctgtttgtgcttcttctgccattgcagctgttgctgtctcttctcccagctcccagaaaagtggatccattgtggggcaacaaagactgcattcctcggtggaaagaaactgagatcagcgaagaaattcacagcaccagctgcgagatcatcggttgctgtatgtgcagtagcggatcctgataggccactctggttcccaggcagcactcctcctccatggcttgatggcagtctccctggggactttggttttgatcctcttggactttcatctgatcctgacagcctaagatggaacgttcaatcagaaattgtgcactgcagatgggcaatgttgggtgctgctgggattttcattccagaattcctaacaaagattggaatcctaaacactccttcgtggtacacagctggagaacaggagtacttcactgacacaaccactctcttcgttgttgaaatgatctttattgggtgggcagagggaagaagatgggctgacattatcaaaccagggtgcgtcaacactgacccaatcttccccaacaacaagcttactgggactgatgttgggtacccgggggggttagtggtttgacccacttggatggggaagtggatctcctgagaaagtgaaggagttgaggacaaaggagatcaagaatgggagattggccatgttggctgtgatgggtgcttggttccaacacatctacactggcactggacctattgacaacctctttgctcaccttgctgatccgggtcatgccaccgtttttgctgctttcactcccaagtgagaagagaaggcaataagagtagggtggacattgatgaagatgtttgccaagagaggaggttgaagatgtgtgtcctcagaaagagcctttgtatcagtagaacttcgaatgcccctgtttgtgtattttatggaatgttcatgcaatgtacaaatacatctttaattttagatgctaagtaagtatacagaatatgatcagtagct

SEQ ID NO: 5580 - DNA, 1085 bp, Solanum melongena
cggggattcattcactcataatcaaaacaacaagagtgaagaatttgttgacatggcctctgcttgtggttcatccaccattgctgctgttgctttttcttccccaagttccaggagaaatggatcaattgttggagcaacaaaagcttcatttcttggagggagaagattgagagtaagcaaatacacttcttcacctgcagctagagctgtgactacagtctgtgttgctgcagaccctgatagacccctttggttccctggcagcacccctcctccatggcttgatggcagcctacccggagatttcggtttcgatcctcttggcctcggttctgacccagagagcttgagatggaaccaacaagcagaacttgtacattgcagatgggcaatgttgggagctgcaggaattttcattccagaactcctcacaaaaatcggaatcctcaacacaccttcatggtacactgctggtgaactagaatatttcacggacacaacaactctcttcatcatcgagttgatacttataggttgggctgagggaagaaggtgggcagatatcatcaagcctggttgcgtaaacacggacccaatcttccctaacaacaaactcacagggacggacgttggttatccaggaggtttatggtttgatccgttgggttggggttcgggttcccctgaaaagataaaggagttgaggacaaaggagattaagaatggtagacttgctatgttagctgttatgggtgcatggttccaacacatttacactggaacaggacctattgacaacctctttgctcaccttgctgatcctggtcatgccactatatttgctgcattcagtcccaagtgagaagcaagcagagcatcttttgttgtaatgattgcaaaagtaacatctgaagtagaattgtgcaaagaaagctttaatgtttcttttgcaactcaatgtagtatccctacatttggtttgcccttctgtagagaaagactaagcaatgtacaaacactctcgagaactcgtatcagatcaaaaaaatctacttatatatgttcgttgtattccatgagtg

SEQ ID NO: 5581 - DNA, 1057 bp, Solanum tuberosum
gatcacaaacacaagagtgaagaacttgccgacatggcctctgcttgtgcttcatccaccattgctgctgttgctttttcttctccaagttcgaagagaaatggatcaattgtaggagcaacaaaagcttcattccttggagggagaagattgagagtaagcaaatacagtactacacctgcagcacgaagtgcgactacagtgtgtgttgctgcagaaccagacagacccctctggttccctggcagcacccctcctccatggcttgatggcagccttcccggagacttcggtttcgatcctcttggcctcggatctgatccagagagcttgagatggaaccaacaggcagaaattgtacactgcagatgggcaatgttgggagctgcaggaattttcattccagaattactcacaaaaattggaatcctgaacacaccttcatggtacactgctggtgaacaagaatatttcaccgacacaacgactctcttcatcgttgaattggtacttataggttgggctgagggaagaagatgggcagatatcatcaagcctggatgcgttaacacagacccaatcttccctaacaacaagctcacaggaacagacgttggttatccaggaggtttatggtttgatcccttgggttggggttcgggttcacctgcaaagataaaggagttgaggacaaaggagattaagaacggtagacttgctatgttagccgttatgggtgcatggttccaacacatttacactggaacaggccctattgataacctctttgctcaccttgccgatcctggtcatgccactatttttgctgcattcagtcccaagtgagaagcagaagcagaacaccttttactgtaatgatgtgtaaaagtaacatttgaaatagatttgtgcaaagaaagctttaatgtttcttttgccactcaatgtagtatccctacatttggtttgcccttctgtagaaaaagactcagtgtacaaatacctttgagaattcgtatcagattaaaaaaatctatttatatatgttcgttccatt

SEQ ID NO: 5582 - DNA, 1074 bp, Solanum phureja
gtatctctcataatcacaaacacaagagtgaagaatttgccgacatggcctctgcttgtgcttcatccaccattgctgctgttgctttttcttctccaagttcgaggagaaatggatcaattgtaggagcaacaaaagcttcattccttggagggagaagattgagagtaagcaaatacagtactacacctgcagcacgaagtgcgactacagtgtgtgttgctgcagaaccagacagacccctctggttccctggcagcacccctcctccatggcttgatggcagccttcccggagacttcggtttcgatcctcttggcctcggatccgatccagagagcttgagatggaaccaacaggcagaaattgtacactgtagatgggcaatgttgggagctgcaggaattttcattccagaattactcacaaaaattggaatccttaacacaccttcatggtacactgctggtgaacaagaatatttcaccgacacaacgactctcttcatcgttgaattggtacttataggttgggctgagggaagaagatgggcagatatcatcaagcctggatgcgttaacacagacccaatcttccctaacaacaagctcacagggacagacgttggttatccaggaggtttatggtttgatcccttgggttggggttcgggttcacctgcaaagataaaggagttgaggacaaaggagattaagaacggtagacttgctatgttagccgttatgggtgcatggttccaacacatttacactggaacaggccctattgacaacctctttgctcacctggctgatcctggtcatgccactatttttgctgcattcagtcccaagtgagaagcagaagcagaacaccttttactgtaatgatgtgtaaaagtaacatttgaagtagatttgtgcaaagaaagctttaatgtttcttttgccactcaatgtagtatccctacatttggtttgcccttatgtagaaaaagactcagtgtacaaatacctttgagaattcgtatcagattaaaaaaatctatttatatatgttcgttccatttgcatg

SEQ ID NO: 5583 - DNA, 1180 bp, Nicotiana tabacum
tacaatatcagcttcttcatacacaccaccaattattcactgcattcaaggaaaaatcaaccaacatggcctccgcctgtgcttcatcagccattgcagcagttgcattctcttctccaagttcccagaaaaatggatcaattgtaggagcaacaaaggcttctttccttggagggaaaagattgagagtaagcaaatacgtcgcaccagctggatcaagatcggttgctgtctctgctgttgctgctgaccctgatagacccctctggttccctggcagtacccctcctccatggctcgatggcagcctccccggggactttggtttcgaccctcttggccttgcatctgacccggagagcttgaaatggaaccagcaggcagaacttgtacactgcagatgggcaatgttaggtgctgcaggcattttcatcccagaattcctaacaaagattggcattcttaacacaccttcatggtacactgctggtgaacaagaatacttcaccgatacaaccactctcttcgtcattgagttggtacttattggctgggctgagggaagaaggtgggcagatatcatcaagcctgggtgcgtaaacacagaccccatcttccctaacaacaagctcacgggcacagatgtcgggtatccaggaggcttatggtttgatcctttaggttggggatctggttctcctgaaaagatcaaggagttgaggacaaaggagatcaagaacggaaggctggccatgttggctgtcatgggtgcatggttccaacacatctacactggaacaggaccaattgacaaccttttcgctcaccttgctgatcctggtcacgccactatttttgctgctttcagccccaagtaagaagcaggagcaccatttgttggcattgatgtgttggagtgacactctgaagatctgaagaaagaaattttagaaattgttttccaacttaatgttgtatcactacacttaagttacctctgtgtgtatcttctgtagaaaaagattaagcagtgtacaaatatctttgggatctcctaagtcctaacagcagcaagatatactatcactaggctgcacccatgtaatgatgattcaagattttgaatgcatttctactcatagataaagagtagatatttaatattgagcggccgcatgag

SEQ ID NO: 5584 - DNA, 1261 bp, Amsonia hubrichtii
aagctgaaacaactgaagggtgagagctaagtaatagattcttgagaccacttggcaaacctcagtagccaatcaggtgtacaaattcctatccttcaagataagccccttcccacattaacagcttctgctgtctctatactttctgctcagactccaatccatcaacaattacactcaacaaaaattcgtcgaaatggcctctgcctgtgcttcctcaaccattgcagcagtctccttctcttcttccccaagctctcagaagaatgggtctattgttggagccactaaagcttccttccttggagggagaaaagttagagtaagcaaatttactactgctccagcaggaggacgatctttgacagtctgtgctgcagctgaccctgacaggcccctctggttcccaggcagcactcctcctccatggcttgatggcagcctccctggagacttcggttttgatcctctgggtcttggatccgaccctgagaccttgaaatggaatgtgcagtcagagcttgtacactgcagatgggctatgttgggtgctgcaggtattttcatcccagagttcttgacaaagatcggcatcctcaatacaccttcctggtacactgctggtgaacaagaatacttcactgacactaccaccctcttcatcattgagttgcttcttattggttgggctgagggaagacgatgggctgacatcctcaagcctggaagcgtgaacactgaccccatcttcccaaataacaagcttacaggtactgatgttggctatcctggtggtctgtggtttgacccactcggttggggaagtggttctcctgagaaaattaaggaattaaggacaaaagagatcaagaacggtaggttggcaatgctggctgtaatgggagcatggttccaacacatctacaccggtactggaccaattgacaacctctttgctcaccttgctgatcccggacatgccactgtattcgcagctttcacctcaaagtgatagaagaagagttgcattgaatttgagtgttgagaaatactggagaacatggggaaaattttaactgtgtgttttccaattgacatcgtatcattacaacttgtattgcctctgtctatgtctgctgtagagaaaagctgatgcattgtacaaatacctcatacaaactccccagcatcatcaatgcgaacccaggttttcatgaaaattacctatgagtggttagaatgtcagaaacgaaatctagaa

SEQ ID NO: 5585 - DNA, 1172 bp, Amsonia hubrichtii
caattacactcaacaaaaattcgtcgaaatggcctctgcctgtgcttcctcaaccattgcagcagtctccttctcttcttccccaagctctcagaagaatgggtctattgttggagccactaaagcttccttccttggagggagaaaagttagagtaagcaaatttactactgctccagcaggaggacgatctgtgacagtctgtgctgcagctgaccctgacaggcccctctggttcccaggcagcactcctcctccatggcttgatggcagcctccctggagacttcggttttgatcctctgggtcttggatccgaccctgagaccttgaaatggaatgtgcagtcagagcttgtacactgcagatgggctatgttgggtgctgcaggtattttcatcccagagttcttgacaaagatcggcatcctcaatacaccttcctggtacactgctggtgaacaagaatacttcactgacactaccaccctcttcatcattgagttgcttcttattggttgggctgagggaagacgatgggctgacatcctcaagcctggaagcgtgaacactgaccccatcttcccaaataacaagcttacaggtactgatgttggctatcctggtggtctgtggtttgacccactcggttggggaagtggttctcctgagaaaattaaggaattaaggacaaaagagatcaagaacggtaggttggcaatgctggctgtaatgggagcatggttccaacacatctacaccggtactggaccaattgacaacctctttgctcaccttgctgatcccggacatgccactgtattcgcagctttcacctcaaaatgatagaagaagagttgcattgaatttgagtgttgagaaatactggagaacatggggaaaattttaactgtgtgttttccaattgacatcgtatcattacaacttgtattgcctctgtctatgtctgctgtagagaaaagctgatgcattgtacaaatacctcatacaaactcccccagcatcatcaatgcgaacccaggttttcatgaaaattacctatgagtggttagaatgtcagaaacgaaatctagaaaacatagctgcagcttggtacaaacaggataatatgcactacagaatgaagcaaatcagacatcaaatcttcttaaaa

SEQ ID NO: 5586 - DNA, 1174 bp, Prunus persica
aacacattcacatctctaggccattgccacatacaatttcactgatcaaacaaacaaagcaaatttggttacaagcctcaatctccaaatggcttccgcttgggcttcttcttctgccattgcagccgttgccatatcttctcccagctcccagaaggctgggtctactttggcagcaacaaaggcttctttctttggtgggaggaagctcagagtgaggaacttgacagcgtcctctggatcatcaacatctttcacagtacgtgctgctgcagctgaccctgatagacccttgtggttcccaggcagcacccctcctccatggctcgatggaagcctcccaggagactttggctttgatccccttggtctttcatctgaccctgacagcttgagatggaaccagcaagcagaacttgtacactgcagatgggctatgttaggtgcagctggcatcttcatcccagaattcttgaccaaaattggcattctaaacaccccttcatggtacacagctggagaacaagagtacttcacagacaccaccactctgtttgttgttgagctggttttgattgggtgggccgagggcaggagatgggccgacatcctcaagcctgggtctgttaacaccgacccgatcttccccaacaacaagctcaccgggacagatgttgggtacccaggcgggctttggtttgacccacttggatggggaagtggttcacctgaaaaggtcaaggagctgaggacaaaggagattaagaatgggagactggctatgttggctgtgatgggggcttggttccaacacatttacactggcactggcccaattgacaacctctttgctcaccttgctgatccgggccatgccaccatctttgctgcttttactcccaagtgagaggaaagtgagggatttctaattgggatttgagtgtgggagaaggggcaacattggtgatcacatactcttttattaatccgtcttagagatatgtgttcttccaaggaaaatttgtaggactaaaacttgtaatatcagagtctcgatgtgttttactttttcacagaatgatcttctgtgtgtacaaaaatctctctggactttgattccatatgtatcaaatcagctggtgacgcatccatattatattattgtgatagaaaa

SEQ ID NO: 5587 - DNA, 1073 bp, Flaveria ramosissima
cttcattatcaagtcaatggcttcaactgcttgtgcttcttctgccattgcagctgttgctttctcttccccaagttcacagaaagtggatctactgttggatcaacaaaggtctttcttttcttggtgggaagaaactcaaagttagcaaattgggtgcaccatccggttcacgatcgtttgcaaccgtgtgcgctgcggctgatcccgatagacccatttggttcccgggcagcaccccaccagaatggcttgatggcagcctacctggagacttcgggttcgatcctcttggtctaggatctgatcccgagactttgagatggaacgtacaagcagaactagtacactgccgatgggcgatgttaggtgccgccgggatcttcatccccgaattcctgacaaaaatcggaatcctaaacactccgtcgtggtacaccgctggtgaacaagaatacttcacagacaaaaccacactgttcatcattgagcttattttcattggttgggcagaaggaagaagatgggctgatattatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggacaaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagtgatgtttgtgtattatcagaaattctatcttatgtttactgtagatcaaagttaatggaatgtacaaatacctcttaatttcaactcaaaatggtgcatatagatatattacataagctagcttgtatctcattaaagtatttcacatataacatcgacgaatccttgttaaatctgtaacgctttaagcgttaaatgaaatgcttgtgatatt

SEQ ID NO: 5588 - DNA, 1142 bp, Flaveria ramosissima
cattaacaccaaccatctttaatttttcctcacaaacactcattcttcattatcaagtcaatggcttcaactgcttgtgcttcttctgccattgcagctgttgctttctcttccccaagttcacagaaaagtggatctactgttggatcaacaaaggcttcttttcttggtgggaagaaactcaaagttagcaaattgggtgcaccatccggttcacgatcgtttgcaaccgtgtgcgctgcggctgatcccgatagacccatttggttcccgggcagcaccccaccagaatggcttgatggcagcctacctggagacttcgggttcgatcctcttggtctaggatctgatcccgagactttgagatggaacgtacaagcagaactagtacactgccgatgggcgatgttaggtgccgccgggatcttcatccccgaattcctgacaaaaatcggaatcctaaacactccgtcgtggtacaccgctggtgaacaagaatacttcacagacaaaaccacactgttcatcattgagcttattttcattggttgggcagaaggaagaagatgggctgatattatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagtgatgtttgtgtattattagaaactctatcttatgtttactgtagatcaaagttaatggaatgtacaaacacctcttaatttcaactcaaaatggtgcatatagatatattacataagctagcttgtatgtcattaaagtatttcacatataacatcgacgaatccttgttaaatcttgtaacgctataagcgttaaatgaaacgcttgtgatctatctggaatctgtaatagttgacaca

SEQ ID NO: 5589 - DNA, 1080 bp, Nicotiana benthamiana
caagaaagaaaatcccccaacatggcctctgcctgtgcttcatcagccattgcagcagttgcattctcttctccaagttccaagaaaaatggatcaattgtaggagcaacaaaggcttctttccttggagggaaaagattgagagtaagcaaatacgtcgcaccagctggatcaagatcggttgctgtctctgctgttgctgctgatcctgatagacccctctggttcccaggcagtacccctcctccatggctcgatggcagcctccccggggactttggtttcgaccctcttggccttgcatctgacccggagagcttgaaatggaatcagcaggcagaacttgtacactgcagatgggcaatgttaggtgctgcaggcattttcatcccagaattcctaacaaagattggcattcttaacacaccttcatggtacactgctggtgaacaagaatacttcaccgatacaaccactctcttcgtcattgagttggtgcttattggctgggctgagggaagaaggtgggcagatatcatcaagcctgggtgcgtaaacacagaccctatcttccctaacaacaagctcacgggcacagatgtcggatatccaggaggcttatggtttgatcctttaggttggggatctggttctcctgaaaagatcaaggagttgaggacaaaggaaatcaagaacggcaggctggccatgttggctgtcatgggtgcatggttccaacacatctacactggaacaggaccaattgacaaccttttcgctcaccttgctgatcctggtcacgccactatttttgctgctttcagccccaagtaagaagcaggagcaccatttttttgcattgatgtgttggagttaaactctgaagatcggaagaaagaaattttagaaattgttttccaacataatgttgtatcactacatttaagttacctctgtgtgtattttccgttgaaaaagattaagcagtgtacatattttttgggatctcccaagtcctaccagcagcaagatatactatcactaggctgcacccatttaatgattcaggattttgaatgc

SEQ ID NO: 5590 - DNA, 1024 bp, Capsicum annuum
gaaatactttgccaaacatggcctctgcttgtgcttcatccaccattgctgctgttgctttttcttctccaagttccaggagaaatggatcgattgtaggagcaacaaaagcttcattccttggagggagaagattgagagtaagcaatgtacctgtagccggatcaccgcgtgctgcaactacagtgtgtgttgctgccgaccccgacagacccctctggttccctggcagcgtccctcctccatggcttgatggcagccttcccggagattttggtttcgatcctcttggcctaggatctgacccagagagcttgagatggaaccaacaggcagagattgtacactgcagatgggcaatgttgggagctgcaggaattttcattccagaattcctcacgaaactcggtatccttaacacaccttcatggtacactgctggtgaactagaatacttcacggacacaacgactctcttcatcattgagttgatacttatcggttgggccgagggaagaaggtgggccgatatcatcaagcctggttgtgtaaacactgaccctatcttccctaacaacaagctcacagggacagacgttggttatccaggaggcttatggtttgatccgttgggttggggttcgggttcacctgagaagataaaggagttgaggacaaaggagatcaagaacggtagacttgctatgttagccgttatgggcgcatggttccaacacatttacactggaacaggtcctattgacaacctctttgctcaccttgctgatcccggtcacgccactatttttgctgcattcactcccaagtgagaagaagaagcatgaggatattttgatgtaatgaatgatgtgtaaaagtaacatttgaagtagatttgtgcaaagagaactaatgtttctttcccacatttggtttgctcatgtctgtcttctgtcgaaaaagactaagcaatgtacaaatacatttcgacaactcgtatcagatcaagaaaaatactatttat

SEQ ID NO: 5591 - DNA, 1066 bp, Capsicum annuum
gcacgaggatcacataagagttgaaatactttgccaaacatggcctctgcttgtgcttcatccaccattgctgctgttgctttttcttctccaagttccaggagaaatggatcgattgtaggagcaacaaaagcttcattccttggagggagaagattgagagtaagcaatgtacctgtagccggatcaccgcgtgctgcaactacagtgtgtgttgctgccgaccccgacagacccctctggttccctggcagcgtccctcctccatggcttgatggcagccttcccggagattttggtttcgatcctcttggcctaggatctgacccagagagcttgagatggaaccaacaggcagagattgtacactgcagatgggcaatgttgggagctgcaggaattttcattccagaattcctcacgaaactcggtatccttaacacaccttcatggtacactgctggtgaactagaatacttcacggacacaacgactctcttcatcattgagttgatacttatcggttgggccgagggaagaaggtgggccgatatcatcaagcctggttgtgtaaacactgaccctatcttccctaacaacaagctcacagggacagacgttggttatccaggaggcttatggtttgatccgttgggttggggttcgggttcacctgagaagataaaggagttgaggacaaaggagatcaagaacggtagacttgctatgttagccgttatgggcgcatggttccaacacatttacactggaacaggtcctattgacaacctctttgctcaccttgctgatcccggtcacgccactatttttgctgcattcactcccaagtgagaagaagaagcatgaggatattttgatgtaatgaatgatgtgtaaaagtaacatttgaagtagatttgtgcaaagagaactaatgtttctttcccacatttggtttgctcatgtctgtcttctgtcgaaaaagactaagcaatgtacaaatacatttcgacaactcgtatcagatcaagaaaatctatttatatatgttcaaaaaacctcgtgc

SEQ ID NO: 5592 - DNA, 956 bp, Cleome spinosa
agtcaaacaatggcttccctctgtgcttcttccgccattaccgccgtctcttctccaagttcgcagaagagtggatccatcgtgggaacaacgagagccggtttcttgggagggaagaaactgagagtgaagaagaacgcagcagctgaggtggcggcgggtcggtccgcgacggttgcagccgcggtggacccagacagacccctctggttccccggcagcacccctcccccttggctcgacggcagcctccccggcgacttcggattcgatcccctcggcctcggatccgacccggagagcctaagatggaaccagcaagcggagctggtccactgccggtgggcgatgctaggagccgccggaatattcataccggagttcctaaccaagatcgggatcttgaacactccgtcatggtacaccgccggagagcaagagtacttcacggacacgaccacgctcttcatcgtcgagctcatcttcatcggatgggcggaaggacgtagatgggcagacatcatcaaacccggctgcgtcaacaccgacccgattttccctaacaacaagctgactggtacggacgtcgggtacccgggcgggctatggttcgaccccttgggttgggggtcgggtgacccggccaagatcaaggaacttcggaccaaagagatcaagaacgggaggttggctatgttggccgtgatgggggcgtggttccaacacatctacacgggaactggcccgatcgataacctctttgcccacctcgccgacccgggccacgccaccattttctcggctttcacacccaagtgagagacgacaagaaagggtctgcgtagaattgttgtttgttgatgccatgttgtacaaatacggttattattattggatttcaatatattatatggtcgaatgcaatttaggggtaatcgaatcgataatatcttcat

SEQ ID NO: 5593 - DNA, 917 bp, Flaveria ramosissima
aaacactcattcttcattatcaaatcaatggcttcaactgcttgtgcttcttctgctattgcagctgttgctttctcttccccaagttcacagaaaagtggatgtactgttggatcaacaaaggcttcttttcttggtgggaagaaactcaaagttagcaagttgggtgcaccatccggttcacgatcgttcgcaaccgtgtgcgctgcggctgatcccgatagacccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaactgggaccgatgttggctacccgggtgggctatggtttgacccactggggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagtgatgtttgtgtattattagaaactctatcttatgtttactgtagatac

SEQ ID NO: 5594 - DNA, 1229 bp, Flaveria ramosissima
cggggcgcgctacccctccgtagtggccttcggtcagtcgtcacgtaagacagtggtagtctaacgcacgagtacactggacaaacactcattcttcattatcaaatcaatggcttcaactgcttgtgcttcttctgctattgcagctgttgctttctcttccccaagttcacagaaaagtggatgtactgttggatcaacaaaggcttcttttcttggtgggaagaaactcaaagttagcaagttgggtgcaccatccggttcacgatcgttcgcaaccgtgtgcgctgcggctgatcccgatagacccatctggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatctttatccccgaattcctgacaaaaatcggaatccttaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaactgggaccgatgttggctacccgggtgggctatggtttgacccactggggtgggggagcggttcacctgcaaagctcaaggagttgaggaccaaagagatcaagaatgggaggttagccatgttggctgtgatgggtgcatggttccaagccatctacactggaaccggacccatcgacaacctgtttgcgcaccttgcggacccgggtcacgccaccatttttgctgcattcaagggctaaaacagcattataagggcttttggcaaagtgatgtttgtgtattattagaaactctatcttatgtttactgtagatcaaagttaatggaatgtacaaacacctcttaatttcaactcaaaatggtgcatatagatatattacataagctagcttgtatgtcattaaagtatttcacatataacatcgaagaatccttgttaaatcttgtaacactttaagcgtcaaatgaaacgtcttgtgatctattctggtttctgtatagttgacacgcgatagctcatccggattggtaatgttacactatctc

SEQ ID NO: 5595 - DNA, 1175 bp, Flaveria ramosissima
aatatggggaacaccaaccatctttagttcttcctcacaaacactcattcttcgttatcaaatcaatggcttcaactgcttgtgcttcttctgctattgcagctgtttctttctcttccccaagttcacagaaaagtggatctactgttggatcaacaaaggcttcttttcttggtgggaagaaactcaaagttagcaagttgggtgcaccatccggttcacgatcgttcgcaaccgtgtgcgctgcggctgatcccgatagacccatttggttcccgggcagcaccccaccagaatggcttgatggcagcctacctggagacttcgggttcgatcctcttggtctaggatctgatcccgagactttgagatggaacgtacaggcggaactagtacactgccgatgggcaatgttaggtgccgcggggatcttcatccccgaattcctgacaaaaatcggcatcctaaacactccgtcatggtacactgctggcgaacaagaatacttcacagacaaaaccacactcttcatcattgagcttattttcattggttgggcagaaggaagaagatgggctgatattatcaaacctgggtgcgttaacacggaccccatcttccccaacaacaagctaaccgggaccgatgttggctacccgggcgggctatggtttgacccactggggtgggggagcggttcacctgcaaagcttaaggagttgaggacaaaagagatcaagaatgggaggttagccatgttggctgtgatgggtgcatggttccaagccatatacactggaaccggacccatcgacaacctgttcgctcaccttgcggacccgggtcacgccaccatttttgctgcattcaagggctaaacagcattataaggccttttggcaattaaagtaatgtttgtgtattattagaaattctatcttatctctactgtagatcaaacttaatgcaatgtacaaatacctcttaaattcaactcaaaatggtgcacatacatattacataagcgtgtatgtccttaaaagtatttcacatatgacatcaacagacccatgttaaatcttgtaacagttttaagcatgaatgaaatgtttgtgatccatctggtttctataatagttgacacgcgatacctcatccggattagaatgttacac

SEQ ID NO: 5596 - DNA, 1110 bp, Flaveria ramosissima
atcaatggcttcaactgcttgtgcttcttctgctattgcagctgttgctttctcctccccaagttcacaaaaaagtggatctactgttggatcaacaaaggcttcttttcttggtggaaagaaactcaaagttagcaagttgggtgcaccatccggttcacgatcgttcgcaaccgtgtgcgccgcggctgatcccgatagacccatttggttcccgggcagcaccccaccagaatggctcgatggcagcctacctggagacttcgggttcgatcctcttggtctaggatctgatcccgagactttgagatggaacgtacaggcggaactagtacattgccgatgggcgatgttaggtgccgccgggatctttatccccgaattcctgacaaaaatcggaatcctaaacactccgtcgtggtacaccgctggtgaacaagaatacttcacagacaaaaccacactcttcatcattgagcttattttcattggttgggctgaaggaagaagatgggctgacatcatcaaacctgggtgcgttaacacggaccccatcttccccaacaacaagctaaccgggaccgatgttggctacccgggcgggctatggtttgacccactcgggtgggggagcagttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttttgccgcattcaagggctaaaacagcattataagggcttttggcaaagtgatgtttgtgtattattagaaactctatcttatgtttactgtagatcaaagttaatggaatgtacaaatacctcttaatttcaactcaaaatggtccatatacataaattacataagctagcttgtatgtcataatttcacatataacatcgacgaatccttgttaaatcttgtaacgctttaagcgttaaatgaaacacttgtgatctatctggtttctgtaatagttgacacgcgatagctcatccggattggaatgttaac

SEQ ID NO: 5597 - DNA, 1172 bp, Flaveria ramosissima
acaaacactcattcttcattatcaaatcaatggcttcaactgcttgtgcttcttctgctattgcagctgttgctttctcttccccaagttcacagaaaagtggaactactgttggatcaacaaaggcttcttttcttggtggaaagaaactcaaagttagcaagttgggtgcaccatccggttcacgatcgttcgcaaccgtgtgcgccgcggctgatcccgatagacccatctggttcccgggcagcaccccaccagaatggctcgatggcagcctacctggagacttcgggttcgatcctcttggtctaggatctgatcccgagactttgaggtggaacgtacaggcggaactagtacactgccgatgggcgatgttaggtgccgcggggatctttatccccgaattcctgacaaaaatcggaatcctaaacactccgtcgtggtacaccgctggtgaacaagaatacttcacagacaaaaccacactcttcatcattgagcttattttcattggttgggcagaaggaagaagatgggctgacatcatcaaacctgggtgcgttaacacggaccccatcttccccaacaacaagctaaccgggaccgatgttggctacccgggtgggctatggtttgacccactcgggtgggggagcggttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttttgccgcattcaagggctaaaacagcattataagggcttttggcaaagtgatgtttgtgtattattagaaactctatcttatgtttactgtagatcaaagttaatggaatgtacaaacacctcttaatttcaactcaaaatggtgcatatagataaattacataagctagcttgtatgtcataatttcacatataacatcgacgaatccttgttaaatcttgtaacgctttaagcgttaaatgaaacacttgtgatctatctggtttctgtaatgttgacacgcgatagctcatccggattggaatgttacactatcttcctcttacatacatgcagacacatacccccc

SEQ ID NO: 5598 - DNA, 1063 bp, Cucumis melo
actcacaaatttcaactcaaacaatcctccacacaaccaaaccaaccatctccgtcactccccaattttttcttttagaagaaaccattaatggcttccgcttgtgcttcttccgccattgccgccgtggcaatttcttcgtcaagttcatcgaagaatggctgccccaagctggcttctaacttccttgctggcaagaagcttaggctgagaaacttaaatgctgctgctgtcgttgctcctcgatccgctccggtatgcgccgcagccgatcccgatagacctctttggttccctggcagcacccctcctccgtggctcgatggcagccttcccggtgactttggctttgaccctcttggtcttgcgtctgatccggaaagtttgagatggaaccaacaggcggagctcgtacactgccgatgggcaatgttgggggcagcaggaattttcatcccggaattcttgacaaagatcggtatattgaacactccttcgtggtactccgccggtgaattggaatatttcaccgacaccaccactctattcatagtggaactcattttcatcggttgggccgagggtagacggtgggccgacatcctcaaacccggatgcgtcaacaccgacccgattttccctaacaacaaactgaccggaaccgacgtcgggtaccctggtgggctctggtttgacccactcggatggggcagcggatcaccggaaaagattaaggaattgagaacgaaagagattaagaacggacgattggctatgttggcggtgatgggagcttggttccaacacatttacacgggcaccggtcccattgataaccttttcgctcaccttgccgatcccggccacgccaccgtcttcgccgcattcacaccaaagtgaagaaattggggagcaaataggagagatgtagtgatgtgttgttgtgagttgagggacacaaatttatgtattgaatcacaactttgatctaatctctgtgtttatgtgtatgatggaccatatcattatcaatttaatgtacaaaatgagatcaaaaaattaa

SEQ ID NO: 5599 - DNA, 1183 bp, Nicotiana benthamiana
gcacgaggcaccctttatctatcaagataagcctcttcttcttcatacaatatcagcttcttcatacacaccatcaatcattcactgcattcaagaaaaaaaatcccccaacatggcctctgcctttgcttcatcagccattgcagccgttgcattctcttctccaagttcccagaaaaatggatcaattgtaggagcaacaaaggcttctttccttggagggaaaagattgagagtaagcaaatacgtcgcaccagctggatcaagatcggttgctgtctctgctgttgctgctgaccctgatagacccctctggttccctggcagtacccctcctccatggctcgatggcagccttcccggggactttggtttcgaccctcttggccttgcatctgatccggagagcttgaaatggaaccagcaggcagaaattgtacactgcagatgggcaatgttaggtgctgcaggcattttcatcccagaattcctgacaaagattggcattcttaacacaccttcatggtacactgctggtgaacaagaatacttcaccgatacaaccactctcttcgtcattgagttggtacttattggctgggcagagggaagaaggtgggcagatatcatcaagcctgggtgcgtaaacacagatcccatcttccctaacaacaagctcacgggcacagatgtcgggtatccaggaggcttatggtttgatcctttaggttggggatctggttctcctgaaaagatcaaggagttgaggacaaaggagatcaagaatggaaggctggccatgttggctgtcatgggtgcatggttccaacacatctacactggaacaggaccaattgacaaccttttcgctcaccttgctgatcctggtcacgccactatttttgctgctttcagccccaagtaagaagcaggagcaccatttgttggcagtgatgtgttggagttaaactctgaagatctgaagaaagaaattttagaaattgttttccaacttaatgttatatcactacacttaagttacttctgtgtgtatcttctgtagaaaaagattaagcagtgtacaaatatctttgggatctcctaagtcctaacagcagcaagatatactatcactaggctgcgcccgtttaatgattcaagattttgaatgcatttctactca

SEQ ID NO: 5600 - DNA, 1332 bp, Triphysaria pusilla
ttttttttttttaaggttagtagaaccaccagtttgagatttcagcaggtaagatcaaacaaactaaaagcaaagataaatgatattagatcctggtggccacatggcatcccaaccagccaatcaatcatccacactcctatccacaccagataagctccttcatacatcaactttcatttcctattactacttctcaaacacaagccccaaacacttgcagaaaataagaaaaataataataataataataaagaaaagaaaaactaggcatagatatggcctctgcatgtgcttcatcagccattgctgccgtttctctatcttccccaagttcccagaaaagcggatcgatcgtgggagcaactaaggcgtctttctttggaggaagaaaattgcgagtgagcaaattggcagcaccgaagagttcgagatcatcggttgctgtgtgtgttgctgctgaaccagacagaccgctgtggttcccggggagcacccctccagcatggcttgatggcagccttcccggagacttcggcttcgatcctctcggcctagcatctgacccggacagcttgaaatggaaccagcaagctgagattgtccactgcagatgggccatgttaggcgctgctggcattttcattcctgagtttctgaccaagattggcattctcaacaccccttcatggtacactgccggtgaacaagaatattttaccgacacaaccacactcttcgtagtcgagttggttctcattggctgggccgagggaaggagatgggctgacataatcaagcccggatgcgtcaacaccgatcccattttccccaacaacaagcttaccggtactgatgtgggttacccaggcgggctatggttcgacccgctcggatggggatccggatccccggcaaaactcaaggagctgagaacgaaggagatcaagaatggacggctggcaatgctggcagtgatgggtgcatggttccaacacatctacactgggacgggccccattgataacctctttgcccaccttgcagatcccggtcatgccaccattttcgctgctttcagccccaagtgagagaaacatgagcaaacatcatcatgtggtaatgaagtagacattcttcggtgtgtatttccaattaatgttgaaatgtattgtcaattctatataagctgtagataagagcttatgcagtgtacaaatacctacgatacccaactacgcaatttacgcttcatgtcgataaatccacccatttgcgtgatgaaattaactgaaaatttctagaaaatgcttgtttaaaccaattaaaatg

SEQ ID NO: 5601 - DNA, 1445 bp, Lippia dulcis
tcccaaataaatataatccatattcaatcatctgagcacattacgaaaaaaagcaacaacaattaatccgtcgatatggcgtccgcctgtgcttcgtcggccattgcagctgttgcattctcctcccctagttgtcagaaaagtggttcgattatgggagctccaaaggcttctttctttgggggaaggaaactgagagtaagcaaattgaaacccgcaacgtcgccgacgagatcggtggcggtttccgccgcggcagctgaccccgacaggccgttatggttccctggcagcatccctccgccgtggcttgacggcagccttcccggagactttggattcgatcctcttggcctaggatcggacccggacagcttgagatggaacgtgcaggcggagctcgtccactgccggtgggccatgctgggggccgccggcattttcatcccggaattcctcacgaagctgggcattctcaacactccgtcgtggtacaccgccggcgagcaggaatacttcaccgacacaaccacgcttttcatcgtggagttgttcttcatcggttgggccgagggaagaagatgggcggacataatcaaacccggatgtgtgaatacggatcctattttccccaacaacaagcttaccgggactgacgtgggatatccgggtgggctgtggttcgacccgcttgggtggggatccgggtcgcccgagaagattaaggagctaagaacaaaggagatcaagaatgggaggttggccatgttggcagtgatgggtgcgtggttccaacacatttacactggaactgggcccattgataacctctttgcccaccttgctgacccgggacatgccaccatctttgccgctttcagccccaaatgagagaagcaatacgaggcgcacctaccattattacggtgagaaggatgcatgtgggcgagaaagagagacaagagtgtgtggttttcaaattaatgtatcattgtttgggtttgtgttgcaacgattaatgatctttgtatgctagctttggacatgacaagtgcttatgctgtgtacaaagtaccttggaagttaactccgtaaatacaataggcttttgaatgtttcgtttgcccacttaccgtattggagaaatatgaagatacgcaagcaagactttgacaaataaagtctatatagtatagaaccatcgaagttggggattttacaatattggggttaagtgtaatttatggaaattggcaaaagcccttcgttaatgaattagaagagcaaacaaggaataaacagatagataatttttttgtaagacagaaaaacaaataatgaaccctcagcaagctccattccttcaggggagtcccacatcttcagatccacatccatcaggctgtgaccaagtttagcgagggaatcagcactacgtattcttc

SEQ ID NO: 5602 - DNA, 1314 bp, Gossypium raimondii
ggacaatgaaaccagcctaaggtacattggcatggatttttgttagatttaagagccacacaaacatgcaatgtgagccaccaagtttgagatttttgctcccaataagcacaacaagtggaggcaaaggggctttgatatcagattctggttgccacatggcaaagcactggccaattgggcatccactctcctatccattatgataaaccccctggaatacattaacagattttaatatccttgtctgccacaaaaaccccctcaattcccccacctcattgtaggcaaaatggccactgtttgtgcttcttctgccgttgcagccgttgccatctcatcccccagttcccagaggagtggatcagtagtgaggacaacaaaggcttctttccttacagggaagaaacttcgatcagtcaaaaagtacacaaaaccagcagcagtccgaaccgttccggtgtgtgcagtggctgaccccgaccgacctctttggttcccaggcagtactcctcctccatggctcgatggcagcctccctggagacttcggttttgatcctctaggccttggatcagaccctgagaccttgagatggaacgtacaggcagagctcgtccattgcagatgggcaatgttaggagccgctgggattttcatcccagagttcctaaccaaaattggcattttaaacactccatcatggtactctgctggaaccgaggaatacttcactgacaccaccaccctcttcatcgttgagcttattttcatcgggtgggcagaagggagaagatgggctgacattctcaagcctgggtgcgtaaacaccgaccccatcttccctaacaacaagctcacgggcaccgatgttgggtaccctggtgggctgtggttcgaccctcttggttggggaactggctcccctgagaagatcaaggaattgaggactaaagagatcaagaatggtcgattggctatgttggcggtaatgggtgcttggttccaacacatctatactggcactggacccattgacaaccttttcgaccacctcgccgatcctggtcacgccaccatttttgctgctttcactcccaagtgagacagaattaagagacaacctttaagagcgattaaaatgttgggatgacaatgatgatcataccattccatacgttggaagaagagcggaagacttgtaatgttgtgggggaatgtttgtattagtagaaactgtaatgcctctgtttgtattgtagatgttatagtgatgtacaaatatttgtgtggaattagatgcaatgaatttta

SEQ ID NO: 5603 - DNA, 1109 bp, Helianthus annuus
cattcttcattaccaaatcttgaagacacaaacatttacatacaaacaatggcttcaactgcttgtgcttcttctgccattgcagctgttgctttttcttccccaagttcacagaaaagtggatctattgttggatcaacaaaggcttcttttcttggtgggaagaaactgagagttagcaagttgggtgcaccatccggttcacgatcatttggaaccgtttgcgctgcggctgaccccgatagacccatttggttccctggaagcaccccaccagaatggctagatggcagcctaccgggagacttcgggtttgatcctcttggtctaggatctgatcccgagactttgagatggaacgtacaagcagaactagtgcactgcagatgggcaatgttaggtgcagccgggatcttcatccccgaattcctgaccaaaatcggaatcctaaacactccttcatggtacactgctggtgaacaagaatacttcaccgacaaaaccacactattcatcattgagcttattttcattggctgggctgaaggaagaagatgggctgacatcatcaaacccgggtgtgttaacaccgaccccatcttccccaacaacaagctaaccggaacagatgttgggtacccaggtggactatggtttgacccactcggctggggaaccggttcacctgcaaagctcaaggaattgaggacaaaagagatcaagaatggaagattggccatgttggctgtcatgggtgcatggttccaagccatttacactggaaccggacccattgacaacctgtttgctcaccttgctgacccgggtcacgctaccatttttgctgcattcaagggctaaactgcatgaaaaactgttggcaggaggattgattataagggttttgggccaagtaatgatcatgtttgtgtattattagaaatcctatcttatctctactgtagaaaagctaatgcaatgtacaaatacctcttcattaatttcaactcaaaatgctgcatatatataagcttgaaagtcattaaagtactttacatataacaaaaatggatccacaacaccattgtgttgcatccttgcatcaaaaa

SEQ ID NO: 5604 - DNA, 1110 bp, Helianthus annuus
ctcctatccttttagataagcccatatgccatacattaccaccaaccacttcttcctcacaaaccctctcattcttcattaccaaatcttgaagacacaaagatttacatacaaacaatggcttcaactgcttgtgcttcttctgccattgcagctgttgctttttcttccccaagttcacagaaaagtggatctattgttggatcaacaaaggcttcttttcttggtgggaagaaactgagagttagcaagttgggtgcaccatccggttcacgatcatttggaaccgtttgcgctgcggctgaccccgatagacccatttggttccctggaagcaccccaccagaatggctagatggcagcctaccgggagacttcgggtttgatcctcttggtctaggatctgatcccgagactttgagatggaacgtacaagcagaactagtgcactgcagatgggcaatgttaggtgcagccgggatcttcatccccgaattcctgaccaaaatcggaatcctaaacactccttcatggtacactgctggtgaacaagaatacttcaccgacaaaaccacactattcatcattgagcttattttcattggctgggctgaaggaagaagatgggctgacatcatcaaacccgggtgtgttaacaccgaccccatcttccccaacaacaagctaaccggaacagatgttgggtacccaggtggactatggtttgacccactcggctggggaactggttcacctgcaaagctcaaggaattgaggacaaaagagatcaagaatggaagattggccatgttggctgtcatgggtgcatggttccaagccatctacactggaaccggacccattgacaacctgtttgctcaccttgctgacccgggtcacgctaccatttttgctgcattcaagggctaagctgcatgaaaaactgttggcaggaggattgattataagggtttttggccaagtgatgatcatgtttgtgtattattagaaatcctatcttatctctactgtagaaaagttaatgcaatgtacaaatacctcttcattaatttcaactcaaaatgctgcatatatataagcttgtatgtc

SEQ ID NO: 5605 - DNA, 1146 bp, Gossypium hirsutum
aaaaccccctcaattcccccacctcattgtaggcaaaatggccactgtttgtgcttcttctgccgttgcagccgttgccatctcatcccccagttcccagaggagtggatcagtagtgaggacaacaaaggcttctttccttacagggaagaaacttcgatcagtcaaaaagtacacaaaaccagcagcagtccgaaccgttccggtgtgtgcagtggctgaccccgaccgacctctttggttcccaggcagtactcctcctccatggctcgatggcagcctccctggagacttcggttttgatcctctaggccttggatcagaccctgagaccttgagatggaacgtacaggcagagctcgtccattgcagatgggcaatgttaggagccgctgggattttcatcccagagttcctaaccaaaattggcattttaaacactccatcatggtactctgctggaaccgaggaatacttcactgacaccaccaccctcttcatcgttgagcttattttcatcgggtgggcagaagggagaagatgggctgacattctcaagcctgggtgcgtaaacactgaccccatcttccctaacaacaagctcacgggcaccgatgttgggtaccctggtgggctgtggttcgaccctctaggttggggaactggttcccctgagaagatcaaggagttgaggactaaagagatcaagaatggtcgattggctatgttggcggtaatgggtgcttggttccaacacatctatactggcactggacccattgacaaccttttcgaccacctcgccgatcctggtcacgccaccatttttgctgctttcactcccaagtgagacacaattaagagacaacctttaagagcgattaaaatgttgggatgacaacgatgatcataccattccttacgtcggaagaagagcggaagacttgtaatgttgtgggggaatgtttgtattagtagaaactgtaatgcctctttttgtattgtagatgttatagtgatgaacaaatatttgtgtggaattagatgcaatgaattttatttattcaggtttataaacatttatgaactccaaagcccaacaaatgctggtaaataaatcagcttttctttccttcattcaaaaaa

SEQ ID NO: 5606 - DNA, 1147 bp, Cucurbita pepo
catcttcatcactcaaatttcccatttagtgatcccgactcgaaatggcctcggcttgtgcttcttctgccattgcaacggtcgcaatttcttcatcgagttctcaaaagaacgggtgtccaaaggcttctaatttcgtaacagggaagaaattgagactaagaaagtacaccaccgctgctgttgctcctcgatctgctccggtctgtgccgccgctgaccccaacagacccctttggttccctggtagcacccctcctccatggctcgacggtagcctccccggtgactttggcttcgaccctcttggtctttcttctgatccggagagcctgagatggaaccagcaggcggagctggtgcactgccggtgggcaatgttaggcgctgccggaattttcatcccggaattcttgacaaagatcggaattttgaacactccatcatggtacaccgccggagaattggaatacttcaccgacaccaccaccctcttcgtcgtcgaactcattttcatcggttgggccgagggtagacggtgggccgacattctcaaacccggctgcgtcaacaccgacccgatcttccccaacaacaagctcaccggaacggacgttgggtacccaggagggctgtggttcgacccgctcggatggggtagcgggtctcccgaaaagatcaaggaattgagaactaaagagatcaagaacggacgtttggctatgttggcagtgatgggtgcatggtttcaacacatttacactggcaccggtcccatcgacaatcttttcgcgcaccttgccgatcccggccacgccaccatcttcgccgcttttactcccaagtgaagaaattgaagagcataggaggaggcgtgtgtatcaaatcataacttgaaaactatgtgtttatgtcttgtgtatggacattgatatcaatttcatgtacaaatgagaacgagaattaaggaagttttagacgcgttttgagttctgaatctctgtgtatgctctatggttgcaattttgtatgaacagttatatcagactgaatttagctatgatcattcttgcgaatgtatacgaaatttcgactttgagaggagcttgaggtgatgtaccacacaacaagcagctcgatttagacg

SEQ ID NO: 5607 - DNA, 950 bp, Flaveria ramosissima
gggggggatcggtaagctacgacgcggagtacatacggggacaacactcatttcttctattatcaaatcaatggcttcaactgcttgtgcttcttctgctattgcagctgttgctttctcttccccaagttcacagaaaagtggaactactgttggatcaacaaaggcttcttttcttggtgggaagaagctcaaagttagcaagttgggtgcaccatccggttcacgatcgttcgcaaccgtgtccgccgcggctgatcccgatagacccatttggttcccgggcagcaccccaccagaatggctcgatggcagcctacctggagacttcgggttcgatcctcttggtctaggatctgatcccgagactttgagatggaacgtacaggcggaactagtacactgccgatgggcgatgttaggtgccgccgggatcttcatccccgaattcctgacaaaaatcggaatcctaaacactccgtcgtggtacactgctggtgaacaagaatacttcacagacaaaaccacactcttcatcattgagcttattttcattggttgggcagaaggaagaagatgggctgacatcatcaaacctgggtgcgttaacacggaccccatcttccccaacaacaagctaaccgggaccgatgttggctacccgggcgggctatggtttgacccactcgggtgggggagcggttcacctgcaaagctcaaggagttgaggacaaaagagatcaagaatgggaggttagccatgttggctgtgatgggtgcatggttccaagccatctacaccggaaccggacccatcgacaacctgtttgcacaccttgcggacccgggtcacgccaccatttttgccgcattcaagggctaaaacagcattataagggcttttggcaaagtgatgtttgtgtattattagaaactctatcttatgttta

SEQ ID NO: 5608 - DNA, 1204 bp, Lactuca sativa
cacccctttcttccacacaaacctactcattcttcatcactaattcttgaaggcaaagaattgcagagacaacaatggcttccactgtctgtgcttcttcagccatcgcagctgttgctttctcttctccagcttcacagaagaatggatcttttgttggatcaacaaaggcttcctttctttgtgggaagaaactaagagttagcaaggtcactgcaccaaccgtggcacgatcttccgggacagtatgcgttaccgccgaccccgaaagacccatttggttccccggcagcacccctccggaatggctcgacggcagcctaccaggagacttcgggttcgatcctcttggtctaggatccgacccggagaccttgaggtggaacgtgcaagcggaaatagtacactgcagatgggctatgttaggagcagctgggatcttcatcccggaattcctaacaaaaatcggaatcctaaacactccttcatggtacacagccggtgaacaagagtacttcacagacaaaaccacactgttcatagtggagcttattttcatcggttgggcagaaggaagacgatgggctgacattctcaaacctgggtgtgttaacaccgatcccatcttccccaacaacaagctaacaggtacagatgttgggtacccaggtggactatggttcgacccactcggatgggggagtggttcacctgcaaagcttaaggaattgaggacaaaggagatcaagaatgggagattggctatgttggctgtcatgggtgcttggttccaagcaatctacactggaactggacccattgataacctctttgctcaccttgctgacccgggtcacgccactatttttgctgcattcaagggttaaatagcaaggggttgttgagatcatgatcttcagatgatgctggagagggaaaatggtggatttaacagtttttggcaagtcatgtgtgtgtatcattagaaattgtatcttgtctctactgtagaaacttaatgcaatgtacaaatacctctttgaacttaaaatgattcagatatataagcttgtatgttggtaaagtactgcataactcttgccacctgatacccgaaccaaggtatttattatcattacacaagggaaactttggtttatgctctaataacaatagaaaaaaaaaatcatcttttccaaattgc
